United States Patent 7,314,974 (EXPRESSION OF MICROBIAL PROTEINS IN PLANTS FOR PRODUCTION OF PLANTS WITH IMPROVED PROPERTIES) - sequence listing, part 16

SEQ ID NO: 45174 - DNA, 1002 bp, Methanococcus jannaschii
atgcataaaatatgtgttatagaaggagatggaattggtaaagaggttgttccagcaacaattcaagttttagaagctactggtttgccatttgagtttgtctatgctgaggcaggggatgaggtttataaaagaactggtaaggcattaccagaagaaacaattgaaactgccttagactgtgatgctgttttatttggagcggctggagaaacagcggcagatgttattgttaaattgaggcatatattggatacttatgcaaacattagaccagttaaagcatacaaaggagttaagtgcctaaggccagatattgattacgttatagttagggaaaacactgaagggctttataaaggaatagaggcagagattgatgaaggaattacaatagctacaagagttataacagaaaaagcatgtgagagaatatttagatttgcttttaacttagcaagggaaagaaagaagatgggcaaagaaggaaaggttacatgtgctcacaaagcaaatgtcttaaaattaactgatgggttatttaaaaagatattttataaagttgcagaggaatatgacgatataaaagcagaagattattacatagatgcaatgaatatgtatatcataacaaaaccgcaagtatttgatgttgtagttacttccaacttatttggagatattttatcagatggagctgctggaactgttgggggattaggtttagctccttcagcgaatataggagatgaacatggattatttgagccggttcatggttcagctccagatattgctggaaaaaagatagctaatccaacagctacaatattaagtgctgttttaatgcttagatacttaggagagtatgaagctgcagataaagttgaaaaagcattggaggaagttttagctttaggtttaacaacacctgacttaggaggtaatttaaatacatttgaaatggctgaagaagtagctaaaagagtaagagaagaataa

SEQ ID NO: 45175 - DNA, 1197 bp, Methanococcus jannaschii
atgagccaagagaattggatagatttagagaaaaaataccatctccaaatctacggaagattaccagttgttttagttgaaggtaaaggaatggaagtttatgatattgatggaaagaaatatcttgatttcttagctggaattggagttaataatgtagggcattgtcatccaaaggttgttgaagcaataaaaaaacaggctgaaactttaatccatacctccaacatatattacacaatccctcaaataaaattagctaaaaagttagttgagctaagtggtttggatagagcatttttctgcaacagtggagctgaagctaacgaaggagctataaagtttgcaaggaagtatgtatcaaaagtattaggaagagaaggaggagaaataatcagcatgtataacgcatttcatggtagaactttaacaacactggcagcaacaccaaaaccaaagtatcaggatgggttttatcctctacctcctggatttaagtatgttccattcaacgatatagaggcgttaaaggaggctataacagacaaaaccgctgctataatgattgagcctgttcagggagaaggaggaattcatgtagctgataaagattatttaaaggccgttagggatttatgtgatgataaaaatatcgtcttaatctttgatgaagtgcagtgtggaatggggagaactggaaggatgtttgcctttgagcattatggtgttgagccagatattttaacattggcaaaagcccttggagggggggtcccaataggagctgttgttttaaaggaagagattgcaaaggcattgagttatggagaccatggaacaacgtttggaggaaatccattggcttgctctgccgctttggcgtcagttgaagttatagaggaattgattaaagatgataaagttatagagaaaggtaaatatttcattcgaaaactcgaaaaccttatagagaaatacaacttcataaaagaggttaggggattaggattaatgattggagcagagcttgaatttaatggagctgatattgttaagaaaatgcttgagaaaggatttttaatcaactgtacttctgacacagttttaagatttttacctccattaattgtagagaaagagcatatagatgctttaattaatgcattggatgaagtatttactgagataaaaaaataa

SEQ ID NO: 45176 - DNA, 669 bp, Methanococcus jannaschii
atgtgtgaaggaaaaatgccagttattggtgagaaattcccagaagtagaggttaaaacaacccatggagctattaaattaccagattattatgtagagaaaggaaagtggtttgttttattcagccatcctgctgactttactccggtttgcacaacagagttcgtaggatttcaaaagagatacgatgaatttaggaaactaaatactgagttgattggattaagtatagatcaagtttttagccacttaaaatgggtcgagtggataaaagaaaaattgaatgtagaaattgagtttccaattatagcggatgatagaggagagttagcagagaaattgggaatgataagcccatacaaaggaaacaatacagttagggctgtgtttgttgtagataataaagggataattagggctatcatctactatccgcaagaagttggtagaaacttggatgagatcgttagattagttaaagctctccaagtttcagatgaaaaaggagtggctatgccagcgaattggcctgaaaatgatttaattggagataaagttattatacctcctgcatcatcagtggaggagataaagcaaagaaaagaggcatgtgagaaaggggagattgagtgcttagattggtggttctgttataaaaagttagattaa

SEQ ID NO: 45177 - DNA, 2022 bp, Methanococcus jannaschii
atggtgtggcttatggaggctctcaaaaccaaagaaaatgaaacaacaaaagaaaaaaaactcacaacaaaagttgaaaaatctgaaaaaaaagaagaaaatgttagagaggaagagattgtttgtccaatttgtggtagtaaagaagttgttaaagattatgaaagggctgaaatagtctgtgctaaatgtggatgtgttatcaaagaaaaattatttgatattggaccagaatggagggcatttgaccatgagcaaaagattaaaagatgtagagttggagctcctatgacttatagtgttgattacaacgaaccaataatcattaaagagaatggagaaataaaagttgttaaaattggagaacttatagataaaattattgaaaactcagagaatattagaagagagggcatcttagagatagcaaaatgtaaaggtattgaagttattgcctttaacagcaattacaaatttaaattcatgcctgtttcggaggtttcaaggcatccagttagtgagatgtttgaaatagttgttgaagggaataaaaaggttagagttaccagaagccatagtgtctttaccataagagataatgaggtagttccaataagagttgatgagctaaaagttggagatatattagttttagcaaaagaattgccgaatattgaagaagatattgaaatagataaaaaatttagtaaaatattgggttacataattgcggaaggttattatgatgacaaaaaaattgtattatcttatgattacaatgaaaaagagtttataaatgaaacaattgattatttcaaatctttgaattcggatataaccatctatagtaaagatttaaatattcaaattgaagtaaagaataaaaaaattatcaatttactaaaaaaattgagagttaagaataaaagaattccctctataatctttaaatctccttatgaaataaaaaaatcattcatagatgggatatttaatggtaaagatgcaaaagtatttgtctcaaaggagttggctgaagatgttatattcttacttttacaaataaaagaaaacgccaccattaataaaaagagtataaatgatattgaagtttatgaggtaaggagaataacaaatatatataccaatagaaaactcgaaaaacttataaactctgatttcatattcttaaaaattaaagagattaataaggtagagccaaccagtggatatgcctatgatttaactgttccaaatgcagaaaacttcgttgctggatttggaggatttgtattacacaacaccatccacgataaaggtttatcaacagttattgattggagaaacaaagatagttatggaaaggatttatctgcaaataagagagcccaactctacagattaagaaaatggcagaggagaattagagtcagtgatgctgcagagagaaacttagcatttgccctgtcagaattagatagaattacatcaaagctcggactaccaagacatgtaagagagaatgccgctataatttatagaggggctgttgagaaaggattaataagaggaagaagtattgaaggagttgttgcagccgctatatacgctgcttgcagaagatgtagagttccaagaactttagatgaaattgccgaagcatcaagggtggataggaaagaaattggaagaacttacagatttttagcgagagaattaaatataaaattaaccccaacaaatccaattgattatgtgccaagatttgcatctgaacttggattgcctggggaagttgagtccaaagctatacagatattgcaacaagcggctgaaaaaggattaacaagcggtagaggccctactggtgttgctgctgcagcaatatatatagcaagcgttcttcttggctgtagaagaactcagagggaagttgctgaagttgctggagtgacagaagtaacaataagaaatagatacaaggaactaaccgagcatttggatattgatgtaactctgtag

SEQ ID NO: 45178 - DNA, 1455 bp, Methanococcus jannaschii
atgaacatcttaaggagaggaagattaggaaattcaataaaagaagatgtagcaaaatacacaacaagcttaagctttgataaggagatttttgaagcggatatcttatgcgacatagctcacgtaataatgctctatgaacaaggtataataaaaaaggaagacgcaaaaaagattattgaagggttaaaagagatttataaaaaaggaatggaaaatctcaacttagacccttccttggatgatatacacatggtcattgaaagtgagctaattaaaaaacttggtgaagatgtagcaggaagaatgcacactggaagaagtagaaatgatgaagtagcaacagatttaagaattgcattaagagagaaggtcttaataatagctaaatctttaattaagatgttaaaagatattttagaattagctgagaaacataaagagacattaatcgttggatatacacatttacagcatgctcagccagtaacttttgctcatcatttgcttagctacgtttcagcaattgaaagagatattttaagattgttagatgcttacaaaagaataaatatttctccattaggttgtggagcaatggcaacaactggatttaagataaacagggagagaactaaagaattattgggctttgatgctttgatagagaattcaatggatggtgtttcagcaagggactttatattagagacaatggctgacttagcaatattaggaacaaacttatcaaaaatctgtgaagaattgattttattctcaacctatgaatttggaactattgagattgctaatgagttctgctcaacatcttcaataatgcctcaaaagaaaaaccctgatgtggcggagatagcgagagctaagctatccaaattaaatggaaatttggttactgcattaacaatattaaaagctctaccaaatacttataatagagatttacaggaaataagcccacatttatgggatagcgtttatacaacaatagacacaataaaaatggttcatggaatgctaaaaacaataaaaattaataaagagagaatggaagaattagctaaagcaaactactcaactgcaacagaattggcagatactttggttagagagacaggaattccatttagaacagcacatggcattgttggagaagttgttagaagaagtatagaagaaaaaaaggatatgattgaagttatctatgaagttttagaaaaatacaatttgaaagttgatgaggagaagataaaaaaggcattagacccttatgagaatgttaagatgagagatgttatagggggccctgctccagaagaagttgaaaaaaggataaaggtatttagggagagattagacagatatgaaaaagaggttgatgagaaattgcagaagataaataaagttaaggagatacttttatcctatgaaatttaa

SEQ ID NO: 45179 - DNA, 984 bp, Methanococcus jannaschii
ttgaaagaattatttaaaagaggtggaattatgctctttgataaaaatattttacaaaaaattgatgaagaattaaagacttatgtagataaagatgataaactatataacgcgtcaaaacatcttctatttgctggaggaaagagaattaggccatatttaactgtagtaacttatatgttgaagaaagacgatattgaggaggttttgccagccgctgctgcagtagagttaattcacaactacaccttaatacatgatgacattatggacaatgatgatgagaggagaggaaaaccaacagttcatgttgtctatggagagccaatggctatcttagctggagatttattatatgctaaagcttttgaagcagtttcaagaataaaagataataaaaaagctcatgaagttttaaaaatcctatcaaaagcatgtgttgaggtttgtgaagggcaggcaatggacatggaatttgaaaactactatcctacaatggaagaatacttagatatgattagaaaaaagacaggagctttattagaggcttctgtgggaattggggctgttatggctgattgtaatgaagaagaaagggaagcattaaaagagtatgcaaaaagaattggattaacttttcaaatacaggatgatgttttagatttaattggggaccagaaaaagttaggtaagccagttggaagtgatataagagaaggtaaaaagacaataattgttatccacgccctaaaaacattggatgaagataaaaagaaaagattattggaaattttaggaaataaaaatgttaaggatgaagaaattaaagaagcaattgagatattaaagccttcaattgaatatgcaaaagaacttatgaaacaaaaaactgaagaagcaaaagaatatttaaagatattcaataaagacagaaggaaagttttagaggatttggctgattttataatgagtagaatttattaa

SEQ ID NO: 45180 - DNA, 1059 bp, Methanococcus jannaschii
atgataaccttcatatatttctttggcaatatcatctattacctcccaatttattcatatattaacaattacaaatttatgcttatggtgataataatggatgatttaactcaactacctggtgtaggtcctacaacagctgagaagttaaaagaagctggttacactgattttatgaaaattgcaactgcatccatcggtgagctaacagaaatagatggaattagtgagaaagctgcagccaggattatagaagctgcaagagaactctgcaatttagggtttaaaagtggaactgaggttttatcccaaagaaaaaatatatggaagctctcaactggaagtaagaacttagatgagattttaggaggaggcttggagagtcagtcagttactgaatttgctggaatgtttggttctggtaaaacccagatagctcatcaggcatgtgttaatttgcagtgcccagagagaatagtagcagatgacgcaataaaggatgagattttaaatgaaccaaaggcagtttatattgacacagaaggaacattcagaccagaaagaattgtccaaatggcagaagctttgggtttagatggaaatgaagttttaaataacatctttgtagcaagagcctacaactcagatatgcaaatgttgtatgctgaaaatgttgagaatttaataagagaagggcataatataaagttggttatagttgattcattaacatcaacattcagaactgagtatataggaagaggtaaattagcagagagacaacaaaaattaggaaggcacatggctactctcaacaaattagctgatatatacaactgtgttgttatagtaactaaccaagtagctgcaagaccagatgctttatttggaccttcagagcaggcaattggagggcatattgttgggcatgcagcaacatttagaatattcctaagaaaggcaaaaggagataagagggttgctaagctttatgattctccacacttaccagatgctgaagcaatgtttaggataaccgaaaagggaattcatgattaa

SEQ ID NO: 45181 - DNA, 918 bp, Methanococcus jannaschii
atgcatctcttagatttggatgtgttgagtagagaagatgtactaaaaattattgaatatggaatatacttcaaaaaaaatagaagaaaacatgaaaaaatcttagaagggaagagtgtagcgattttatttgaaaaaccctcaacaagaacaagaatgagttttgatattgcagtttatgagttgggagggcatccactaataatgaaccagaatgagatacatttaggaaagaaagagtcaataaaagatactgcaaaggttatgggcagatatgttgatactatagtggcaagggtctataagcatagacatttagaggagatggctaaatattcctcagttcctgttataaatgctttaagcgatttagctcacccatgccaaatattggctgatttgatgactataaaagagtataaaggcaaattcaaaggtttaaaaatagcttatttaggagatggaaataacgtctgtaattctttaattttaggctctgctttagtaggaatggatacttatgtgggaacaccaaaaggttatgaacctaatgctaaagttgtcttaaaagctaaggagattattaataattatggagaaggttctttaacattaaccaacgacccaatagaggcagctgaagatgctgatgtattatacaccgacgtatggattagtatgggtgatgataaagacaaagaagaggttttaaaaatctttccaccattccaaattaatagcaagctcttagagtatgctaaagatgatgttatagttatgcactgcctcccagcaaatagaggatatgagataacagacgatgttattgacggagagcattcagttgtctatgatgaggctgagaataggttacatgttcagaagggagtatttaagtttatatttgagagaaagtaa

SEQ ID NO: 45182 - DNA, 3699 bp, Methanococcus jannaschii
ttggtgatacttatgataaagattggctttgtttcaacaatagatagtgatgatttagtttttgaagaagcatataaagagattaaaaaatatggcattgaatttaaaatattggattataaatgtagcagaaaggagtttgaagaatttttagagtttattaaagaagctaatattgtttttacaaaactcatgggagggaaaaatgccttcaagtattacgatgaattggctgagttttgtaaaaggcataacatcccatttctccctctaccaacaatctcagaaattcatccagatttagagaaggataggacagtagatgatgacgtaaagaataaagttgtcaaatatttgggatatgaaggggtttataattacaaaaatcttcttttatatttggcaaataggtttggaaatttaaatgttgagtatgaagaaccaagaccaatgccatggcaaggaatttactataaaggaaaatactttgaaacattagatgattatctaaactatctaaaagaattgggcagagatttagataaaccaattataggagttttattttatagaaattggtttgtagctaataacattgattatgttaatgatttgattgatattattgagaataaaggagctattccaatagctgtttttagctctcatttaaagaacgaactcggctctataggaactttagaaacattcaaaagatttttctacaaagatgggaagccaatagttcatgccttaattaacactaccatgttcactctttcaatgggtgttaaggcagagttgttaaaagatgagccggagtttttgaaagagcttaatgttccaatactgcaggggattatatcaactggatttattgaggattggaaaaagtcagtatctggattaaatccaattgatttaattataggaatggcaatgccagagtttgatggggcaataatacatttcccaattggtgggaaggagaagataaaagatggagaagttggagttccaattattaagtatagagctataagagatagagctgagaagatagttgatttagccctaagatatgcaaatttaaaattaaagtcaaataaagataaaaaaatagccataattttccacaattatccaccaaggaatgacaagatagcaagtgcctttggtttagatagcccagagagtgttgttaatattttgaaggagatgaagaaaagaggatttatagttgatgagattccaaagaatggaactgagttaataaaaaagatgttaaactatgccacaaatgataagagatttctaactgaagagatgataaaaaaagcagttggaaaagtaaaaaaagaagattacgagaagtggtttaactctctgtctgaaaaggttaagcaagagctaataaaaaattggggagccattcctggagatgttatgaacttcgatggagagctaataatcccaggaataattaatggaaatgtctttatctcagttcagccaccaagaggatttggagagaatccctctgccatataccactctccagatttgccaccaactcattactatatagcattttataaatggattaaggatgttttcaaagcagatgcaattatgcatataggaaagcatggaaacttagaatggcttcctgggaagtgtgttggcttatctaatgaatgctatccagacatctgcatggaattgccaaatatttatccatttattgtaaataatcctggagaaggaactcaagcaaagaggaggagttatgcaacaattataagccatttaatcccaccaatgacaatatctgatttgtatggtgatttagtagagttagaaaagagtattgatgactattatgaaacagagaataaagagaaaaaagaatttttaaagaaagagattttaaagaagattaaagagctaaaattagatgaagatttgttggatggaaaagttatagatgaagagataaatgatgagaattttgaaaaactcctaaataaaatccacgattacttagaaactttaaagaataggcagataaatgatggattgcatataatgggagtcccattggaaggagataagttagttaatatgttattcatgattattaggtatcaattcaactatttggagattttggcagagattttagattacagttgggaagagttaaatgaaaataaaggaaagtatcacaaaatcttagatgaaataaatgaaataggattaaatctactaaaagagtatatgcaatacaacttcgatgaaaataagattgatgagctaaaaacagttaaaataaactctaaattaagggatgtcttaaaaaccgtctcgacaatctataaaaatctaatgaaagttgatgaagagattataaatgcagtaaatgccttagagggtttttacatccctccaagagttgcaggagctcctacgaaagatataaactgccttccaactggaaggaacttttattcatgtaatccgcaagagattccaacaaaatctgcatatgagatgggtaaaaaattggctgaggacttaattaacaagtatctaaaagaagaagggaaatatcctgaatatataggcgttatcgtctggggatctccaactatgagaacaaaaggagatgatattggagagattttatatttattgggagttaagccagtttggaataagatgggaagagttgttggtttagaagttatcccattggaagagttagggagaccaaggatcgatgtaactttgagaatctctgggttgtttagagacacttttccaaacgttgttgagcttatagatgaagcaataaaaatggttgctaatttagatgagccagacgagatgaactatgtaaagaagcattatagggaggaggttgaagagaagataaagaagggtattgatgaaaaaacagccaaagaaacctcattatataggatattcagtgataaaccgggttgttatggagctggtgtctctcatttaatagatgagaaaaactgggaatcaatagaggactttgcaaaggtttatgttgaatggggaggctatgcttatggaaagggctattatggagtagaggcaaaagaagagtttataaatcgtctatcaaagattgaattaacagttaaaaatgaagatagccaagaatgggatatatttgagggggatgacttcaacagctatcatggtggtttaattgcctctgtaacctattactctggcaaaaagccagtgagttatgttggagatacatcaaatccaaatgatataagaacaaaacatctaaaagaagaaggaaaagaaatattcagaacaaaaatcatgaatccaaagtggattgagggaatgaagaggcatggatataaaggagccgctgacttttcaaagtatgttgatcatatgtttgcatgggatgcaacctctggcataatagacgattggatgtatgagaagattgctgagaagtatgtgtttgataaagatatggaagagttttttaaagaaaataatccttatgctctgctaaatataactgaaaggttgttggaggcaatagagagaggaatgtggaaggcagatgaggagatgaaagagaagttaaggaagaagtatttagaaatagagggaatgattgaggaaaaactataa

SEQ ID NO: 45183 - DNA, 1098 bp, Methanococcus jannaschii
gtgatgattatgcagtatatttacccatttacagcaatagttggacaggaaaagatgaaaaaagcattgatcttaaatgcaataaatccaaagattggtggtgtcttaattagaggagagaaagggacagcgaaatctacagcagttagggctttggctgatttactcccagagattgaaattgttgaaggatgtccattcaactgcgacccaaatggaaacctatgtgatatttgcaaagaaaagaaaaagagaggagagttaaaaactacaaaaaagaagatgaaagtagttaatctcccaattggagctactgaagatagggttatcggaacattggatatagagaaggcaataaaagaaggaattaaagcattagagccaggaattttagcagaggcaaatagaaatatcctatacattgatgaagttaatttactggatgaccatataattgatgttttgttggatgctgcagcaatgggttggaatatcattgagagagaaggagttaagataaagcatccttcaagatttatattagtagggactatgaacccagaggagggagagttgagacctcaaatcttagatagatttggtttaatggttgatgttgaaggattaaatgatgttaaagatagggtagaggttataaagagagttgaggaattcaacgaaaatccagaggcattttataagaaatttgaggaagagcagaacaaattaagagagaggataattaaagcaagagagcttttaaataaagttgagataagtgatgacctcttagaatttatatctaaagtttgtattgagttaggaattcagacaaatagagcagatataaccgttgttagaacagctaaggcgttagctgcttacaatggacgaacttatgtaactatagatgatgttaaagaggctatggagttggctctaccacatagaatgagaagaaagccatttgaacctccacaactaaataaagagaagttggagcagatgattaatgaatttaaacagcaaaataataaagataatgaagagaaagaagagcataaagatgatgacgtaaaaaaaaacatgatgaaataa

SEQ ID NO: 45184 - DNA, 558 bp, Methanococcus jannaschii
atgcaagataaagagtttaaaatagccattattggcccagaaaatgctggaaagtcatcaataatgaacgcattgtttggaaaatatgtttcattagtgtctgaggtaggtggaactacaaaaatgcccataaaaagatactggggaaagttgaagattgggagaattaaggaggagccagaatttgtgaatttagtgtttgttgatttgggaggattatatacaacaactgacaaacaatccccaattatgacaccaaaagttttagaaaagacgtttgaggagattaatgattcagatatgattatacatgtaattgatggcagtgttggattattaaggagctttgagagactccaccacttgttaaaattcagataccaaaaacctattatagtggtaatcaataaatgtgatttattaaatgatagtgataaagaacatttaaagaattatgttgaaagaagaataaaaaatactccaatatttgtatcagcaaaaacttttgaaggaatccctgaattgttggatataattattaagtatttgaaaaggtga

SEQ ID NO: 45185 - DNA, 1389 bp, Methanococcus jannaschii
ttggaacttaatcaaataataaagtcaggtgaaaaaatggctgtgcatccaattgattatagatatggaacaccagagatgagaaaagtttgggaagaagaaaataaattggaaaaaatgttaaaggtagaggctgcattagctaaagctcaggcagaactcggcttaattccaaaagaagccgctgaagagataaacaaaaaagcatcaacaaaatatgtaaaattggagagagttaaagaaattgagaaacaaacaaaacatgatgttgttgcaatgattagagctttagctgaagtatgtgaaggaaatgctggagaatacatacacttcggagctacatcaaacgatattgttgatactgccaactccctactaataaaagaatccattgaaattatagaagataagttaaagcagttaagagatatattattagacaaagcagaagagcataaatacactgtctgtgtaggaagaacacatggacagcatgcaattccaacaacctatgggatgagatttgctctatgggcggctgagattgacagacacttagagagattaaaagaagcaaaaaagagaatatgcgtctctatgattactggagctgttggaacaatggcggctatgggagagaagggtttggaagtgcataaaagagttgctgaaatcttaggcttagaaccagttttaatctcaaaccaagttattcagagagacagacatgctgaattcgtctttttattagctttaattgctcagacattaaacaagattggagttactgttagaagtatgcagagaactgaaattggagagctagaagaagagttcgaccctacaaagcaaactggttcatcaacaatgcctcacaagagaaatccaataacctttgagcaaatctgcggtttatcaagggttataaaatcactatgtatagctgaaatggacaatatcccattatgggaagagagggatttaacaaactcatcagctgagagatgtatatttgcagaggtttgcgttttaacagaccacatcttaacattagcaattaaaggagttaaaaagctaaaagtaaataaagaaaatgttgagagaaacttagaattaacaaaaggactgataatggctgagagaataatgattgaattggctaagagaggtatgggcagacaaacagctcatgaaatagtaaggcagtgtgcaatgaaagcctatgaagagaaaaggcatttaaaagatattttattagaaaatgaggaagttatgaagtatataacaaaagaagagttagaggaattgatgaatcctaaaacttacataggtttagctccacagatagttgatgaagttattaaaactctaaagaataaaaagtactaa

SEQ ID NO: 45186 - DNA, 1956 bp, Methanococcus jannaschii
atggaatttaaagggtatattaaagagaagtttccatatcctaaagttagggagccacagaaaaggatgatgctaaaaatttacgagtgtataaaaaataagagaaatttgatagttgaagcaccaactggtgttggaaaaactttaggctatctaattcctgctttatactttgcagagagaagaaagagagttttaatattaacagaaacgatagaccagcaggttaggatttatgaggatttaagttctctaaggcataatttaaaggttgcattcttaatgggaaaaagtaactttatttgcaaatcaaaaggaggaaaggctaatagactatattgccaattgaataaaaaatgcttatatagaccaaataaaagaccaatttgctattgtggaacaaaaaaacaaccagtgaatttaggggataaagttatttactactgcccatactgcacctgtgaatatcaaaaggcaaaaatagagagtatcttagctgatattgtggttatgaataacagtatgttttactatgctaaggaagatattgaggcaaaaagagatattgatataattatttgtgatgaagcccataaattggaaagcagtataagaaatacatcaacaataattataaatccagaattaccaattaatagattaaaatatatggctatacattatgctcccaatattttaaaaaagagattggatattggagacgaaaatttttgggaaattattgaaaaatatttaacaagtagaggcatcaatatagatatctgcaaagagacaattatttttgatggagaaaatttaagctcttggaaatataagacagaacttgctgtattaggggctattttagatgcatattatcaaataaacaacataaagaataaaatattgagatttaatgaaaatgaggaaattgatagagaggaacttagatttgaaattgacaataaagctttaatagctatagagcttgattttatccataaaaagaaattatctgacctatatcttttggaatttatagaaaatattaaaaatttaagatatattaatgaaaattatgtagtttatagaagtggaaattctttattatgtgagccagtttttgtaagctctcatctaaaagaactttatggaaatgctgtagttatccactgctcagcaacaattggaaatttaaagatgcatgctttaaagacaggtttagataaagcagaatttttaattttagagagtccatttccaaagaataggaagaaaattatagctttaaaagatggcgttgatatgaaatacgaaaggaaagatagagagaaagcaaataaaaatttattaaaaatattggaagcaataaatggaaactctttagttttatttaagagctttgaggatttagatagtttttataaatatctaaaaagggagattacaaaaacaaatattaaaaataaaaatatccatgtgtatgagcaaggtatggatggaaaagaagctaaagagctaaaagagagatttgaaaagattggaggaattttgttagcaactgggaggtttgctgaaggagtagatattcctggtgaggcattggttggagttgttattgactcccttccattcccagttcccactcctttaatattgagagagcagaagatattggaagagagatttaaaattagaggagttagggatgctcattggagagcttttttaatgacatcatttgatagaatggcaaggacattggttcagatgattggaagattaataagaactgagaatgattatggagttgtagttatacaggataagaggttcgcagattgggtaggaagagttatgagagaaaaaggttatctaaaagataactatgaggttatgagtttggatatggctataaaatatattccaaagtttatgagtcagtttaaaaattaa

SEQ ID NO: 45187 - DNA, 1122 bp, Methanococcus jannaschii
ttgggtgattggatgatagaaaataaagtaagagacgttgttaaaaaattaaagccctatgttccaggaaaatcaaaagaagagatagcaagggcttacggaataaaaccagaggacattataaaacttggttctaatgaaaatccttggggaccatctccaaaaataaaagaaaaaattttagatgaaattgacaaaattcaccaatatccagagccagtaaatccaattttaatgaaagagttaagcaaatttttgaatgttgatgaggaaaacataattgttggaggagatggagctgatgagattatagacacaatatttagaacgtttgttgatgatggagatgaggttataattccaattccaacatttacccaatatagagtttcagcaacaatccacaatgctaaaataaaatatgctaaatatgataaggagaaagactttaaattgaatgttgaaagtgtcttaaataatataacagataaaacgaaggttattttcctctgcactccaaataatccaacaggaaatataatagaaaatagagatgtagagagggttatcaatgaaacagacgctttagttgttattgaccatgcatacattgagtatgctaaaaaagaatatgattggactcaaaaagcccctgaatatgataatgttattgttttaagaaccttttcaaaggtctttggtttagcaggaatgagggttggttatggtgttgcaaataaaaaaatcatagattatatgatgagagttaagccaatatttagcttaacaaggttaagtcaagtttgtgccataactgcattaagagatagagaattctttgaaagatgtgttagagatggaattaaaagtagagagatgctctacaatggattgaagaagtttaaggatattaaagtttatccttcagaagctaattatctattggttgaattaaaaacaatgaaagcaaaagaattttgtgaggaactattaaaaagaggtgttattgttagagattgcacatcctttgatggtttaggggataattatgttagagtatcaatagggacgtttgaagaggttgaaaggtttttaaagattttggaggagattataagctaa

SEQ ID NO: 45188 - DNA, 654 bp, Methanococcus jannaschii
atgaaattcttcttagacactgcaaatgttgaagagattaaaaaatatgctgagcttggattagtagatggggttacaacaaacccaacattggtagctaaggaaggaagagatttctatgaagttgttaaagaaatctgtgaaattgttgaaggtccagtaagtgctgaggttatctcaacagatgctgagggaatggttaaagaggcaagagaattggcaaaattagcagataacatagttataaaaatcccaatgacaaaagatggaatgaaggcagttaaaatattatcagctgaaggaataaaaacaaatgtaacattagttttctctccattacaggctttagttgctgctaaggcaggggctacctatgtatcaccattcgttggaaggttagatgacattggacacgttgggatgaagttaattgaggatgttgtaaagatatacaaaaactacgatattaagactgaagttatagttgcttcagttagacacccatggcatgttttagaggcggcaaaaataggagcagatattgcaacaatgccaccagcagttatggacaagctattcaatcacccattaacagacattggtttggagagattcttaaaagattgggatgaatacttaaagagtagaaaataa

SEQ ID NO: 45189 - DNA, 2289 bp, Methanococcus jannaschii
atggtaaattttgatgaagaagtttttagagcatattatgaacataaaataaagagttttataaaagaagagctgtctaataatttaattaaggggaatatctttgaatttgacattgagaagtttttaatgcactttccagatgcatgtgaagttaatgacttaatcattgagagaccgaaagaaattgaggaaataatattggatatatttaaagaagcttatgttgaactatttggtgaagataaagagttagaaaagatacaaattgcatttaaaaatccaaaaggttgtgaaaaattaattgaggagatttctgctgaagatataaacaaattggttaaatttgaaggaaatatactgcaagcaggaaaagttaatgcacttttaaaaaaggcagtatattactgtaacaaaagaataaaagatgaaaatggaggttttttgtgtaaatacacatatactccatgtgatggacgtgttgaaattgagattgatgactactttagtgaaggagaatttattaaggacatgttatctccaagagaggtcaaaaaaattttagaaaacaaaaaagtttgggataaattagtggaaaaagggaaaatcccaagatgtgtggatttgaaggaaaatgatgaagtttttaaagaaaatttaaaggaaataaagttcattttggatgaatatgattcaatatatgtgaatattcaggagatggagattcagcagccaattgatttaatgaaaaatcctgaagagccagcgaggagcattagagtctttttagaaaacactccgggaatatatgcaggaagggtaaatgttataggaagggttatgaaaagagagtatagacataacatcccaatttataaaatttacattaaaagtaactatattaaaatttctgaaagttataataaaattgaagttaaagatatattaagaaatgaagagcttatagagactttaaatgaattagggagaaagaaaaatattattgacattttatcaaactatctaatctctcaaataaaaggttatgaattagttaaaaaagccatatttttgcaacaaataaaaggagcttttaaatttttacctgatgggactcctttaagaagggatagccatattttattaattacagacccaggtattggaaaatcaacaatgctcagaagaatagcaagattattccctcaaaatgcttatgcatcagtaacaactgctactggaggaggtttaactgctatagtaacaagagaggctactgaaatcggagatggatgggttgttaagccgggggtttttgttagagctaatgaaggaactgcatgtattgatgagctaactgtagataagaatgtaatgaaatatatattggaggctatggagagccagacaatccacgtcaataaaggagggattaatgttaaactgcccgcaagatgtgcagttttagcagcatgcaacccaaagaggggaagatttgataggaatttaactgttattgagcagatagatattccagccccattgcttagtagatttgatttaatatttccattgatggataaaccaaatagaaagagtgatgaagagatagctgaacatatattaaacacccatattgagacagcaacaaaagactacaaaatcttaggagctattgatattgatggaataacagtggatgagaagcttttaaaatactatattatttatgcaaggagctgtgcatacatagaagagaatcaagatttatacttaggagagtttgatgaaacaaagttaattatgccttatttaactgataaagcaaaaaagatgattaaaaagtattacttagagatgagaaagttgggagagggggataacccaataccaataactgcaaggcagttagaggcaattattaggattgctgaaatgcatgcaaaggcaagactatcagataaagttgaagatgtcgatgctgaagtggcaataagtattattgatgattgcttaaaacaggtagcttatgacccagaaactggaactttggacttggataagatagctggaactccaaagtcaagaagagataagatggacgctgtccttaacattattagggagattgttagcttgagagatgatggtttagcaccagaagaggagatatatgaaaaagcgatggctattggtttatctgaaaaggatgttaatgatgccttagaatatttaaagaaagctggagatatatacaatccaagatatggattctggggtttattatga

SEQ ID NO: 45190 - DNA, 534 bp, Methanobacterium thermoautotrophicum
gtgaaggtggatcttgaaatcgacgggagtggaaaatcaagcgtgaacaccggtctcggattccttgaccacatgcttgaatcagttgcacgccatggactccttgacctggaggttgaggcgaggggtgacctggaggttgacgaccatcataccgttgaggatgttgccctcacactgggggaggccctgagggaggccctgggtgataagagcggtataaggaggatggcccatgccatggtcccaatggatgatgcccttgcaaccgttgccctggacctcagtggaaggccctatacggtccttgaactggaattcgatgatgctgtgataggtgatgtgaaatcacagaacataggacacttcattgagtcccttgcggtatctgcagccatgaacatccacgcctccgtgaggggaaggaacgaccatcacaaggccgaggctctatttaaggcccttgcccttgcaatccgggacgctgtccgggttgaacacggggaaattccaagcacgaagggcaaattgtaa

SEQ ID NO: 45191 - DNA, 1209 bp, Methanobacterium thermoautotrophicum
ttgagctggtatgatatggggccagtttcaacctgcaagctcttcggtgccgtgagggcggtgacaggcataaaaaatgcagtacccctcatccatggccccaggggatgcgcataccatataggctatctactcacagccaggggcgggcggaggatagctgtggcatcaacagaactatcagaatcagacgtggtcttcggagcatcagagaaactcagggacaggataatagaggttgacaggacacgaaaacctgatatcatagtaattatgagttcctgtgcaaccagcataatcggagaggatatagggcgggttgcagatgagacctcagaactcgtggacgcggagctcataaccgtcagtgccggtggatttgaatccagtcagggtgagggatatgaggaggtgatgatggcactcatccataaattctgctggaggatggagccatcatctaagccttcagtcaacataataggtgaattcaggggcggagccgacctcagggaggtcagggagtccctatcattgatgggggtggatgtgaactgtgtcctgacatcaggatgcagcatcagggacatgaccatgatcccggcgggccacctcaactgctccttctgtgatgtctcgggtatcgccccctgccgcttccttgaggagaacttcgggacacccttcatccaccaccccatccccataggtttttcaaattcactcagattttacagggaggttctcgggtatctcaacctcgattatcccataaatgaggaattctcagcttttatcgaggagagggatcgaataagggctgaacttgagggtctgagggtggcggtagtttcaggaccaacaagggccgttgcactcacagaattcataactgaactgcggatgaagccagttcttgtatcaatggatatgataggtgattacacactggaaaaccttagaggggtgcctggattgaggtcagagatacttgtcggggtcgatgtttctgatattgaggaggccatcatcaggactgaacccgaactgatactgggaggccttgcagagacccgcatatctgaggtttcaggggcacccctcatcgatgttatgcatggatccagcctcacagcaggtttcaggggggctgttaaccttggtgctagaatgtgcggggctgtttatggggatcatgattgttattaa

SEQ ID NO: 45192 - DNA, 1053 bp, Methanobacterium thermoautotrophicum
atgaaatatgcgatagaaaccttcgatctcacaaaggtctacggggacttcaaggcggtggacagcctgaacatgaagatagagaagaactccatctttggtttcctggggcccaacggggccgggaagacaacaaccataaagatgctcacatgtctcatcccgccaagctcagggaccgccagggttgcaggttatgatatactcaaaaaccccgatgaggtccggcagcagataggcatggttccccagaaggtaagcctatacgaggacctcacagcaagggaaaacgtggagatgtgcgcagacttctatggcatgcccgaggatctgaaggaatcaaggatagaggagctcatggaacttgtggacataaaatacgctgcagacaagccagtcgggcagatgtcaggtggccagcagcagaaggtgtcactggttgcaagcctcatacatcaaccagacatcctcttcctggacgaaccaacaatcggcctggacccgacaaccaagcgggtgctctgggacctcatagacgaactgaacagcagcggtcacaccatcatactctgctcccacgacatgtacgaggtggaactcctctgtgactacgtggggataataaatcagggcgttcttgccgcctttgacactccacaggggctcaaggacacagtgataaaggaggaggaatccctcagagcaaaggagatcggtgggatactggacaggatcgacaaggagacgcctgaatccgagagaagggccatccaggagatcaagaaatcagagaggatatgtgccggtaaggagataagcatgctcattgtgaacctcacagatgatctactatctgaactggaagccctaccggttacactggacgttaagaagcaccatacaggaaggataatccttgaactcgatgaaacatgcgaaactgccgttaatgatgttctggcggctgttataaggaacaacgccaggataacctcaatttcaacaaaggacccctcactcgaggacgtatttatgaaggttacagggaggtaa

SEQ ID NO: 45193 - DNA, 1401 bp, Methanobacterium thermoautotrophicum
gtgaacgacacccatggatacattaaaagccatcccgaacttttctgggagggccgtgaaatcgtatatgagacccttggtggttaccagcacatagctggactcgttgataaaatacgcaaagagaggcccgctctacttcttgactgcggggataccatccacggcacataccatgccgtgaagagtcggggcgctgcaatgatccccctgctgaatgagatgggattcaaggccatgacagctcactgggagtttgcctacggacctgaaaggttcattgaactctcaaagaagctcaattaccctgtacttgccataaactgctaccgtgagggtaccgaacggctggtattccagccctatgaaatccttgatgttggggaactgcaggtgggtatcatagggatagcatcaaacatcgtagataaggtcatgccaccccacttcagtgagggccttgaattcacccttggccttgaggagctccccggatggatcgatatcctcaggaatgaggagagggtggatctcaccgttgtgatatcacacctcggctttccacaggaggttcagctggcatctgatgttgagggcatcgatgtgctgctgagcgcacacacccacaacagactcgagaggccccacatcgttggagataccataatcatacagtcaggctgtcatggctccttcatcgggcgccttgacctggaggtggatgatggtgtcaggggattcagccatgaactcatgaaggtgaggggtccctcagatcctgatgttgaggagatggtgctcaggataactgagaccgacagtgaccacctcgaaacagtcgtgggctccaccaggacccaccttaacaggtacaccatactggagtcaaccatggataacctcctcctaaaggccgtgatggatacaggggactttgaccttgcattctccaatgggtggcgttacggtgcccctgtgccgccaggagatatcagaattgaggatctctggaacattatacctgtaaatcctcctttatcccgggtgaggttaacaggcagggaaatatgggatatgatggaggaaaacattgaactcgtattctcaaggaacccctacaatcagatggggggctacctcaagaggtgcctcggacttgagatgtacttcaagatcgagaaccctccaggtgcaaggatacagaagatatttgtaaatggcagaccccttgacccgtcagggacctacagtgccgtctacgtcacatcccagggagtcccctccaggtacggtgaggaccatgaggagaccgatctgagggccattgatgtgcttgaagaatacatcgcgagaaacagcccggtggacgccggccttgaggggaggataacacccgtgtag

SEQ ID NO: 45194 - DNA, 1677 bp, Methanobacterium thermoautotrophicum
atgctaaaaatattgtccatggaaagtcaggtctatgaatgtgatgttctgataataggctcaggtggagctggctgcagggcagccatagaagtttctgaacacaatctcacgccattaatagtttcaaagggattatcatttaaatcagggtgcactggaatggctgaaggaggatacaacgctgcatttgcatgtgttgaccccgaggacagtccggatgtgcacttcgaggacaccatgaggggtgggggattcctcaatgacccccagcttgtccgcatacttgtggatgaggcacccgacaggttgagggaccttgaaacatatggagccctctttgacagacaggaatccgggctgcttgaccagaggccctttggggggcagacctacaggaggacatgctaccagggggaccgcaccggccatgagatgataacagccctcaaggaggaggtcatacgacgggatatagagacagttgaggagatcatgataacatccctccttgtggaggaggaccgtgtactgggagccatgggtgtgtccataagggactcaagcactgtggccttcagggcgtcttcaaccatcctggcagccggtggggccggtcacatctaccccgttacctccaacaccatccagaagggcggtgatggattttcagtggcatggaaggcaggggctgacctcatagacatggaacaggtccagttccaccccacgggcatggtctaccccgagtcaaggagaggggtccttgtgacggaggccgtgaggggtgagggcggaatactcctcaacagtgagggggagaggttcatgaagagatacgacccccgcggcgaactggcaacaagggatgttgttgcaagggcaatctacaccgagatcatggaggggaggggcaccgggaatggtggagtctaccttgatgtcagccacctgcccgatgaggtcatagaggagaagcttgagaccatgctcctccagttccaggatgttggtattgatataaggtccgagccaatggaggtggcacccacagcacaccacttcatgggaggcgtcaggatagatgagtggggcaggacaaacctcaggaacctctttgcagccggtgaggttaccggtggtgtccatggagccaacagactgggcggcaatgcactggcggatacccaggtattcggaaggagggccgggatagcagctgcaaggaacgccatcaaatcagccccggcgtctatcaagtctactgttgaggaggaggaataccgtataaagtcaatggtggccgaaggatcacacagcccatccgagataagggacaggcttcatgaggccatgtggaacggtgttgccatagtaaggagccgtgaatcccttgaatcagccagagcagttatccaggacctcacgacgatgatgggggatctgaatgtccctgagacgtctggctttaacacctacctcatcgaggccctcgaacttgaaaatatgcttgtaacctcatcaatggtggtggaatcagccctgataagggaggagagcaggggatcccattacaggaaggatttccctgaaaccagacctgaatggcttaagagcatagtcctcaacaggaacagaagacccggcttcatagagaggggccttaaatcagcctag

SEQ ID NO: 45195 - DNA, 864 bp, Methanobacterium thermoautotrophicum
atgaagataagaatagcggttccctccaagggaaggataagcgagcctgcaataaggttacttgaaaatgcaggtgtcggccttaaggacactgttaacaggaaattattctcaaagacacagcacccccagattgaggtaatgttcagcagagcagcggatataccggaattcgttgccgacggtgccgctgacctggggatcaccggctatgacctcatagttgaaaggggaagtgacgttgaaatcctggaggacctcaaatacgggagggccagcctggttcttgcagcccctgaggactccaccatcaggggcccggaggacatacctcggggtgcagttatagccacagagttcccggggataacagagaactatctcagggagcatggtatagatgcggaggttgttgaactcacaggatcaacagagatagcgcccttcattggagtcgctgacctcataacagacctcagcagcacagggacaaccctcaggatgaaccacctccgggtaatcgacaccatcctcgaaagttcggttaagctcatagcaaacagggaaagctacgccaccaaatcagggataatagaggaactcagaacagggatacgtggagtcatagatgccgaggggaagagactggtgatgcttaacatcgaccgcaaaaaccttgacagggtcagggccctgatgcccgggatgacaggtcccacggtctcagaggtgctctcagataacggggttgtggcagtacacgcagtggtggatgaaaaggaggtcttcaacctcataaacaggctcaaggcggtgggggcaagggatatacttgttgtgcccattgagaggataataccctga

SEQ ID NO: 45196 - DNA, 2733 bp, Methanobacterium thermoautotrophicum
gtggtgttaaccatgaccgccatatatgaacttgaagtggaggaggtcctgcagaggcttgaaacatcagaatcaggccttgacccccaggaggcggaaaaacgcctcaagatccacggtccaaacaaacttgaggaggtcaaaaggagaccactcatcctgctttttctatcaaacctctacaacgtacttgcactgctgctctggatcgcagccatactgtcctttataacaggcaattaccagcttgcagtcgccattgtaatggttataatcataaacgcactcttcagtttctggcaggaatatgaggctgaaaaggcagccgaggcccttaaaaacattctgcctgtgatggttaaggtcataagggcctcaaaggaggttctgatacccgcggctgatgtcgtgcacggggacatcataatccttgaggagggggacaccgtcccggccgacgcaaggatccttgaatcacacaacctgagggtggatgcatcagcactgacaggagaatcaaaacctgtgagaaaggtatcacacccggtcagggaggctgataactacatagacacagagaacattctgtttgcaggcacccaggtgacttcaggtacaggaagggccgctgtgtttgcaaccggcagggacaccgagttcagcaggatagcgacactcacacaggaggtgcgtgaggagcccagccccctccagcgacagatatccctggccgcaaggatcataggggccctggcggtcgccatgggggtcatcctcttcctggtgaacctttacatagtcagactcccccttgaaacggcattcatattcgcaattggtttgatggttgcaaacgtcccggagggccttcttccgagcgtcacactctcacttgcggcatccgcaaggaagatggcccgggaaaacgcccttgtgaagagactttccagtgtggagacactgggatcaacgacaatcatatgcacagataagacagggaccctcacaaggggtgagatgacggtcaggaaaatatggatcccccataaggtcatcgaggtcacagggtcaggttacagaccagaaggtcagttcctcttcaggggtgaaccagtgagccacagggacatggccgagctgaagctgctcatgagggcagccaccttctgcaacgattcggccctcatacatgaggaaggtgaatggagtgtgctgggtgattcaaccgagggcgccctccttgttgcagccgagaagctgggctttgatgctgaggcagaactcaaagcgatgccaaggataacagagctcccctttgactccaggcggaaatcaatgacctcaatccatgagaaatcagggaagagggtggcctacgtcaagggagcgccaaagaagataataggattatcggaacgcatttctgtggatgggagggtcagagccctccatgcagatgagaaggaaaggataataggcatacatgatgaaatggcctcgaagggtctccgtgtacttgccttcgcataccgggaactccccgaggaccttgaagtcagggaccccggtgaggttgagagggaccttgtactggtgggcatggcagccatgcatgatccaccaagggagggggttaaggaggctgtggagcactgcaagactgcaggtataaggatcataatgataacaggtgactatggtctcacagcagaggccatagccagggagatcgggatagtggagggtgagtgcagaataatcaagggaaaggagctggataagctcaaagacaccgaactcaggggtatactggccagggagaggaaccttatattcgcaagggcggtccctgaacataagatgaggatagcatctgtcctggaggactcagatgagatcgttgccatgacaggggacggtgttaacgatgcacccgccctcaggaaggcagatataggtgttgccatggggagcggcaccgatgttgcaaaggaggcagcagacatagtccttgcagatgacaactttgcaagtatcgtgaccgcggtcagggagggccgtacggtctatgagaatataaggaagttcataacctacatattttctcatgagacagctgagatagtcccatttatcatgatggttctcttcagcatacccctcccaataaccataatgcagatactcgcaatagaccttggaacagacaccctcccggccctggcccttggaagatccctgccggagtctgatgtgatgaaactgccaccaagggccccctcagagaggctccttaacagggaggtcatcctgaggggttacctgttcacagggacaattgaggcagccctcatcatggcagcatacttcctggttctctattcagggggatggcttccaggacaggaactttcagccagcgatcccctctacatgagggccaccacggtggtctttgcaggtatagtcatggcacagctgggcaatcttctctcctcacagaccctccgttcatcagcacttgaggcgggcctcctgaggaacaggtggatactggcaggtatggtctttgcaatctcggtgatgctccttgttatctatctgccaccactgcagcccatcttcggcacagccccacccggaatcctggagtggttcatcctgatactcttcacacccatcgtctttctgacagatgagatgaggaagttcatacagaggaggctggcctga

SEQ ID NO: 45197 - DNA, 2373 bp, Methanobacterium thermoautotrophicum
atgaaaagaataacgataaggataggcgggatggggtgcgctgcatgcgcactgaagatcgaggaggccctcagaaaactggatggaatccgcgatgctgcggtcaacctggttgagggaaaggtttcagttgagtatgacccccggagggttgatctctccgatatggaggccgccattgaggacgccggctacactgtactcaatgagaacatagccatggctgtgggtggtatgagctgtgcgatgtgtgtacagaaaatagaatccgccctgaggggacttgagggcgtaagcaatgccacagtcaacctcgcagctgaaaaggcctacatctcctataacccatccctgacctctgtggaggacctcaaaaggacggtggaggatcttggatacaccgtgaggggtctggagggtgaagagatcagtgaggacctgaaaccaaaaattagaagaataatagtgggtttcggagtgtcagtccccctgatggcgatgatgtacctcggtctacagcccccaggtgggggtatatccatgctactggtgtcaatcataccattcatctatgtctcaggaccgatattcaggggggccctcagatcactgagatccgggacacttgacatggatgtaatgtactcaatgggtataggagtcgccttcctttcaagcatcctgggcaccgcagggattctcccatccgatttcatgttctatgacaccgcacttatgctggcatccttcctcacccttggaaggtacctggaggcaggtgcccggggtaaaacatcagaggcagtgaggaggctcatggaactccagccagacaccgccacggtcctcagggacggcagggaggttgaggtgaggatccacgagatagatgtgggtgatgaggtaattgtgagaccaggggacagggtacccgctgatggaaaggttgtggagggatcctcctatgtggatgagttcatgataacaggtgagcccctcccggcccttaaaacacccggatcagaggtcgttgcaggtacaataaacactgacggcatcctgaggttcagggttgaacgcaccggtgatgaaaccttcctttcaggtataataaaactcgttgacgaggcccaggcatcaaagcctcccatacagaggattgctgaccgggcagtatcctatttcatacccgcagttctgcttgttgcaacatcagccttcctcttctggtaccttgttgaaggtgcagggttactcctgtccatcacggttctcatatccgtacttgtggtggcctgtccatgcgcactgggccttgcaacaccaaccgctgtcacagcaggtataggcaggggcgctgaacttggaatactcataaagaagggtgaggcccttgaggtatccgacaggatatcgtgcgtgatcttcgataaaacaggtacactgacactgggaaggcccagggtcacagacatggttggtgatgtgctgggcctggcagcggcccttgagagaaaatccaggcaccccattgcagctgcagtaactgagagggccgaggaggaaggggttgacgtcccggaggccgaggacttccgggccatacccggcatgggacttgaggggatggtggactcacaccatgtacttgcaggtaaccgggccctcatggagaaatacggcatccccctggaacactgggaccctgaaaaatttgaatcagatgggaagacggtggtcatagtcgcagtggatggcgaggtgaaggggatcatagcggtctcagatgagataaagcctggttcagcgcgggctgtcagggaactggagaggatgggaataggcactgcaatgataaccggggacaaccggaaaaccgcggaggctgtggcccgtgaggtggggatagggaccgtgattgcagaggtcctcccacaggataaggcaacaagggtggccgagcttcgagaaaggggtgaaggagtcgcctttgtcggggacggtataaacgatgcccccgcacttgcagaggccgacctcggagtggcggttggtagcggaacagacatagcccgggaggccggtgaggtggtcctcatgggagatgacccacttgatgttccagcggccctccagctggcagggaaggtcatatcaaggatccggcagaacatcttctgggccttcgcctacaacgttgtgctgattccactggctgccggagccctttaccccctcggaatcgtattcagaccagaatacgcgggtctggcaatggccctcagttcagtgacagtggtatccctctcactcaccctcaggggatacaccccacctgcaagaaggttgagggagaagcagggagaaggttaa

SEQ ID NO: 45198 - DNA, 1350 bp, Methanobacterium thermoautotrophicum
atggccattcatccagttgaattcaggtacgggacacctgaaatgagggttatctgggaggctgaaaataagctccagaagatgcttgacgttgaggcggcccttgcacaggcagagggcgaacttggaatcatacctgctgaagcggcctctgagatagtcaggaaggccagcacagaatttgtaacccttgaaagggttaatgagattgagagggacacaaagcatgatattgcatcccttgtaaaggcccttgcagagcagtgtgagggtgacgcaggggaatatgtgcacttcggtgcaacatccaatgacattgttgacacatccaattccctgcttctcagggactcaatctcggttctcagggataaactcaccagggtacttgaggttctccttgctctggcggatgaaaacagggacagggtctgcatcggaaggacccatggacagcacgccctcccaaccacctatggcatgaaattcgccatctgggcagatgagatccaccggcagctggagcgccttgatgcgtgcagtgaaaggctctgtgtcgggatgatgacaggagccgtcggaaccacagcggccctgggggaggagggcctggaggtccatgagagggtctcagagatactgggactcagaccggtcctgatatccaaccaggtcgtccagagggataaccatgcagagttcataatggtccttgccaacatagccacaacccttgataagatagccctcgagatcaggaaccttcagaggacagagataatggaggttggagagaaatttgaccctgagaaacaggtgggcagcagtaccatgcctcataagatgaacccaataactgcagagaggatatgtggtattgcgcgtgttataaggtcctatgttgtcgcggccctggagaacaacccattatggcatgagagggacctcacaaattcatcatccgaacgcataatccttcctgaggcatgcatcctcacggactacatacttaaactgacactggatgtcctctgcaacctcgtcttctaccctgagaatattaagaggaaccttgaattcacaggaggcctgataatggcggagaggctcatggctgagctaacaaggaggggcatgggtcggcagacagcatatgcagctgtgcgccagtgtgccattgaggccagcaggacaggaagaagcctaagggatgtggtccttgagaggtccgagatcatggattaccttacagtggaggaccttgaggagataatgaaccctgagacctacatcggatcagccaggaggatggttgagagggtccttgaggaatcacaaaaatggctctga

SEQ ID NO: 45199 - DNA, 930 bp, Methanobacterium thermoautotrophicum
atgagtgaagacagagaccttcttgctgttggacataccgccttcgattacataatacatctggatgaatttccagaaccaaacacatcaacagccataaaacgcatgaggaaccttcatgggggagcagccgcaaatgtcgccctggtgggatcaaggcttggtcttagaacatcccttgtatccgcggttggaggcgactttgagggttcagagtacagggagctcctggagtcaagtggtatagatattgaatccatgatcctggtggcggacgaaagcaccccaacagcctttgtgatgaccgattctgatcacaaccagataagctacttctactggggcgctgcaaggtacttcaaagacgccgagacacctgcggatgccataaaatctgcccgtgcagtgcaccttgcaaccggtgacccatccttcaactgcaggtgcggtgaatttgcaaggtccctcggtaagataataagctttgacccggggcaggacctccacatgtactcccgcagccagcttgaaagggccgttggtgtatgcgacatactatttgggaaccaccatgaaatagatcgcatatgcagcaaactgtcggtggatatccatggactccgggagatgggacctggggtggtggttaagacctacgggaaagaggggagcatcatatactccgatgatgtgataaagatagacgcaataccccgggaggcggttgaccccacaggggccggggactcctaccgggcaggcttcatgagggcctacctccggggcgcggacctcaaaacctgtgggcggttcgcatctgcagttgcatcattcatagtagaggatgagggtacccagacaaacatccctgacacaggagaagccgtgaaacgcttcactgcacagtggggctatgaacccccgatatga

SEQ ID NO: 45200 - DNA, 2598 bp, Methanobacterium thermoautotrophicum
atgaccgtccttgaggcggcccttgcaaatgacatatacatccctcacctctgcttcagggagggtatcgaaccctttgggggatgcaggctgtgtctggtggagaacactgatggacgccttgtaacggcctgtgaaactcctgtagaggatggcgcggaattcatatctgaatcagagaggataaataatatccggaggaccgtggtatccctcctgatatcagagcacagcagggattgcctttcatgcccctcgtcaggggactgcagtctccaggaggtctcatcctatcttaatctgacagaggatgacctttcgagactcagacaggatctgcctgaatcagaaccagatgaatcaaacccctttttcattagaaaccatgataagtgcattctttgcggtttatgcgtaagggtctgtcgtgctactggtgcagaggccatagacttcgcctacaggggacatgacacaaggatatccaccttcatggacagggccatcactgaatcgagctgtgtatcctgcggggaatgtgtggaggtctgccctgtgggggcccttgtttcacgggaagagaaacccttcacagaggtgaagacggtatgcccatactgtggtgctggctgcggcatctacctcggtgtgaggggggacagggttgttagttcaaggggtgaccctgataatcccgttaacaggggtaaactatgtgttaagggcagatttgcattgaagtttgtaaacagccctgaaagacttaaaaagccactcataaaggttgatggtagattcgttgaggttgaatgggatgaggcattatccaccgtggccgagaggctatcagaatatagtggtgaggagtttgctgcagttgcatctgcaaagtgcaccaatgaggagaactacatcctccagaagtttacaagggctgtgatgttatccggtaacatcgaccactgcgcaaggctctgccatgcaccctccgtaaggagcctcagcatgacgctgggtagcggtgcaatgacaaactcaatagctgaacttgaggattcagcatgcatcctggcggtggggaccaaccccaccgagacacaccccctaacggcctacagtgtaatcagggccatcaggtcaggtgcaaagctggtggtcattgacccgaggaggacgaggatctcggagcttgcagacatccacctccagaaccggcctggctctgacatcccactgatcatggccatgtgtcgcttcatcattgaggagggcctccatgacacagaattcattgagtcaaggacagagaactttgatgaattcagggatgcagtcatggcactggaccttgaggaggttgaaagcctcaccggtgttggggtagaggatatgaggagggctgcaatcacctacgcctcaaaaaagccggcatccatcatatactcaatgggtatcacccagcacgctcacggtactgacaatgtaatcgcacttagcaacctcgccctcctcacagggaacctcgggaaaccatcggcaggtataaatcccctcaggggccagaacaacgtccagggggcctgtgatatgggggcgctcccggaccttctacctggctaccagacccttgacgactccttcagattctctgataaatggggttcaaccataccggggcccggaatgacgctacccgagatgtttgacgcagcccttgagggacgtttgagggccatgtacataatgggcgagaatcccctcctgagcgaacctgaaactgagaagacccggaaggcacttgaaagtcttgattttcttgttgtccaggacatattcatgaccgagactgctgaactcgctgatgtggtccttccggcatgtgcatgggcagagaaggatgggacattcaccaacaccgagaggagggttcagctgatcaggaaggccctggatgcccctggagaagcaaggactgactgggagataatctgcatgctggcagagaagatgggggctgagggctttgattatgcttcatcatcggagatattcaaggagatagcagcactcgtgccatcatatgccggcatatcacatgagcggcttcaggatggtggtatacagtggccctgcacatcttatgagcatgggggcacacagtacctgcattctgagagattctcaacacccacagggagggcgtcatttttactgccagggtatcatgtaggggaggtatcagaggagtatccgatggtccttgtaaccggccgcaatctctaccagtaccatacaagatccatgacagggcgcgtgccagaacttgattcattctctgacagggaggaacttctcattaaccctctggatgcagcaaaactcggagttgaggatggcggcacggtcctcgtgaaatcagaggggggctctctggaggtgagggcaagggtttcaggggatgtcatggagggtgttgtcttcatgacattccactttgcagagaccccggcgaatgtcctcacagggggagatcgtgacccggtatcagggatgcctgaactgaaattcacacccgtcagcataagacctgtggagtaa

SEQ ID NO: 45201 - DNA, 1410 bp, Methanobacterium thermoautotrophicum
atgccatttaaactgtttgatgttgacgctgaaatacctgagagaaaaaaacatgtctatataaagaagaaggaagatcccgaagaggatctgcccttatgtaacacaaagacaatccctggttgcatgactgagaggggctgcgcctttgcgggtgcgaagggtgtcataaccggtgcaataaaggatgctctgcatgttatccattcccctgttggatgcacagcatatggctacggtacaaagaggtatcccacatcacaggaaatgcctgatggcagcctttttcccattgaaaacttcaacctgaagtatataacgggcacaaatctcacagagacagatgttgtgtttgggggtatggataaactcaaaagatgcatcatcgaggctgctaaagaattcccagaggcaaatgctgtttacacatatgcaacatgcacaaccggtctcataggagatgatattgaagccgtttcaagggaggtttcagaagaaatagggaaggacgtggttgcaataaatgcccccgggtttgcgggtccaacacagtcaaaggggcatcaggttgcaaactacacactgtttgagaaccttgtgggaaccgcagagcctccggtagtaacagactatgatgtaaacctcataggagagtacaacatcgatggtgacctctgggttctcaagagatacttcgaggagatgggaataaatgtcctcagcacattcactggagactgctgccatgatgagataaaatggatgcacagagctaagcttagcctggtccggtgtcagcgttcagccacatatattgcaaggcttctggaggaacgttacaatgttccatacatgaaggttgatttctttggaatagaatactgcaagaggaatctcatggctacaggggaatactttgggattcctgaaagggcagaggaggtcataaaggataggatggagaagataggccccgaaattgaatatcttcgtaataaattggctggtaagaaggtctgggtattttcagggggtcctaagaactggcaccttccacgcccccttgaggatgaacttggaatggaggtagttgcagtttcaacaatgttcgaacacgaagacggctatgaaaaaatcaagaaaagggtcggagaaaatacggtgatagttgatgacccaaactcactggaacttgaggaaatcattgaaaaatacaggccagatatcatcctttcaggtataaaggagaagtatcttgcccataaacttggtgtaccatgcgttctcatccattcctacgaaaatggaccttacataggttttgaggggttcctgaatctcgcaagggacatgtatgcatcaatatacagtcctgtctgggatctccttgaatttgaggcaggtgattga

SEQ ID NO: 45202 - DNA, 1380 bp, Methanobacterium thermoautotrophicum
atgtcagaaataaatgtgatggaaagaacaagggaacttgtggtaaaccctcttgtgacctgtcagccattcggggcaatgttcgcaacccttggcatacggaggggtctccccatagtccatggttcgcagggttgcagcacctttgtgaggtatggtcttaataggcacttccgtgaaccggctgaaatagctgtcacatcgcttcatgaggatgctgcggtttttggaggcaggagcaacctcatagatggtgttaaaaatcttgtgaagagattcaggccagaactcgtaggaattgtaacgacctgttcaagtgagataactggtgacgatgtggatggattcctgagggttgcggaggctgaattaagagaagaacttggagaaagattcagaacaaggatggttagcatatcaacaccaagctttgttgaacatcacttaagaggatatggaaatgccctaaaatcgtttatagatactcttgcagttgatgagggggactgcaatgagaggatcaacctgataccaggtattgttaacccgggtgatatacgggagataaggcacatctttgagttgatggacgtcgaccccattatactcacagacacttcggatccattcgattcaccactacgaccatcaaagacagagaaaatgccattctatcctaagggtggaacagtggtttctgatatagaggaatcctcaaacagtataggaacactttcaatgtcaatgtatggaaatgaagcatcagaaacacttaaaaagcgtttcaatattcccaaggagcaccacatacccattggtgtcaggaatacagacgatttcgtccgttcattggcgagaatagcagaagtagatgtgagcgaagagcttctggatgaaagaggtatcctcattgattcaatggcagatattagctcaagatatctctttggaaggacagcagctgtttacggggatcccgacatggtaatgggtgtgtcaaggttcctctgtgaacttggaatcacaccactctatgcatgtgtcggtgtcgataatgaaatcttcagggagggaatgaaaagagtggcatccgaggcagatgaaaggataaacgtcatgataaactcagatctgagggcacttgaaagagaacttacagaggaacctgtggactttatgatagggaattcggatggaaggcttatagcaagggatcttggaataccccttgtaaggatgggctttcctgtatatgatagagttgggtatcacaggattcctgttgtgggttaccgtggatctgtcaatcttctaaacagaataacaaacacagtactgagagaatactatgaaccacagcactggaaactccagcaataa

SEQ ID NO: 45203 - DNA, 2001 bp, Methanobacterium thermoautotrophicum
atgaaggtcctgacaacatgtacaagggattgccctggttcatgtggtcttacagttaatgtgagcaggggtaaggtcaattccatagaaggaagcagtattcacccacacacaaggggatttatatgtaaaaatacagcgaggtatcatgtaaggaggctctattctgatagaagggtattaaaaccgttgaagagggatgggaggcagtggaaaacgatatcctgggatgaggcacttcatgtgatttctgataaattgaatgagtgcatggatgaacacggagctgagtctatagtgtattatcagggttttggagcacgaacagcgttgagactcctcaacaggaggtttttcaatctcataggagcaacaactctcaggggaactctatgcgggggtgcagccatagcagctcaatcaaaagactttgggaggagactgtcccatgatccgtcagatcaccttaacagcaggaacatattcatatggggacgtaaccctgccgtcacagacattaatctctggaggataataaagagggcccagaaacatggaacacgggttatcacaatcgatcccataaggactcaaacagcagtgaaatcagatattcactgtcagattgaagccgggaaggacctataccttgcaatagcaatggcgaagataatcatggctgaagagcttcatgactctggattcatagagaaacatgcggaaaattttgattcatatatagaaatccttgatgaattcaatttaaatcaattatcagagctgagtggggttccattgaaaataatctctaagcttgcacacctatactctgatgggccaagcagcataatacttggctggggtctgcagcggtacttcaactcatatatggcttgcagattcatagatgcccttgcagccatatcagggtatataggtgtgagtggaggtggtgtgagcagcggttttgatgaatatggggcctttgatgaatctgttacacttgaaggggcaggaaatggtagaaaagtgtcaatgcccctttttggaagggaaatagtgaatatgaattcaccaaccgttaactgtgtatttataacggcaggtaatcccgtgacccttggacccaactccattcagactctaaatgcgctaagagaagttgattttgttgtcatggtggatctcttcttgaatgatacagcacatacagccgacctatttttacccgcaacaacatttctggaggaaacagaccttgttggaagctatggtcacccctacgtgtctcctgtaaacgctgcagtcaagccattgggtgaatctcattccgagttctggattttacagagattatcagagatcatgggttttgctgatatggaaggaacaaggatggagtggcttgaaattatagcttcaaaggttcttgattatcatggaatagaaatttgtgatctcctggaaaaaccatacagatcaccgggattccctccggtcccatttgaggggcctttattctatacagacaatggaaggttcaatttaccatcggacaggccttacgagatggagcaacatgatggggcacaccctgaaaattccataaggcttttaacagtcatgtcaccacagtgggtaggttccgttgagcctacctttcataaaggtcttgtagaaatttacctaaaccccggaacgctttcacaacttggttttaatgatggagagatttcagtcgcggaatcaaatgcaggaaagagttgtgtgattgtacgttccagcgaggatgtccatccactatgcgccctttcattcagggggacatggttatcaaagggaggctgtataaatactgtcattgaggatagagagacaattatgggtcatggaacagcttacaacgagaccagaataaaattaaaaaaagtttcaggcggcgtttctgttcatgaaatgtgccatgagactcacaagtataaatcccgccactatgagtga

SEQ ID NO: 45204 - DNA, 1686 bp, Methanobacterium thermoautotrophicum
atgaaggaattgctctatatggaacttgcagaggtataccacagacttgaatcaaccacaaaacgccttgaaaagactgaaatacttgcggaactcctgaggagtgttgataaggaacttctgcccgatgtaacaatactgatgcttggcagggtgtttccaatctggagtgaggaggaacttggggttggcataaagctgctcatgaaggcaatatccctggttgtgggggtttcgatggatgaaatcgaggacgaaataagggaacagggtgatataggccttgcaagtgaaaaactattctccagaaaaactcaaacaacctttttttcacaacccctgacagtggaatttgtttacagcagactgaaggccctggcatcagcttctggtgatagggcacagtcaaagaagataaacatacttgttgaggtcctgtcccaggcaaagccactggaggcacgctatataacaaggacggtccttgaggaactgagggttggtgttgcagagggaatcataagggacgccattgcccgggcctttgaggttgacccggcactcgttgaaagggcccacatgctcacaaatgacctgggaatggtggccgcagttgcaagggaggagggcgagcctggacttggaagactcaaccttgaaccgggaagacccgtgaaaccaatgctggcacagcttgccagcagcatagaatctgccataacggagcttggaagggccttctgtgaaaccaaatatgatggtatacgtgttcagatacacagatgcggggatgagatatccatcttcaccaggagacttgagaacatcaccgcggcggtccccgagatacttgagggtgttgaggaggcccttccagccgatgactacatagttgagggggaaataatagtcaccatggatgggaggccagcctccttccagtacatactccagcgtgtcagaagaaaatatgatgtggagagacttacaagggaggttcccctctcactgttcctctttgatgtcctctaccacagagaacccctcatcgatgaacccctccggcacagaagggaggtccttgagtcaatactctcagaaatacctggaagggttgaggcgagtcgcatggttgatgtgggcccggataacctgaatgatgctctatggctcttcgaggagtcaataagagagggacatgagggtataatgataaaggatacggaggcgccgtatataccgggtataaggggtaaaaagatgcttaagtttaaggcagaaccagagaccctggacctcattgtggtcggtggcacctatggcaggggtaaaagggcacatctggtgggatcctatctcctggcagccagggatgaggatagcggggaccttgttacggttgcacatgttgcaacggggcttgacgatgagacgctccagcaactctcagagaggatggaaaaacttgccattgagaggaagggacggaaactcttggtcaggccagaaataatacttgaggtcgcctacagtgagatagtgaagagtcctgagtatgaaagcggttactccctgcgttttccagtggtgaaacgtataagggacgatctgtgcctggacgatgttgatacagttggacgtatagagtccctcttccagtccggacagccagaccaaccaggttag

SEQ ID NO: 45205 - DNA, 1368 bp, Methanobacterium thermoautotrophicum
atgaagaaactatttggcacattcggagttagaagacttgcaaatgaggttttaacacctgaattcgcatcaaagcttgcggcagcatacggttcaactgtagaagggaaaatagctgttggaggagatacaaggacatccactgtaatgataaagaatgctgtcatatccggccttctttcaagcggatgtgatgttgttgacctgggaatactcccaacgccagccgttcagtatgcagtcagaaaatattatgatggaggggttatcgtaacggcgtcccacaaccccccacagtacaacggtataaaattcgttgactcagacggcataggcatccctgatgacctggaggaggaaatagaaaggatattcttcagcgaagatttcaggagggcctcctgggataaaatcggaaacctcacatcaaacccctccataatcagggagtaccaggacggtgtcatagcgagggtcgatgcagaggccatccgtagaaggaaattccgggtggtggtcgactgtggctgtggagcagcgtcctacaccatgccctacatcctcaggaggctcggatgtcaggtgatagcacttaactctcagcctgatggtttcttcccgggccgtgaccctgaacctgtccctgagaacctctcggagctgatggagactgtgaggtcaaccggggctgatctgggcatagcccacgacggtgacgcagacaggacaatatgtatcgatgagaggggagaatttgtcctcggcgataagacattcgcccttgttgagaagaggatgctccaggaaaagggtggaggcataatagtcaccaccgtcgcaacatcctcagcaatatacgatatagcatcagagaacaacggagaggtaataacaacagctgtaggggacctcctggtggcaagaaaacttaaagagacagacggactatttggaggcgaggaaaacggtggattaatattccccgactttgtatacgggagggacgcagccctcacagccgccacgatactcgagataatggcccatgaggacaggccactatcagcgcttgtatcggaactacccgcatattactccagtaagaggaaaatagaatgtcccgatgaaattaaaggggatgtgatggacctggtaagtaagatgctggcagatgaggagggtgtaagggacatagataccacagacggtgttaaaatattcagtgaagccgggtgggtcataataaggccctcagggaccgagccaatattcagatgcttcgcagagtcagagacacaggagcaggcagatgaaatggcccgctggggcatatccctggtcgagagggccatggaaaaactgaaatag

SEQ ID NO: 45206 - DNA, 1122 bp, Methanobacterium thermoautotrophicum
atgaaactcaagagtggttctatggtaaagattcggaataagatcaatgatattgaaccctatgtacctggaagatccataaaggaaattgcagatgcctatggtcttaaagaggatgagataattaaacttggatccaatgagaaccccctgggcccatcacccgccgcggtggaggccatggagcgtgaacttgaatcggttcacagataccccgagtcagccctgaccgacctcagggaagccatagcagactacgcaggggttgggatggatcaggttatagtgggtggtgatggtgccgatgagataatcgatgtcctggggaggaccttccttgaaccgggggagtccttcgtcgtgcccatgccatcctacatgtactatgagtacacgctccaggcccatgatgcaagggctgtccatgcacggtgggacgtcaacgagaaccgcctcgaccttgaatcggtcctggatgcggttgatgaatcaacccgcctcgtctttctctgcacacccaacaatcccaccgggggcctcatagataagaaggacatccgggctgttctggagtcaacagataccctggtggttgttgatgaggcctacaccgaatttgcaggtgtggacaacactgacctcctccctgaccatgaaaacctctttatcctgaggacattctcaaaggtgatgggacttgcaggtatgaggataggttatggtctcggggacccacagataatagagtacatgcaccgtgtaaagccggttttcagcctcacgaggctatcccatgcagctgcccttgcaaccatcagggacagggattacataaaaaaatccaccgagtactcaataaaaagcagggagtacctctactccgggttaaagaaattcccggaactgagggttttcagatcatatgcaaactacatactgattgacgtgagggggacaggcaggaccgctgccgaactctcagaagaactcttaaggaagggtataatcgtgagggactgcacttccttcacaggacttgatgaatactggatacgtgtcagtgtcggcacccttgaagaggatagaaggttccttgaggtcctgggtgaactggttcagtga

SEQ ID NO: 45207 - DNA, 1350 bp, Methanobacterium thermoautotrophicum
atgaaggagaaaaaaccgcgactcttcggtacatcaggtataaggggccgcttcggagagaaggtcacactggaactgacagctgaacaccggaaggccctggcaacccacctcggtggtgatggggaggttgttgtgggctacgatacaaggacatccagccagcttctggagaatgccctgatcgccgggatagtagaatgtggctgtgatgttacacgccttggaatggtccccacaccccttgtgggttacgcagcatcccgtctgggtgcagctgctggtgtgatgataaccgcatcccataaccccgccccctacaacgggataaaactctggaaccctgacgggatggcctacagaccatcgcaggagagggtcatagagtccataatacacagcagggacttcaaaaggaaggcctgggatgaactggggtccataaccacggttgatatgagggatgactatgtcagggcggtactcgaaaccgtggagattaaaaaacccctcaaggtcgtcattgactcagggtgcggcgcagcatcccacctgtctcccctcatattcaggaaggccggctgcagggtcataacccttaactctcagcctgatggtttcttcccgggccgtgaccctgaaccggtccctgagaacctctcggagctgatggagactgtgaggtcaaccggggctgatctgggcatagcccacgacggtgacgcagacaggatggttgcaatcgacgaccagggacgattcgcaagcttcgataagctcctggccctcatggcaagggagattggaggtaaaataataacaaccgttgatgcgtccctctgtgttgatgaatgcctgggggaccggggcgaagtcataaggacccgtgtgggtgatgtgcatgtggccaacaccattgcagaggagggggccaggttcggaggtgagccctcaggtacctggctgcaccctgatttctgcatgtgccccgacgggatactctcagccctcagggtggcggaacttgtatcagcaagggggcccctctcagagctgcttgaggaggtgccatcctaccccaacataagggacaaggtcccgtgccccgacgagaagaaggatatcataatggagagggtagctgctgagctcagtgaccagttcagcgagacatcagatattaacaccatcgacggcgtcaggatatccctcgatgatgggagctgggtccttgtgagaccatcagggacagagccctacatcaggatcaccctggagggaaagacagaggagaaggccaggtatatacatgaaaggacccgcggttaccttgaaaatgtgatagggtga

SEQ ID NO: 45208 - DNA, 1203 bp, Methanobacterium thermoautotrophicum
ttgtttatgagaggacagcttgatgctctgctcagggaggaaagggtttttaatccagacgaggaacttgcagaaaacagcaatataagggcctggatggacgcccggggtattgggggttatgatgagctccttgagagggccagctctgaccctgagtggttctgggatgagatggcatctgaactcgaatggttcagaccctacaccagggtccttgaatgggaaccaccccatgcccgctggttcacaggcgggaaattcaacatcacatacagtgcccttgacaggcatgttatgggtcctgagagaaacagggtggcatatatatgggagggtgaggatggtagcgtccggaagctcacctactatgacctctacagggaggttaaccgcctggccaatgcccttaaggatatgggtgtctcaaggggggaccgcgtcagcatatacctccccatgataccggaactccccatagccatgctcgcctgtgcacgtataggtgcagtccacagtgtagtgttcagcggcttctgggccaaggccttcagggagagggctgcagatgccggggcaaaggttgcgatcactgcagacgcattctaccgcaggggtaaggtaataagactcaaggaaacccttgatatggtcgcagatgagatcccctcccttgagagggtcatagtcgtgaaccgcatgggggatgatgtcagcatggtggatgggagggatatctactggagcgaggctgttgagggcatggacgatgaatgtccctgccaggagcttgaccctgaggatcccctcttcatactctacacctctggcacgacgggtaaaccaaagggtgttgtgcacacccatgggggctacgccgtgggtgtgagctctacctacaggttcgtcttcgatgttaaggaccaggacatatggtggtgtctggctgacataggatggataacgggtcacagctacatagtctacgcccccctcattgagggtgcaacctcggtcatctatgagggtgcacctgatcacccggatcctggaaggatatggagcatggttgagaggtacggtgtcagcatcctctacacagcacccacgacggtgaggctcttcatgaaatatggggacaagtggcctgagaagtatgacctcagaacactcagaatactggggtccgttgggaacccataa

SEQ ID NO: 45209 - DNA, 1143 bp, Methanobacterium thermoautotrophicum
atgattacactgatttttcccggcttcaacaatgttcatgtgagtggtatggatatcgaagagaagatcagaaagatagaagaggagattcagaagacaccatacaacaaggccacagcccaccatataggtaaactgaaggcaaagatctcccgcctcaaggaggaggccctccagaggaagacctcatctggaaaggggagaggattccatatcaaaaagtctggagactccaccgtggtcctcatcggttttccatctgttgggaaatcaacactcctcaacgagttaaccagtgcagagtcaaaggtgggtgactatcagttcacaacccttgagatcgtcccgggcgtcatggagtaccggggggcccagatacagatatttgacatacccgggataataaccggggcctcccgtgggaggggccgtggaagggagatactctcagttgccaggagcgccgacctcatagtgatagtccttgatgtcttcaacacagaccacatggacataatcctcagggagctgagggatgttggtataagacccaacgagacgccccctgatgtgattgttaagaggagaaaactgggtggtgtgaagctctcagcaacggtcgaactcacacaccttgatgagaagatcataaggtcagtcctcaatgagtacggaatccacaatgccgacgtcctcataagggatgacataaccgttgaccagttcatagacgtcatggaggccaaccgcgcctacataccggccatcaccgttataaacaagatagaccttgtggatgaatcctatcttgagggtctcagggagaaattcccggaagccctcttcatctccgcagacagggacatcaacatcgatgagctcagggaggaaatatttaacagactgggcctcataaggatatacctgaagccccagggtaaaaaggctgattacgacgaacccctcatcatcagggaagggtcaaccgttggcgatgtgtgccagaagctccacagggactttgtgcgtaaattcagacatgcaagggtctgggggagctctgttaaattcgacggccagaaggtgggccttgaacatgtcctcaatgatgaggacgtcctgaggatcataataaagaagtga

SEQ ID NO: 45210 - DNA, 2157 bp, Methanobacterium thermoautotrophicum
gtgagatccctgagtggtaagatgcatgaagttataatctgtgagaagcccaaatcatctgaaaagattgccggggccctctttccagacgccatgaagaaaaaacatggaaaggtgtcctactgggaacatgtggagggtgataagagggtcaccatagtatcagcggtgggacacctctactcactccgccccaggcagtccaacgaagaacacttttttgaccttgaatgggcacccatacacgagatcgataagaagaagggttacgttaaggattacctcaacgttataaggaaatttgcagccggcgctgaccgctacatccatgcctgcgattatgacattgagggtaccctcattggtttcaacgccctcaaatacggttgcggtgaggaggccctccggaagacctccaggatgaagttctcaaccctcacccgggaggagatacagagggcctacaagaaccccattgaggtcgactatgggcaggtcgacagcggcgctgcaaggcacatacttgattttattttcggagtaaacatatcccgctccctcatgaagtctgttaaggcggccacaaatcgtttcataaaattatccgccgggagggttcagaccccgaccctcgcgatactggttgaacgggagaaggagataagggactttaaacccgtcccctactggataatacgcgctgagctcggggaagggatcatcgccgagagcaagaggggcaagatcttcaagcgggagcttgtcgacagcatcctggagaagtgccagggaagtgacgctgaggttaaggatgttagggtgagggacaccatcagaaagcccccggtacccttcgacctggggaccctccagtcagaggcctaccgtgtattcggattcagccccaagaagacacagacaattgcacagaacctctacaccgagggttacacctcatatcccaggacatcatcccagaagctcccggaaagtatagggtacgaaaagatcctcaaaaaccttgcaaagaacccccgcttcggagtccacattgaaaggctcagaggccccctaaaaccccatgagggaaaaaaggaggatgatgcccacccggccatacatcccacaggtcttcttccatcggaactctcaaaggatgagaaaaaggtttatgacctcatagtccaccggttcataagtgtattcggtgaggatgccatcctccagaccatgaaggtagaacttgaaattggagaagaggagttcagcttctcaaggaagagggtcagtaaggcgggctggatggagagctacccctacacgaagatggaggatgaagaattccctgagatatccggcggagactctctggctgtcaggagtgtaagtgcagatgaaagggagacaaaacccccggcaagatacaacgaggcttccctcatcagggaactcgagaggaggggtcttggaaccaagtcaacacgtgcagatataatagccaaactctatgacaggaagtacattgagggtaaaaagataagggtcagtcccctgggtgagaacataattgacaccctcacaaggtactgtgagaagatcatcagcgaggaactcacaaggcagttcgagagggaactagaggacatcatgagggggaagataagcaaggaccgggttatagatgaggccatcacagaggtaagatccatactcagtgacatagaggagaacctcagggacatcgggaaggaactctacagggcctaccaggacagcagggttgtgggtgaatgccccgcctgtggtgggaagctcgtcataaaatactctcccagaaacaggagcacctttgtggggtgttccagctaccctgactgcaggaccgtttactcacttccaaggggcgccagtgtgcttaaaagtctctgtgaaaagtgcggtctccccatgatatcctatggaaggccgcggcagagggcctgtcttgacccaaaatgtggtaaaaagaaatcagaggttgaagaggttgtcggtaaatgccctgaatgtggttcagacctcataaagcgctccggacgttacggggaattcgtcggttgtaagggattcccgaagtgtcgcttcacctgttccgttgatgaggtccccgagggttga

SEQ ID NO: 45211 - DNA, 546 bp, Methanobacterium thermoautotrophicum
ttgacagatgtggatatcaaaatagaaaatattgttgcttcagcaacccttggaaaatccattgatcttcagacagttgcagaagcccttgagaatgttgattttaacagggaacagttcccggggcttgtgtacaaattaaaggagccgaagacggctgcactgatctttggatcaggcaaactcgtatgtacaggagccaaatcaatagaggactccaagagggccataaaactgacggttgacatgatgaggaccatggatcctgacataccagaggaatttgaaataaagatccagaacattgtggcctcggcgaaccttggaaaaccacttaaccttgaggctgttgcccttggacttgaaaatacagagtacgaacctgaacagttccctggactcgtttacagactggatgatcccaaggtggtgctcctgttattcggttcaggtaaggttgtatgtacaggagccaagagtgcagaggatgctaaacttggagttgaaaagactaaggcaaggcttgccgagttagatctgatttaa

SEQ ID NO: 45212 - DNA, 1287 bp, Methanobacterium thermoautotrophicum
gtggttaaaatgaacatgacagagaagatcctcgcagaggcagcaggactcagggaggtcacacccggcgagataatagaggcaagggttgacctcgccatgacccatgacggcacctcaccccccaccatcaggaccttcagggatatagcctcaaggggaggccccgctagggtctgggaccccgagaggatagtcatggtatttgatcacaacgtaccagccaacacaataggtgccgcggagttccagagggtcacaagggaattcgccagggaacagggtatagtgaacatattccagaacgcagcaggcatatgccaccaggttctgcctgagaggggatttgtaagacctggcatggtcattgttggggcggactcccacacctgcacctacggagccttcggagccttcgcaacaggcatgggggcgactgacatggccatggtctttgcaacaggcaaaacctggttcatggtacctgaggcaatgagaatcgaggttacaggtgaacctgagggccacgtgtatgcaaaggacgtcatactccacatcataggcgagatcggtgttgatggtgcaacctaccgttccgtggaattcacaggagacaccatagagagcatggatgtctccgggaggatgaccatctgcaacatggccgtggagatgggtgcaaagaacggtataatggagcccaaccggcagacccttgactatgtgagggcaaggacaggcagggaattcagggtttacagttcagatgaggacagccagtacctggaggatcaccacttcgatgtctcagaccttgaaccccaggtggcctgtccagatgatgttgacaacgtctaccctgtccacagggttgagggaacccacatagacgaggccttcctgggttcatgcaccaacggccggtacgaggacctgaaaatcgccgcagaggttataggcgacaggagggtccatgaggatgtgaggttcatagtctcgccggcatcaagggagatctaccttaaggcactggaggatggtataatagagaccttcatcagggcaggggcgatagtctgcaaccctggctgcggcccgtgcctgggggcccatatgggagtccttgccccgggggaggtcagcatagcaacaaccaacagaaacttcaggggaaggatgggtgaccctgcatccagcgtctacctggccaacccggcagtcgtcgcagaatccgccattgaaggggtaataagcgcccctcaacaggaggcaggaaatggatgttaa

SEQ ID NO: 45213 - DNA, 1929 bp, Methanobacterium thermoautotrophicum
atggagagggaagccgaaataagcgccatgatgaatgagataaggaggctttccccccgacagcgcgagagggctcgaagggctgtgaatggattgaacggtaagataaccgggagggagctgggatttcaccttgtcaagtacggaagacgtgaccccatagacacccagatatccgtgggtgacctcgtccttataagtaggggaaaccccctcaggagcgacctgacaggtaccgttgcaatgaagggtaagagattcctggttgttgcccttgaacatgttcctggatgggccctcaaaaatgtgaggatagacctctatgccaatgatgtgacctttcagagaatgattgacaacctcaaatccccaaccagaaacgttctcagggtcctgggtttcctctgtggtacagaaaaaccttcagatggggttgatgtggttgatttccaggctgtggacccggaactcaacgaatcacagagggatgccatcaggatggcccttggatcagaggatttctttctcatacacggcccctttggaaccggtaaaacccgcaccctccatgagctaataaggcaggaggtcatgaggggcagccgggtcctcgtaaccgccgagagcaacgcagcagttgataacctccttgagggaattgcaggtcatgttaaatgcgtccgcctgggacacccccagagggtttcaagggaaaacctgagggagacccttgcctataaaattgaaaaccaccctgaatacagtaaagtccgggaataccaggagaagatcgatgaactcatagaggaacgtgagaggcaccagaaacccaccccacagatcaggaggggcctcagtgacacccagatactcatcaacgccacaaagaggaggggtgcaaggggcatctcacccaacgtcatgatctcaatggcccgctggatagagacaaaccagaggatagatgacctccacagtaagcttcaggaggcagagatgagaatcgctgacaggatactccgggagagccaggttgtcctttcaaccaactcatctgcagccctcgagtacatagatggcttaaggttcgatgtcgccatcgtcgatgaagcatcccaggccacaataccaagcatactcataccccttgcaagggccccaagattcatactggcaggggatcacaggcagctcccacccacaatactcagcagagatgcatccgaacttgagaggacactctttgaagaacttatcaaacgccacccgggcagatccaggatgctgaactgccagtaccgcatgcacccggccataatggagttccccaaccgtgaattctatgatgggaggataagggcccatccatcccttgaggatatatccatcagggatatcatcgaggatgtccctgactccgatatctgccagaaactcgcagatcccgaccccgtcctcttcattgacacttcaggactggatggctgtgagcgcaggctaaagggttcaacctcaatacagaacccccttgaagcggaccttgcagttataatctcccgttcactcatgaggatgggtgttaaacctgaggagatcggtataataaccccctacgatgaccaggtggacctcatctcatccatgatagatgttgaggtgaacagtgttgacggattccagggacgtgagaaggatgttataataatctcaatggtcagaagcaatcggaatggcagtatagggtttctgaaggatttaaggcgtctaaacgtttcactcacccgtgccagacgcaagctcataataataggggatagcaggacactctcagcccacccatcctacaggcggctcactgaattctgcagaaaaaggggattccttgatgaagccggcctcgatgatgtcaggaagtggggtgcttcataa

SEQ ID NO: 45214 - DNA, 1254 bp, Methanobacterium thermoautotrophicum
atgccatataaagttaaagatatttcactggcccctcagggcgaaaaaaagatcagatgggttcaggaacacatgcctgtacttgaaaggataaaaagtgacttctcagaggagaaaccattcaaaggagtcaccataggatcatgccttcaccttgaaccaaagaccataaaccttggtctcacactccaggcaggcggtgcagaggtcgccatgaccggatgcaaccccctatcaacccaggacgacgccacagccgcgggggcgaagatgggactcaacatgtacgggtggcgtggggagacaaacgaggaatactatgagaacatacaccgcgtcctggaccatgaacctgaaatcctcatagacgatggtgcagacatgatattccttgtccaccgggagagaccggagctccttgatgggataataggtgcctgtgaagagacaaccactggtataaaccggttgagggcaatggcagccgacggagccctcaaattccctgtgatggcggtgaacgacgcctacaccaagtacctctttgacaaccgctacggtaccggacagtcaacctttgactccataatggggaccaccaacatgctgatagccgggaagaccgtcgtggtctgcggctacgggtggtgcggtcgcggtatagccatgagggctgagggacttggagccagtgtaatagtgaccgaagtggatcccataagagctcttgaagcacgtatggatggtttcagagttatgaaggtttcagatgctgttaaggaggccgatatactcataacagccaccgggaacacagacgtggtttctgaatccgaattcatgaacatgaaggatggctgtgtcatggcgaactccggccacttcaacgttgagataaaccgggaggcccttgaagagctctcaagggagacaggaaaggttaaggaggacatcgaggtgttcataatgcctgatggacgtaaaatatatcttctggctgagggcaggcttgtgaaccttgcatccgagcgtggccagggtcatcctgcagagataatggatatgagctttgcaatgcaggcactatcagcaagacacctcctccaggagaaaccagaccctggagtctaccgggcacccgatgagatagacctgatggttgcccggatgaaactcgatgccatgggcattgagatcgatgaactcacagaaaaacagagactctaccttgaaaactgggaagaaggaacctga

SEQ ID NO: 45215 - DNA, 2199 bp, Methanobacterium thermoautotrophicum
gtgggttgtatgacaaaaaaagagataaaattaaaggttgcagaggccctggcccagcaggacgtcgggaggggaatagcccgtgtggaccctgcatgcatggaaaaactgggtctttcggatggagacataattgaaatagagggcaaaaaactgacagctgcaacggtagtatcatcacagtccgacataggactcggaataataaggatagacggatacctccgtaaaaacgccggcgcatccataggcgaagaggtgacagtcagaagggccgacgttaaggacgcccagaaggtcgttctggccccagtggaccaggaggtcataataaggggggacataagatcagcattcctcaacagggtacttgttaagggagacataatagtatcaggtatcagacagcatatatccggcggcggactcttcgacgagttcttcagggacttcatggacatatcacccctcggagagatcaaactggccgtcgtatcaacaagtcccgcaggtgttgtgcgtgtaacaccctcaacacaggtcgagatgcagcaaaaacccgtggacgtcagcaaactcgagggcgtcaagaacctcgttgatgtcacctacgaggacatcgggggcctcaaggaggaggtcaaaaaggtccgggaaatgatagagatccccctcaagagaccggaactcttcgaaaggcttggaataacaccaccaaagggtgtcctcatgcacggaccaccaggaacaggtaaaacactcctggcgaaggccgttgccaacgagagcgacgcccacttcatagccatcaacgggcccgagataatgagcaaatacgtcggggggtccgaggagaggctcagggaattcttcgaggaagcagaagagaacgctccatcaatcatattcatcgatgagatagacgccatagcgcccaaaagggaagacgtgagcggagaggttgaaaggaggatcgttgcccagctcctcaccctgatggacggcctcaagagcaggggccaggttgttgtcataggtgcaaccaacagacccgacgcccttgaccctgcactcagaaggccgggccgctttgacagggaaatcgagataggagtccctgacagggaggaaaggaaggagatactccagatacacaccagggggatgccccttgcagatgacgttgacctcgatgaactggcagagataacccatggatttgtgggtgcagaccttgagtcactctgtaaggaatccgccatgagggtcctgaggagggtgctcccggagataaaggctgatgaggagatacccaaggaggtcctcaagaagatggtggtaacaagggccgacttcaaggacgccctcaaggagatacagccatcagccctcagggaggtcctggtacaggtccccaatgtttcatgggacgacataggaggcctggagggcgcaaagcaggagctgagggaggctgttgagtggcccctcaagtaccccgacagattcaagaagtttggaataagaccacctaagggtattctcctgcacggatcaccgggtaccggtaaaacactcctggcgaaggccgttgccaatgagagccaggcaaacttcatagcggttaagggtccggagctcctgtcaaagtgggtcggtgaatcagagaagggtgtgcgtgaagttttcagaaaagcacgtcagacagctcccacagtgatattcttcgatgagatagactcaatagcctcagtgaggagtggaagcaccgccgactccggcgtaacccagagggtggtcaaccagctgctcacagagatcgatggacttgaagagctgcaggatgtggcggttatagccgcgacaaacaggcccgacatcctcgaccccgcactcctcaggcctggaagattcgacaggcacgtcaaggttgaggatccagataaggaggcaaggctcgcaatattcagggtccacacaaaggacatgccccttgcagatgacgttgatcttgaaaaacttgcagagaaaactgagggatacgtcggtgcagacattgaggctgtatgcagagaagccgccatgctgaccctcagggataacatggacgccgaggaggtctcaatgaagtacttccttgaggccatggagaaagtaaaaccaaagggcggcgtagaggagcaggtccagtaccactaa

SEQ ID NO: 45216 - DNA, 1686 bp, Methanobacterium thermoautotrophicum
gtgattaatatgaacataggcccctataataacaggccggacatgggtcgcctcagggagatcataagggtcatgaccaagtaccacttcgggaacatccttgaggcggttggccttaaaaacagactcttcgagacccttaaattatatataaagagccctgaggaggtacatgaacccgcccatgtacgtctcaggctggttcttgaggaacttggaacaaccttcataaaactggggcaggtcctgagcacaagggcagaccttgtgggtagggaggtggctgaggagctggccaagcttcaggacgaggctccaccgttcccctttgaggatgtgaagagggtcctggaatctgaactcggagttcccatggaggaagttttcgctgaatttcaggaggaaccagtggcatcggcatcaataggacaggtccacagggcccgtctaaggaatggtgatgctgttgctgtgaaggtccagcgcccgggcatagccgacaccgtgaagagcgacataatcctgatgaagtaccttgcaaagcttgccaatgacagggtccccggtttgaggtactacaacctgccagggatagtggctgaattcgagagggccatcagaaaggaactggactaccaccaggaagccaacaatgtggagagattccgtgcaatgttcatggatgatgagaccgtttacgcgccctacgtttacagggagtactcaacaggcagggtactcaccatggagtatgtggacggtgttaagctcacagacattttaaagtcagatataaaattcaatgcacgggtgatagccgagaggggtgccaggtgttactttaaacagatattcatacatgggttcttccatgcggacccccaccccggcaatattctcgtccagaagggaaatgtcctctgtttcctcgattttgggatgatgggacatcttgatcgttcattcagggacagactggcagagcttttcatactccttatgaactatgatgttaacggtatagttaaccagctgaggtacatgaacatcctgacagaggagacagaccttgaggaggtcaagtatgacataatagacctccttgaccgctattacggtgccgatgtcaggaaggttggggagatactcacagagttcacaatgcctggtatgataaggaggcacaggataaggataccccgtgacttcgtgctgcttgcaagggtcatgagcatggcagaggacctgggtgagaggcttgatccaaggttcaatggccttgcggttgcatgggagatgacccataaactgataagaaaccggctcaaccccctgaggaaccttgatgaggtgcccgcggccatcattgaactggagcacataatgaatgatctcccccgtggcctgataagcgccctccagaagctggaggagggtaaattgaagatggaactggaacaccggaaccttgacgagatatcggtgcggattgaacggtcgaccaacaggatatcggttgccatgctcgtatcggcactcataataggttcatcgctggtcacgatcccccgggaggccctcatactcgagaagttccccttcctcgggatattcggttttgctgtgagttttctgatagccctcgcactcatagtatccataataaagtcaaggcgacttagctga

SEQ ID NO: 45217 - DNA, 1296 bp, Methanobacterium thermoautotrophicum
atggtgtctgatatgcgatgtgttgtgatagggggagggccagctggaagggccgctgcaatggagctcgcagccctcgacatggacgtaatacttgttgaaaagaaactgattggtgggacatgcctgaacgagggctgtatggttgtatgtggcctcaatgacgttgcaaggttccttgatgatgcccggcagctcagtgatcttggggtgctggatgttgaatgctcagcagactaccgccgcatagccgggggtgtgaagaggacccttgaacgtataaggcatgtcaccgagagggagaccctggatgccggtattgaaatagtgtacggtgtggcggagtttgaggatgataggctcctcgttgagggggaggagatggactatgacagactcataatcgcaaccggagcatctcccctcataccccccattgaaggcgccagcaaagccataacataccgggacatcctcgacctcgacggaatccctgacaagctcgttataataggtggaggagttatagcagctgaatttgcaggcatattctcttccttcggatcagaggtcacggtagtatcaagaagcggttttctcagtaaactggaccccctgataagggactatgtttcagaaaaggtcctcagcgatgtcagaatactggaggatacatcaaccacagaaatagatggatcaggtgttcagacgtctggaggctacatagagggcctcccaatgcttgcaacgggtctcagaccaaattcggatttcctgaaggggttccttgaactgggaccccgcggaggagttaaggtgaatgaccgtatggagacctcacgtcagaatgtatatgccgccggtgatgttacagggggccatggaacaacacccgttgcaaggatggagggggtggtggcggggctcaacgccgccggtattgagaggagggttgattaccgttacctcccctactcaatctccctcagatacgatgtcggattcgtggatattcccggtgagggtgggagggaagccgtgatacccggccttgcaggaccggggtcattctggggagttaataatggtaaaacagggatcagcaaggtcagaatccttgatgatggcaccccctcaggtatatactcggttgcgcccggtgcaaggctcatcatgccctacctctccctcctgatgaggctcggtgtgtccatgtatgagtttgagggcttcgttgagacccacccctccacggattccatatacaagctcatgaggttcctttcaaggtactga

SEQ ID NO: 45218 - DNA, 1158 bp, Methanobacterium thermoautotrophicum
atgatttctcctaaaaaatatgctaaagctgcaaaagtgccaccaaatggctttaaaacttcaaatgagttttttaactacgtctttaaggataaagaaatgatatggatgggtcagaacaccaaccatcttcatgatcactctgaaatagcggaagccatgattgaatgcataaatgagggcagctactgcaagtatccaccacctgaaggctttcctgagcttaaggaacttgtactgaaggatctgggccttggtgatgactttgaggctctgataactgcagggggtactgagtcactctacctgtgcatgaacgatatacttgaacccgaggataatgccataacctgtgacccgggctacctgataattgacaatttcgcaagcagatttgcatgcagcgtaaaatcggttcccatatacagcagtgaatgtgactacaagttaacacccgaccttgtacttgaaaacatggaccgcgacacccgtctcatatcactcatagatcccctgaatccgctgggttcctcgtatacaagggatgagataaaggcattcgctgacatagctgtggaccatgacgtttatctactccacgatataacctacagggactttgcaagggagcaccacctcgcagcagaatatgcacccgagcacacggttactgtctacagcttctccaagatatgtggaatggcaggtctgaggataggtgcaattgttgcaacatccgatatcattgaatcagtcaagggtatagtcataaatgatctcggtacaaatgttgtctcacaggcaggtgcaattgcagccctcaaatcaaaggctaaatgggttgaaaggatacgtaatgagaccctcggtaatcagaagatcattaaggctgccgtcgatgaggtggaaggagccttcctcccggtttatccatcaaatggtaacatgatggccatcgacatatatgaaacaggggttaaccccgttgaccttacagactacctgcttaagcggaagatcttcgtgaggcagggcgcctacaccagcaagatatttggtgataggtacatacgcctcagcttctcaataccaagagagcaggtcgagatattcgctgagaactttgtggatgtcatggaattcctgagaccatcctga

SEQ ID NO: 45219 - DNA, 1146 bp, Methanobacterium thermoautotrophicum
gtggtggttattggtggacgtgtagccggttcaacagcggcctatcacgctgcaaggctgggcctcagtgttctgttactggagcgtaaccctgaaatcgggacccctgtgcagtgtgcaggcggagtgagtgacagtttcttcaaatcaacaggtttaaaaccgcttcctgagttcacatgcacaaggatccgggcagccgcggtgaacggacccctcggtgccaggattgtgacagaaaatcctgttgtgaggggatatatcctcgaaagaaagtccttagacaagtaccttgcactgagggccgctgaagccggcgccgatgtactcacaatgtccatcgcaggggacctaatattcagggagggatcagtcagtggtgtggtgttcagggggcccgatggagtccaggaggttgaatgtggaatggtgattgccgcagacggtgtgcagtccagcatcgccaggaaggcaggtcttgaaacaggtttcaggccagctgacctctgctcctgtgtccagtacgaggttgcaggtgtggacgtggaccctgaaaccatggaattctacttcgggagccgttttgcaccatcaggttatctctgggtgttccccaagggtgaaggaagggcaaatgtgggccttggaatacgaagaaaaagctgctcagagaggggtcccctcagctatctcaacaggttcatggaggagagaggatttaagaggatagaattcaatgcaggagctgtacctgtttgcggacccattgagaggaccttcacagatggtctcctggttgtgggggatgccgccggacaggttgaccccctcaccggtggtgggatacaccttgcagctgaatgcgcaaaaatcgccggtgaggttgccgccgaggccattgaatctggaagggttgacggcagattcctctcaaggtatgagatgagatggcgcaaaaagattggtaagaaccttgaaaggtcactcaaattcaggaaaatccttgatgggctcggtgatgaggaactcgatgccctgctgagatcccttgagggaaaagatttaagttcaatttcaaagatatcccttctgaggattttaaaggactatccttcaatgttaaggatactcagagatattctttag

SEQ ID NO: 45220 - DNA, 1491 bp, Methanobacterium thermoautotrophicum
gtgagtgagcttcagaaacgtgccatgaggtttcttgaagacaagaaccccgttattgtatccaacagggggcctgtggaattcttcaaggaaaatgatgaaactgttatgaagaggggtgccggtggccttgtctcaacactgctgcccctcgttgaaaggttcagtggtgtctggatttcaagtgcaatgacagttgaggatgcaagggtcgcctcagggtaccctgagaacagggttccactccctgaagatgatcccagattcacggtttcattcgttatagtggatcgtgaacgatatgagtcatactacagcattataagcaatcctcttctctggttcgtccagcactacatgtggaatactccctacgatcctcagatagatgataaagtttaccgtgcctgggaagatggctatgtccatgtcaataaaaaatttggggataaggtgatatctgaaattgagagaaatgaaaaggattccctgattatgttacaggattaccatctttatttatgtcctttcttcataaaaaaggaaattggtgacgtctttttaagtcacttcatacatataccctggccacaaagggattacttcaatatacttcctgaaaggatgagggctgacataataggaggccttctatcaaataccatcctcggcttccatatagagagatactgcgccaatttctttgagtgctgtgaggaccttggttatgaggttgacggggacagaggtatcgtgaggaacggggatgaaaaaacccttgttaaaagttatcccatatctgttgaccctgaaagcatggaaaggaccgtcagctcccccaccttcatggaaaaggatgaatttgttcggaaattaaaggggaacatgtttctcatataccgcacagatagggctgatctcagcaaaaacataatacgtggtttccgggcctatgaattatttttgagggatcatccagaatttcatggaaaggtaaagtttcttgcaaccggtaaaccaacaagacagcagataagagaatacaggaattactctgaggaggtcaaagatactgtagaggagatcaacgagaaatatggtacagatgaatggaaacccattgaatacatttaccgtgccgactacgaacttgttgcagccgccttcaagaactatgactgcctgattgtaaatcccattgcagatggtatgaacatcgtgccaaaggaggctgcgattatcaatagagaagatggtgccctgatactctcagaacgggctggatgctatgatgaacttgctgagcatgtaataggtgtaaacccctttgatataaaggaaactgcagatgcgatttacagtgccatgaaaatgagtcccgggaaaaggaagaagctttcagaaggtcttaagtcaagggtccttaaaagaacaatctaccactggatcaacgagcagttcgatgattttgaggatctatgggaaagttaa

SEQ ID NO: 45221 - DNA, 1311 bp, Methanobacterium thermoautotrophicum
gtgattcgcatggcacggtatgtacaggatataaggggttccgttaaccgggatatagactgtcagtttgcactcaacctcgggatgctgattggggactatgtgagctgcaaacgcgtcctcataggacgggatgcccacaccccatctcaacttataaagagggccatcggaacgggattgatggctgcaggtgtggatgtaatcgatttcggtgtggccacagttccggttatacaccaccacatgaagagtttcgatacccatctcatgataaacgtttcccgttcaccactccgtgcagatgaaataaacatcaaacttctcagcaaccatgaaataccccttgaacagcgtcccaccctctatgcggaatatgaggaacttggaaagctgatgtatgttgataattatcttgaatcctatgttagatctgttcttcagttgatagtcccctctgttagtgaaagggagttcatggttgtgcttggatgcgatgagggctccccccataacgttgaaggtgagatactcaaccagcttgggtgtcagaccatcaacatcacattcaggggatccctctttggtaaaaactttcccatcgcaaatccatccagcatagccatgatttcagatgttgttaaggccgtgggtgcagacatgggggttatactggacaatgaccgggatactatcttctttatagatgagaggggacagctactaagggatcagactgttctatcaatatttgcagggcattacctttcaaggggggatgggccagtggtgtcctctgtggttgcatcaaaatccctggagagggttagcagaggacgtctcataaggacatctgttaacaacgttctcaatgaggttcacacaaacaatgctgtttttggcggtgatgaacctggaatgtacatattccctgaatttcagtgctgctatgacgccaccttcgcacttttaaagatgctcgaaatcattacagaggagaacaggacactccacgacctggcatctgagataggtaagtacagcagggttgaattcagtgtcgaatgtccgaacgagtttaaggatactgttattgagagactgctggagcagtttcaggaaagtgatcctgaacttattgatggtatacgggttgaggaccgggcgggagttattcttataaggccctcaagatttgaacccgttctgagggtttatattgaatcagaatccccggaggaaacccagaaaagatcacgtgatatgatagatcttataaagaaagaaatgagtgatctgtatggtgagtga

SEQ ID NO: 45222 - DNA, 1158 bp, Methanobacterium thermoautotrophicum
ttgttcatgacatctgttgttgtcatggcggggggaaagggtacaagaataagacccttaacattctcaaggccaaaaccacttgtacctgttgcaaacaggccaatcctcgattacataatccatagggttcttgattctggttacagtaaggttgtgatgacccttgggtaccttaaagatcagataagatcccacgttctcgcagagtaccctgagattgactttagattctcagtcgaaaagaagccacttggaactgctggaggtgtgaaggcagccgccagtgaaataaatgaaaccttcattgtactcagtggcgatgtaatctttgatcttgatctgcgagaaatggtaaaattccacagaaaaaagaatgcccttgtcacagtggcgctcacaccagttgaagatccctcacattatggaatagcggttctcgatgatgatgggaagataaaacgattccatgagaaaccacgccccgaagaggtcttcagcaaaatcgccaatgctggcatatatgtgatggaaccggaggtcattgaacacatcccccagggaagctctgacttttcagccgatattttccctgttctgatagagagggatgccgggatgtatggattccttttcgacggatactggaatgatgccggcaaacccaacacattcttaagggccaatcatgatgtcttgaatggaacagtgactcctgaacctgatggtgagatagctgaggaggtgcccggtagatttggaaagatatggatcggcagggatgtcgttatcggtgacagggtccgtattgtgggaccagcggtactcggggatggttcaagggtagatgatggtgcatacataggtaaaaacaccgtgattggatcccgtgttaacgtgggggagaacagctttataagggggtctgttattcttgatggctgtgtgattggaagaggttctcagcttctaaactgtgttgtagatgaagactgtgaaataggagcaggatgtgcaattgacagatgcgcaataattggtcgcggggcatttataggtccctccaccgttatcagatctcactgcagcgtcagtaaccgtctcaggatattatctggctcccttgtggactcagactatccgctggtacctgagtga

SEQ ID NO: 45223 - DNA, 795 bp, Methanobacterium thermoautotrophicum
atgcctgattatctatttgattttctggatgaactgaagtttctgaggaatggcaggaaaacagcgataattacagacatcgatggcaccataagtgaaatagcaccgacacctgaagaagccgttgtagacgatgaaatgagggatgtgctgagggacctcgcatcaagatacagagtcctggcatttataagtggaagacctgtccgtgaggcactccgcatggttggggttcccggtgcagtttatgttggaaaccacggccttgagtatataataaatgggaattatcagcgcttcagtgaggttgaagaatacatccctttaataaaaaaatgtgcccttgaactcagggataagatagatgaagagaacgtcatcttcgaggataagggcatctgttattccatacattaccgtcagtgcactgaccctgagctgtcacgcaaaaggatactcaaaaacctgcaggagatacctgaatcaaaggggcttaaggtggaccatggaagaatgcttgtggaactcaaaccaccccttcattacaacaagggcttcatagtgcggaagatactggaggattctgatgtgtcatccgcagtgtaccttggagatgatataacagatgctgatgccttcagggaaatcagaaaacttgaatcagaaagaggcatgaaaaacgtccccatccttgtattatcaaaagaaatacctcctgaggtaaagaacagcgctcgattttttgtctatggcatctccgaagttcttagatttttcagatggctcctaaaatag

SEQ ID NO: 45224 - DNA, 585 bp, Methanobacterium thermoautotrophicum
atgtacatatgctttgaaggaatcgatggttccggtaagacaacccatgccgccctgacggccagctggcttagggaaaacggttacatggtccatgaggtgagggaaccaaccgattctaatatcggcagccttataaggagcatgctttcaagtccagatgcccggacacctgatgttcagaggatgcttgccctcctctttgcagcggaccgtctgaccttgaggagcaaaattgagggtgactgggcagaggatgtggttgtaagtgacaggtgctactactccagcatggtgtatcagggacccgaggaatgggtctgtgagataaacaggttcgctccacgaccggatgttgtcatacttctcgacattgacgtggaggtggccatggagcgctgcggcgggaccgatgagtttgaggacccattataccttgcaggagtccgtgaaaggtaccttgaacttgcagataaaaacgggttctacactgtgaatgctgaaaggggggttaacctgatccagagggatataaggaggatactggccccccattttggcatatgttcagggggtataatgtag

SEQ ID NO: 45225 - DNA, 2001 bp, Methanobacterium thermoautotrophicum
atgatgaaaaccgtggataagagcaagacacttacaaaatttgaggaattcttttcactgcaggactacaaggacagggtatttgaggcaatagagaaatatccaaacgtcagatcaattgaagttgattatcttgaccttgaaatgtttgaccctgaccttgcagacctcctcatcgaaaaacccgatgatgtgataagggcggcccagcaggccataaggaacatcgaccgcctccgaaagaatgtggacctcaacataaggttcagcgggatcagcaacgtaatacccctcagggagctccggagtaaattcataggtaagttcgtggcagttgatggcatcgtcaggaagaccgatgagataaggccaaggatagttaaggccgtctttgagtgccgtgggtgtatgcggcaccatgcggtaacacagtcaaccaacatgatcacagagccatcactctgctcagagtgtggtgggagatccttcaggctccttcaggacgaatccgagttcctggacacccagacactgaaactccaggagcccctggagaacctttccggtggggaacagccccggcagataacagttgtcctggaggacgacctggttgacaccctcacacccggggatattgtgagggtgaccggcaccctcaggacggtgcgggacgagagaacaaaacgtttcaagaacttcatctacgggaactacaccgaattccttgaacaggaatttgaggagctccagataagtgaagaggatgaggaaaagataaaggagcttgcaggggaccccaacatctatgagaagatcataaggtccaccgcaccatccatacacggctaccgtgaggttaaggaggccatagccctccagctctttggaggaaccgggaaggaactggatgataagaccaggctccgtggggatatccacatactcatagtgggggacccgggtatcggtaagtcacagatgctcaagtacgtctcaaagctggcccccagggggatatacaccagcggtaagggtacctcaggggtcggtctcacagcggcagccgtgagggacgaattcggtggctggtcacttgaggcaggggccctggtcctcggggataagggtaacgtctgtgtggacgaacttgacaagatgcgtgaggaggaccgctcagccatacacgaggccctggagcagcagaccatcagcatagctaaggcagggataatggcaaccctgaattcccggtgttcggtcctggcagctgcaaaccccaagttcggaagattcgatagttacaagtcaattgcagagcagatagatcttccatcaacaatactatcacgtttcgacctcatattcgtggttgaggacaaaccggatgaggagaaggacagggagcttgcaaggcacatcctcaagacacacaaggaggaccacatgcccttcgagattgaccctgaactcctgaggaagtacatagcctatgcaaggaagaacgtcaggccggtcctcacagatgaggccatgcaggtcctggaggacttctatgtctccatgagggccagcgccgcagatgaggactcaccggtccccataaccgcgaggcagctggaggcccttgtgcgtctatcagaggccagtgccaagataaaacttaaggaacatgttgaggcagaggatgcaaggaaggcaataaaactgtcacaggcctgcctcaaacaggtcggctatgaccccgagacaggcaagatagatatagacaaggttgaggggaggacaccaaaatcagagagggataagttcagacttctccttgaactcataaaggaatatgaggatgactacggtggcagggcacccaccaatattcttataactgagatgatggatagatataatgtaagtgaggaaaaggttgaagaactaataaggatcctcaaggacaagggagccatatttgaacccgcaaggggataccttaagatagtctga

SEQ ID NO: 45226 - DNA, 1011 bp, Methanobacterium thermoautotrophicum
atggagaagattcttgtaaccgggggggctggtttcatagggagcaacttcataaggtacatgctccaggaacacccctaccatataataaaccttgacgccctcacctactgcggaaaccttgagaacctgaggggggttgaggatgaaccccgctacacctttgtgagggggagcataaccgacaggaaactcgtggatggaatcataaaggacgtggacgccgtcattaactttgcagcggagtcacatgtggaccgcagcatcgaggatccagagatattcataaggacaaatatcctgggcacacagactctgctggaggcctcaagaaaacatggagttgaaaggttcatacagatctcaaccgatgaggtctatggttcagcagagaagggttacttcacagaggagacacccctggcacccaacagcccctactccgccagcaaggcctctgcggatctcatggtgagggcatatcacaggacctatggtctgccagtcaatataacccgctgctcaaacaactatggaccctaccagttccctgaaaaactcatacccttaatgataacaaatgcccttgagaataagccgctgcctgtctacggtgatgggatgaatgtcagggactggatacatgtcctggaccactgcagggcagttgaccttgttctgcaccgcggacgtgtaggtgaggtctacaatatagggggtaacagtgagaggaggaacatagagatcgttgagctgatagtgagggagcttggcaaggatgaatccctcataaggttcgttgaggaccgcccgggacatgaccggagatatgcaatcgatgccagtaagatacggaatgaacttggctggaagcccctttactcatttgaggagggtatcagggagaccataaggtggtacattgataacagggactggtgggagaatataaagagcggggagtacctcaggtactatgagagaatgtacggtgggaggctccaggattag

SEQ ID NO: 45227 - DNA, 879 bp, Methanobacterium thermoautotrophicum
atgaagggaatagttcttgcaggtggctcagggacccgcctctacccgataacaagggctgtttcaaagcagctgctgccgatctatgataaaccaatgatatactaccccctatccgtccttatgctggcgggaataagggacatacttataatatcaacaccccgggaccttccactctacagggatcttctgggggacggctcgcagttcggggtcaggttctcctacagggtccaggaggaaccccgggggattgcggatgcattcatcgtgggtaaagatttcataggggactcaaaggttgcccttgttctgggtgacaacgtcttctacgggcacaggttcagtgaaatactccgcagggcggcttcactggaggatggcgctgtcatattcggttactatgtcagagacccgcgtcccttcggggtggttgaatttgacagtgaaggcagggttatctccattgaggagaaaccatcacggccaaaatcgaattacgttgtacccggcctctacttctatgacaaccaggttgttgagatcgcaaggaggatagaaccctcagataggggtgagcttgagataacatcagtcaatgaggaatacctcaggatgggtaaactcagggtcgagctcatgggtcgtgggatggcctggctggatacagggacccatgatggtctccttgaggcaagcagcttcatagaaacaatacagaagaggcagggtttctacattgcatgcctggaggagatcgcctacaacaatggctggatcaccagggaggatgtgcttgaaatggccgaaaagcttgaaaaaacagattacggtaagtacctcagggaccttgcggaggggaacttccatggctga

SEQ ID NO: 45228 - DNA, 1545 bp, Methanobacterium thermoautotrophicum
atgaagtttttatatctgcttcaacataatactattaatatggtctgtggtggttttatgaatattgtgattgttggagctggattcgggggaatatctgcagcggcactccttgcacagaaggggctggaagtaactgtcattgagaaaaatgagggtcctgggggacgtgcaagcgtctacagtgaggggggattcacctttgacatgggaccatcatggtacctcatgccagacgtctttgaaaacttcttcgcagagttcaatgccaggccagaggatttctatgacctcaaaaaacttgaaccagcataccgcgtattctttgacgggggaagggtagttgatgtatcatctgatattgaaaagaactatgaactctttgacagctttgaggaagatgggggtgaaagactcagggagtacctggaatcagccggtaaactctacgactcggttgtgaaggaaatgctctacagggactacaggtcagtcctggacttccttaatggaaagctcctgctacagggattgaggctcaacatactcgaatctcttgaacacttcgttaacaggcgatttaagagtgacgaggcccgcaagatactccagtactcaatgggattccttggaagcgcaccacagaacacaccctcaatgtatcatataatgtcccatatcgacatgacccttggagtcttctaccctgaggggggtataaggagggttgcccaatcaatatatgaactcgcccttgaacatggagccagattccacttcaacgaggaggttaaaaggatagaggtaatcgatggagtggcaacatctatcataaccgacaggaacatctatgaagctgatgcggtcctggtgaatgcggattacccccacagtgaactggaacttcttgatgaaccccacaggacctatgatgaggcatactgggagtccagggtaatggcaccatcagcctttgtagcctacctcggagttgacagggttatagatgcccttgaacaccacaacctcttcctggagagggactgggccgataaattccaggaggtatttgacccccggagggcgaggtggccagagagaccatcctactatgtgaatgtaccatcacggacagatacgactgctgccccccagggatcagacaccctcttcatactggtccccctcgcgccgggcatggaggataacgaggaactcagggagggcctctaccggagggtcatggatgaccttgagaggaaggtgggtgaaaatatacgtgaccatgttgttgtgaagaggatattcgccataaatgatttcagggaccgttacaatgcatacaggggcacagccctgggtctttcccatacactcagacagacagccctctggagaccatcacataagagtaagaaggttaagaacctctattacacgggacattacacccatccaggtataggcgtgccgatgacacttatctcctcccagatagtctgcaacgagatgatggatgatatgggaattaatccggatggatga

SEQ ID NO: 45229 - DNA, 543 bp, Methanobacterium thermoautotrophicum
atgcaggtcaaaaatacagaggaactcagaagggagcttatagaacttctgtctgaaatggatgtcgttcagaggggtaaattcatcctctcatcaggcagggaaagcgattactacgttgatataaagagggcggtaacggagccggctgtccttgacgttatagcgaggttaatagccgatgcggccggtgaagtggacaggatagcaggtcctgcccttggagcggtcccaatagccactgcggtgtcactctactccagaaaaccgctcctgatgataagaaaggagaaaaagggatacggaacatcaaaactcattgagggggatctgcagaaaggtgacagggttgccgtggttgaggacgttacaacgactggcgggtctcttcttaaggctgttagggcaattcaggagaacggtgggatcgttgagaaggcatttgttattgttgaccgtgaggaaggggctgtagacgaatttaaaagggagggcataaccctcatacccctcctttcggtatctgacttcaaccattcctga

SEQ ID NO: 45230 - DNA, 564 bp, Methanobacterium thermoautotrophicum
gtgggcagagtgcatgttgatgggggtaaatcaacacgtgacctcatagacgccaggaaactgattgagctgcttccactgaaaccaggagatacgttcctcgatgctggatgtggtgatggcttcatttcacttgaggcggtgaatgctgtgggagatgagggaatggtaattgcagttgacatatacccaccatcagttgaagccctcagatcagccgcttcagggatcaaaaacattgtaacactccttgatgatataacagggaggcttccggtccccgatgggacagttgacatttatttcatggcaaacgtgttccatgggatagttgcaaatggggaggttgacctcctccttgccgaggtgaggagacttctgagggatgatggtaaactcgccatagttgattttaagaaaattccaggaaccccgggtccacaccttgacctgaggctatctgaggatgaggtcatcgggatactcagggaaaagggatttgaggtcgaggatgtggtggatgcagggtcttttcattatcttgttgtggggtctcctttgtga

SEQ ID NO: 45231 - DNA, 1125 bp, Methanobacterium thermoautotrophicum
atgatcatgaggaaatttgcctcccgtgtaaaggatatacagctttctgagataaggaaaatatttgaggttgcagatgaggatacaataaaccttggcataggtgaaccagatttcagtgtccctgatcatgtcagggaggctgttaaggatgctgttgacgagggcctgacccattacacctccaacatggggatggaggagctgagggaagccatagcagataaacttaaaagcgaaaacagggttcatgctgaaccagaatcaataatagtgactgtgggtgccagtgaggccatattcatgtgcacccaggccctccttgacattggtgaccatgccctcatacctgaccctggttttctatcctatgatgcctgtgtccggctttccggggcagtgagcatacccgtgcccctcagtatggatgaagggttctcgatgagccctgaaagggttgaatcactcatcacccaggatacccgggtcataataatgaattccccatcgaacccaaccgggagcgtcatgggaaaggatgatgtgaaggggattgctgagatcgccgaggacaatgacctgataataatatcggatgagatctatgagaagataatctatgatggaaaacactacagtccggcgcagtttacagataacgccctcatagtcaatgggttttcaaagacctatgcaatgactggtctcaggatcggttacgttgccggctgtgaggatataattgaggagctcctgaaggtccaccagtacaacaccgcctgtgccccttcaatatcccagtacgcagcccttgcagccatcagggggcctcagaactgtgttaaggatatggtggatgagtttagaagaaggagggaccttatgttccgttccctcactgatatgggccttgaatgtgtcctgcccggcggggcgttctacatgttcccgtatgctggggactcagaagaattcacaaagctttcacttgaagctggagttgcagttgtcccgggatccgcctttgggaatgaagggaaaggttacatcaggatgtcctatgcaacatcctatgagcttatcgaggaggctatggaacgacttaaaactgtctgtggtgtttaa

SEQ ID NO: 45232 - DNA, 621 bp, Methanobacterium thermoautotrophicum
atggcaaattttttcacaaacttcctggataaactgcttggaaggaacaagaaacttaagattggactctatggtcacccaaattcaggtaaaacaaccctggccaacagaatgtgtgaggactggcttggaaaaccactgggtttaacatcagagataccccacgagacaaggactgtttacaagaaggagaaggtaaccataaaaaaggatggcgccgaacttgactttgatatcatcgacaccccggggatagccaccaaggttgactacaagaacttcctggagtttggattatcagaacccgaggccaaggaaagggcaaaggaggccacaaagggcataatcgaggccataaaatggctggacgatgtcacaggggttctacttgtaatggactcatcacaggatcccctgacacaggcgaacataaccataatagggaacctggaggcaaggaagatacccttcctgatagttgccaataagatagaccttcctgattcctcacctgagaggatcgtatcggtctttccccagcacacagtcgtccccatatccgcactgcacggtgagaaaacagaggacctttacatggaaatggttaaaaaattcagatga

SEQ ID NO: 45233 - DNA, 1476 bp, Methanobacterium thermoautotrophicum
atgttcagtaaaatccttgttgcaaaccgtggtgaaatagcaataagagttatgcgtgcctgcagggaacttggaataaagagcgtggctgtttactctgaagcagacaaaaacgcccttttcacaagatacgccgatgaggcatatgagataggaaaaccagccccatcacagagctacctcaggatcgacaggatactggaggtggccgagaaggcaggcgccgaagccatccacccgggctacggtttcctcgcagagaacccccgcctcggagaggaatgtgaaaaacagggaatcaaactcataggtcccaagggctcagttatagaggccatgggggataaaataacctcaaagaagctcatgaagaaggccggtgtacccgtgatccccggtaccgatcagggcgtcagtgaccctgatgaagccgccaggatagctgattccataggttaccccgtcattataaaggcatctgcaggcgggggcgggatcggtatgcgggctgtctacgaggaggatgaactcataagggccatggagtccacccagtcggtggctgcatcagccttcggggaccccaccgtgtacatcgagaagtaccttgaaaggccacggcacatcgaattccaggtcatggcagatgaatcaggcaacgtgatacaccttgcagacagggagtgctcgatacagaggaggcaccagaaactgatagaggaggcaccgtcccccataatgacaccggaactcagggagaggatgggatccgctgcagttaaggccgctgaatatataggctatgaaaacgcaggtacagttgagttcctttactccaacggggacttctacttccttgagatgaacaccaggatacaggtggaacatcccataacagaggttatcacaggagtcgaccttgtcaaggaacagataagggtcgcctccggagaggaacttcgcttcacccagaaggatataaacatcagggggcatgccatcgagtgccgtataaacgcagagaacccccttgcagatttcgcgccaaaccccggtaagatcacaggttacagatccccagggggtataggtgtgagggttgacagcggcgtttacatgaactatgagataccccccttctatgattccatgatatcaaaactcatagtgtggggtatggaccgccaggaggccataaaccggatgaagagggccctcagtgagtacataatactgggggttaaaaccaccatacccttccacaaggccataatgaggaacgaggcattcaggcgaggcgaactccatacacacttcgttgacgaatacagaaggggtatagacgccgagatgcgaaaaatcgttaaggaggaccaggagatggttgaacgtctccagtcaacatttctcccatcaaagaaggttgccgccatatcagcggcgataggaacctacatgcattcaaggagggggtga

SEQ ID NO: 45234 - DNA, 1200 bp, Pyrococcus abyssi
gtgaatataatgagcggtgacgaagttcaattccacgaaaattacgatgattacataacttacctcaagaggagaataaggcagcttgaactccaagtgagaatgcttgaagctgacaaggagagactcgagagggaattatcgaggcttagatccgaaatgtcgcgattaaggcaaccaccggcattcgctggaaccgtgatagaggtacttgacgatgacagggccatagttcagaactacaacgggccaaggttcgtggttaggatagcgccatggatagagagggacaagcttagaccaggggctagagttgccctggatcagaggacaatggcaatcatagagttgctaccaagctccaaggacccaaccgtcctaggatttgaggttatagagaggcccaatgttacttacaacgacataggcggcctaaagaagcaactgcaagagctaagggaagcgatagagttgccacttaagcacccagagctctttgaggaagtcggtattgatccgccaaagggcgttctcctctatggcccacctggatgtgggaagacattgatggcgaaagctttagcgcatgaggtgaatgcaacgttcataagggtcgtcggaagcgagctggtcagaaagtacataggcgaaggtgctaggctagtccacgagctctttgaattggccaaagaaaaagctccaactataatattcatagacgaaattgatgcaataggtgccaagagaatggatgagaccacaggaggagaaagggaagttaatagaacattaatgcaacttctagccgagatggatggcttcgatcccaggggaaacgttaaggttatagccgcaactaacagacccgatatattggatccagcacttcttaggccaggcaggtttgacagactcatcgaggttccgttgccagacttcgaaggtaggcttgaaatactcaaggttcatacgaggaggatgaagcttaagaacgttgatctaagggtcattgcagagataacagagggggcaagtggagcggacttaaaggccatagctacggaagcgggtatgtttgccataagggagaggagaacgtacgtaacccaggaagactttctaaaagcagtcgataaggttcttggtaacgagaggaagttactgcaacagataacttcccatgagataatatacggttaa

SEQ ID NO: 45235 - DNA, 1797 bp, Pyrococcus abyssi
gtgtgcgggataatagggtacataggacccaggaaggcctctccaataatcgttgaaggtctaaaaaggcttgaatacaggggctacgattcagctggaatagcgacatctcacgaagggaggattctaataaagaagggagccgggaagattgatgaacttgccaagaggttgaacttcacggaccttcctgggaacatcggaattggacacacgaggtgggcaacccatggaataccgaacgacacaaacgctcacccacataccgattgcaccgggaagatagtggtagttcacaacgggataatagagaactttcaagagctcaaggaagaactcctaaggcaagggcacgtattcaggagcgacacggataccgaggttatagctcacctaatagaggagaacttaaggataactggaaactttgaggacgcgtttaggttgtccctgcttaggctcaggggctcatttgccttggtcgtcatgtttgccgatgatcccgaaaggctctacatagctagaaaggacagccccctcataattgggattggaaacggggaaatgttcattgcgagtgacattccagcttttctcccatatactaggaaagcagttttcctggatgatggagagtatggagtggtatctaggaacggatttaccgtgaaggacataataaccggaaaggagaagaggaaaaaagtgtatgaaatccaatggaccttagaaatggccgaaaagggaggatacgaccacttcatgctcaaggagatatttgaacagccaagagccgtgaaagatgccatatatggaaaccttgaggaagtcccaaagatagcagggctgttatctaagtacgataggataataataacgggaatgggaacctcttatcacgccgctctcgttggaaagtatctaattcaaaggttcgggaaaattccagtcctcgtagaggaggcaagcgagctcaggtacgagtatgaggatatccttgacaacaagactttactcattgcaataacccagagtggcgagacggcagatacagtagctgccatgaagctcgcgaaatccaagggatcaaaagttatagggattgtaaacgtcgttggaagtttggcaaccagaatagcggatgccacgctttacactcacgctggaccagaaattggcgttgcggcgactaagacttacacgacccagttaacggttctcctcctactatctctagagctcggaaagatgaatggagtagatacaactcaagtagagaacaccctaccaaagcttccagagttgatagatgcaggactcaagatgaacgagaagataaaggaacttgccaagtccctaaatgataggagagacttcttctacataggaagggggattagctatccaacggccctcgagggggcccttaagataaaagagatcgcttacgttcatgccgagggattatcggctggagaactaaagcatggaccccttgccttaatagaggaaggggttccggtaattggggtagccccaagtggaaagaccttcgagaagatgttgtcgaacatcgaagaggccaaggctaggggagggttcataataacggttggggacgacctaaggttgcaccaagttagtaacgtattcataaggctacccaaggttccggaggaggtaagtcccataacgtatatagttccgcttcaattgctcgcgtatcacttagcggttctaaagggtcataacccagacaggccaaggaatcttgcgaagtccgtaaccgtggaatga

SEQ ID NO: 45236 - DNA, 594 bp, Pyrococcus abyssi
atgaacaggaagaccggaaccacaacggtaggaataagggttaaggatggcgtaattttagctgctgacactcaagcttccctcgatcatatggttgaaaccctcaatataaggaagatcatcccgataactgacaggatagcgataacaacggcgggaagcgttggagatgttcagatgattgcgagaattctcgaggcagaggctagatattaccaattcacctggggcagaccaatgaccacgagggcgatggcgaacttgctgagcaacatcctaaacgagaacaagtggttcccatatttagttcaaatcataataggaggctacgttgacgagccaacgatagcaaacctagatccccttggaggattgatattcgacgactatacagcaacgggctcgggaacaccatttgccatcgcaatacttgaagagggctacaggaaaaacctaggaatagagaaagccaaagagcttgcaataaaagccgtaaaagcggctggagctagagatgtttacaccggaagcaagaaaatccaagtggttacaataacgaaggacggcatgaaagaagagttcgtgaccttgtaa

SEQ ID NO: 45237 - DNA, 1071 bp, Pyrococcus abyssi
gtgatgatcatgggtaagaagagtagcgatcctgcggtcgttgagataaatgatgttgatgagcttgagctggaagttggagaggaagttacctctaaaaagaaaaagaaggaaaaagaaataaggacgattgaagatcttcctggagttggaccggcaaccgccgaaaaactaagggaggctggattcgacactttggaggcaatagccgttgcatctccaatagaacttaaagaggtagcgggcattagcgagggcgccgcgctcaagataattcaagccgcgagaaaagccgcaaaccttggaaccttcatgagggctgacgagtaccttaagaagagggagagcatagggaggatctccactggaagcaaaagcctcgacaagcttcttggtggtgggatagaaacgcaggcaataacggaagtctttggagaattcgggagtggaaagactcagcttgcccacacgttggctgtaatggttcaattacctccagaggagggcggtctaaacggctcggtcatctggatagatacagagaacacgtttaggccggaaagaataagggaaattgctaagaaccgtggccttgatccagatgaagtccttaagcatatatacgttgccagggcgttcaacagtaaccatcagatgctcctagttcaacaagctgaagacaagattaaggagctcctcaatactgataagcctgtaaagcttctaatagtggactccctcacgagccacttcagaagtgaatacataggaaggggagccctagctgagagacagcagaagctcgctaaacacttggcagaccttcacaggttggcaaatctctatgaaatcgcggttttcgtaacgaatcaagttcaagctagaccagatgcattctttggagatccaacgaggcccattggaggtcacatactagctcacagtgcaaccctaagggtttacctaaggaagggtaagggtggcaagagggttgccaggttaatagacgctccacacctgccagagggagaggccgtgttcaggataactgagaagggcatcgaggattaa

SEQ ID NO: 45238 - DNA, 792 bp, Pyrococcus abyssi
atgctgaagatagacctctcaggtaagctagcattcacgacagcttcaagcaagggcataggattcggagttgcgagggttttggcgaaggctggggcggacgtgataatactctcaaggaatgaggagaacctaaaaagagcaagagagaaaataaaagaagaaagcaacgtcgaagttcattacatcgttgctgatttaaccaagatggatgatttggaaagaacagtgaaagagttaaaaaatataggagagccagacatattcttcttctcaactggaggtccaaagccgggctacttcatggagatgagcatggaggactgggaagaggcagttaaattactactttacccagcgatatacctaacgaaggccctagttccagcaatggaaaggaaaggattcggaaggataatctactcaacgagcgttgccataaaggagccgataccgaacatcgcattaagcaacgttgtcaggattgcaatggccggattggtgagaactttggccaaggaacttgggccaaagggaataaccgttaacgggataatgccagggataataagaactgacaggatgatacagctggcccaggatagggctaagagggaaggcaaaaccgtagaagaagctttgcaagagtacgccaagccaatacccctaggaagacttggagaaccagaggaaatcggttacctagttgcgttcctggcgagcgatttaggaagctacataaacggagcaatgatacccgttgatggaggaaggttaaactcagtattctga

SEQ ID NO: 45239 - DNA, 1485 bp, Pyrococcus abyssi
gtgagccccgtggaggggtacattttatcgcttgacgaaggtaccacatcggcgagggcgatagtgttcgacagggaggggaacataaagggcatcggtcaatacgagtttccacagtactatccaaagcctggctgggtggagcataacccgatggaaatctgggatgcccaggtgagggcaataaaaactgcaattcaaaaggctaaggttgaaccggcccaaataaaggcgattggaataacgaaccagagggaaactacaatagtttgggataaaaacggcaatcccctttacaatgccatagtttggcagtgtagaaggacggctgaaatggtagaggagataaagagggagtatggagacttaatcaaggagaaaactggattaattccagacgcttacttctctgcaagtaagataagatggctcctggacaatgttcctaggctgagggaaaaagcagagaggggcgaggtcttatttggaaccgttgacagcttcctgatttacaaattgactggagaacacgtcaccgactactcaaatgcatctaggactatgctattcaacataaagaagcttgattgggatgaagagctactcgaaatcttcaagattcccgagggtatattgcctgaggttagggagtccagcgaaatatacggttacactaggattcttgggaatgaaattcctgtgagcggagatgctggagatcagcaagccgcactctttggccaagctggctttgaaactggaatggtgaaggccacgtatggaaccgggaacttcatacttgttaacactggaaagaccgttcgttactctgagaatttgctaactacgatagcttggggcttggatggaaaggtaacctacgccctcgagggaagcatattcatcaccggggcggccgttcagtggctacgcgatgggataaagataattaagcatgcttccgaaactgaggacctcgcagaaaagctggagagcaatgaaggtgtttacttcgttccagcgttcgttggtctaggggctccctactgggatcagtttgccagagggttaataataggtataacgaggggaaccggtagagaacacttagcgagggcaactttagaggccatagcttacctcactagggacgttatagaggagatggagaagttggtcggcataaaggagctccgtgtcgatggaggggcgacagcaaatgacttcttgatgcagttccaagctgatatcctcaataggcgcgttgttaggccagtggttaaggagacaacggctcttggagcggcttaccttgctgggctggcggtagattactgggagagtctagaggaaatagaaagcctctggagggtcgaaaaaatttttgagccaagaatggatgaagaaacgagggaaaagctttaccgtggatggaaggaagctgtgaagagggccatggggtgggcaaaggtcatttcttcataa

SEQ ID NO: 45240 - DNA, 1494 bp, Pyrococcus abyssi
atgggtacgagaacgaaggtcgccataattggggcagggattacgggggctagcatagctagggttctaagtaagtacgagaacctcgaagttcacctaatcgagaagaatccagacgttggctggggtgttagtaaggctaatactgcgataatccatggaggctacgacgacgaccctgaaaagtatccaatgagggcgaggttctgtgttaaggggaacaggatttggcacgagtgggttaagcagctagaaattcctcatgtctggaacggtgctttagtagttgccctggaagaggaggatttcgacgagctggaaaagttactggagcgcggaataaaaaatggagtcccagagatgagaattgttgacaaggaagagctctttcagttagagcccggtttgaatagaaatgctcttggagccttgtgggttccaatagttgggcaaatagctccgattccagccgttatagccctcgtggagaatgccgttgcaaatggcgttaagactcacctagaaactaaagtcaagggaattaaagttaagagaggtgaagttagaggcctagaaactaacgatggctttatagaggctgacataatcattaacgccgctggactttatgcggatgaaatatcgaggatggttggcttagattattttgagattcgtcccaggaagggagaatactggatattcgacgagggaattcctgggccaaagagggttcttttcccgacgcctaccccgataagcaagggaatcgtcgtcacaacggagattagcggacacttaatgataggtcctaatgctaaggacttatctcctgaagaaaaggagaatacagcaacaactagagaagggttggacgaagtctgggaaggggccaagaaactgtggccaaatttgccaccaaggagtaaggtaataagaacttttgccggcttgaggcctgaacctacaggtggagatttcataatcagagctgaggaggaagtttggggcttcataaacgttgcaggtataaggtctcctggcctgacgagcgctccggctatagcttactacgtggccgagctgatagagagggagctcgacgttaaattgattgagaagaaaaactggaacccttacagaagggactttcccaggattgccatgcttcctcctgaaaaggcaaatgagctcataaggaggaatcccctatacggaaagatagtgtgtagatgcaacacggttagcgagggtgagatagttgaagcgataaacagaatgaagttcataggggttaagagcccgagcatagactccgtcaagttcagaactaaagccacaacgggaacctgtcagggagctttctgcaggccaagaataattcagattttggccagagaatacaagttgcctccttggaagattaggctaaacgttcctgggagcgaaattgggattggggatgttaaggtgttaacgaggggtgagaactga

SEQ ID NO: 45241 - DNA, 2259 bp, Pyrococcus abyssi
gtgaatacgatgtacctaaggaaggagcttttgcagccaagactttaccaggaacttatctacgctaaatgcaaggagaggaattgcttgatagttttgccaactggattgggtaagacgataatagccatgatgatcgccgattataggttaaataagtacggcggtaaggttttgatgctcgctcccacgaagcccctcgttcttcagcacgcggaaaccttcaggaagttctttaaccttccccccgagaagatagttgccctaacgggcgaggtaagtcccagcgagagggtgaaggcttggaatagggcgaaggttataatcgcaacgccacaaactgttgaaaatgacctccttactggaaagataaaccttgaagatgtcgttcttgtgatatttgacgaggcccatagggccgttggaaattacgcttacgtttacatagcaagggagtaccttaaccaagctaagaatccccacgtcattggcctgacggcatcccctggtagctcccaggagaagatactggaagttctaaggaatttaggaatagagcacatagagtatcgctccgagaattccccagacgttaagccgtacgttcagggtataaagtttgagtggattaaggtggagctccctgggctttacaaggaggttaggaaattacttagagacatgcttagggactccttgaagcctctcgctgaggccggtttgatagaatctgcctcggctgatcttcctaagaaggaaatcttgagggccgggcagataataaacgaggagacggcaaagggcaaccacgatctgagaaagctactcctctttcacgcgatggcgttgaagcttcatcatgccatagagctcctcgaaacccagggcttatctgccttaagggtctacctaaagaagctatatgaggaggcaaaaactggctccaccagggccagcaaggagttattcctggacaggaggatgaagaaggcgttggcattgctaatccaggcaaaggaacttggcatcgaccatccaaagatggaagttctgaaggaacttgtaaaggaacagctctccaagaaagaaaactccaagataatagtcttcaccaactacagggagaccgcaaggaaggtcgttgaggaattaacgaaggaaggaataaaagctaagcggttcgttggccaagcgacgaaagaaaatgataggggaatgagccaaagggagcaaaaactaatcctagattcctttgctaggggagaatttaacgttctagtagctactagcgttggcgaggaaggattggacgttcctgaggttgatttggtagttttttatgagccagttccatccgcgattaggagcgtccagaggagggggagaacgggaaggcaaaagccaggtcgagttgtcatattaatagcccagggaaccagggatgaggcctactattggagctccaagcataaggagaggcagatgagggagacgataaggatggtaagccaagcgataaagagggagaagcagctatcccttgaatcttacgtcaaaaaggacacagagaaggaaatggaaagggaggaaaaagaggaaagaaaaggagagagggaaggtgtaaaagtggtcgtggatagcagggagctgaggagcgaagttgtgaagaggctcaagaccttgggagttaagatagaggtgaaaactttagatgttggagactatataatcagcgatgaggttgccatcgagagaaaatcagcaaacgacttcattcagtcgataatcgatggtagattatttgatcaggttaagaggctcaaggattcctatccaaggcctgttgtgatagttgaaggccagctctacgggataaggaacgtccatccaaacgccattaggggagccatagcttcgatagttatagactttggagttccaattatattctcctcgaatcctgaggagactgccaattacatcttcttcatggcgagaagagagcaagaggaaaggagaagggaagtgagggttagaggtgagaagaaggccctaactttagcggaaaggcagaggttgatagttgagagcctcccccacgtttcggcgacgttggctaaaaggctactcaagcacttcggaagcgttgagagggtcttcacggcaagcgtcccagagctgatgaaggttgagggtataggggagaagatagccagagaaattaggagggtaataacatccccttacaccgaggattaa

SEQ ID NO: 45242 - DNA, 1743 bp, Pyrococcus abyssi
atggcggataaatcgtcactctctctgctcaaaaggttcattaaagaggcactctcggaaaggagaaccctagcaatagttgtggttagcatagtgggttcagcgttagcgaaccttgcgtctccctatattttgagggttgcaattgatcactacataatcccgggaaggtacaaggagcttggattcatcgcgatgctttacctcctttccctcgtagcccagtggttctttacaacactccaaacattctatacagaggttttcggtcaaaaagttctaaggaacttaagaagtcagctccacgagaagattctacaatctaacctggactttttcaagacgaaatcaacaggtgacctcgtttcaaggataataaacgacaccaacgtcgttaacgacgttctagtttcaggtctcctgggagggctgggtagtatcttaagcttagctggtattattgtggcgatgctattactggacgttaagctaaccctcgtcacgctaacgagcgttcccttgatggtgattattgccctctactttggaggcaagatgagaagggcctaccgcgagacgaggcaaaagattgcaaagatatctagcgttgttgaggagagcgttgctggaatagaaactattagagcattcggaaaagaaaaagacgtggaaaaggagttctcaaaggtctccacagagacgataaaggcctatttaagggtggcaatatacatgggaatattctggcccctgatgaacatagcaagcttgctctcagttatagtggttatagcctatgggggttatctagcttacaagggagcagtaagcataggtgtcgtggttgcgttcattcaatacgctcagagatttagggggcccataaacaatgtagttagtatgtacgatagtttacaatccgctttagcggcccttgagaggatatacgagattcttgacgatgaaaacgtcgaggattacgaaggaattagcgtcgagaagcttaagggcgaaatagagttcagaaacgtttggttcgagtacgagaagggaaggccagttcttaaggacgttaacctctacatcccaccggcctcgaaggtagctatagttgggaagactggagcaggtaaaacaacgatagccaacctcataatgcgcttctatgatccaacgaagggtgaaattctttacgatggaattgatggaaagaagattagtagaaagagcttaaggaagaggataggctacgttccccaggaaacatatctcttccctggaaccataatggagaatatcctaatggcaaatccggaggccaaggaagaggatgtaataagggtctgcaaggaacttggaatccatgacttcataatgaaactaccaaagggctatgaaacatcggccggagaagcagggaagctactctctgttggagaaaggcaacttatctccctcgccagggccatgcttaaggaccccgacatagtcatcttggacgaagctctgtcaagcgtcgatccgaagaccgagcaactcgttcagaatgctatgataaagctcatggagggaagaaccagtataataatcgcccacagactatcgataacccgctttgcagacaaagttatcgtcgtggatgatggaagaattgtggaggagggttctccaggagagcttttaagcagaaagggttacttttacaaactttacacttcccaaatgcaggaagttcctggatga

SEQ ID NO: 45243 - DNA, 1740 bp, Pyrococcus abyssi
atgaggaagtccataaatcagttgataaggttactaagctatctcagggggcatgcggttcacttcctcatagggttattcttaattatattgatgtcctacacgaatagcatagtccccgttttgataaggaacgccatagacaagggggtatcgactggagcgtataaagttgcaattcgctacgggctcttgatactcttagttggagttctcaatggtgtattcagcctcgccggaaggtatttgcttgtaaaagcagcacaatatgcagtttactatctaagaatggacgcattcagggctatccaaaggcatgaaatggagttcttcgacaaaactttctcaggccagcttataagtaggataacgaacgataccgagaggataacgaggttcctatcttttagagtcaggatgctgctctattccatcttcctcataataatatccctgtactacatggttaggatgaacatcacgctcactatggtagcgctgataacgattgccatcgtcgttggcttaaacacgacttacgcgatgaaggtcaggccaatatacgataagattagacatcaaacgggggttatagcctcaatagctaccggcaccatagcaggaataaagacgataaagtccctttcagtagaagaaaacgttcaaaccaaattttcccaggaaaacgaagaactctacagtcttaacgttaaagccatgaagataactgcactttatggaaacgctccatttttagtcttgggcctcgcgatgagcacaatgttctactatggaggaaaggcgataattcaaaacacccttacggttggagagctcgtcgcctttctaacttatatgcttacgatgatgtggcccttaagggctctcggctttacgataggtgacatacagaggagcctagctgcagcgtcgaggctcttcgatgtaatagattcagctccaaagagcatcgatccgccagatgccgttgaaataagtaaccctagaggggagatagaatttagggatgtctggcttacttatcacacaggtagaaccgtcctgaaaggtgtaagctttaaggtcaaacctggagagaaggttctaataaccggccctcctgggtccggaaagagtagcatactaaagctaatagcgagattctacaagccgacgaaaggtgaagttttgatagatggagttaacgttgccaagataaaaactgagaacctcaggaagatagttgcctacgtgccccaggaaccgttcatattcaataggagcattagggagaacatagcattggctaagccaaatgcaacccaggaagaagtagagagggctgcaaagatagccaagatacatgacttcatagcttcccttccaaagggttacgataccgtggtcggcgaaaagggtataaccctctcagggggacagaggcagagaatagctctagctagggccatgctgatgaacccgaagatagttctccttgacgatccagtttctaacttggacgctgaaaccgagaaaaagttagtggaagacctcaaggagatactacaggataaaacggccctaatagtgtcccaaaggctgtccctggttaagctcgtcgatagggtaatcgtgatgaaagatggtaagatagttgaagatggaaagcccgaagagctaatcaagaaaggcggaatcttcagcgagatgatgaaagccggtggggtgtatggcggataa

SEQ ID NO: 45244 - DNA, 924 bp, Pyrococcus abyssi
atgaggaataaattaatcgttgtaactgggggggcaggcttcataggatcccatatagccgaggccctaaaggaggaaaatgatgtagttgtaatagacaatttatattctggaaagcctgaaaacgttccggaaggagtaaagttcatagaggctgatgtgagggattatgagagcatagccgagatcgttagttccgctgactacgtatttcacgaggccgctcaaataagcgttgaagagagcgtgaaggatcccgtgtttacggaagaggtaaacgtaatagggacgataaacattcttagggcgctctcagagggaaacggaaagctaatattcgcttcttcagcggccgtttacggagaaccaacttccctacccataagggaagatcatccgctgaatccaatttccccctatggagttagcaaagtttcgggtgaacactattgtaaggtgttttaccagctctatggcgttccaacagttatactcaggtacttcaacgtttatggtccaaggcaaagctcagcatatgctggagttatcagcatattcatggagagggcattaaggggagaacccctcgtgatatttggagacggtaagcagagtagagacttcgtttacgttaaggatgttgttgaggcaaacattttggtcgctgagaagagaagggccgagggcgaaacgttcaacgttggaacgggaagggaaactacgataatcgagctcgcgatgaagataattgaactaagctccacgagttcccaaatattattctcaaagcctagacctggagatataaggaggagtgttgcggatattgaaaagataaaaaagctagggtttaagccaagatattctttagaggagggattgcttgagacgtggaaatggtttaagtctcgtactctaggttaa

SEQ ID NO: 45245 - DNA, 3534 bp, Pyrococcus abyssi
atgccgtacatagagaagcttgagctgaaggggttcaaatcatatggaaacaggaaggttgtaatcccgttctcaaagggtttcacggctatagttggagccaacggttctggaaagagcaacatcggagatgcaatactcttcgtccttggaggactatcagctaaggccatgagggcgagcaggataagcgacttaatatttgccggaagcaaaagcgagccacctgcaaagtacgcggaggtagccatttactttaacaatgaggataggggcttcccgatagatgaggatgaggttgtaattaagaggcgagtttatcccgatggtagaagtagttactggctaaatggtagaagggctacaagaagtgaaattcttgatgtgctaagtgcggcaatgatatctcccgagggatacaacataatcctccagggagacataacgaagttcataaagatgtctccccttgagaggaggttaattctggatgacatctcgggaattgctgagtacgatgccaagaaggaaaaagccctccaggagcttaagcaggccgaggagaacctcgctagggttgatctcctaataagggaagtgaagaagcagctcgacaagctcgaaaaggagagaaatgacgccttaaggtacttagacctaaaggagaggctggagagggcgagagttgagctaatccttggcgagataaaaaaggttgaaagcgagattaaaggcaacgatgagaggatcgaaaaaatagaggaggaaataaaggagatagaggaaaagctagaggagatagcgaaggagatcgttagaaaggagagggaactcaaagaggtggaggagttaattgaaaaggagagtagcgaagaggcgctcaagattacgagggagatcggtgaggtaaattcgaagataaatttggcgaagaggaacatagaggttgctaagaaggagctggatgaagctcaaataaggcttatcaaagccaaagacgagctaaagaaagtcttaagcgagatagagaaatcgaagggagccattgctaggtggggaaagaggaaagaggcactgctcaataagataaaggagcttgaagaggaaagaaataagctagtagttaagctaggagagatagacaggacgttcgccgttgctagagaagagttcgataacgtcgttaaagagctcgaaaacgctagaaaatcgttgtatgagaacgaagccgacataaaaagacttgaagctgaaaaggaaagactttcttcgagaataactattctcaaggctaaacttcctgggattagggaggaagtggagaagcttagggagaaactagaggagaagaaggcggaactgagcaacgttgagaacaagatttcatcaatttcacagaggaggagaaaagtcgaagaagagctagagaagaaaacatccgagcttcagaaggtttcctcagaacttgaaagcctagaaagagaactgataaaggccgaggctcaaagtgaggttagggttaatagggcagttgaagagctcaagaggtctggaattagcggaatatacgggactttattggagttgattagggtaaaggacgagatgtactcaatagcggttgaggtagccctcggaaacagggccgataatgtagttgtggagaacgaaatcgttgctgaaaaggcaatagaattccttaagaggaacaagctgggaaggctaacgtttcttccgctcaacaaaataaagccaaagaaagttaacgattcagtaggaactccagtcatagatgtcatagagtacgaccccaggatagagaatgcaatcagattcgcactcggcgatacggtaatagtttcctcaatggaggaagctagagagcacataggtaaggttaggatggtgaccctcgagggagagctctatgaaaggagcggagcaataacgggtggccactacaaacctagggggttacccgtagatactagggagctgaaagaaagagtagagaagctaaaattaaggaaggaagctttggaggcagaaattaactcgttaaaagtcgagctaagaggtttggaaaaccagggatttgagttgaggataaaaatgagtgaaatcgagaaggagataaccctgctaacgagggatattgagaagcttctaagcgaagagagaattattaaatcggagatagaggattcccagaaggggatagaggagatagataggattatacacgagaagaaaggagaaatagcaaagctaagggggaaaatcgagaggttagagaggaagagggacaagctaaagaaggccctagagaaccctgaagctagagaagtcacggagaagataagggaagttgagggagagatagggaagcttagggaagagcttagtagggttgaaagcaggttagaatctttaaactcaaggctaaatgaagagcttattccaaggaaggcctcgctcgaggaggagatagagggattagtgaataagataaacgctctaaaggccaacatagctgagaacgaagaggtccttaaggggcttaaggggaaactagaggagttaaaagccaaggaggagagcgttcactcaaagataagtgaatacagaagaaagagggaggagctggaaaaggagataagggagcttaggaaagagaaggaagagctctcgaagaggatgcaagagtttagaatagaggccaacactttaagggtcaggaacacccagttgaggagtattctaaacgaaaagaactctcagctaaggcacttcccgaaggaggtaataagatcgataagggagatacctctcgacttagaaaagctcaagagggaaatcgaggagatggaggaagagattaggtctctggagccagtgaacatgaaggcaatagaggacttcgaagtcgtcgagaggagatacttagaattgaagagcaagagagagaagcttgaagccgagaaggagagcataatagagttcataaacgagatagagaaggagaagaaaaacgttttcatgaggacgttcgaggccatagcgaagaacttctcggagctatttgcgaagctctctcctgggggaagtgcaaggctaatcctggagaatccggaagatcctttctcgggaggactcgagatagaggcaaagccagctgggaaagatgttaagaggatagaggctatgagcggaggagagaaagccctaacagcattggcatttatcttcgcaatccagaagttcaagccagccccattctatctatttgacgagatagatgcccacctagatgatgccaacgttaagagggttgcagatttaatcaaggaatcttccaaggagagccagttcatagtgataacgttaagagatgtgatgatggccaacgctgaaaagataatcggggtctcgatgagggatggagttagcaaagtcgtctccttgagccttgagaaggccatgaggatactggaggatattaggaagagggaagctttaagctcggagggataa

SEQ ID NO: 45246 - DNA, 1236 bp, Pyrococcus abyssi
gtgaaaactttgaacgttgaagatattattgagaaggtagctaacggagaaattaaactgcatcaagttgagaagtacgttaacggtgataagagacttgcaaccgaaataagaaggaaagctttggagagaaagcttgggataagtcttaagcacatagggcactactccatagatccaaacgagctcataggaaggaacatagagaacatgataggtgtcgttcagataccgatgggagtggctgggcccttgaagataaacggagagtacgcgaagggcgaattctacattccactagcaactacggaaggtgcattagtagcttcggtgaacagagggtgctcagctttaaccgaggcaggaggggttgtaacgactatactcgacgataagatgacgagagctccccttataaggtgtccgaacgctagaagggctagagaagttgcggagtgggttaaggaaaatctgaactacctccaagagaaagccgtggcaaaggtaacgaggcatggaaagcttagagatgtaaagcctttcatagtcggcaacaacctctacctacgctttgaattcgaaaccggggatgccatgggaatgaacatggtaaccatagcgagcgaggagataatgaaggtcattgaggaagagtttccagatgtaaggtacttagcactctcaggaaacctatgcgtcgacaagaagccaaatgcagtaaacttcatcttgggtagagggaaaactgttgttgccgaggccatagttcccagggaaatagttgagaagaaactaaaaacaacgccagagcttatagccgaggtcaactactttaagaacctagttggatcagcccaagctggaagttatggctttaacgctcacttcggaaacatagtcggtgcaatattcttagcaactggtcaagatgaagctcaaatcacagaaggctcccacgggataacaatagctgaagttacccccgagggagatctctacataagcataacgatgccaagcctcgagataggaactgttggagggggaactagagttccaacccaaagggaggccctctcaattatgggagttgcagggggaggggatcctcctggggtaaacgctaagaagtttgcagagatcgtagctggagcagttctagctggggagctttcacttttagctgcaatagcagccaaacacttggcaagagctcacaaaatgcttggtcgctga

SEQ ID NO: 45247 - DNA, 780 bp, Pyrococcus abyssi
atgagaattctaataacggcagcctcaagagggataggattcaacatcgcgaaggaactcttaaagaaggggcatgaggtttctatagcttcaagcaatcctgataacataagaaaggcttatgaaaagttgaaggaaataggggagatccactatttcaaggcagatttaaaatcaaaggatgacataaagttacttattaaggaagcttgggaggccatgggggctatagacgctcttgtatggaatgcccccaacgttggatgcgaaccctgcatggcccatgaagctaggtacatagattggcttgaggcggccctcctccacatagttgccccagggtacataacgacccttctaattcaagcctggttggagaagaagatgaggggagtcataatataccttagttcagcctccgttcttgagccgatgccaccgcttatacttgccgatacagcaagggctgggttagttcagttggccaaaggaatatccagaacttatggtggaaaggggataagggcttataccgtacttctcggtagctttgatacccctggggcgagggagaacttggctagaatagctgaggaaaggggagtaacgatggatgaaatctgggagagggaagtcatagatagaacccccttaaagagaactggaaggtggagtgagctcggggcccttatagatttcctcctaagcgagaacgcagagtacatgcttggctcgacgatagtattcgatggagccatgactagaggtgtcaatctatga

SEQ ID NO: 45248 - DNA, 2388 bp, Pyrococcus abyssi
atggcagagaagaaggaggtcaaacttaaggtagcttccgcttatcaaagggacgttggtaggggaattgtcaggttagatagaaaaactatgagagagctaggaatctccccaggagatgtcgttgagataatcggaacaaagaacacggcagcgatagcctggccagcctatccagaggatgaagggctaggaataataagaatggacggaactatcagaaagaatgcaggagtagggcttggagacgaggttactgttaggaaggcagaagtcagggaagctaagaaggtcacgctagccccaacagagcccataaggttcggaagggacttcgttgaatggctccacgagaggctagttggaaggccagtagttagaggagactacattaaggtcggagttcttgggcaagagctaaccttcgttgtcacggcaacccagccgagtggtgttgtccagataacggaattcactgacttcaacatcagcgagaagccagtgaaggaagtagagaagagaatgacaacgggagtaacttacgaggacatcggcggactcaaggatgtcatcgagaagataagggagatgatagagttaccgttgaagcaccctgaactgttcgagaaactcggtatagagcctcctaagggtgttcttctctatggtccaccaggaactggtaagaccttgctagccaaggcggtagctaacgaggctaacgcttacttcatcgcaataaacgggccggagataatgagcaagtactacggagagagcgaagaaaggttgagagaggtcttcaaggaagctgaagagaacgctccagcgataatattcatagacgagatagatgcgatagcaccgaagaggagcgaagttactggggaagttgagaagagggtagtggctcagctgttagcattaatggacggtctcaagagcaggggtaaggtcatcgtcataggcgcaaccaacaggccagatgccatagacccagctctaagaaggcctggaaggttcgatagggaaattgaggtaggagtcccagacaggcaaggtaggaaggagatactccagatacacactaggggaatgccaatagagccagacttcaggaaggatgatgtgcttaagatactcgaagacttcaagagggagggcaagttcactaagataatagataaggctattgaggaagtcaacaagagcaaggaggaggaaattccacaggttctcaagaagatagacgcagagttatacgatgaggttaagacgaggctaatagacaagttgctcgatgagttagccgatgtaacccatggattcgttggtgcagacttggctgcactagcaagagaggcagcgatggcggcactgaggagactaataagggaaggaaagatcgacttcgaagcagagacaattccaagagaagtcctagatgagcttaaggttaccaggagagacttttatgaggctttgaagatggttgagccttctgctctcagggaagtgctcattgaagttccaaacgttcactgggacgacattggaggattagaagatgtgaagcaagaactaagagaagcagtagaatggccactaaagtacccagaggcgtttaaagcctatggaataactcctccaaagggtatcctgctctacggcccaccgggaactggtaagaccttgctagctaaggcagttgccactgaaagccaggcaaacttcatagctgtcagggggcccgagatcttaagtaaatgggtcggtgagagcgagaagaacataagggagatattcaggaaggctagacaagcggcgccgacggtgatattcatagacgagatagatgcaatagctccaagaaggggaaccgacgttaacagggtaaccgataggataatcaatcagttactaacagagatggatggaatccaggagaatgcaggggtggtcgtcatagcagctactaataggcctgatattttggatcctgcgttgttgaggcctgggcgttttgataggcttatcctagtgcctgctcctgatgagaaggctaggtttgagatattcaaggttcacacgaggggaatgccactggcagatgacgttgacttgaaagaactagcaagaagaacagaaggctacacaggagcagacatagcagcagtctgcagagaagcagccatgatagccatgagaagggcgctagagaaggggataataaagccaggcatgaaggccagcgagataaggagattagccaaggtcacgatgaaggacttcgaggaggccctgaggaagataggaccatccgtaagcaaggagacgatggagtactacagaaagatacaggagcagttcaagcaggctaggggatga

SEQ ID NO: 45249 - DNA, 882 bp, Pyrococcus abyssi
atgaggtttgacgtaatctgtatgggaaatttaaactacgacatagtctttctaatggagaagttccctgggatccatgagaaggtcaacgctaaaggtgtttttacgggacttgggggttcggctggaaatactgcgacttggctggctaagctagggttgaaggttggcttcattggggcagttggaaacgatgactttggaaggcttcacctcgagttctttagggaaattggcgtagatactagtggtataaaggttgtgaacgatgcaaccgggatagcggttactatggttaaaggggaagataagaggatagtcaagtatcctggggccaacaggtggaaggaagtaaacaccgagtacctcaagagggctagacaccttcacctatcctcaaatccaattgaacttatcagggaagccgttgagaaggcgaaggagcttggcttgaccgtttcctttgaccctggggagatggaagttcccagggacgttgaaaaagagctagacatcttgatgatgaacgaggatgagttcaaggcgaaatatggaagcttggacagaataaaggatgtaaaagctagaatagctatagccacgctgaacggtggaggggctcttgttagggatgaaaaaggagaggttcacgaggttaggggactctcagcaaaagccatagatacaactggagggggtgacgcattcaatgccggctttctctatggcttccttagtggatgggatgtcgttaattcagcaaagcttggaatgctgctcgcttatctaactgttcaggaggttggggctagaagcgctgtgaggccattagatgagatcaagaaaatagcccaggaactaaagctgaaccttccaatttag

SEQ ID NO: 45250 - DNA, 1143 bp, Pyrococcus abyssi
atgacccttgttggaaaactacttaacgctaagcccggtgaggctgtaataaggaaagtcgacctagtttacgcgcacgatggaacgatgcctctaataatagaggccttcaataggatattcaatgaggttagaactagggcttacatattctttgaccacgtttatccggcacctacggtaaaggttgcgaacctgcatagggagataagggagttcgccaagatccatggtattccagttgttgagggaaagggaataagccatcagctcgtcgttgagcttgggcttgcagaggaggcaaagataatcgttggtggtgattctcacaccccaacgcttggagctcttggtgtgttcgctgtaggtatgggtgctacggatgttgccatagctctagggcttggaaagatatggcttaaggttcccgagagcatagcagttttactggatggttccccaagagaatacataatggcttccgacgttatgatacacctaataacatcccttaaggatagggagatgagctacaatgcgatagaattctttaacgttccgttctccttcgatgaaaggttgacgctcactaacttcagcgttgaagcaaatgcaaagacggcaataatcggagaggagtacgagggagggggatactcagatgagattaccattgagttagactctttacctccaatggttgcgaaaccttttagtcctgctaacggcgtgagcgttgaggatgtagagggaactaagatagaccaagttttcataggttcatgcactaacggtagattcgaacaaataaagagagcggctgagatattggatggggagcaggttaatgttagaaccctggttgctccagcctccatcaacgtctatagaaggatgattgaggaaggattagttaggattctgatagacgctggtgttgtaattctaccgcctgggtgtggaccgtgtcttggaaggcatatgggagttgctggagacaatgaggttatcctctcaactacgaacaggaatttcaggggaaggatgggttctccaaaggctgaaatttaccttgcgagtcctgttactgccgcggttagcgctctttacggtgagataacgaacccggagggagagttatga

SEQ ID NO: 45251 - DNA, 1041 bp, Pyrococcus abyssi
gtgtatagggtagccgtgattaagggtgacggaatagggcctgaggttgtagattcagcgattagggtggttaattccgtaacggataggataaggttctatgaattcgagggaggattcgaggtattcaagagaattggctcgccgataagtgaggatgacctgaaagagataaggaagatggatgccatattgtttggagcaacaaccacaccctttaacgttcctgggtataggagtttgatagtaaccctcaggaaggagctcgacctttatgcaaaccttaggattatcccggatttaagcaacggtaaggagatagttatagttagggaaaacaccgagggattgtacgcaagggacgggataggattcagtgatagagccattgatttcaggataataacccttgaaggggctagaaggatagcaaaatttgccattaacttggctaaggaaaggaactccttcataactttcgttcataaggcgaacgtgttgaagggtgacagattcttcagggagatagttctggagattgctgaaagggaaggggtggaagttagggaagctataatcgattctttcatgattaagttagtcaagaacccctgggaccacggggttatattaaccgagaacatgtttggggatataatttccgacctagcaactatccatgctggaagcataggaatagttccaagtggcaactatggagatgaaatagcgctctttgagcccatccacggttccgcaccggatatagctgggaaggggatagcaaatccaattggagctattctaagcgcagccatgatgctcgactatctggggcttaacggtaaggtagtatgggaggccaccaggaggtacgtgaggtacggtaatctaacccccgatatgggtggaactgcaacgactagcgaagttactaagggaataatctcggaaatttattcttttgatccctttgacatagatgaaatctgggttgaagagatcaggcttgggagaattcctctaacactttggaggtga

SEQ ID NO: 45252 - DNA, 993 bp, Pyrococcus abyssi
atgattaaagctgccatagtgggaggtagtggatacattggtggggagttaataaggttgctctcaatgcatcctgaggttgaaataaccactatcacatcccgaaagtttgccggaaagaaggttcataaagttcaccccaacttaaggggattgaacctgaggtttactgataaatacgagttcgacgctgacgttatatttctggccgttccgcatgggacctccatgaggataataggtgaattcctgggtagcgctaagataatagacctgagtgctgatttcagggtttcaaaggatctttacgagaaatactatggttcccacgagaagcctgagttgatagataaattcgtttacggtctccctgagttgcatcggaaagaaataaagagagctgagcttgtggctaacccaggatgcaatgccacagccgtgatcttggccctttatcctttcagagatgtaacatccgaagctatagttgatctaaaggttagctcttccgcaggtggtaggagggaaaacgtagcaagcattcatcctgaaaggagtcacgttgttagggtttacaaacccttccaccaccgacacgaagctgaagttctccaagaaactggagttaaagcgatgttcacggttcactcagttgacatagtcagggggcttttggctacaacatacttcaagttcgagggtagcgagaaggatttgcttaagaggttgctaatgtacaggggagaacctttcataaggttagttaccgataaaggagggctccaaaggtatcccgatccgaagtacgtgattggtagcaacttcgtcgacatagggttctcctacgattcggaaaactctagggcgatagtattttctgccctagacaatctgatcaaaggcggggcgggacaggccgttcaaaacatgaacatcatgtttggattcgatgagacccttggtttgaattattaccccctctatccggggtga

SEQ ID NO: 45253 - DNA, 747 bp, Pyrococcus abyssi
gtgattcaaatgagggttatcaaggttggaggatctgttgtgccaatgcttgataaaattctcgacacgagcagtttgcatggtaactcgattattgtccatgggggttccaggtacgtggacgagatggctaggaaacttggtgtcaaagtggaaaggcttgttagcccctctggagtaatgttcaggaggactaccaggagagtccttgacgtgtacgttgcagccttaatgagggctaacagggagttggtttcattcctaagggagagagggattgatgcaattggagttagtgggctcgatggtgtcgtgttagctaagaggaagaagctcgtaaaggcggtagttaatgggaaggtgatagcgataagggatgactattcaggagttataaagagcattaacgtgactctccttaagaattacctgaaggttggaattccagtcatagcctcaatagcttacgatcctgaggagaatgttcctttgaacgttgatggggataaagtagcttatcacgtagctattgcaatgaaagctaaggagttgcgcttcctctcggatacagcattcttaatcgacggaaacgtcgtggagagaatccccttagaggattttgacgagtatttaaggtatgcaggcggtggtatgaagaagaagctcatgatggctagaaaagctctcgaaagtggagttaagaaagttgtaattgagggattaaacggtaggacggtgatatcttga

SEQ ID NO: 45254 - DNA, 1095 bp, Pyrococcus abyssi
atgagtctctatagaaagaggttgaagatagtcaggggagaggggatctacgtatgggattctgaggggaagaggtacctcgacttaatagcaggtataggagttgcaatccttgggcataaccatccgaaatgggtagaagaggtagggaaccagttgaacaagctggtcgttgcgggtcccatgtttgaacatgaggaaaaggaggaaatgctggaggagctttcgaggtgggttaacttcgagtacgtttacatgggtaactcgggaacggaggctgttgaagctgccctcaagttcgcaaggctttacacgggtaggaaggaaataatagccatgacgaacgctttccatgggagaacgatgggagctttaagtgcaacttggaagtcaaagtacaagaaggattttgagcctctagttccggggttcaagcatatcccctttaatgacgttgaggctgccaaagaagcgataacaaggactacagctgctgtaatatttgaaccgattcaaggggaaagtggtataattccggcaaaggaagagttcgtgaagactttgagggatttaaccgaggatgttggggctctattaattgccgatgaggttcaaagcggtttaagaaccgggaagttcctagctgttgaacattacaaggttgaacctgatatagtaacgcttgggaagggaatagggaacggggttccggttagcttaacgttaactaactttgacgtcgagaggggaaagcatggctcaactttcggtggaaatccgctagcttgtaaggccgttgctgttacgctaaggatactaaggaaggagaggttagttgaaaaagcctcagagaagttcataaaggtgaagggtaaggatgtagtaacgacgagggggagggggttgatgatagggatagttctcaagaaacccgtgggtaggtacgttgaggagttgcagaacgagggttacctcgttcacacttcaggtcagagggttattaggttgttaccgcccttgataatctcaaaagaaaagatgatggaggttaaatcagccattgagggtgttataaatggagataccgaaggatga

SEQ ID NO: 45255 - DNA, 798 bp, Pyrococcus abyssi
atgaggatgatgaagtactcgaaggagtataaagataaaacgataatcaaggttggggacgttaaaattggggagggtttcacgataatggctggtccctgtgcgatagagagcgaagatcaaataatgaaaaccgctgaattcctggctgagcttggaattaagatccttagaggtggagcgttcaagcccaggacttccccgtattcattccagggatacggggagaaggctttgaaatggatgagaaaggctgctgatgagtatgggttagttacggtaactgaggttatggatacaaggcacgttgagctagtctcaaagtatgctgacatacttcagataggagccaggaattcccagaatttcgagttgctgaaggaagttgggaggcaggaaaagcccgttctattaaagaggggtatggggaacaccattcaggagctcctttactcagctgagtacataatgagtcaaggaaacgagaacgtcatactgtgcgagaggggtataagaacatttgaaacatccactagatttacgctagatatttctgcagttccggtggttaaagagctttcccatctcccgatagtagttgatccatcccatccggctggaaggagaagtctagttatcccactagcgaaagcagcctacgctgttggggctgatggtgtactcgttgaggttcatccagatcccgaaaatgcactgtccgattcaaagcagcagctaaccttcgaggatttcaagattttgcttgacgagttaaggaagctgggatggaggggatag

SEQ ID NO: 45256 - DNA, 1017 bp, Pyrococcus abyssi
atggaggggatagctcacatggagaacataatattttctccactctcctctctcccttccatagtcgaggaattaaatccctacaaaattgcagttctaacgaatgatatgctgaaatcgctgtggctcgataagattattgaactcctgggaggcgacgtgtttccaatagtgattccagatggggaggaatacaaaacgatagagaccgccatcaagatctgggatgagctcgtgagctttggctttacgagaaaatccctactaatagggcttggtggtggggttattaccgatatagctggcttcgtagcatcaacatatatgagggggacgctcctggggttcataccgacaacattgcttgcccaggttgatgctgctataggtgggaaaaccggcgttaacttccatggtaaaaacatgatagggactttttaccttccaaactttgtgttaatttcaactgaaaccctctcaactttgcccaggatagagctactgaacgggatggctgaggttatcaagtacgccatcctcgataagaatgtatacaggttactccaagacgttaagaatgtcgaggagattagaaacagggaagatataatcagagaatccgtaaacgtaaaggttagggtcgttgaggaagacttaaaggagagtgggaagaggagaattctaaaccttggacacacggttgggcatgccattgagaagctttctggatacaagattaagcacggcttcgcagtttcggttggattaatagcagcagccaagttgggagagaagctttacaattttgactcgggtaaggttattgagctcgttgagcggttcaacttgccaactaagttaccctacccgcctaaggatataattgaagccatgaagctcgacaaaaaggcttggtacggtaagatagtcttcgtaattccagttgaaatagggaggatttcaatagaggatgtgcccgaggagttgctccttcaggttctgggtgagataagatga

SEQ ID NO: 45257 - DNA, 648 bp, Pyrococcus abyssi
atgatagcaaccgttatcttggctgactccattaaggaggcgattgagaagattaaatcatcgtcttccgatttgtacgagctaagggctgactcccttaaggattactctaaattggaactccttgaaccctactccgagaagcttgtggtaacaataaggagcaaggatgaagggggttttaaggagttaagtgatgaaaagaggttggagctctattcaaaattcctcgagataaagccgaggtacgtggatgtagagttcagatccaagataaaggatgaagttatggagatagcaaaaagggttggttctagggttattctctcttaccataacttccgtgagacacctccttttggcgtgctctacaatcttttagaggatatggagagcgagggggctgatattgtaaagatcgttactcatgcaagctctcccaaggataacataaggattataaggctctacgagtttgcggataatttaatagccttttgcatgggttccaagggtaaaatctcgaggattttcagctcaatgtactcgccgataacttatgtagccctggataagaaagctgctccaggacaattaacgcttgaagagctaagggttatacttaaaatcctgggtgaggggagatga

SEQ ID NO: 45258 - DNA, 795 bp, Pyrococcus abyssi
atgaaagtttatggcttgataggaaagcccgtttcacactccttaagccccgttatgcacaatgccctcttcaggaagtatggaatagatgcagtttacgtaacctttgaggttgaggagctcggtaaggctattgatggtgttagggccctcggaatttctgggctcaacgttaccatgccctataaggaggtggtcaccaaattcttggatgagttgtccgaggatgctagggaaattaacagtgttaatactataataaatctggagggttcactaatcggatatacaaccgatggtgtaggggctagaaaagctttggaaaggtttaccgagattgagggaagaaacgtgctaatccttggagcagggggagctgggaaggctatagcgtatgagctatctaagattgcaaacattgtcgttctaaataggacaccctctaaggctaaatccttggagaagttcggtgtgaagggaggaagcttggatgagttacccaattacgtgggttgggcggatgtattgattaacgcaacctcggtgggaatgggaacaaatgaaagcttagttcccaggaggctcttgaggagggaactcatagttatggatatagtctacaaaccccttaaaacgagactattgagggatgccgaaagcgttgggtgcagagttatagatggcttgtggatgctaatctatcagggagccgagagctttaaactttggactgggatatatccggatgtggagcttatgaggagggtttcccttgagaggctcgggaagggctag

SEQ ID NO: 45259 - DNA, 1233 bp, Pyrococcus abyssi
gtgtttgggccagtatcagtggagatgataatagagagggttgatgaagttagggggaaggttaaagcacccccatcaaagagttacacccatagggcttacttcctatccttgttggctgattctccgagcaaagtcatgaaccccctcatttccgaagatacgatagctagcctagatgctataagtaaatttggagctcaagttaatggaaataaaatcatcccgccccaggagctaaccccaggaaagatagatgctcgcgaatctggaaccaccgccagaatttccctagctgttgcctcactagctaggggaactagcgtcataacaggtaagggaaggctcgttgagaggcccttcaaacccttagttgatgctttgaggagcttaaaggtaaagataagtggcgagaagctacctattgcagttgagggaggaaatcccgtgggtgaatacgtgaaagttgactgttcactctcgtcccagtttggaacggctatgttaattctagcctcgaagatagggcttacggttgagatgttaaacccagtttcaaggccctacattgaagtaaccttgaaggtaatggaatccttcggcattgagtttgagaggaatggattcaaggtgaaagtccatccagggataagggggagcaagttccacgttcccggcgattattcttcagcctctttcttcttggcggctggtgcgctttacggtaaggttaaggtctcgaacttggtgaaggatgaccctcaagcggatgcaaggataatagatatcctggaggaatttggagctgacgttaaggtggggaggaaatatgtggttgttgaaagaaacgagatgaaacctataaatgttgattgttccaattttccagatttgtttccaatattagctgtgctagcttcgtacgccgaggggaagagcgtaatcactgggagacagttgagactcaaggagagcgatagggttaaggccgtggctgttaatttgagaaaagccggtatcaaggttaaggaattgccgaatggcttggagatagttgggggtaaaccaagggggtttaccgttgaatcttttaacgatcataggatagttatggcgatggcgatcctcgggcttggagctgaagggaaaaccatcattaaagatcctcacgttgtctcgaaatcctatccaagcttcttcctagacttaaggagggttctgaatgaggggtag

SEQ ID NO: 45260 - DNA, 1071 bp, Pyrococcus abyssi
atgaggggtagggtgctcagctttacgttgtttggtgaaagccatgggaaaggcgttggggttgtcataactggaattcctcctgggataaaggtgagtcacgaggagctagtcaaggagctcgagaggaggaaaggaattcctggcttatcaacagctcgctctgaacccgacaacccaataatactatcgggaatatttagggggtacactacgggaacgccaatagcggtgctctttgagaataaggacgttgattcatcctattacgaggatatcaaagacaagccaagacctgggcatgctgattatccagctaggatcaagtactttggttacaacgactataggggcgggggtcacttctccggaaggctaacggttggtatcgtaacggccggatacttcgcgaagaagatccttgaaaagtacgggataaggattagggcgtacataaagaggatagggagggttgaggccaaacagctaacccttgaggagatactctcctcggagaatccattctgtccagatgaagaagcttttgaaaagatggttgaggagatagaattagctagaagggaaggtgatagcgttggtggtatagttgaggttgtagccgtaaacgttcctcctgggcttgggggaccctacgaggaggatatagaggccgatttagcctcagccttcttcaggattccagctgtgaagggcgttgaatttgggttgggatttaaggttgccgagaagaggggaagtgaggttaacgatccgtacgtgataagggatggtaaagttgtaactaaaacaaacaatcatggaggtgtcctcgggggtataacaacggggatgcccataattgctaggatagccttcaagccaactccgtcaatataccttccccagagaaccgtggatctcagggaaatgaaagaagttgagatcaagttaaggggaaggttcgatccttcaatagttccccgagcccttccagtggttgaaggtgttatggcgttcgtattggctgatcatcttttgtttagacgggtatgggagctaaagtccagctag

SEQ ID NO: 45261 - DNA, 627 bp, Pyrococcus abyssi
atgttcgtgaaggtctgtggcgttaagagcttagaagagcttgagatagttgaaaagtacgctgatgccaccggggtggttgttaactcgaaatcgaagaggaacgttccccttgatgccgctagggaaataatatcttcggcaaaaatcccggtattcctggtatccacaatgaaaaaccgagaagactgggaggttgcgatagagaggacagaagctaggtacattcagatacactccgatgttgaaccttcccttctcccctatttaaaggatgagtatggagttgagataatgaaagccttccgggttccccaggaaagtgagaacccagaaagggatgctcaaatgctcttgaaaaagataaggaagtacgaagctgaccttattctactcgatacaggggcaggctccggtaagatgcacgacttaagggttactaggatagttgctgaggagattcccgttgtggttgcaggaggattaaaacctgagaacgttgaaatggtgattaagcttgtcaaacccttcggggttgacgtgtcttctggagtggagaggaacggtaagaaggatgaggagttagttagggagttcgttaggagggctaaaaatgtggttcggtaa

SEQ ID NO: 45262 - DNA, 1236 bp, Pyrococcus abyssi
atgggagagaagagaaaatcaaggcaggcagaggtaaatataggtatggttggtcacgttgaccacggtaaaacgacgttgaccaaagcattaactggagtgtggactgatacccacagcgaagagctgaggaggggtatcacgataaagataggatttgcggatgccgagataaggagatgtccaaactgcggtaggtattcaacttccccagtgtgtccctactgcggtcatgagacggaattcgtgaggagggtttcgttcatagatgctcctgggcacgaggccttgatgaccacgatgctcgccggagcctcccttatggatggtgcgattctagtcatagcggcaaacgagccctgtccaaggccccagacgagagagcacttaatggccctccagattataggtcagaagaacataattatagcccagaacaagatagagctcgttgacaaggagaaggccctcgagaattacaggcagataaaggagtttatagaggggacggttgctgagaacgctccaataattccaatctcagctttgcatggggccaacatagacgtcctagtcaaggccatagaggacttcatcccaacgccaaagagggatccgaacaagccaccaaagatgctcgttcttagaagctttgacgtcaataaaccaggaaccccaccggaaaagctagtaggtggcgttttaggtggctcaatagttcaagggaagctcaaagttggggacgagattgagataaggccgggcgttccttatgaggagcatggaaggatcaagtacgagccgataacgaccgagatagtgtcgctccaagctggagggcagttcgttgaggaagcctacccaggaggactcgtcggagttggaactaagttagatccgtatctaaccaagggagacttaatggctggaaacgtcgttggaaagcctggaaagttaccaccagtatgggacagccttagattagaggttcacttacttgagagggtcgttggaacggagcaggaacttaaagtcgaacccataaagaggaaagaagtcctactcttgaacgtcggaactgcgagaaccatgggcttggtgacaggtctaggaaaggacgagatcgaggtaaagctacaaattccggtctgtgctgaaccaggagatagggttgcaataagcaggcagataggctcaaggtggaggctcataggatacggaataatcaaggagtaa

SEQ ID NO: 45263 - DNA, 1086 bp, Pyrococcus abyssi
atgcaagccgtactgctggcgggtggcatgggaactagattgctcccactcacgatttacaggccaaagccaatgatacccttcttcaataagcctctgatggagtacatggtgaacaacctagtggaggttggagttgacgagataatagtgctcgtcggctatttaaaggagaagataattgaacacttcggagatggaaaggagtttggagttgagataaagtattcaaatggggagaacgtgaaatttggtaccgctggggcattgaagagggctgagaagttcatcgaaggaacattcatagtagcatctagcgacgtcttgactaacctagatttcaagtcccttctcgagtttcacgcaaagaagggtggcatagccacgatggcactaacgaaggttgaagatccaagtccctatggggttgctgtcctggatgatgaagggaagatcctgtacttcaaggagaagcccaggagggaagaggccccgagcaatttagtcaacgctggaatatacgtttttgagcctgaaatcctcgacttaattcctaagggaaaaccctttgacttctccctaaacttattcccaaagatgcttgaggagggaattccaatatatggctttccctttgacgagtactggaacgacgttggaaggccctctacctatcttcaagcaactgaggatgtcttcctggggaagcttaagctaccccagataagcgtgggtaggcttaagggaaacgtcgagaggggaggtagcctgttcaccggtagtaggtgtatactcagaaacccaaaggtctcgggattcgccgtccttggagacaacgttgaaataggaagggacgttaaaatagagagatccgttatcttctctaacgtcacgattgaggatggggccgagataagggaagctataataggggagaacgtttacattgggaaaggcgttaccatagaacctggaagcgttataggggataactcaataattgaggagcacagcaggattggcgctaacgttaagatttgggccgattcaagggttgggagggaaagcattatacttccagattga

SEQ ID NO: 45264 - DNA, 618 bp, Pyrococcus abyssi
atgaggggctacttcgtggtgctcgagggtatagatgggtcaggcaagactacgcaagccaagctattagctgagtggttcgaggaacagggatgggatgtattgctgacgaaggaacctacggatacggagtttgggaggctgataagagagctggtgttaaagaacagcataatagatggctctagaattagttacgaggccgaagccttgttattcgctgctgatagggctgagcacgttaagaaagttatccttccggccctcgagaaaggtaaagtcgtgatatgcgatcgctacctctactcttccctcgcctatcaatgggccaggggattaagcctcgagtggctcatgcagataaactcattcgccccgaggccggacttggcgatcctcctagatcttccggttaaggagagtataaggagaaccaaggcaaggggaaatatgagcgagttcgataagcttctcgagttgcaaaggaaggttaggatgaactacctaaagctcgccgagatgttcaaggagatgaggatagtcaatgcgatggcaagcgttgaggaggttcatgaggatatagttgcgttggttaagcatgagctcctgggtttataa

SEQ ID NO: 45265 - DNA, 1716 bp, Pyrococcus abyssi
atggaagttgaaagaatcgcgcttaagtatgccttgataaacgcaattgaacacggggggaaggcaaatcccaaggcagttataggcaaggttctcggcgagaatccagagcttagatccaaggcgagggagatagttcccataataaacaaggtcgttgaggaggttaactccctatcattggacgagcaaaaggcaaagctcatggagatctatcccgagtacttcgagaagaaggaggagaaaaaggaggaaaagaaaggccttccaccccttccaaaggccgagaaaggtaaggttgtcacgcgttttgcacctaaccctgatggggcctttcacctaggaaacgcgagggcggcgatactaagctacgagtacgctaagatgtacggtggtaagttcatacttcgctttgatgacaccgatccaaaggtgaagaggccagagcctatattctacgagatgataattgaggacttggagtggctcggaataaagcccgatgagatagtttacgccagcgataggcttgagctgtactacaagtacgctgaagagctcataaagatgggcaaagcctacgtctgcacttgtaaaccagagaagttcagggagcttcgcgataagggaattccgtgtcctcatagagatgagccagtagaggttcagcttgaacgctggaggaaaatgctgaacggcgagtataaagagggggaagctgtggttagaattaagaccgacttaaaccacccgaatccagctgtcagggactggccagctttgaggatagttgataatcctaaccaccctagggccgggaataagtacagggtctggccgctctacaactttgcctccgccatagatgaccacgagctcggcgttacccatatattcaggggtcaggagcatgccgagaacgagacgaggcaacgctacatctacgagtacttcggctgggagtacccagttaccgttcaccacgggaggctcagcatagagggggtaatactcagcaagtcgaagacgaggaagggaatagaggagggcaagtacctcggctgggacgatcccaggttagggactataagggccctgaggaggaggggaatacttccagaggccataaaggaattaataatagaggttgggctgaagaagagcgacgcaacggttagctgggataacttggccgcgataaacaggaagcttgtcgatccgatagcaaacaggtacttcttcgttgccgatccggtgcccatggaagttgaaggcgctccagagttcatagctaagatccctctacaccctgatcaccctgagaggggcacgagggagctgaggtttactcctggaaagccgatatacgtttcaaaggatgaccttgacttgctcaagccaggtagctttgtaaggctaaaagacctgttcaacgttgagatagttgaagttggagagaaaataaaagctaagttccacagcttcgagtacgaaatcgctaggaagaacaagtggaggatgatccactgggttcctgaaggcaggccttgtgaggtcataattccagaaggcgatgagctcatagtgaggaagggattgctggagaaggacgctaacgttaaggctggtgagatagttcagttcgagcgcttcggcttcgttaggatagataagatagagggggagaaggttgtcgcaatttacgcccacaagtga

SEQ ID NO: 45266 - DNA, 708 bp, Pyrococcus abyssi
ttgggctttctcaattacatgagagttctcctgactggagcttccggtggaataggtcaggaactagctaaagaacttataagaagaggctacgaggttataggcgttgggaggaacgagaaagccttaaaggagctcgggattaaatacatagttgtagatctatctacatatgagggcatttccaaggttagggagagcctcaaaggggaaatagatgttttgataaataacgcaggcttcggcctcgttaagcccttgctggagcactcctgggaagaattggaagggatgttcaaagttaacgccatagctcccgtgatattaactaaggagctcctcgactttattccagagggagggaaagtcgttttcattatcagcggtgcatcccacgtttatacccttgacttgcctggatacggggcttccaaggttgcactccactacatggccaaggtgcttgaggaagagctgaaggagagggggataaaggttcttagggtttacccgaagcaagtggccacggatttctggaagggggccaagctgagaggggctctatctcctgagtacgttgccaggaagatagtcaatgcaattgagagcgacaagcgagagcttttcataccctggtatttaaagctcgccaagttcttcgaaatcaaatataggttcagttttgaaaaggaatttaagcctcaatga

SEQ ID NO: 45267 - DNA, 1164 bp, Pyrococcus abyssi
atgccgaccaacgtgacagcggagtacttggcagctgaagaagagtacaggaacgccaagactatccctgagaagattagggcacttgaaaagatgtacgccttggttccaaagcacaagggaactgagaagctaaggttgcagataaagaggaagctcgccgagctaaggaaagagctagagaagcaaaggcaacagagaaagggtgggggttattcgttagccgtcaagaaggagggtgcagcccaaatagttctagtcggcctgccgaacgttggcaaatccgaattgttgagggccctaactggggtcgacgttgagagcgcagattatccttttacaaccacggagccaattccagccatgatgaactacaaggacgtccaaattcaacttgtggaggttcctgggctaatagaaggggctgctcttggtaaggggatgggaccacagcttttagcagtaataaggaatgccgatgcgatagccatagtcattgacctgagcgaggatccaatcaagcagatgaaaatcctcctgagagaattcgagagagctggaataaaggtgaacaagaggagacccaggatagagatcaggagaactccaagcgggggcatagtgataaacgggatagagaacattaaaggagatataaacgaggtcatgaagatgctcagggaggagaagatacactctgcagaaatcacagtaagggagcccgtgacccttgaggacttcgcggacgctttagatgagagtctggtttggaagaaggccataataatagccaacaagggggacgccccgggaagtaaggacaactacgagaagctcgtcaaagcctacggggagaggttcaagataatacccgtttcagccaagaagaggataaacttggatgctgttaaagaagccctgtacgatgttgcagaaataataagggttttcacgaagagcccaggtgaggagccagcttatcccccaatagcgcttaagagagggtcaaccgtcctcgacgttgccgagaggattcataaagatttggtaaagaacttcaggtatgcgagggtgtgggggaagagcgttaagttccctgggcagagggttggaccagaccacgttctcgaggatggggatatagtggagatacatgcgaggtag

SEQ ID NO: 45268 - DNA, 675 bp, Pyrococcus abyssi
atgaaggttgccggagcagatgaagcggggagagggcccgttataggaccactagttatagttgccgcagttgttgaagaagacaaaatcagatccttaactaagctaggagttaaggattcaaagcagttgacgccagctcagagggaaaagctattcgatgagatagttaaagttcttgatgactactcggtcgtaatagtgtcccctcaagatatagacggcagaaaggggtcaatgaacgagcttgaggttgagaacttcgttaaggccttgaactccctgaaggtcaagcctgaagttatctacatagattcggccgacgttaaagccgagagattcgccgagaacattaggtcgagactagcttatgaagcaaaggtggttgcggagcataaggcggatgccaagtacgagatcgtttcagcggcctcgattctggcaaaggtcataagggatagggaaattgagaagctgaaggcagaatatggagacttcggatctggataccctagcgatcccaggactaagaagtggcttgaggagtggtactctaaacatggcaatttccctccaatagtcaggagaacttgggatacagccaagaaaattgaggagaaatttaagagggcccagctaacgcttgataactttcttaagcggtttcgcaattga

SEQ ID NO: 45269 - DNA, 1029 bp, Pyrococcus abyssi
atgagcgtgatacagaatataatcggaagggtggtcgttttaaggggtgggatgtactcagttgaagttgatgtagccacggatgaaggttttgggagattcgcttctcccattgaagagaaccccatgcttcacatagccgaggctagaagggcggttagcgaggttgatgagataatagggcccgaacttataggattcgatgcagtggagcaggagttaatagacagctatctctgggaaatagatgggactgaggattttagtcatataggtgcaaacacggcattggctgtctctattgctatagctagggcagctgcaaattccaaggatatgtccctttattcctacattgggggcacctttgcaactgaacttccagttccgataattcagtttgcgagcgacgaaaacttcgagtactatatactcgtcagagatttgcttgaggttaccgacatagttgacgcggtgaataaaataatatccgaagtcggcaacaaggtttcaattgaagaattgtctaaggcatcagaaagcgttgggatggagcttgggttggaggttgcgcttggaattaaaatgaagagggagcttgagattgaagacgttctcaacatagtcgaggacaacaatgttgcgtacattaaaccccttggtcctccagagttgttccttgagctgatagctggcacccatggagttttcatcgatggggagtacttgtttagggcaaacaatattttagataggaggtactacaatgcactatcaataaaacctataaaccttggcacgctcaccgatttgtacaacttcgtgaacgatgtgaagtccgaaaaaataaccccaattttggccgaggcgaagtatgaacccgccgatgatacgttcccacatctcgccctgggccttaggtgcccggccatgctgataagctggaactcggtggaaaagattaatgagcttaataggattgctgaagagctcggagaaaggggtaggataataacgtttgaggagtga

SEQ ID NO: 45270 - DNA, 1008 bp, Pyrococcus abyssi
atgccaaggttagtgctggcgtcagctccagcaaagataatactcttcggggaacacagcgttgtgtatggaaagcctgccatagcatctgctattgacttgagaacttacgttagggcggagtttaatgattcgggaaatataaagatagaagcccatgacataaaaacccctgggctaatagtttctttttcagaagacaaaatttacttcgagactgactatggaaaggcagctgaagtgctgagttacgttagacacgccatagagctcgtccttgaagaggctgataagaggactggggtcagcgtttcaataacgtctcaaattccagtaggtgctggcctaggttcttcagctgccgtcgccgttgctaccatcggtgccgtctccaagttacttgacctcgagcttagtaaagaggagatagctaagatgggccataaggttgaactcctggttcagggagcttcgagtggcatagatccgacggtctcggcaataggagggttcttgtactataagcaaggtgaatttgagcacctaccattcgtggagcttccaatagtagttggatataccggctcaagtggctccacaaaggaattagttgcgatggttaggagaaggtacgaggagatgcccgagttaattgaacccattctagagtcaatgggtaagctcgtggataaagctaaggaggtaataatatctaagctcgatgaggaggaaaagttcctgaaattgggagagctcatgaacataaatcatggccttctcgatgccctaggtgtttcaaccaaaaagctaagcgaactcgtctatgccgctagaactgctggagcaattggagccaagctaacgggggctgggggaggtggatgcatgtacgctttagctcctgggaagcagagggaggttgctacggccataaagatagctggcggaactcccatgataacgaggataagcaaggaggggcttagaatagaggaggtaagggaatga

SEQ ID NO: 45271 - DNA, 1680 bp, Pyrococcus abyssi
atgaggtacatagagctggcccaactttatcagaagttagaaaaaacaacaatgaagcttattaaaacgaggcttgttgcggactttctcaagaaggttccggaggatcatctcgagttcatcccctacttaatccttggcgacgtcttccccgagtgggatgaaagggagcttggagtgggtgaaaagttattgataaaggcagtatctatggcgacgggaatagactccaaggagatagaaaactcggtaaaagatacgggtgatttgggtgaaagcatagctttagccgtaaagaagaggaaacaaaagagcttcttctcgcaacccttaacgattaagagggtctaccaaaccctcgtcaaagttgccgagacaactggtgaagggagccaggataagaagatgaagtaccttgcaaacctgttcatggatgctgagcctattgaagctaagtacatagcgagaacggtgctcggaacgatgagaactggagtagccgagggactgctcagggatgcgatatccctagcatttaacgtcaaagttgagctcgttgagagggcttacatgctaactagcgactttggattcgtcgcaaaaattgccaaaactgagggtaatgatggattagctaaggtgacaattcagattggtaagccaataaagcccatgctagcccaacaggcggccaatataaaagaggcccttcttgagatgggtggggaagccgagtttgagataaagtacgatggagctagggttcaagttcacaaagacggagagaaagttacaatttactcgaggagactcgaaaatgtgactagggcaatacccgaaatcgttgaggcgataaaagaagccctaaaacctacaaaagctatagtagagggagaattagtcgctatcggagaagatgggagaccactcccgttccaatacgttctcaggaggtttagaaggaagtacaacatcgaggagatgatggaaaagatacctctcgagttgaatcttttcgacgtgctatatgttgatggggtaagcttgatagacacaaagttcatggagaggagaaagaagctagaggagatcgtagagacgaatggaaaagttaagatcgctgagaacttgataaccaagaatgttgaggaggccgagcagttctacaagagagccctcgagatgggacacgaagggttgatggccaaaaggttggatgcagtttacgagcccggtaacaggggtaagaagtggctcaagataaagccgacaatggagaatttagaccttgtgataataggggcagaatggggagaaggaagaagggcccatctcctcggttctttcatcctcggagcgtacgatcccgagactggtgaattcttggaggttggaaaggttggaagtggattcactgatgatgacttagtggagttcaccaagatgctaaagcccctcataataaaggaggaagggaagagggtctggattcaaccaaaggtcgttatagaggtaacataccaagaaatccagaagagtccgaagtacaggagcgggttcgcattgagattcccaaggtacgtggccctgagagaggataagggtccagaggatgcagatacgatagagagaatagcccagctttacgaacttcaggagaggatgaagggaaaggtgtga

SEQ ID NO: 45272 - DNA, 1257 bp, Pyrococcus abyssi
atgagaatagctgtaatcggcctaggctatataggattaccgactgcgataatgttcgcctcctcgggtcacgatgttatagggtatgatattagaagagatgtggtggagaaagttaatagaggaattgctcacatagttgagcccgaaattggggaaagactacgagaagtggtttccaaaggaaagcttagggccacaagtgattacaacgacctgaagggggcggacgcttttataatatgcgtccaaacccccctctctaatggagttccagatttgacctacctagagagtgcgataaagaccatagccaaggtgattgagaaggaggctttggtcgttatagaaagcacagtgcccccaggaacaactgagaggatggctaagcttcttgaagaattaaccggacttaaggaaggcgaagacttttacgtagctcacgctcctgagagggtgatgccaggaagaattttcaaggagttggtttacaactccaggataattggaggggtaagtgaaaaagcgtcaatattagccgaaaagttgtacagatcgttcgtaaaagggagaatattcctaacaacggccacaactgccgaaatggtcaagctcatggagaacacattcagggatgttaatattgccctcgccaatgaatttgcttttctggcccataagtatggggttaacgtttacgaggctatagagttggcgaatacccatccgagggttaaaattcacagaccaggaatcggagttggagggcactgtctccccaaggacccttatctcctcttggcaaatgttgatgaagatttgggactgattagaaaggctaggaaaataaatgaaagcatgccaaggtttgctgctaagcttttatttgaggctttaggtgaggctaacgttgatcctggggatgccgtggtgctagtcctggggttagcatacaaaggagatactgatgacgttcgaaattctccagccctagaattcattaagattatcgagaaggacgtgaaggaggttaggacttacgatccctatgtaaatggcacccacaccattttagaagaagcagttaaaggtgttgatgctataattatagcgacggatcattcgatgttcagggaaattgagtgggataagctcggaaacctcatgaggaataagataataatcgatgggagaaacctcgtgaaggaacctcccaaggggtttatattcaaaggtatagggaggggcgacgtttga

SEQ ID NO: 45273 - DNA, 1263 bp, Pyrococcus abyssi
atggttgagcaggacccatttgaaattgcggttaagcagcttgagagggctgctcagtacatgaagataagtgaagaggctctcgaattcttaaagaggcctcagagaattgttgaagttaccataccagttgagatggatgatggttctgtaaaggtcttcacaggatttagagtccaatacaactgggctaggggtccaactaagggtggaattaggtggcaccccgaggaaacgctcagcacagttaaggctcttgccgcttggatgacttggaagaccgctgttatggacttaccatacggtggaggtaagggtggaataatagttgatcccaagaagctctcagacagggagaaggagaggctcgcaaggggatacataagggcaatatacgacgtaataagcccatatgaggacatcccagctccagacgtttacaccaacccacagataatggcttggatgatggatgagtacgagacaatagcaaggaggaagacccctgcctttggaataatcacaggaaagccactcagcattggaggatcacttggaaggaacgaggctactgcaaggggagcttcatacacaattagagaggccgcaaaggttcttggatgggatgacctcaagggcaagacaatagcgatccagggttatggtaacgcaggttactatttagctaagataatgagcgaggactacggaatgaaggtcgttgcggtaagcgacagtaagggtggaatctacaacccagatggacttaacgctgatgaggttctcaagtggaagagggagcatggctcagttaaggacttcccaggagccactaacataaccaacgaggagctcctagagcttgaggttgatgttctcgcaccagctgcaattgaggaagtcataaccaagaagaacgctgataacatcaaggctaagatcgttgcagaggtagctaacggtccagtcacaccagaagctgacgagatactcttcgagaagggaatcctccagataccagacttcctatgtaacgcaggtggtgtgacagtcagttacttcgagtgggttcagaacataacgggttactactggacactagaggaggtcagggagaagcttgacaagaagatgaccaaggcattctacgacgtctacaatactgcaaaggagaagaacatccacatgagagatgcagcatacgtcgttgcagtccagagagtctaccaggcaatgcttgaccgtggttgggtcaagcactga

SEQ ID NO: 45274 - DNA, 783 bp, Pyrococcus abyssi
atggcattcgttccaccgcaggcaggttacgatagggccattacggtcttcagtcctgatggtagactgttccaggttaactatgcaagggaagccgtaaagaggggggcaaccgctgtaggggttaagtgtaaggacggagtagttttagctgtagaaaagaggatcactagcaggttaatagagccggaaagttatgagaaaatctttcagattgatgatcatatagccgcggcttcaagcggtataattgccgatgctagggttttggttaacagggcaaggcttgaggcccagatacacaggctaacctatggtgagcccgcgccattggccgtgatagttaagaagatatgcgacctcaagcagatgcacactcaatatggtggcgttagaccgtttggtgccgcacttttaatggctggggtaaacgataagcctgagctttacgagactgatccaagtggagcgtacttcgcatggaaggctgttgcaataggaagcggaaggaacaccgcgatggctatattcgaggacaagtatagagatgacatgacgctggatgaggctataaagttagcaatcttcgccttagcaaagacgatggagaagccgagcgcagagaacatcgaagttgccgtgataaccgtgaaggataagaagttcaggaagttatccaaggaggaaatagagaagttcttgggtgaagtgatgaaggaggttgaagaggaggaggtgaaagagaaggaggaggattactcagagctcgatagccactattga

SEQ ID NO: 45275 - DNA, 3354 bp, Pyrococcus abyssi
atgagaggtccgaccgttgtagaggttactcccgacgatctttggattgttatggagagctactggcaagaaaagggtctcgtaagacagcacttggattcttacaatgccttcattgataggggccttcaagaggtcgttgatgaattcggaggaataaagccggatattcctgattttgaagttaagtttgggaaaataagggttggagaaccagaattccaggagcctcatggtcaaaggaagccactgtacccaatggatgcaaggattaggaacctaacttactccgcacctctctacctggaaatgatacccgtgattaggggaatagaacaggaacccgttgaggtgagaataggggagctcccaataatgctcaagtcgaaagtttgcagactctatggacttagcgatgacgagttaaggcaactcggtgaggatccaaaggatcctggaggttactttataattaatggttctgagagagtaatagtttctatagaggatatagcccctaatagaaccctagtagaaaaagatgagaggcaggagaagtacatcgccaaggtcttctcttataggcatggttatagggctctcgttacagttgagagaaagaaggatggaattctatacgttggtatacccaacgttccaaagccggtaaagttcgtttatgtgatgagagctttaggtctggagagggataaggacatagtggatgccgttggtaatgatcctgaggttcagcagattctattcgacaaccttgaggatgcaagtgatatcactacccagcaggaggccctagagtacataggaaagctagtggctcctggccaagctagggagtacaggttgaagagggcggaatacgttatagacaacaatctcctcccacacataggtgtttcccctgaggataggataaggaaggcctactaccttggaatgatggcattaaaggtcatagagctatccctgggtaagagagatgaagacgataaagatcactacgctaacaagaggctgaggcttgcgggggatctgctaaaggaccttttcagggtagcgtttagtcagcttgtaaaggacatacagtaccagatgacaaagacctaccagaggaggggtgagaagtacgtatttgggaacatccacaggttcataaggaactcgataagacccgacgttcttaccgagaggattgagcatgctctagcaactggagcatggccgggtggaagaactggtgtgagccagttgctcgatagaactaattacgtctcaacgctctcccacctgagaagggttacatctcctcttgacagagagcaaccccacttcgaggcaagagacttgcacggaactcactggggaaggatatgtccaactgaaacccctgaaggtcctaactgtggtctagttaagaacttagcattaatggcccagataaccaccgcagttcccgaggaagaggtaaaggaatacctaatgtccctgggcatagttccaattgaggttagaaggccgagtccagagctctggagagtgtacctcaatggagttataataggaaccattgaggatggcaaggcccttgttgagaggattaagaaggacaggaggagcggaaagataagcgacataataaacgtcgcctattacgaggacgttagggaggtttacgttaatagcgatgatggtagagttaggaggccactaataatagtcgagaacggtaagccaaagctaactaaggagcacgttcaggcaattaaagagggaagactcaagtggagcgacctcgttaggatgggcgtaatcgagtacctcgatgctgaagaggaggagaacgcgtacgttgcgatgtggccctgggaggtcaccgaggaacacactcatctcgagcttatgcccgcagcaattctaggattgccggcttcactaattccatacccagagcacaacgccgccccgagaaatacatatggagccggtatggccaagcagagtttgggtcttggatgggctaacttcaggattagggtcgacacgaggggtcacttgttacactatccacagattccactcgttaactctagaataatgaaggccgttggttacgaggacaggcctgcgggtcagaacttcgtcgtcgctgtcttggcttatcacggctataacatggaggatgctattataatcaataaggcatctatagagagaggattagctagatcaacgttcttcagaacgtacgaggctgaggagaagaagtacctaggaggtcaaaccgataagttcgagattccatcacctaccgttaggggatacaggggagagaagtactacaggcacctcgatgaagatggtttgatattcccagagtcaaaggttgaaggaaaggacgttctgataggcagaacatcaccgccaaggttccttgaggagagagggttaggagctgttagtttacaagagagaagggaaacgagtgttgccgttaggcccagtgagaggggtgtagtcgataaggtgataataactgaaactggagatggaactaagctggtcaaggtcacggttagagacttaaggatcccagagattggagataaattcgcttcaaggcacggtcagaagggtgtcataggattgatagtgccccaagaagacatgccttggaccgagagcggaatagttcccgacctaatagttaacccacacggtatcccatcgagaatgaccgttggacagttacttgaggctattggaggtaaggtagccgctttaaagggaaggagggttgatggtacagcgttcataggggagcccgaggagaagctcaggaaagagttagaagagcttggcttcaagcacaccggaagggagataatgtacgatggaattactggaaagaggttcgaagctgacatattcgtcggagtaatctactaccagaggctgcaccacatggttgccgataagatacatgcaagaagcaggggtccagttcaggttctcaccaagcaaccaaccgagggtagagctagggaaggaggtctcagattcggagagatggagagagatgtcctcgttggtcatggtgctgcaatgctactaatcgagcgtcttctggaggagagtgataagactgaagtctgggtctgtgagaactgtggtcacatagccttggaggacaagagaagacataaggtctattgtccagtctgtggagaggaggagaggattagtaaagttgagatgagttatgcgtttaagctactcttggatgagcttaaggccatggttattaggccaaagttaaacctcacggagagggtgtga

SEQ ID NO: 45276 - DNA, 735 bp, Pyrococcus abyssi
gtggttctcgtgaccgctgtagcggtttctaacttagagaaggattatggaaaggttaaagctctaaggggggtaagctttcagatagaagaaggggagatatttggtttgataggccctaacggtgctgggaagtctacaacgctgaagatcttggcaacgcttctccatcccacggggggaagggctgaggtctttgggcatgacgttgtcaaagaggccagcgaggttaggaagttgataagttatttacctgaagaggccggcgcttacaagaggcttacaggcttagaatacctagaattcatggccaaactctatgctaaggattcaaggaaggctgaaaagatgctcaagcttggaatagagctcagcggtctcggtgagaggctcaatgataaggtctcaacttattccaagggaatggttaggaggcttttgcttgccagggccttgatggttaagcccaagctagctatcctggatgagccgacgagcggtttggacataatgaacgccttcgagattaggagaacgatcaaggagttctccaaggagggggtgacattcctaatatctagccacaacatgctcgaggttgaatacctctgcgatagggttgccctaattcacaagggtaggatcctcgaggtgggaacccctcgagagttgaaggagaggtacaatgccgagaacctcgaagaagttttcatggaggctgttaaaaatgtctga

SEQ ID NO: 45277 - DNA, 912 bp, Pyrococcus abyssi
ttggtgagaggtatgctcgaagtgaatctctttggaataaaattcaagaatcccctaattctggcttcaggcgtagtggacatgacgcccgagctcttaaggagggcccatagggaaggtgccgggggtgtcgttactaaatctataggaatggagcccaggaaaggttacgaaaatcctacgatcgttgagctaccttatggactaataaacgccatgggcctccccaatcctgggtgggaagcatttctcgaagaatttcggaaggagaagttcgattttccagttatagtttcaatatttggaggaacaccagaggaattcgcttttctagcggaaaaactaggggaagttgccgatgcatttgaactgaaccttagttgtcctcatgctaagggatatggtatggaaatagggcaaaaaccagagaacgtatacgaagttgttaaagcagttaaggacgtgacggataaaccagttatagcaaagttaaccccaaacgttagtgatataagggaactcggactagccgctgagaaagctggagccgatggtgtttcagccattaacaccgtgaaggccattgcaatagatatctacgctaagaggccgatactcagcaacaagtttggaggttattcaggacctggggtcaagccaatagcattaagggcggtttacgatttagctagctccttggatattccagttatagggataggtgggataaccacgtggcaagatgccgttgaattcttgcttgccggagcttccgcccttcaaattggaaccgccgtctacttaagggggttctcagtttttagggagatagcagagggaatctcaagatacctgaaggaagaggggtactccagcgttaaggaaataataggcctcgccctaaaggtttaa

SEQ ID NO: 45278 - DNA, 987 bp, Pyrococcus abyssi
atgtacgcgattgaggttgagaacttggttaagaagtacggagattttacggcggtaaaggggatatccttcaaggttaagaagggcgagatattcgccttccttggacccaacggggctggaaaaactacaaccgtccacgttttaacgacgttactaaagccaacctctggaaaagctatagttgcaggtcacgacgtagtgaaggaaccccaggaagttaggaagaagataggaatagtatttcaagacccaagcttagacagggaactcacggcctacgagaacatgtacattcacggcatgatatacggcctcaagggaagggaactaaaggaaaagattgaggaactcttaaagttcgtcgagctctggaggttcaaagatagaccagtaaagtacttctcgggaggaatgcagagaagactagaaatcgcgagagccttaatccacgagccggagatcctcttcttagatgagccgacgatagggctggatcctcaaactagggctcacatctgggagtacataaggactatgaaggaggagcacgagatgacgatattcttgactacgcactacatggacgaggccgagcagttagcggacaggatagccataatagatcacggtaagataatagccgagggaacttctgaggaacttaagaagctcgtcgggaacgacattatctacctgaaacttgaaagcccaaaggaagagctgaagtgcctgaaggctgatttcataaggggatgcaagcttctacccgatggtagggttagaatagatgtagagaacgctactgaagcgttgccgaagctgttcgagctcgcccagaagaacaacgtcaagatccttgaggttacatatcacaggcccacgctaaacgacgtgttcctgcacttaaccggaagggagattagggatgaagagggtggagaaagcttcgccagggtggttatgagggccagaatgaggaggtga

SEQ ID NO: 45279 - DNA, 1296 bp, Pyrococcus abyssi
atgaaagcaatcgatgttatcgagaggtactccaagataatcgccccggctaacaggatgcactacttccccctcgttcccgtcagggctgagaacgctaagatatgggacatagaagggaaagaatacatagattttctcagcaacgccgcagttcaaaacgtgggccacaacaacccgagggttgttaaagccataaaggagcaggtggaaaagcttacccacgcaagctacatctactcctaccctgtggagcccctgttgctcgctgagaagttagccgaaatagcgcccgttgatgaccccaagatctcctttggacttacgggagcggatgccaacgatggggccattaaatacgcgagggcttacactaagaggcaggcaatcctgagttacatgaagagcttttacggttccacatatggcgccatgagcctcacaggattggactttcaggtcagggcaatggttggagagctcagcgagattcactacattccttatccaaactgctaccgctgtcccttcgggaaggaaccagggagctgtaaaatggaatgcgtagagtacttgaaggagaaattcgagggagaagtctacgctgaaggagtcgcggcactctttgcagagcctattcaaggggactctggaatagtggttcctcccaaggattacttcaggaaggtcgttaaaatcctaagggagcacggaattctcttcgttgtggacgaggttcagagtggcatggggagaactggaaagtggttcgcgatagagcactttggagttagaccggatataataaccgtgggcaaatccctcggaggaggattacctattagcgcaactataggcaggagggaaatcatagactcgttaccaccgctgagccacgccttcacgctctcgggcaatccaacggcttcaagggccgctctagctgttatagaggagatagaggagaaaaacctgttaagaagggcagaaaagcttggaaaccacgccatgaagaggctcaagaagatgatggacgagcacgagctgataggagacgttaggggaatagggttgatgattggagtagagctcgttaaggacagggagactaaagagagggccatagaggaaacccagaaggtcatagagagggcctttgagctcggattgatcgttacgcacttcaacggaaacgtcctcaggatagagccaccgctaacgatagaggaggagacccttgacgaggggctggacatacttgagagggccataagtgaagttgaggaggagaaatag

SEQ ID NO: 45280 - DNA, 1287 bp, Pyrococcus abyssi
atgccaaaggagaagccccacgttaacatcgtgtttatcggacacgtagaccacggaaagagcacgaccatcggaaggctcctctacgacaccgggaacatcccagagaccatcatcaagaagttcgaggagatgggtgaaaagggtaagtccttcaagttcgcttgggtcatggacaggcttaaggaggagagagaaaggggtatcaccatcgacgttgctcacaccaagttcgagaccccacacaggtacatcacgatcattgacgctccaggtcacagggacttcgttaagaacatgatcaccggtgcaagccaggccgacgctgcagttctcgtcgttgcagctaccgatggtgtcatgccacagaccaaggagcacgccttccttgcgaggaccctaggtatcaagcacatcatagttaccataaacaagatggacatggtcaactacgaccagaaggtattcgagaaggtcaaggcccaggttgagaagcttctcaggaccctcggttacaaggacttcccagtcattccaacgagcgcttggaacggtgacaacatcgttaagaagagcgacaagatgccatggtacaacggcccaaccctcattgaggccctcgaccagatcccagagccagagaagccagttgacaagccactaagaatcccaatccaggatgtgtactcaattaagggtgtcggtaccgttccagtcggtagggttgagaccggtaagctcaaggtcggtgacgttgtgatctttgagccagcatcaacgatcttccacaagccaatacagggtgaagtcaagagcattgagatgcaccacgagccactacaagaggccctcccaggtgacaacataggattcaacgtcagaggtgtcagcaagaacgacatcaagagaggtgacgttgctggtcacccagacaagccaccaacagtcgtaaggaccaaggacacattcaaggcccagatcatcgtcctcaaccacccaactgcaattacggtcggttacagcccagtcctacacgcccacactgcccaggttccagtcaggttcgagcagttactcgctaagatcgacccaaggactggtaacatcaccgaggagaacccacagttcatcaagaccggtgactcagctatcgtcgttctaaggccaatgaagccagtcgtccttgagcccgtcaaggagcttccacagctcggtaggttcgctatcagagacatgggtatgaccatcgcagctggaatggttatctcaatccagaagggtgagtga

SEQ ID NO: 45281 - DNA, 903 bp, Pyrococcus abyssi
gtgaccaagcaaagggtttgtcccgtttgtggatcaaccgagtttatttacgaccccgaaaggggtgaaatcgtctgcgcacgctgtggatatgtaatcgaggagaacatagtcgatatgggaccagaatggcgtgcttttgatgcttctcagagggagaagcgttctaggacgggtgcgccagagagtattttacttcatgacaaggggttgtcgacggatattggcattgataggagtttgactgggttgatgagggagaagatgtacaggcttaggaagtggcagtctaggcttagagttagtgatgccgccgagcgtaatcttgcattcgccctaagcgagttggatagaattaccgcccagttaaagcttccaaagcacgttgaggaggaagctgctaggctttatagggaagcagtaagaaagggtttgatcaggggtaggtctatagagagcgttattgcagcctgcgtttacgcggcttgtaggctattaaaagtcccgaggactcttgacgaaattagtgatattgctagggttgagaagaaggagattgggaggagttatcgttttattgcaaggaatctaaacttgactccaaagaaactctttgtaaaacctactgattacgtgaacaagtttgctgacgagcttgggttaagcgagaaggttaggaggagggctattgaaattttagaggaggcttacaagaggggtttaacgagcggtaaaagcccagcgggattagttgccgcagcactctacattgcatccctcttggaaggagagaagagaacccaaagagaagtagcagaagtagcaagagtaacagaagtaacagtaagaaacagatacaaagaactagtagagaagcttggaataaaggttcccgtcacttga

SEQ ID NO: 45282 - DNA, 360 bp, Pyrococcus abyssi
gtgatgaagctcaaaactttacccccaacgcttagggataagaacaggtacatagccttcgagataattagcgatgatgaattcacgaaggatgaggtgaagagcctaatatgggaggcctcgctgagggttctcggagagcttggaacggcgttggccaagccatggttcataaagtacgatccaaaaacgaagacagggatagttagatgtgatagggagtacgtggagcatttaaggtttgccctgatgctagccactgatttcaatggtaaaaggctaatcataaggactcttggagtatcgggaacgataaagaggcttaaaaagaagtttttgagccagtatggttggaaatga

SEQ ID NO: 45283 - DNA, 1041 bp, Pyrococcus abyssi
atgcacctaatggagtttccccgtgaagttattcttggcaagaatctcgttccagaagttaataacgttataaaaaggttaaagctggaatcccctggcttagtcgtttatgggccagttaccaagaagatagccggcgagagtgtgaaaaaagcgattagggatgaatttgacgtttattcgatcaccgtgaagaaggctcacataggggaagtcgaaaaggttgaggctaaaataagggactacaacattaagtgggcaatagccgttggaggaggaagcataatagatgtaacaaagttggcaagctacagaagtggaatacctttcataagcttccccacaacggcctcccacgatggaatagcgagtgcaaacgcctctattagaggcatagaggcaaaaacgtcgataaaggccagaccgcctattgcagtgatagccgacatcgaggtaataaagacggcgcccaggagatacttagcggctggggttggggatgtaataagtaacataacagcggttagggactggaaattggcccacaagctcaaaggggaatacttcagcgagtacgccgctgcactcagtttaatgagtgccaagatggtgattagggatgctgagataataaggctcggcaacgacgaaggagttagaaaggtcataaaggccttgatttcaagcggggtcgccatgagcatagctggttcttcaaggccagcgagcggagcggaacacctatttagtcatgccttagaccttctccttgataagccggcattgcatggagagcagaccggaataggaaccataattatggcgtacttgcatgggataaactggaggaagatcaaggaaaccctgaaaacagtaggcgcgccaacgagtgcttacgaactaggaatagatccggagataataatagaggccctaactatagctcacaaaatcaggccagaaaggtacaccatcctgggcaaggagggtttaactagggaagccgccgaaaaggcagctaaaatcacgggtgtaatttaa

SEQ ID NO: 45284 - DNA, 918 bp, Pyrococcus abyssi
ttggtgctagttatgatatgctccataggggaattacttgtagatgttatagcaaccgaagagggtgacctaaaggacgttagacttttcgagaagcatcctgggggagcccctgcaaacgttgctgttggaattgcaaggttaggttttgactcttgcctagtaagcaaagttggggacgacccctttggggaattcttggtggaatcacttagaagggagaatgttaaaaccgatggcatcgtgaaggatgaagaaaagcataccggaatagtcttcgttcaacttactggggtatctccgagctttatcttgtacgatggcgttgcatactttaacctaagacgggaggacatcaactgggagctgattaattcttcaaggatagttcactttggttcagtgattttggctagaagtcctagtagggagaccgtcctcgatgtaattaagagggttaaaaccattgtgagctttgacgtaaaccttaggttagacctctggaagaacaggggagaggatatgctgagaacgattgaggaagcgataaaattggctgacatcgtaaaggccagcgaggaagaggtcgattacttggaggataacgggatagaagttgagggtaaattgataactgcgataaccatgggttctaagggggccaagctcaacggtattcaagttccagggtacaaagttaaccccgtcgatacaaccggtgcaggggacgcgttcaccgctgcccttttggtggggatcatgaaggttagggagattaccaacgagaatttggagaagataggaaagttcgcaaacctagttgcggccctttcaacgcttaaaaggggagcctggagcgtcccaaaagttgaggaattgctaaaatataaggaagcaagggaaatactaagactttaa

SEQ ID NO: 45285 - DNA, 1365 bp, Pyrococcus abyssi
atggagctcaagccgaacgttaaagaaattcctgggccaaaggcaaggaaagtgattgaggaacaccacaagtacatggctacaacgacaaacgatccaaatgagtactttcttgttatagagaaggcggaaggggtttattggatcgacgttgatggcaacgttatccttgacttctcctccggaattggagtcatgaacgttggtcttaggaatcccaaggtgatcgaggccataaagaagcaacttgacttagtccttcacgctgctggaaccgattattacaacccctaccaagttgagctcgcaaagaagctcattgaaatagccccaggagacatggagaggaaagttttcctaagcaacagtggaactgaggcaaatgaggctgcattgaagatagccaagtggtcaacaaacaggaagatgttcatagctttcataggggcgttccacggaaggacccacggaacgatgagccttacagctagcaaacccgttcacaggagtaggatgttcccaacgatgcctggagttgagcacgttccatatccaaacccgtacaggaacccctggggaatcgacggttatgaaaacccagatgagctcataaacagggtaatcgagtacatagaggattacctatttgagcactacgttccagcagaggaagttgctggaatattcttcgagccaatacagggagagggcggttacgtagtcccaccaaagaacttcttcaaagaacttaagaagctcgccgataagcatggtatcctcctaatcgacgatgaagttcagatgggaatgggtaggacaggaaggatgtgggctatagagcacttcgacgtagttccagacataataaccgtggcaaaggccttgggcggtggaattccaattggtgccacgatattcagggctgaccttgacttcggagttagcggagtccacagcaacaccttcggtggaaatgccgtggctgctgctgcggcactcgcggttatagaagaactccagaacggcctgatagagaacgcccagaagctcgagccattgttcagagaaaggcttgaggagatgaaagagaagtacgagataataggagacgttagaggactaggattggcatggggagttgagttcgttaaggacaggaagacgaaagaatacgcaaccaaggagaggaacgaaatcgtcgttgaagcattgaagagaggattagcacttctcggctgtggaaagagcgcaataaggcttatcccaccgttaataattagcgaggaagaggcaaagattggtcttgacatattcgaggaggcaataaaggtcgtgagcgaaagacacggatacaagattcactga

SEQ ID NO: 45286 - DNA, 1032 bp, Pyrococcus abyssi
atgggagttcctataggggagttaataccaagaaaggaaatagagctcgaaaacttatacggtaagaagattgccatagacgcccttaacgctatctatcaattcctctcaacgataaggcagagggatgggactccactaatggactccaagggtaggataacctcccacctgagtgggctcttttacagaacgataaaccttatggaggccgggattaagccggtgtatgttttcgatggaaaacctccagcgtttaagaagaaggaacttgagaaaagaagagaagcaagagaagaagctgagataaagtggaaagaggctctggccaagggagacatcgaggaagcaagaaagtacgctcaaagggctaccaaagttaacgagatgcttattgaagacgctaaaaagcttttacagctcatgggaattcctatagttcaagctccaagcgagggagaagcccaggcagcgtacatggctggcaagggagatgtttatgcctcggcaagccaagattatgattccctactctttggaactccaagattggttaggaacctcacgataactggaaagagaaaaatgccaggaaaggatatctacgttgagataaaaccggaacttatagttcttgaggaagttttgaaggagctcaagataactagggaaaaacttatagagctagcaattttggttggaactgattataatcctgggggcataaaaggtatagggcctaagaaagcccttgaaatagtgaagtattcgaaagaccccttggctaagtttcagaggcagagcgacgtggatctctatgcgataaaggagttcttcctgaacccaccaactactgatgattattcactgaaatggaaggaaccagatgaagaaggaatcataagatttctctgcgatgaacatgattttagcgaagaaagggtcaagaatgggttagaaagactcaaaaaagccataaaagcaggaaaacagtcgacccttgaaagctggttcatcaaaaagaaaccctga

SEQ ID NO: 45287 - DNA, 624 bp, Pyrococcus abyssi
gtgttgcagttgactgagaaattcaaaggtacaactacagtaggcattgtttgtagtgacggagtagtgcttgccgcggacagaagggccagccttgggaacattgtatatgccaagaacgttactaagatacacaagatagatgagcatctagccatagcaggagcaggcgacgttggggatatattaaacttagttagactactcagggctgaggcaaaactatactacgctcaatccgggaagaggatgagcgtcaaggctctagctacgcttttggcaaatatgctcaatggagctaggatgctcccgtacttggcgtggttcttagttgggggttttgatgaaaagcccaggttatattccgtggatatgatgggagggataactgaagacaagtacgtggccgctgggagtggaatggagtttgcgtattcggttcttgattcagaatatagggaggacctgaaggtaagagaagggataaagattgccgttgaggcgataaattcagcaattaaaagagacgtattttctggagacggaataatggtagttactataaccgaagaaggctacagggagctctcaaactcgaggcttaaggcaatcctcagacagtaa

SEQ ID NO: 45288 - DNA, 1170 bp, Pyrococcus abyssi
atggcgatgagcgataggcttgaccttgttaacccttctgaaattagaaagctcttcgatatagcggcgggaatgaaggatgtcatatccctggggattggggagccggactttgatacccctcagcacattaaggagtatgctaaggaagcccttgatatgggattaacgcattatggccctaacataggcctgccagaattgagggaggcgatagctgagaagttgaaaaagcaaaataacattgaagctgacccaaataaggagattatggtcctcgttggtgccaatcaagcgtttctcatgggtctttcagcatttctaaaggatggggaagaagttctaatcccaacccctgccttcgtcagctacgctccagccgtaatattagctggaggaaagccagttgaagttccaacgtacgaagagaacgagttcagattaaacgttgatgagctaaagaagtacgtcacggagaagactaaggccttaataataaactctccttgcaacccaacaggttccgttttgaagaagaaagacctagaagagatagcggattttgccgtggagcatgatttaatagtgataagcgatgaggtttatgaacactttatatatgacgatgttaagcactacagcatagcttctttggatggaatgtttgagaggacgataacagttaacggcttctcaaagacgtttgcaatgactgggtggagactcggctttgtcgcggctccctcatggataatagagaagatggtcaagttccagatgtacaatgcaacgtgcccagtaactttcatccaatatgcggcagctaaggctctcagggatgagaggagttggaaggcagttgaagagatgaggaaggaatatgacaggagaaggaagctcgtgtggaagaggcttaacgagatgggtctcccaactgtaaaacccaagggtgcattctacatattccccaggataaaggatacgggattaacgagcaaggaattcagcgaactaatgttaatggaagcgaaggttgccgtggttcctgggagtgcattcgggaaggcaggggagggctacgttaggataagctatgcaacagcctatgaaaagttggaggaagccatggacagaatggagaaggttttgagggagaagaagctcacctaa

SEQ ID NO: 45289 - DNA, 918 bp, Pyrococcus abyssi
atgaaagttatagaaattgagaacttgacgaaatcttacgggaaatttaaagccgttgacaatctttcactggaggttgaaaaggggataatatttggatttttgggaccaaatggtgctgggaagaccactacgatactaagtatgctgggaataataatcccggatagcggaagcgtgaggttgctaggttatgacatcttcaaggaaccaattaaagcaaaggaaagacttggattcctccccgaaaacgctacgatatacgaggagctaacagcttggaggaaccttgacttctttgcaagcttctataatatcccaaaacaggaaaaagaaaagaggatagaggagctcctgaagctagttggcctctgggatgtgagatataggaaggtgaagtcgttctcaaagggaatgaaacagaggctcttattagctcaggccttaattaacgatcccgaattgttaatactcgatgaaccgacgagcggtttagatccccaaggtgcaaggctcgtaaaggacataatattggagcagaaaaagcagggaaaaacagtcttcttttcatcccacatacttagtgaggttgaggagctcgccgataaagtcgggatcatcgtaaaaggaaaactaagaacggtaggaactctggaagagattaaaaagcagtacatggagcttgaaggttacgagataaaggtagagacgaagcagccatttccagaaatagagctgcctgacgtgataaggattgagaagatagccgataacaaggttttgatatttgctaagagcgatataagggaaattctaagcgaggaactctcaaagaggggtataactgtcttaagcttggaaattgaggagccaagtctcgaggatgtgttcctaaagacaatatacaggagggattaa

SEQ ID NO: 45290 - DNA, 1914 bp, Pyrococcus abyssi
atgttctcggcctgcatgagggattgctacgatacgtgctcgataataagcgaattcaggaatggaaaactcatcgtaaaaggcaaccccgagcatccaataaccagaggttttctctgcccaaaaggtgccctattgccgagatggtttcactcgaaggataggctaaagctccccctaatcaaagagggagatgaatttaatgagacatcgtgggacaaagcgataagtctggttgctgagaagttgaaggagatgataaaagagtacggaagcgagagcgttctcgtttataagtacgctggtgacaggggagttgttaactactattttccaatgcgcctcttccactacctcaacgcgagcacgatagatggtggaatatgcgacagggcaggacaagaggccctgaaagatatctatggaactgcagttggggtggaccctgagaagctcaaagagcacaagttaatagtttactggggaataaacgctttctggacgaatcttcacggcttcatgtttgcgaagagaaataatttggagatatggacggttgatgtagttagaactgaaacggcaaagagaagcgataaattctttcaagtaaggccagatacggacgttctctttgcacttggagttgcgaaggttatgatagaggagaacttgtacgatgaagatttcgttagggagaacgtttatggatttgaagaattcaagaactatgtaattaaattatcgcttaattatgtatcccaggagactggggttgaggttgaggagatcagggaatttgctagggagttcgcggagaaaaaggggataattcatataggctacgggtttcaaaggtctctagctggaggggaagccgtaagggcaatagctatcttgccagctctagttgggcataggttcggcttcatatacgacatgaaaaccatagacaaaagctatgctgaggctaagtttcttagaacgaaacccgaacttaggattccacaaatggaactaacagaggcgatagaagatggaagggttaagttcctatacatctataattccaacccgttagcgagttatcctaaccagaacaggcttagaaaggctttgaggaagaacgatatcttcgtcgttacccatgacatcttcctaaccgacactgccttgttctccgatgtcgttcttccggccaatactttcttcgagaggcttgacatagtcgattcctattaccaccgctacgttctcctcaacgagcccgtggccaagggacccggaaaaagtaacagtgaagttacaaggctaattgccaaggcgttagggataaagaacccctacttgtatgagagcgatgaggaagtgataaggaaggttctagaggcaaataggataagcttcgaggagttgaagaagaagggattcgtgaagattccagagggtgaaaggaagtggaacactccgagcggaaagatagaattctactcccagagggcagttaagaggggcttgagtcctttcccggagtacaagaagttcaaagggaagtatccactcagactgctaagcccaacttataggatgaccgtgacgagccagtatcacaacacacatggaattattgattcaaacttgtatatgaatccaaaggatgctgctgagagaggaataaaggatggagatgaggttatcgtctttaacgaaaatgggaaaataaagacaaagattaagctaacggaagacgtgcccccaggagttgttctcctgtacaaggcattctgggttaagctactcggctggaacgtcaacttcctaactactgataagaaagtagaaaagtacgggaaaggctcagcattccattcaacgtgggttgaggttattcgatgtggtgaacctggggtaaagtag

SEQ ID NO: 45291 - DNA, 1998 bp, Pyrococcus abyssi
atgtttattggtgatagggtgataagggttgtttgtccctattgcggtttcggctgtaaccttctcatagatcctaagacacttaaggttaaaccctacaagggggagcccaacaggggtaagctctgccctaaaggtttgcatgccttggagttcgtgctgtcaaaggataggctcagatacccattgaagaaggtgggtagtgacttcgttagaataggctgggatgatgcaataagggagatcgcgagtaagctgagggagataaaggagagatacgggcccaacgcgatagcgttcatagcttcatctaaggtttcgaacgaggagaactatctccttcagaagatagctagattgttgggaaccaacaacatagacaactgcgcaagactttgtcatgaagctagcgttcatgcgctcaagatgaccctgggcgctggggtgcagacgaatccttactcggatctcgagaactttaaggcgataatgatctgggggtataatccggctgagacccatccggttgtcatggattacatcttaaacgctaagaggaaaggggctaagataattgttattgacgttagggaaacaacaacaatgagactcgcagattacaagcttatgataaacccaggaacggacataaccctcgcaaacgctctcatgaacgttataatctccgaggggttgtacgataaagagttcgtaaggagcagaaccgttgggttctctgaggtgaagatggccgttaaaaagtatacccccgagtacgccgagaaggttactggtatagaggcgaagttgataagggaagtagctagggaatttgccaaggctggtagtggagctataatgtggggcatgggattaacccagcacgtttctggggttgagaatgtgatagcggttatagacatggctttgctcttggggtacgttggtgataaaggtggcttgtacccaatgagaggccagaacaacgttcaaggtgcagcttatatgggtgctttaagcgagtttctaccaggttatgttcctctaacggattcaacgttcaggaagagggtagcttctctttggggagttgaggatatcccaacggagagggggctgtatttaacggagctctgggatgctatacttgagggggaagttaaggccctctacataatgggcgagaaccctgcggttagcgaggccaacgtcttaaaagttagaaaggcccttcaaaagctagaactacttgtcgtccaggatttattcctaactagaactgcgaggttcgcccactacattttaccggcagcagctttctgtgagaaggaaggaagttacatgaacagcgagaggaggattcagtggagctttaaggtctgcgatcccccaggggaagccaagcccgactgggagatactaagcttactggggaaagagctagatctccctgggttcccctatgaaaaggttgaggacataaccgaggagtacttcaagatgtttccagagttggcggggataagcgttgaagaactaaagaactccaacgggataataatcccctacaagaggttgcacactataaggttccagactccggatggaaaagctaggctgatagcggtcgaacaaataatgccctgggagcaaccgaacggcgagtatccgctgatattaaccacggtcagggtaatgagtcactacaatacaggtgagatgacgatgagaagtccttcgcttgttaagctgatgagcgagccggttgtttacataagtgaaagcgacgccaaaaagtacgggattaaggatggagacctcgtgaaggttgaaactaggaggggctcaatagtcctcaaagctaagataagcaaggtaaaggagggtgtcatagtggttccattccactttgacgctaacatcctaactaacgatgccctgaacaaggccggaactccggagcttaagtactcatccgcgagaattagaaaaatttga

SEQ ID NO: 45292 - DNA, 1197 bp, Pyrococcus abyssi
atggttagagcctcaaaaagggctctttctatagagtatgcaattagagatgtcgttctaccagctagagagctcgaaaagaagggtataaaggtcataaggctaaacattggcgatccagttaagtttgacttccagccaccggagcatatgaaggaagcatactgcaaggccattaaggaaggtcacaactactatggagatagtgagggtttaatggaactaagggaggcgatagttgagagggaaaagaagaagaatggtgtaaacattacgccagatgacgttagggttacggctgcagttacagaggcccttcagatgatatttggagcattactagacccaggagatgaaatattaattccaggaccaagttacccaccgtacaccggcctagtcaagttctatggtggagtaccagtagaatacagaacgatcgaggaggaaggctggcaacctgatatagatgaccttaggaagaagataaccgagagaaccaaggcgatagcggtaataaatccgaataatccgaccggagcattgtacgacaagaagactctggaggagataatcaacattgcaggtgagcatgacattccagttctaagcgacgagatctatgacttaatgacctatgaagggaagcacatttcaccagcatcactaaccaaggacgtcccggtaatagtgatgaacggcctatcgaaggtttactttgccaccggctggagattaggatacatgtactttgtagaccctgagggtaagctaagcgaagttagggaagccattgacaagcttgcaaggataagactgtgtccaaacactccagcccaatttgccgcaatagcaggactgaggggcccaatggattaccttgaagagtatatgaagaagcttaaggagaggagggactacatatacaagagattgaacgaaattcctgggataagcacgactaaaccacagggagccttctacatattccccaggattgaggaaggcccatggaaggatgacaaagagttcgtccttgacgtactccacaacgcccacgtcctctttgtacacggctcgggattcggagaatacggaagaggacacttcagggcagtattcctaccaccagtagaggttcttgaggaggcgatgaacaggtttgagaagttcatgagagagaagttaagctcttga

SEQ ID NO: 45293 - DNA, 435 bp, Pyrococcus abyssi
ttgttgggaaaagagaatgtggtggttaatatgattgaggttggagaatacaaggttaaggaaggcctctattataccaaggaacatgagtgggctcaagtgctggaagatggaacagttctcgttggaataactgattacgctcagaaggagcttggagatatagcctatgttgagctccctgaagttggaaaggaggttaaaaagggagaagttctttgtgaagttgaaagcgttaaagccgttagtgaagtgtacgcacctgtaagcggagaagttattgaggtcaacgaggaactaagtgacagccccgagaagataaacgaagatccttatggggcttggatagctaagatcaaaccaaataacttagaagaggaacttaaagagttgatggacgcagagaagtatgctgaattcttaaagagcctttaa

SEQ ID NO: 45294 - DNA, 1152 bp, Pyrococcus abyssi
atggaattcgaggacgcatttaaggaagtttatgagatggtgaaaccaaaatataagctttttacggcaggaccagttgcgtgcttccctgaagtgttggagataatgaaggtacagatgttcagccatagatcgaaggaatacagaaaggttcacgtagataccgttgagaggttaagggatttcctcgaggtcaagaagggtgaagttctactagtgccaagctcaggaactggaattatggaggccagcattaggaatggagttacaaagggtggaaaagttctcgtaacgataatcggagcatttggaaagaggtacaaagaggttgtggagactaacggaaggaaggcagtggtcttagaatacgagccaggaaaagctgtaaaacctgaggatcttgatgaggctttaaagaagaacccagatgttgaggcggtaaccataacttataacgagacatctacgggagttttaaacccactaccagaactcgctaaagttgcaaaagagcacgataagttggttttcgttgatgcggtttccgccatgggcggggctgacataaagttcgacaagtgggaacttgacgtcgtgttctcaagctcccagaaagcctttggcgttcccccaggattagccattggtgccttcagcgagaggttcatagagatagccgagaagatgccagagagaggttggtacttcgacattccgctttacatcaagtaccttaaggagaaggaatcaactccttcaacgccaccgatgccacaggtcttcggccttaacgttgttctcaggataatagagaagatgggcggaaaggagaagtggctcgagatgtacgagaagagagcgaagatggtcagagagggagttaaggagatcggcctaggaattctggcagagccagggtacgagagcccaacgatcacggctgtgctaacaccagagggaatcaagggtgacgaagtgtacgaagccatgagaaagaggggattcgagctagctaagggttacggtagcgttagggagaagacgttcaggattgggcacatggggtacatgaagttcgaggacatacaagagatgctcgacaacctcaaggaggtaatagaggaattaaagaagcagaaaggtatcaactga

SEQ ID NO: 45295 - DNA, 1278 bp, Pyrococcus abyssi
atggggtggcttaaaaaatacctagagttccctgttctgcaaaagatcttgattggccttatcctgggtgcaattgttggattgatcctcggtcactatggttacgccgatgcggtaaaaacgtacataaaacccttcggtgacctattcgtaagacttctaaagatgctagtgatgccaatagtcttcgcctcactagtagtcggtgcggccagtataagtccagctaggctcggaagggtaggagtgaagatagtagtttattacctactaacctcggccttcgctgtaactctaggaataataatggcaaggatcttcaacccaggagctggaataactctagccgaggctggaaagcagttccaacccaagcaggcgccaccactagttcaaaccctacttaacataataccaactaaccccttcggtgcccttgctaacggtaaagtgctcccaacgatattcttcgcgatagtcctaggaatagcgataacttacttgatgaacagcaaggatgagagggtaagaaagagcgcagaaacgttgttgaatgccataaacggtttggccgaggcaatgtacaagatagtcgccggagttatgcagtacgccccgataggtgtctttgcgttgatagctaacgtcatggcaagtcagggagttaaggtagtcggagaactcgccaaggttaccgtagctgtttacgtcggtctagctctccagatactactagtatacttcgtcctcctgaaggtgttcggcatcgatccaatcaagttcataagcaaggcgaaagatgccatgctcacggcgttcgtcacgaggagttcaagcggtacactgcctgttactatgagggtagcagaagacatggggatatccaagggaatctactcattcaccctcccactaggtgctacaataaacatggatggaactgccctctaccagggtgtctgtaccttcttcatagctaacgccctaggaatgcacctaacccttggccagcaattaacgatagttcttacggcagtcttggcttcaataggaaccgctggagttcctggagctggtgccataatgcttgcaatggttcttgagagcgtcggtttgcctctaacggatgctaacgttgctgctgcatatgcaatgatcctaggtatagatgcgatcctcgacatgggtagaacgatggtcaacgttaccggagaccttactggaactgcaatagttgcaaagaccgagggcgaacttaaagaaggaataatatactga

SEQ ID NO: 45296 - DNA, 828 bp, Pyrococcus abyssi
atgccgagaagggctagggaatatcccgaagagggagagtttgtggtggctaccgttaagaggattcacaattacggagcattccttgagcttgacgagtatcctgggaaggaagctttcatgcacataagcgaagtcgcctctacttgggttaggaacattagggattaccttaaggaggggcagaaggtagttgcaaaagtgataagggtagaccccaggaagggacatatagatttaagcctgagaagggtgacccaacagcaaagaaaggcgaagctccaggaatttaagagggctcagaaggcagagaatttactcaagctcgcggccgaaaagcttgggaaggacttcgaaactgcttggcgcgaggtttgggttccgttggaagaggagtggggcgaagtttacgctgcctttgaggacgctgccaaggatggtattgatgtcctaaagggccacgttccagacgagtggttgcccgttttgaaggagataatagataactacgtagaggttcccaccgtaaccatagatgcggagttcgagataacggttccaaagccaaatggagtggagataataaaggaggcactcataagggctagagatagggcgaacaaagagaaggatgtggaggtgaagttcacctacctaggagccccccgctacagaatagacataacggcaccggactactacaaggccgaggaagtccttgagagcatagccgaggaaatacttagggtcatcaaggaagcaggtggggaagctaccctattaaggaaggagaagaggataaagaaggttaagaagaggaagaagtga

SEQ ID NO: 45297 - DNA, 1089 bp, Pyrococcus abyssi
atgttcgaaaagggttacgtggatgagaactacgtgagaattccgaaggatgaactgttctcattcgtcgtcagggttctaactaagctcggaacaccagaggaagacgctaagatagtggccgataatctaataatggcagatttaaggggaatagagagtcacggagtccagaggttgaagaggtacgtggatggaattctaagcggaggaataaaccttcaccccaggataaagataattagagaaggcccctcctatgcactactcgatggagacgaaggatttggtcaagtagttggatacaaggcaatgaagctggcaatagaaaaagccagaaaaaccggaatagggattgttgcggttaggaacagcaatcactatggaatagctggttattacgccctcatggcagcggaagagggaatgatagggataagcatgacgaattctaggccgttagttgccccaactggaggagttgaaaggattctaggtactaacccaatagctttagctgctcccactaagggcaagcctttcctcctcgacatggcaacaagcgtcgttccgataggtaaactcgaggtttacaggaggaaaggtgaggaaatccccgagggctgggccataaattctaaaggagagataacgaggagcgttgaagaagtgttcaacgggggctcccttttaccgctgggtgggtttggagaactgcttggaggtcacaaaggttatgggttgagcttaatggttgacatactgtctggaatactcagcgggggaacctggagtaagcacgtgaagaataccaacgagaagaacagcaacgtttgccacttcttcatggccataaacatagagcactttacacccctagaagagttcaagggaaggatgagcgagatgattaacgagattaagaactcaaggaagcacccagactttgagaggatatggatccacggagagaagggattcttgacgatggagactaggttaaagctcgggattcctatttataagaaggttttagatgagttgaacgagatagctagaagggtgggagtcaagggactggaggtttaa

SEQ ID NO: 45298 - DNA, 1092 bp, Pyrococcus abyssi
atgtataggctacagcttcttcaagtccagaaatgccaagaagagtttgagagggcactctccctaggtcactacgacaaggccagactcatagccctaaggtgcgccgagttacttaggaaaatagcctctgaaaaccttagcttatcacacatccttctggaggaagctaaaaagtgggaagagaaagctaaaaacgttagaaaacggagagaagggaagaatgaatattttgacaagttaaaggccctcataaagaggagcacaattacatggaacgacataggcggtctaagagaggccaagaaattgatagcccaggccatcggattaagcattgcaaagtccccaatagagcctccccagggaatactcctctttggacccccaggaaccgggaagagcttacttgccagtgccgtggcaaacagtttaaacgcaactttcttcagcgtaaaggctagcgacttgctgagtaaatattttggggaatcttcaaagctaatatcggcattgttctcgctagctaggcaactaagtccaagcgtgattttcattgatgaagttgattccttaacgatgaagagggttagcctggatgatgctgctagaagaatgatcggaacgttgcttgcagaaatggacgggttcaaagagagaaaagacaaagtcatagttctcacggcaacgaatgctccctgggacttagatgaggccatgctttcgaggttacctatccgtatctatgttccgttgccggacgttaattcagcagttgagatattcaagatacatcttagaggtatccattatgatgttccattatcgagactggctaaagaggccgtgaaaaggctgtactctggaagggaaatagctaacgtagtgaagcttgcaaccatgaagatgcttgaagagatgaaccccgagttgagtgacccgctacgcgtctctacgctcaaggggagagatttaaccactagacccctaacattggatgactttaagtacgcgatggccaggataaagagtcccataacaaagagcgatgtcaaaaagtacgagagatgggccaaggaatttgcgatctag

SEQ ID NO: 45299 - DNA, 945 bp, Pyrococcus abyssi
atgccggagagagtcgtcatagccctcggaggaaacgcccttcagcagaggggtcaaaagggaacgtacgaggagatgatggagaacgttaagaaaactgcaaagcagatagctgaaattatcgcgaggggttacgaagtggttataacccacggaaatggccctcaggtagggacgatcctccttcacatggacgctggccaatcacttcacggaattccagctcagcccatggacgttgctggggcaatgagccagggatggataggttacatgatacagcaggcactgaggaacgagcttaggaagagggggatagagagggaggtagttacgatagttacccagacaatagtagataaggacgatcctgccttcgagaacccaactaaaccagttggcccgttctacgacgaggaaactgcaaagaaactagctaaggaaaagggatgggtagtgaaggaagacgctggaaggggatggaggagggtagttccaagcccagatccaaagaggcacgtagaggctgagaccataaagaagttagttgaggatggcgttatagttatagcgagcggcgggggaggagtgccggtaatagaggaggatggagagataaaaggggtcgaagcggtaatagacaaggatctagcgggagagaggttagctgaggaggttaacgctgacatactgatgatcttaacggatgtaaacggggcagcactctactacggaaccgagaaggagacctggcttagagaagttaaggtggacgagatggagaggtactatcaagaagggcacttcaaggccggaagcatggggccaaaggttttagctgctataaggttcgtgaagaacggaggaaagagggcaataattgctcaccttgagaaagctgttgaagccctggaaggaaagaccgggacacaggttattccctga

SEQ ID NO: 45300 - DNA, 1182 bp, Pyrococcus abyssi
atggttatatttaggatcaaaaattatgtcgaaaaagatataaatcttccgtgggatcaacgtgaaggtgagataaaaatgaaaccgcttcacgatcctctctacataacggccgtgttcaagcaagtcggtgatgcttatccaaccgataggggaaccgagttgaagtattccagggaggaaaatccaacggttagaaaactagaggataaactagcagaacttgaaggttcagacaatgctttggccttcaatagcggaatgtcagcgatctcaactctctacttttccctacttgaaggtggtgataaagtagtgctatcgatggaaggctatggaacgacgattgagttggcaaagctccttaggaaattcggcgtagatgttaagctcgcctatccaagtgcagattctctgatagaaaccatagatgaggagactaagctcgttttggtggaaacgatgactaatccaacactgaaagttatagacgttccggaggtcgcgaagaggtgtcgggaagttggggcgatattagttgtagacaacaccttcgtgactccactcctctacaaacccttggaagatggggcaagttacgtcgttcatagcctcacgaagtacatagcgggtcacaatgacgttttaggtggggccgttctctggaatggggaattctccagggatctctgggagtggaggaggaggctcggaacgataatccagcccttcgatgcgtggatgattgagaggggaatgagaacccttgaagttaggttcgaaaggcaatccgagaacgccatggccatagcggaattcttaaaggatcacccaaaggttagggaagtccactatcctggacttaaagacgatccctattataaggtagccaggaggctttttaagaaggatctttacggcggagtagtcgcctttgacttgggtagtggagataatgccctggccttcttgaggggattgaaaaggatattcccatcgccttccctgggaggcgttgagagcatagcaacttatccagtgaaaagtgccgccaaaactctagatgaggagattagagaaattctcgggataactgatggtttaataaggctctcggttggccttgaacctcttgacgagcttattgaggacatagacaacgccttgggggtggtgagatga

SEQ ID NO: 45301 - DNA, 957 bp, Pyrococcus abyssi
atgaaagttaaagtctcagttttcggatttggaaccgtcggaagggcattggcagaaataatagccgaaaagagaaaagtcttcggagtggagttaaatgtcgtctcaataacagataggagcggaactatttggggagattttgacctgcttgaggccaaagaggttaaagaatcaacaggaaaacttagtaacatcggtgaatacgaggtttatgacttctcaccccaggagctcatagaggaggttaagcccgacatactagttgacgttagtagctgggatgacgctcatgagatgtatagctatgctttggcagaggggataagcgtcgtaacaagtaataagccgccgatagctaaccactacgatgagctaattaccttagctagagaaaatggggttggcatattctttgagtcaacggttatggcgggaaccccgataatagggttgcttagggagaaccttctaggagaagaaatagtgaagatggaagccatcgttaatgcgagcacaaccttcatcttgacgaggatggagaacggtaaaacctttgaagaggccatggaggaggctagaaccttaggaatcctggaggaggatccttccaaggatatagatggtatagatgcgtactacaaagctaaaatcctccactgggtttcctacggggaacaaccggaggaagaagagagggaagggataaggaatgttaaagatgctaggaacgttagattagttgccgagatatctaagggcaggataagcgttgccccgaggaagcttccagataacagtcccctactcgtttccgaagttgaaaacgcagcattgataaaaaccgagaacttgaccttaaccctaaagggcccaggagggggtggaaaagttacagctagtggggtcttcacggatataataaaagccgcacttaagtttccgagtcctcgctaa

SEQ ID NO: 45302 - DNA, 1041 bp, Pyrococcus abyssi
atgaaaatgggggttggaaagtacgatgagctatttaataggataaaggagagggctaaactagtcgatgaaaagttattcgagttaattcccgagaaagagcccaaggttctttacgaagcagccagacattacccgcttgcaggtggtaagaggattaggcccttcgtggttttgacggcaacagaagccgttggtggaaatgcattgaaggctatttatccggcagttgccatcgagttgatccataactattccctagtccacgacgacataatggacatggacgagactaggaggggaaagccgaccgtgcacaaggtttggggaataaacatggcgatcttagccggcgacttattattcagcaaggccttcgaggctatatctagggctgaaatttcacctgaaaagaaagctaaagttcttgaaacgatagtcaaggcgtcaaatgagctctgcgaggggcaggccttggacttagaattcgagaacagggaaatggttagcatagaggaatacatgaggatgataagcggaaaaactggagctctctttgatgcctcagctaaagtagggggaatagttggaaccgaaaacgaggaatacatagaggccctgtcgaggtggggaaggaacgttggaatggcgttccagatatgggatgacgtcctagacttgatagccgacgaggagaagcttggaaaaccagtgggtagcgacattaggaagggcaagaagactttgatagttgctcacttcttcgagaacgcggatgagaaagcgaaggagaagttcttaaaggtctttggaaagtacgctggggacgttaaggggaagggaataatagaggaggacgtaaaggcggaggtaatggaggccatagagctactcaaggagcatgggagcatagattatgcgagtagaatagcaagggaactagttgagaaggcaaatgaggctttaaacgttctacccgagagcagggcgagaaaggatttagagttgcttgcgagtttcatggttgagagggagtactga

SEQ ID NO: 45303 - DNA, 2070 bp, Pyrococcus abyssi
atgatgcctcggaagcttaagttagaaggtttagactgcgcaagttgtgcgtacgagatagaggaggctcttaggaaagaaggctttaagttcgctgtcgtaaactttgccacgaaagaggcaattatagaaggtgacattgagaaggccaaagaagttattaagaaagttgaacctgatgtagaggtcgttgaggaagtgcatattcacgatcatgcccatggtgagtttgaaaaaaggacaatatactttattggaatctcgctagttctcttcactataggcattttaatgcgctactactatgccatagataatactctcgtctttggactctttcttgcaagctatcttatctccggttggaaagttctaaagagtgccattgttaactcccttaatggcaacgtcttcgatgagaactttctaatagctgtagccactattggcgctttcttaatcaaagaataccctgagggcgtggcggttatgcttttctatgtcatcggggagttcctccaagatatggctgtagataagtcaaggcgttcaataaaagcattacttgcccttaaagctgagtacgctaacttagttagagatggaaccgtagttaaagttaagcctgaggagcttaaagtaggggacataattatcgtcaagcccggcgagaaggttcctgttgacggtgttattattgaaggaacgtcaagtgttgatacctctgcgctaacaggtgaaagtatgccaagaaccgttaaggaaggagatgagattttatcaggcatgattaaccttactggccttttaaaggttcgcgtcactagggagcttagtgaatcgacagtttcaagaatccttgaactcgtggagaacgctagtgctagaaaagcgaagaccgagaagttcataacgcgcttcgctcactattacacaccagcggtagttggaatagccacccttatagccacagtcccaccgctcgtatttaaagagtcctttacttcctgggtatatagggctcttgtaatattggttatctcatgcccctgtgctttagttctctcgatacctctaggttactttgggggcattggaagggccgctaaggaaggtatactcataaaaggatctaattaccttgatgcacttaaggacgctagcatagttgccttcgataaaacaggaacactaaccaagggcgtctttaaggtaacaaaaatagaaacaaggaatggttttactgaggaggaaatactaaggtttgcggcacttgcagaggcacattcgaatcatccaatagctaaggcaataagagaagcctatggtaaagagataaacgaggccgagatcacggaatacgaggagatagctggtcatggcgttagggcgagaatagatagtgtcgaagtaatggtaggaaatgacaagttgttgcatcgttctaacattgagcacgacacttgcaaagtgaaaggaacaattgcccacgtcgttatagatggtcagtatgccggttacatagtgatatctgatgaaataaaagaggatgcacatcttgcggtaaaagagctcaaacgcctaggtgtcaggaaagttgttatggtcactggagatagtagggatgttgctgaggaaatagcgaagcaactaggacttgacggtttttatgcggaactccttccagaggacaaagtgaaaattattgagaagcttgagaaggaaaaagggaatggaaaactcgtgtttgttggggatggcataaatgatgcccctgtacttgctagggccgatgttggggttgcaatgggggcccttggaagtgatgcagctatagaaacggctgatgttgtcataatggatgacaagccatctaagttaccaaaggctattcagattgctaggaagactcagagaatagtatgggaaaatataatcttcgctcttggcgttaagctggcctttataggtctaggaatttttggaaaagccactatgtgggaagccgtgtttgcagatgttggtgttgctcttatagctgtctttaacgcgatgagagtcttaaggtga

SEQ ID NO: 45304 - DNA, 1563 bp, Pyrococcus abyssi
atgttcccagagaacttttactggggtgtctcacagtcaggatttcagtttgagatgggggataaatataggaggcatatagatccaaacactgactggtggcactgggttagggacaaagtgaacattgaaaagggcctcgttagtggagatctacctgaagacggcatcaacagttatgaactttatgaagtagatcataatctggcgaaggatttaggtctcaacatgtatcgtataggaattgagtggagtagaatatttccctggccgacgacttatgttgatgttgattattctatcgatagctcatatgacctagtaaaagatatcaaaatagacaagagcattctagaggagcttgatgagcttgcaaatcaaagggagattgcttactataggagagtcatctcaagcttaagagataagggattcaaggttatcgttaatcttaatcactttacattgccacattggctccatgatccaataaccgcaagagaaaaagcgctaacgaacagtagaaatggttggataaacaagagaacggtaattgagtttgctaaatttgcagcttatattgcgtacaaatttggcgatatcgttgacatgtggagcacttttaacgaacctatggttgtagttgagctaggttacctagccccatactccggattccccccaggagtcatgaatcccgaagctgcaaagttggctatgctcaacatgataaatgcgcatgcccttgcgtataagatgataaagaaatttgacaaagaaaaagctgacaaagattcaaaagaggctgctgatgttggaataatttacaacaacataggggttgcctatccagagaatcacagaaatgaaaaggatatcaaggcagccgagaatgacaacttcttccacagcagattattcttggaggccataacatgggggaaactcaacattgagtttgacggtgaaacatttgtcaacttgccttacctaaaaggtaatgattggattggaattaactactatactagagaagttgttaaatggagtgatcccatgtttccaacactgccattgataactttcaaaggagttccgggatatggttacgcttgtaggccgggaatgtcatcaaaatcgggaaatccagttagtgatatgggctgggagatataccctgagggaatatataactcgattgttgaggcggaaagatatggggtacctctgtatataacggagaatggaatcgccgactcaaaggatgttctaaggccctactatattgtaagccacttagccgtgatagaggaagcttatgaagagggccatgaagtgaggggttatctccattgggccctaactgataactatgagtggccattaggatttagaatgcgctttggtctctacgaagtaaacttaataacaaaggaaagaaaacctaggaagaggagtgttgaagtttttagtaggataatttcagaggggacgacaaaaggcctacaagacgagttcagactcaaagttaggggggagagatatgaaaacgatagcggttga

SEQ ID NO: 45305 - DNA, 1545 bp, Pyrococcus abyssi
gtggagataaaattattttgtgtcttcattgtttttattatccttttctcgccgtttgttattgcactaagttatccagatgtaaattacactgctgagaatggaattatctttgtccaaaacgttacaacgggggaaaagaagccgctgtaccttcacggtgttagctggttcggattcgaattgaaggaccacgtagtttatggactcgataaaagaaactggaaggacatacttaaagacgtaaaaaggctaggttttaatgccattcgtttaccattttgcagcgaatctataagacccgatacaaggccctctcctgagagaattaattatgagctgaatccagatctaaagaacttaacttctctcgagatcatggagaaaataatagagtacgcaaacagtattggactttacatcctccttgactatcacaggataggatgcgaggaaattgaacctttgtggtacactgaaaattacagtgaagagcagtacattaaagattggatatttctcgccaagagatttgggaagtacccaaacgtcataggggctgacataaagaatgaaccacatggtgaagcaggttgggggactggagatgagagagactttagactttttgctgaaaaggttggaagagagatactcaaggttgcccctcattggttaatctttgttgaaggaactcaatatacccatgtgcccaatatagatgagataatagaaaagaaaggatggtggactttctggggagagaacttaatgggagtaaaggactatccagttagattgcctagaggaaaagttgtatactcccctcacgtttacggacctagcgtttatatgatggattactttaagagtccagacttcccaaataacatgcctattatctgggaaacgcattttggttatctcacggatttaaattataccttggttatcggggagtggggaggaaattatgagggcttagacaaagtatggcaagatgctttcgttaaatggttaataaagaagaagatttacaatttcttctattggtgtttaaacccggagagtggcgatactggcggtatatttcttgatgactggaaaactgtaaactgggagaaaatgagagttatctatcgtctaataaaagccgctaatccagaatttgaggaaccactatacataatcttaaagacgaatgctaccacatcaatcctgggggttggtgagaggattaggatttattggtacaccaatggtaaagtcattgattcaaactttgctcatagtagtgagggagagatgaacatcacagttacgaagagcatgaccctctacattattgtaaagaaaggaaatcagactcttagaaaggagctaaaactgtacgttataggaggtaattatggaagtaacatctcaacaacacaattggtaactcccaaaaaaggaggtgaaaggataagtacttcacttaagcttgcaatttccctgcttttcatcttactgttcgtttggtatcttctcagggaaaaacattga

SEQ ID NO: 45306 - DNA, 924 bp, Pyrococcus abyssi
atgatattcgatgcacattcagacttgccgacattcgtttacaacgaaagggagaagggcaagacaagggttctagaatcgaatttcgagaagttctttacgggcatatcggcaagggtcatgagcgtttggagtaggcctgacaagaggcccgtaatactgagatacgcgctagaggcttataataggctgttcaaggacgttagcgaaagcgaaaggtttaggatagttggaaccgtcaaggaaatggacgaagcgattaaggagggaaaagttgccctctggctgggcatggaaggtggtgagcctatagaaagcttggatatacttgagatcttccattcgatggggctgagggttctaaccctaacctggagcctaagaaatcagataggagacggtgtttttgagagaactaagggaggattaacgaactttggggccgaagtcgttgggaagtgtgaagagcttgggattatcgtggatgttagtcacatcaacgagcagggtttctgggacgttctcgacatcacggcatttccagttatagcctctcactcaaacgcaaaggccctctgtgaccatgttaggaatttgacggatgatcagataaaggcaatagccgagagggacggcgttataggagccgttgcaattccagagttcgtggataaggagaaaccaaccttggagaagtacgttagacatatagagtacatggttgacctagtagggtacaagcatgtcggtataggtctcgacttcgtctactaccttggaagcaagaagagcgtcgagggactcgaggatgagtcaaaaattccggcattaattgacactcttaacgaaaagttctccgagaaggaagttaaggcgatagccttcgaaaacttcaagagggtgtttgagagggtagttggttga

SEQ ID NO: 45307 - DNA, 1242 bp, Pyrococcus abyssi
atgaaagcagtaattcttgctggaggattcgggacgagattgaggccaatttcttcaacgaggccgaaaccaatggttcccgtgctagggaagcccaatctacagtatattctcgaggccctcgagaaggttaaggagatagatgaggtgatcctttccgttcactacatgaggggtgagattagggagttcatccaggagaagatgagagactaccccaaggatattaggttcgttaacgaccccatgcccctcgaaactggaggcgccctgaagaacgttgaagagtacgtttcagacgacttccttgtaatatatggagacgtgttcacgaacttcgattactcggagctaatagaggcccacaagaagaacgatggcttggttactgtggctttaacgaaagtttacgatccagagaggttcggagttgttataactgatgaagaggggaagatagttgagttcgaagagaagcccaggaagccaaagactaacttagttgacgctggaatttacatggtcaacaaagacgttctaaaggagatacccaagaacaaggaggtttactttgagagggagatacttccaaagttcgttagccagggcctagtatatggatataagatgcccaagcactactattgggtcgaccttggaacgccagaggacttcttctatgctcaccagatagccctggatgagatggccagggagaatggttacatgatcttgggtgagaacgtcgagatacctgaggatgtagaagttcaggggccagtgtatatagatgacaacgcgaagatagggcacggcgtgaagataaaggcttatacatatataggtccgaacacgatgatagaggacaaggcatacatcaagcgcgccatactcctgggcaacgacataataaaggagagagccgagctcaaagatacaatcctgggagaaggggtcgttgtagggaagaacgtcataatcaaggaaaatgccgttataggagactacgcaaagatctacgacaacttagttatctatggagctaaagtcttgccgtggaagaaagttgaggagtatgaggcttacataaggataaagctagatccggcaaaggttaggccagaattgaccccagacagatgcccactcgggttgcctgagtgtatatataagaagttcaaggctatcgctggagaaaagccaccctgcgacgagtgtatagagaaccagtggctcttctga

SEQ ID NO: 45308 - DNA, 576 bp, Pyrococcus abyssi
atggtggatacgaacaatgttaaacttagaatcgagaacatagttgcatccgtagatctcttcgctcaactcgatcttgaaaaggttctagatatatgcccaaactccaagtacaaccctgaggaatttcccggtattatctgtcgctttgatgatccaaaggttgcactcctgatattcagctctggaaagcttgtggttaccggggcaaagagcatacacgatattgaaagggctgtagccaagttgattgaaaagctcaagggcataggcgtgaaattcaagagggcaccgctgatagatattcaaaacatggtatttagcggagacatcggaagggaattcaacctagacaacgtcgcgctaactttaccaaactgtgagtacgagcccgagcagttccctggggttatatacagggttaaggatcctagggccgttatactgctgttctcatcgggtaagatagtttgctctggagctaagagtgaggctgacgcttgggaggcagtgagaaagctacttagggaacttgagaaatacgggctgatcgaagaggaggaggaagagctttag

SEQ ID NO: 45309 - DNA, 945 bp, Pyrococcus abyssi
atgccaatacttgaagttaaaagcgtgactaaaaaattcccaactcccaaaggtgaagttattgcagttaataacgtcagctttagtgctaatagtggagaagtcttagggatcctaggccctaatggtgctgggaagaccactaccctaaggatgatagcaacgatatacaggccagatagtggtgaggttcttgtcgacggtatagatgccgtgaagaacccattagaagtgagaaaaagaatagcctatatgacccaggaacctgatttaacacctcccttgtcggttagggattatatcatttactattttaggtttagggggttcagcaagagagatgcaaagaaacattgcgaggatatccttgaactttttggcctaaagacgcatgctcacaagaaaccttttcaactaagcaccggtctaaagaggagagttcagcttgcttgtgctctttcaagcgatgttccactagtattcctcgacgaacccaccgcaggagttgatccgagaagtaaaaggaagacatgggaactaatcaaggaaaaactcgaggataagggagtaactgtcatcttaactagtcatgatctctatgaggtggaatacttagcagatagggtaattataatgaatcaaggaaaaatagtggcggaaggttctcctaaggaattgaaaaagaggtttggaaaaactgtcaggattgtactcgaggaaccgataaaaaactttgaattgttaaaggaagaactcctaagagttaaaaacgtcaaagacgtgcgtcttgctagagatgactcctttgacgtgtatttcaagtcgctggacgattctataaacggcatccttcaagttataagcccccaggagttaaagattaaggatatattcacggcaaccgcaaactttgaggatgtttatctcgagataattgagaggtga

SEQ ID NO: 45310 - DNA, 762 bp, Pyrococcus abyssi
atgataatagttgaaaaccttaggaagagattcggaggtaaagaagtacttaaggggataagcttcaccgtcaaggatggggaaatttatggactcttagggccaaacggtagtggaaagtcaacgacaatgaggatactctcggggataataaccgattttgaggggaaagtcatagttggtggagttgaagtcgccaaagaccctctccaggtaaagaggatagtgggttacgtcccagaaactcctgctctatatgagagcttaactccagcggaattcttcagcttcgtaggtggggtaagaggaattccaaaggatatcttagaggagagggttaggaagctcgttgaggcattcgaaataaagaagtacatgaaccagctcataggaaccctcagctttggaactaagcaaaagatttccctgatatcttctctccttcacgatcccaaagttctaattctagatgaagctatgaacggtcttgacccgaagagtgctaggatattcagggaacttctctatgaattcaaggaggaggggaagagcattgtattctcgacccacgttctagcgttagctgaattaatctgcgatagggtgggcataatttaccaaggaaggataatagcggagggaaccgtggaagagctcaaggaaatatcgaaggaggaaaggttagaggacgtgttcctaaagcttacccaagcgaaggaagagatagctcaggtggtttcggccctcaaggaggccctgtaa

SEQ ID NO: 45311 - DNA, 1233 bp, Pyrococcus abyssi
atgttcaggttgggggattttaattatcataacaaggtagtttttctcagggttgatcttaattcaccgatgaaagatggcaagataatcagcgatgccaggtttagagcggtgttgccaacgataaagtacctcctcgagaacggagcgagggtcgtcgttggaacgcatcaaggaaagccttacagcgaggactacgcaactacagaagaacacgctagaatactctccaatctcttaaaccagcacgttgagtacgtagaggacatctttggcaggtacgctagagagaagattcaggagcttaagccaggggaaatagcgatgctcgaaaacctaaggttctcggccgaggaagttaaaaacaagccaatagaggagtgcgaaaaaactttcttcgtcaagaagctttcaaaggttatagattacgttgttaacgatgcatttgccgcagctcatagaagtcagccctccttagttggttttgcaaggataaagccgatgataatgggttttctaatggagagggagattgaagccctaatgaaggcctactacagcaaagagagtccaagggtttacgtgcttgggggggctaaagttgacgactcgctaaaggtggcagagaacgttcttagaagaggattcgcagatgttatcctaactggtggactcgttgctaacgtcttcacgttggccaagggatttgatcttggaaggaagaacatcgaattcatgaagaagaaaggattgttggagttggtcaagcatgctgaaaagatactagacgagttttatccgtacgttagaactcccgtggactttgcgatcgactacaagggagatagggaggaaatttatctgttaagcgagaagagggagttactcaacgactaccagataatggacattggaagtagaacgatagagaagtacagagatataataatgaaggccaaagtagttgttgcgaacggccccatgggggtgttcgagagggaagaatttgccctgggaaccgttgaggtgtttaaggcgatagctgaaagcgaagcattcagcgttttaggcgggggccattccatagcgagcatccagaagtacggcatcgagggcataacccacatctcgacgggaggaggtgccatgctaaccttcttcgcaggtgaagaattgccagttcttagggcccttcagataagttacgagaagtttaaggaggtgaaggcgtga

SEQ ID NO: 45312 - DNA, 1008 bp, Pyrococcus abyssi
atgaagagggttgcagtcttaggtgcaacgggtttagtcggtaggacgtttgtgaagttgctaggggggcatccatggtttaaagttgaaaaattgatagcatcagaaaaatcagctggaaagaaatatggggacttagttgaagattctccagaggagttcagggattattatgtaataagcctcaacgaatttctagagaatccaggagttgatcttgtttttaacgcccttccggcatcgatatcaagagacgtggaggaaaagttagcccaagaaattccagtgttcacaaacgcgagggcacatcgctatgatgaagacgtgccaatactcgttccagaggttaataaagatcacctaaaactagtagaagtccaaagaaagaggagaggatggaaaggcttcatagtaactaatcccaactgttctacagcaatactaacactttcgctggcacctctcaggaatttcggaattaaaaaagttagagtagcgacaatgcaagcaataagtggggctggattctctggactttcagcgtatgcaattcaagacaacgtgattccattcataagcggagaagaatggaagatagaaaatgagagcaaaaaaatcatgggaaaattaaagggagatgaaattgaacctgcatctttcgatgtcattgcaatagcaacaagggttccagttatccatgggcatactgaagcagttttcgtagagttagagaatccagacattaagagtataagggaagcaatcgagaactttgatccgctaaaggatttaaagttgccctcttatgagaaacctatagtttatacggaaatccctcagcccagattgcacagggatagaggtagaggcttaaccgttacagtgggaagactcgaaagaactagtgaaggagtgaagtatgtagctctcggacataaccttgtgagaggcgctgcaggaggctcagttttaaacgctgagctcgcctataaacttaagatcatctag

SEQ ID NO: 45313 - DNA, 1059 bp, Pyrococcus abyssi
gtggtttacaaactattggttgttaaatttggtggtagttctgttagatatgctttcgaggaggctctagagcttgtaaagtacctttccgagagaatacctatagtagttgttgtttctgcactaaagggagtcacggacgaactaataagatttgccaatggtgataaaggggcactacccaggatagagaggatacacgaagaattcttgaattatcatggcttaaacaccaagataagcataagcttcaggaaagatatgcctcctgaagcattaagagatgagataatatctctcggcgaaaggatctcggcaaagatatttgccgaaggcttggaactccttggaataaagagtaaggtcgttgaccccctcgaattccttatagctaaaggtgagtttggagatgcatatatcaacatccaagaaagcaaaaggagggccggaaaactaataaggctcataaaaagtggagttattccagtcattccagggttctatgggaacctaaatggttttagggtaacatttggaagaggaggaagtgactactcggccacggctttggctagaattctcgactcaaggtgcgttctgataatgagtgatgttgagggtatctttactgcagatccgaagttagttccaagtgcccgcttaatcccatacctatcctacgaagagataaaagtggcagcaaagcttggaatgaaagctttgcactggaaggcagtggatcccgtagtaggggatatcccaataatattcggaaagacaaaagactggaagtttggaacgatagttctaaatgctagaagcaatttcccgattatagttcatagagtgagggaggattttgccgagatctttgtagttgggaggaatattagtctcccaggatttttggttgaggaggaaagagaagattttgttaagatagttgttgcaagggaagatcttcccgaagcgattagggaaatccatagggaggtggtagagcgtgaagaaaagaatctacgcaccggcaacaatagcgaactttgggccaggatttga

SEQ ID NO: 45314 - DNA, 1107 bp, Pyrococcus abyssi
gtgagaaaaatgattgtgctaaaatttggagggagttcagtcaaaaatgactttcatgaagcagtttcgctgacaaaatctatatttgaagagaaagaagtggccgtagtagtctctgcattaaaaggaattacagatatgctaattaagtatgccaagacgttcgacagcaagtatgcaattaaaattgcagatagctatgtaaaatttgccaggactaatggtgttgatcctaacatcctttctcctcatatccaggaacttttcaatcctccttcgcttcctaaagatgcccttactgattacatcctcagcattggagagctactttcagctgttatatttgctgaggtcgtagaaggtcaagtaatttacccctgggagcttttttctgcatatggtaagtttggcgatggtttcatagatctaaagaagagcaagaaaaatgcaaagataatctatgaagtcatagatagtggaaagattcccattgttccaggattcgtaggtggtatggatgggtatagggtgacattgggaagagggggaagcgattactccgctgtggcccttggagttatattgaactcggaattagttgctataatgagtaacgttgagggtatctttactgcagatccgaagttagttccaagtgcccgcttaatcccatacctatcctatgaggaagccttgattgcggctaagcatggaatgaaggcaattcagtggaaagctgcagaacttgctaaggagaagaaaattctaatgttattcggtagaacaaataattggagaatgggaactgtaatcagtaacagaacatccagaatgccgttgatgacatacaaagatgggttactacttataaacgttgaagaggaacttgagtatagggttatagatgaagggccattttggaaactttacgacgttccagggaatgaggggataaggataatcagggaactccacaaggccatctttggaaatgtgttgtcaatgctccaggaaccagggaaacatatcaggataaatagacataaagttggaaaaagttttgaacatatgacatttaaccaaagctttagtagaaaattttattaa

SEQ ID NO: 45315 - DNA, 651 bp, Pyrococcus abyssi
atggtagttataggggaaaagttcccagaggttgaggtaaagacaacccacggagtaatcaagttgccagaccactttacaaagcaggggaagtggttcatactcttcagccacccagccgatttcaccccggtttgtacaacggagttctatggaatgcagaagaggcttgaggagttcaggaagttgggcgttgaacccatagggcttagcgttgaccaggtttttgctcatatcaagtggatggagtggataaaggaaaatcttggcgttgagattgaatttccaataatagccgatgacagaggagagcttgctgagaagctaggaatgatacctagcggtgctacgataaccgctagggcagtcttcatcgttgatgacaaggggataataagggctatcgtctactatccagcagaagttggaagggactgggacgagatccttaggctcgtcaaggcactcaagataagcacggagaatggagttgcactcccacacaagtggccaaacaacgagttaattggagataaggtaataatcccaccagcttcaaccgttgaggagaagaagcagagagaagaagctaaggcaaagggcgagattgagtgctacgactggtggttctgctacaagaagcttaagtga

SEQ ID NO: 45316 - DNA, 948 bp, Pyrococcus abyssi
atgcctacctacattattgaaaccaaggaactaacgaagttcttcggtaaaaggaacgttgtttacaatctcaaccttaaagtgcctaaaggggctgtttatgggttccttgggccgaacggtgccggtaaaaccacaactatcaagatgctcacgggcgctttaaagccgacctacggtgaaattaaaatcatcggaatggaaatgccacgcgagagggttaaaataatgaggaacgtcggttatatgcccgaaagaccgctcgcttacgatgatatgacgattttcgagttcttagtttatatggggcgtctcctggggcttccaaaggataaagcagttaatcaagcccgagagcttatggcctatacaggcgttgggagattagccttcaataagattgaggaactatcaagtgggcagaggcagagagttctgtttgcttctgcgttgatgggagatccagagctcttaatactcgatgaaccaacgagcaatctagatcccctcggcaggatggaattcatagggaaaattctcgagcttgcaaaatccgggaagactgtgtttataagctctcacatcgtgagcgaaatcgaaaggatgtgcaattacgttggtctaataaaggacggtcaactcatcgaacagggaaaggtgagagacttagccaaaattgagagcacggattacgatgtagtggtttcggataacgagaaacttctaaagttcctcagggataagatctatgtgagggaagtctgggaggaagagggaatcgttagggtaaagctagatgagagattttccgaaaagttctttctagaacttccagcctttttagcctcagaaaagcttgccattaaacttttcaagccccatacaagtcctttggagaggatactgatgaagcgtttcaacatggggtggaaaaatggagagcaatag

SEQ ID NO: 45317 - DNA, 1356 bp, Pyrococcus abyssi
atgggaaaatacttcgggacgagcggaattagagaggtggtaaacgagaagctaacgcccgagctggcactaaaggttggacttgccctgggaacttacttaaatggaggcagagtcgtcatagggaacgacacgagaacgagtagcgagatgctcaaaaaggcagtcataagtggacttttagctagtggggttgatgtcatagatataggtctcgctccaactccactggtaggctttgccataaagctgtacgatgcggatgctggagttaccataaccgcgagccacaacccgccagagtataacgggataaaggtttgggacaggaatggcatggcttacactccggagaaggagagagaactagagaggattattgaggaagaaaaattcaaaagagctccttggaatgagataggccagctaaaacaagctaatcccagggaagaatacatagaagctataatgaaggagataaagcttgataactcttatacggtcgtcatagatcctgggaatggagctggttctataattagcccttacctccacagggagctcgggaacagggtcatcacaataaactcagacccccacggcttcttcgttagggaactggaacccaacaaggaaagcctcagcatgctagctaagacggtcaaagccttgaaagctgatatcggaatagcccacgatggagatgccgacagggttggggttgtagatgaaaacggggaattcgttgagtacgaggttatgctatccctaatagctggttacatgctgaggaaatacggaaaaggtaaggtagttaccaccgtggacgcagggtttgccttggatgactacgttaggggacttggaggagaggtagttagaactagggtaggggacgttgccgtggctgaagaacttatgaagcacggaggagtatttggaggggaaccctcgggaacttggataatgccgcagtggaacctaactccagatggaatcttcgctggagccctagtcttggaaatgatagataggcttggcttaataggagaactggcgaaggaagtcccaaggtacgttacactcaggaagaagataccctgtccaaatgatctaaaagcaaaggccatggaggagatagctaaactaattcccagggaattctcgtacgagagggagataaccatagatgggataaggatagagaacgatgactggtggatcctgtttaggccgagcggaacagagcctataatgaggataactctcgaggcacacacaaaagagagggctgagtctttgatggaaaaggctgaaaagctcgttaaggacgcaataaagaaggcctcttcttaa

SEQ ID NO: 45318 - DNA, 1257 bp, Pyrococcus abyssi
atgaataggaacttctggctcttcgtggctggaaggttcatttcccagctcggatgggccatccaagaggttgcccttcccctgtacgttctagacgtgacccacagtgctaagataatgacactcttcgtcttagcagatttaatcccctcgataataacaacgccaatagctggagtttttggagatagatatgacaggaagaagattatggttggtttcgatttaataagaggagtcctcctctttctggttattgcatttaacttcctaacgataagatgtctgcttgtagttcaagtgattatggcaatcatgaacgctttcttctcggctggaactggtgctatgtatccagacctcgtgaagcccgaagagcttgagagggccaactccatagttatgtccgcgagtataatctcgaggcttgttggaccggcaatcggaggtttcgtgtacggatttggaggaataaagctagcgatactgatgaatgcgataagcttcttcggctccggcctcttcgagatcttcataaagtacgaatggaagaccagaaacatcgaagggttctcagatttcgtgagagatattaaagagggtttgaaatttataatgtcgaacagcttcatatcgacgctcatagggcttgttatcctcttaaatgcccttggggcgccttttgcaagtattatctatccatatgcaatgagggaaatactgaagttctcgagccaacagttcggcctcgtggagagcgcttttatgctgggagccctgattgggaatttaatcgttggagcgtttctaggggcaaaagctgggagatatatattcaggttattcctagttaatggggccgtggaattaatatttatcctaataatttctcccttcttagctctccccaggaatagcgctttcatgttactcttagtgcttggagcaactatgggcatggctggggctatgataaacgttccactggcttctaagctacagagggcggttccctcggagataaggggaagggtgttctccaccatggaaatgctggctagaatagcgaatccattgagcctagttgtggtgggtccgctagtagatacaataggagcctggaaaacagcttcattcctctggcttggttctggagttgtaatcctctactactggatcttcaagggaaaagaattaacatcagaggaggagtctaagcttgtcgagaacttccctggggttcctcccgaagattag

SEQ ID NO: 45319 - DNA, 1056 bp, Pyrococcus abyssi
gtgaacataatggacgaaaagataaaacgaataattgagtttatgaacgaaaactctatagatgcagttctcataacaaaaaatccaaatatctactatctctctggagcttctccccttgcaggaggttacattctcgtgaacaatgatggagcaacgctttatgtgccagaactcgaatatgagatggccaaggaggaaagtaagataccagtcgagaagtttaagagaagggatgatttctacaaggtatttgaaggggtaaaagtccttggaatagagggcagcctttcttacagtttcgttgaggatttgaaggaaaaaggaaagatctccgagtttaagaaggtggacgatgttatcaaggaaatgagaatagtaaaatcagatgaggagataaaaatcatcgagaaagcctgcgaaatagcagataaagctgtaatggcagctattgaggaagtaacggaaggtaaaaaggagagggaaattgctgccaaggttgagtacttgatgaaaatgaacggggcagaaaagccagcctttgacaccataattgctagcggttacaggtcagcgttaccccatggggtggccagtgacaagaggatagagaagggggatttagtcgttatagaccttggggccctatacaaccattataattccgatataacaaggacggtcgtcgttggctctcccaatgagaagcaaagggagatatatgaaatagttctcgaagcacagaagaaagccgtggaagctgcaaggcctggaataactacaaaggagctagattcaatagcgaggaatataattaaagaatatgggtatggagattacttcattcacagcttaggtcatggtgtcgggttagaaatccacgaatggcctggtgttagccaatacgatgaaaccgttcttaaggagggtatggtaataaccatagagcctggaatatacattccaaagtttggtggcgttagaattgaggatacgatagttataacgaagacgggggccaggagattaacgaagactgagagggaactcatctag

SEQ ID NO: 45320 - DNA, 549 bp, Pyrococcus abyssi
atgaaggaagagctagtgaagttgataatagatagtggatgcataaagttcggacacttcattctaacctcggggaaggagagtaactactatattgacataaagagccttatcacgaatccaaaagcacttaagctaatagctaaaatgatcaaagaagaatccaggaagcttgggattgaatatgataaggtagcgggcccagaattgggtgctgttccaattgctaccgctttaagtcttgaaacggacaaacctctcttgataataaggaagaagaaaaaagagcacggaactgggaagctaattgagggtgaaatatctcccggggacagggtcctcttagttgaggacgtgacgacaacgggtggtagcgtcataagagcggccaagatattaaaagagcatggagctgaagttgttgggatattcgtagttgtcgatagggaggaaggagcaagagaaaacatcgagaaggagggattcaagttataccccctagttttagttagcgacttatttgaagccgctggtgtctcgaaggattga

SEQ ID NO: 45321 - DNA, 2979 bp, Pyrococcus abyssi
atgacgaagagaattaggcaaccaatcatagcggttctcggtcacgttgatcacggcaaatgcctacttccagatgagaaggttgtagttccaagcgttggttttgtaacattaaaagagctcttcgagaccgctagcaaagtcgttgagagggacgatgagaaggagataagggagttagacgagagaattacaagcgttaatggagatggcaagacgggccttgtgaaagcctcctacgtctggaaggttaggcacaaggggaaggtcatcagggttaagctgaagaactggcacggcgtaacggtaacgccagagcatccatttctaactactaaaggctggaaaagagcagatcagttaaggccgggcgactatgtagctgttccaaggttcatacatggaaacgaggatgaaaaaattttcctgtcctacgttaaggttaaaaagtcgggggaggagtggaaggagtacttctacttggctgggagaaaagggaatatcgatgtcaacttgctctttgtagcaccgaaaaggtacgtggtcgagtttctcagggggtatttcgaggagagatctgaagttaaaggagaatctgttatagttgaggcgagggaattggttgaacccctatccttagccctcctccggtttggaatattttcaaaaatacagggaagcaaactcatcgtgaccgggaagaggaacttggaggctttcaaggattacatagggttcaaagacgagagagagaaagcgctagaggaagccattgaaaaggtcaagggtagcgaggtttacccgatatttgaggagattaggaggttgaggctcctctttggcttcacaagggaagagctcggaagctatgctaaatacgagaatagtgaagcaccgacatatgaggagctcatggaaattttagatttcatagagaggggttccccaagcttaagtaagaagatagcgatactagagggtaagctaaaagctgagctaagggtgctagaggaagagggtttaataaaggacggaaagctaaccccgcttggaagggaactcttggaggtttggcgcaacagggagttcgattccaaggatgtggattacattagaaatatagccgaaactttagttttcatcccagttgaaaatgtcgaggaagaggagtacgatggctacgtctacgatttaacaacggaaacacacaacttcatcgccaacggaatactcgtccacaacacaactttactcgataggataaggaagaccaatgtggctgcgaaggaggccggcgggataacccagcacataggggctacagaagttccgatagaagtggttaagaagatagccgggcctttgataaagctttggaaggccgagataaagctccctgggctactcttcatagacaccccagggcatgaggctttcacaagcttgagggccaggggaggtagcttagccgacctagcggttttagtcgttgatataaacgagggattccagccacagacgatagagagcatagagatactgaggaagtacaggacacccttcgtagttgctgcaaacaagatagacaggataaagggatgggtcatagaggaggatgagcccttcctcatgaacataaagaagcaagatcagagggctgtccaggagttagagaccaagctttgggaacttattggaaagttctacgagtttggatttcaagctaaccgcttcgacagggttcagaactttacgagggagttagcaatagttccaatatccgcgaagtacgggatcgggatagccgagttactcgttctcatagctggacttagtcagagatatctggaggagaagctaaagatagaggttgaaggcccggcgaggggaacgatattagaggttagggaagagcccggactcgggcatacgatagatgtgataatttacgatggaacactacacaaggacgacactatcgtcgtcggtgggaaggataaggccatagtgaccaagataagggcactactaaagccgaagcccctcgacgagataagggatccaaggtttagattcgactacgttgatgaagtaacagcggcggccggagtaaagatagccgctccaggacttgaggaggctctggcgggttcgccggttatagcagccccaacccccgaagatgtggagaaggctaaacaggaaatattagagcagatagagagggtcgtcataagcaccgacaaggttggagtgatagtgaaggcagataccctcggtagccttgaagccctaagcaaggagctccaggaaaaggagataccaataaggaaggccgacgttggaaacgtaagtaaaacggatgtcatggaggcccttagtgtgaaggaagaggaaccaaagtacggtgtcatcttggggttcaacgtgaaagtaaacgaagatgcagaggaagttgcaaaggcgaaagacgttaagatattcgttggtaacgttatctacaagttaatagaagattacgaagagtgggtcaaggaggaagaggagaagaagaagagggaactgctcagcaaagtgacgttccctggggttataaggctgtatccagatgaaaggtacgtcttcaggaggagcaacccggcgatagtggggatagaggtcattgagggaaggataaagcctggtgtgactttaattaagcagaacggtcagaaggttggcgtgataaggtcaataaagagcagagacgagtttttgcaagaggctaagaagggacaagctgtggctatagcgatagagggtgccatagtcggaagacatatccaccctggagaaaccctctatgtcgatctcagtagggatgatgcgataacgctactgaagcatctgagagatacccttgaagataccgacatcaaggctttgaagatgattgcaaaggtcaaggcaaaggaagaccccttctggagggcaatttga

SEQ ID NO: 45322 - DNA, 543 bp, Pyrococcus abyssi
atgctaatagcgataacgggaacccctggagttggtaagacgacaattgcaaagttgctagctgaaaagcttggctatgagtacgtcaaccttagggatttcgcccttgagaagggttgcgggagggaagttgatggggaggttgaagttgagattgatgagttagcgtacttcgttgagaaggaacttaaggataggaacgttgtgttggacggtcatctcagtcatctaatgcccgtcgatctggtagttgtcctgagggcccatcctaggataataggggaaaggctgagggagaggggttacagcaaggaaaagataggagagaacgtcgaggctgaattagtcgatgcgatattgatagaggctatagatgagcacgaaaacgttatagaggttgatactactaataaaacaccggaagagatagttgaggagattataggcttaattaaatctggagtgaagaggagggttgggatagtcgattggagcgaggtgtacgatgagataattccttatctaagattggggggtgagtga

SEQ ID NO: 45323 - DNA, 546 bp, Pyrococcus abyssi
atgccaaagggttgcctcgtgataacggtcagcggtttagccggttcagggacaaccacgctttgccgcaacttagctaaacactacggcttcaagcacgtctacgctggtttaatctttaggcaaatggccaaggaaaggggaatgagcttagaagagtttcaaaaatatgcagagcttcacccggagatagacagggaagtcgacaggagacaagtagaggcggcgaaggagtgtaacgtggtcatagagggtcgtttagccggatggatggttaagaatgcagacctaaagatatggctcgatgccccgataagggttagagctgagagggttgccaagagggaaggcataagcgtagaagaagctttcatgaagatagccgagagggagatgcagaacaggaagaggtacctaaacctttacggaatagatattaacgacctctccatttacgatttgataatagacacatccaagtggtcccccgagggtgtgtttgcgatagttaaagccgcgatagatcacctctacgaaaaggtttaa

SEQ ID NO: 45324 - DNA, 1284 bp, Pyrococcus abyssi
atgaatgtttcgattattggttctggttatgttggtcttgttactgggatgggctttgttaagctgggaaatagggtcattttcgttgatgttgatgagtggaaggtgagagtgataaataacgcccaacctccaatctatgaggagggcctcgaagaactcatgcaagagttcaagggcaagtactacgccaccaacaactatcgtgaagcaattctcaactcagacataacgttcataaccgtcggaactccatccaaaccagacggtacaatagacctaacctacgtgaaaaacgcagctaaagaaatcggtaaagcattaaaagaaaaggataactttcatatcgtcgtcgtcaagagcaccgtcctcccaggaactactgaaggtgtaataagaccaatcctggagaagtactctggcaagaaggcattccaagatttcggcctagcaatgaaccccgagttcctaagagagggagtagcactaaaggactttctaaacccagacagaatcgtaattggagttcaagacgagaggacaaagaaagttctagaaaaactctacgaaccgttcaacgcaccaaaactcttcactgatattaaaacggctgaaatgattaaatacgcatcaaacgcctttctcgcaacgaaaataagctttgccaatgagattggaaacatatgcaaaaaactcggcatagactcctggaaagtctttgagggagtcggcttagaccacagaataagcccacacttctttagaagtggaatcggatttggaggatcatgcttcccaaaagacttaaaagctctaatcaaaaaggcagaagagcttggagaagacccaataatactaaaagcagtgctgcaagtaaacgagagacaaccactaaagctaatcgaactcctgaaaaaacacgtcccaaacctaaaggacatgaaagttggcgtcctaggcctagcattcaaaccgaacaccgatgacgtcagggaaacgagggcttacattgtgattaaaaaactcctcgaagaaggagcaaaagtaattgcttatgatccaaaagccatggagaatttcaagcgcttttatccagacgttggaaggcaaataagctatgccaactctgcggaggaagttttaagagaagttgacgttatcctgatactcaccgagtggcgtgattttgaaagtcttgactactcgggtaaaatcgttattgatggtaggcgtgtaagatccgctgagaagacagcgaagatttacgagggggtgtgctggtga

SEQ ID NO: 45325 - DNA, 876 bp, Pyrococcus abyssi
gtgattaggaaggcagtgattccagccgctggtttagggacgaggatgttgccgataacaaaatctatgccgaaagaaatgctgcccatcgttgataggccggtgattcattacgtggttgaggaggcagtgaaggcgggtatagaggacattctgataattactggaaaggggaagagggcgattgaggattactttgacaggagctttgagctggagtactatttaaaagagagggggaaactggaggcgttaagggaagtggaagaaatcggagaaatggtggatatttactacgtgaggcagaaaaaacccctcggtttaggcgatgcaattctttacgctgagaagcacgtgaacggagaaccattcgccgtactcctgggagacgacataataatcagcaaaaaaccagcaataaaacaactaattgaggttgcagaaagaaaaaacactccagttatcggtgtggagagtgttccaagggagcttgtgagtagatatggaatcatagagggcgagctaattgaaaatgatctgtataggataaagcgtctcgttgagaagccttcccctaaagaagcaccaagcaatattgcaataattgggaggtacattttaattcctgagatatttgatatcctgagggagaccccacctggaagagatggagagatacagcttacagacgccctccagatacttttgaacaagaatgaaatccttgcaaaaagaattgaaggagaaagatatgacattggaagtaaattcggttttgtcatggcaaatctaaaattgagcctcagaagagaagaattaagaaatgaagtattgaaatacctaaaaagtattttgaaggagatctcaaatgagtag

SEQ ID NO: 45326 - DNA, 1347 bp, Pyrococcus abyssi
atggttaaactgctgggaatgtcaagagaagatgttagggaagccattaagaacggagacgttactatagcggtttacggcttggggaagatgggacttccactagcggctgtttttgcagataacggggccaaagttataggtgtggatataaatgagagagtagttaactcggttaacaatggagagaatcacatcaaagaagaacctgggctggatgagctagttaagaagaatgtagaagctggaaggttaaaagctaccacagacggtattctagccgctaaaaaagccgatgtcatgataattctcgtcccaacattggccgatgacaggggaaacctaaagcttgaatcagtgtatgacgttgctgagaaaatatccaaggggctcgagaagggagatatagtaataactgaagcaacgatgcccccaggaacaacagagagcctgatacctatcctcgagaagtctggactaaaactcggagatttcggactggcccacgctccagagaggacaatgacggggacagctataagggacataaccggccaatatccaaaaatcgttggggccagcgatgagagaaccctggaggcggtcatagggatatacgagacaataaacaggaaaggtgttattccaatgagctcaataaaggccgcagaagctgtgaaagttttcgaaggaatttacagagacgtcaacattgcgttggcgaatgaattagcactatggtgtgaggagcatggacttgatgcaatagagatcttcaacgccgccaatacacagccctactgtcaccttcacatgcccggagcaggggttggggggcattgcatcccaatatatccttggttcgtgataaacttagcgaagaaaactaacgtcaggctgataagaacggccagggagataaacgactcaatgccaaggcacgtagtcgagctaaccgtcagagcacttaatgacgctgggaaacccatgaaggggagtaaaattctagtcctgggattaacatttagagggggggtcaaggagttcacaaagagtccagcaatagatgtaataagggagcttaaggagtggggggcggaggtctacgcctatgatcccctgtgcactagggaagacgctgaaaggttcggtgcgaaatggaaagaagacttcaaggacgtggatgcaatagttatagtcactgaccatagggaatttaaaacgttggatcttaaagaaatagccgcagaggtcaggacaaaagttatcgttgatgggagaaacgttatccatcctgaggaagctaagaaactaggatttatttataaaggtgtggggagggtttaa

SEQ ID NO: 45327 - DNA, 1140 bp, Pyrococcus abyssi
atggtttcgaagcctcacggtggtaagttaattagaaggatagccgctcccagaaccagggagcgaattctgagcgagcaacatgagtaccccaaagttcaaatagaccacggtagggccatagatttagagaacatagctcatggagtctattccccactaaaaggatttctaactagggaggattttgagagtgttctcgaccacatgaggctgagtgatgacactccatggacgataccaatagtgttggatgttgaaaagccagagttcgaggagggggatgccattctgctttaccacaaagaaacaccaatagcaaggatgcacgttgaagacatatacacctatgagaaagaggagttcgctctgaaggttttcaaaaccaaagatgccaatcatcctggggttgcaaaggtttattccatgggcaagtacttagttggtggcgagatagagttactgaatgagctcccgaaccccttcgcgaagtacacactaaggcccatagaaactagggttctcttcaaggagaagggttggaaaacagtagtcgcgttccaaactaggaacgtcccccaccttgggcacgaatacgttcaaaaagcagctcttaccttcgtggatggattattcataaaccccgtcctcgggagaaagaagaggggagattacaaggatgaggtcataataaaggcatatgaagttttattcgagcactactatccaaaggatgttgcagttctagctactgtccgctatgagatgcgctacgcggggccaagggaggctatacatcacgctataatgaggaagaacttcggggcaactcacttcatagttggtagggatcatgcaggggttggaaattattacggcccatatgaagcgtgggatctcttcgacgagttccctgatttggggataacaccgatgttcataagggaagcgttctactgcaagaagtgtggaggaatggtcaacgagaagatatgccctcacgatgagaaatatcatgtaaggataagcggaaccaagctaaggaacatgataatgaggggagagaagccgcctgagtacatgatgagaccagaggtttacgaggttataaggagctttgacaaccccttcgtggaatag

SEQ ID NO: 45328 - DNA, 525 bp, Pyrococcus abyssi
atggaagggtttacgatatggcttactggacctagcggtgcagggaagactaccttggccgtgaaacttgcaaagaagctcagggaaatgggatacaaggttgagatccttgatggagatactataaggaaaaccctctatccaaacctaggcttctccaaggaagctagggagatgcacaatagaatcgttatatatatggctaaattactgacaaggaatggagtcatcgctatagtctctttaatttcaccatataagaggatcagggagtacgctaggaaggagatagggagattcatggaggtttacgtctacgctcctcttgaggttaggataaagagggatccaaagggattgtacgctaaagcaattagaggtgaaataaggggcttaactggatacgatggtgtttacgaggaacctgaaaatccagaggtcaaggtcgactcttcgaggatgacaccagatgaggaggcagagttagtaatcagaaaggccaaagagctaggatacttaccctag

SEQ ID NO: 45329 - DNA, 1059 bp, Pyrococcus abyssi
atgaaagccctaatcctctcaggcggttatggaactaggctaaggcccttaacttactcacagcaaaagcaactgataccggtagcaaataaaccagtccttttctatgcgatagaagatgttatagaggctgggattcacgagataggaataatcgttggcccaaataaggaacaggttatagaaacagtaaagagcgttgactgggatgctaacatagagttcatttatcaaggggaacctaaaggattggcacatgctattctagttgcaagagactaccttggcaatgatgatttcgtaatgtatctcggagataatatactaagggaaggaatagtcaggcacaaagagcacttcgagaagagcgattacgatgcaagcattttactttgtgaagttcccaatccacagcagtttggagttgcagagctgagtgaggatggaaagacgataaagagactaatcgaaaagccaaagcatcccccaagcaacctcgcactagtgggtatctacttctttaggccaataatccacgaggccgtgaggcacataaagccgtcatggaggaacgagctggagattaccgatgcaattcaatggctcatcgataatggatataaggtgggatggacgaaagttacaggttggtggaaggacacgggaaagccagaagatttgcttgaagctaacaggttggtgcttgatgaaattgagagggaaatcaaggtggaaactagggcgaagataataggaagggtaaagatagaagaaggtgcaaagatagatgagaacaccatcataaagggcccagcagtaatcggacggaatgctgtgataaggaacgcttacatcgggccttacacgagcgtaggaaataatgtcgttatagaggatactgaagttgaggattcaataatcatggatggtagcgttataataggtgccgggagaataattgagagtattataggtaaggaagtcaggatagtgaggggcgatggacaccccttaggtagaaggctcatcgttggtgacaagtcccagctcaccctatga

SEQ ID NO: 45330 - DNA, 2643 bp, Pyrococcus abyssi
atgaagatagaggaggttaaagtttacaatttcaggtcacacgaggaaactgtggttaggtttagaaagggaattaacctaataataggccaaaacggttccggaaagagctcgctcctagatgcaattttagttggcctctactggtctaagaagctgaggctgaggggattaaagaaggacgagttcaggaggataggaggaaagggaggaaccaggatagagataaaattcgaaaacgacgattcaaagtacgtactcttcagggacttctcgaggaacgtggcataccttaaggttcaagaaaacgggaagtggaggcatgcatctgagccgagcatggaaagtgtgtcatcttacatagagaggatcctcccctataacgtcttcttaaatgcgatctacattaggcaaggccaaatagatgcaattctcgagagcgacgagacgagggataaggttgtcagggaaatactaaacctcgacaagcttgaaagcgcctatgaaaaccttaagagaataaagaccaacataaaccttctgatagagagtaaaaagtctttcattgcgagaactgagaacattgaggagttaataaaggcgaacgaggacgagttaaccaaaaagctgtccgagataaacgagataagctctaagctacctccaatcaggggggaactcgaaaaggttagagagaatgtcaaggaactcgagagcattaagggtaagataagcgagctgaagatccaggtggaaaaactcaagggtaggaagaagggacttgaggaaaagatagtccaaatagagaggagtattgaggagaagaaggcaaagatctcggagcttgaagaaatcgtgaaagatattcctaaacttcaggaaaaggaaaaagaatataggaaactgaaaggcttcagggatgagtacgaatccaaactcaggaggctagagaaggagctgagcaaatgggaaagtgagctgaaggcgattgaagaggtaataaaggaaggagaaaagaaaaaggagagggccgaagagataagagaaaagttaagcgagatcgagaagaggctagaggagttaaaaccgtacgtagaggagctcgaagatgctaaacaagttcaaaagcagatagaaagattaaaggctaggctcaagggtctgagcccaggagaagttatagagaaactggaaagcttagagaaggagaggactgagatagaagaggcaataaaggagattaccacaagaattggccaaatggagcaggagaaaaacgagagaatgaaggcaatagaagagctaaggaaggccaagggaaagtgtcccgtctgtgggagagagttaaccgaggaacataagaaggagctcatggagaggtacacccttgagataaagaaaatagaagaggaactcaaaagaaccacggaagaggagagaaagctcagggtaaatttaaggaagttagaaatcaagcttagggagttctcagttatgagggacatcgcagagcagataaaagagttagagagtaaactcaagggcttcaacttggaagagcttgaacaaaaggagagggaatttgaagggctaaacgaggagtttaacaaactcaaaggtgaactcctgggactagagagggatttaaagaggataaaagctctggaaggtagaaggaaattgatagaggagaaggtcaggaaagccaaggaggagctggagaaccttcatagacaacttagagaacttggcttcgagagcgtagaagagctcaacctgagaattcaagagcttgaggagttccacgacaagtacgtagaggccaaaaagtctgaaagcgagctgagggagctaaagaacaaattagaaaaagagaaaacagagctggatcaagcattcgaaatgttagctgacgttgaaaatgagatcgaagaaaaagaggccaagttgaaggatttagaatcaaagttcaacgaggaagagtacgaggagaagagggagaggctagttaaactcgagagggaagtttcttccctaacggcaaggctagaggaattgaagaagagcgttgagcagataaaggcaacgctaaggaaattaaaggaggagaaagaagagagggagaaggcaaagcttgagataaagaaactagaaaaggccctaagtaaagtggaagaccttagaaagaagattaaagattacaaaactcttgcaaaggagcaggctttgaacaggataagtgaaatagcgagcgaaatattctcggagttcaccgatgggaagtactcaaacgtcatcgttagggctgaggagaacaagacaaagcttttcgttgtgtacgagggcaaggaagtcccgctaacgtttctaagcggtggggagaggatagcgctgggtttagcattcagactcgcactttcaatgtacctggtgggcaggatagatctcctaatactagatgagccgacacccttccttgacgaggagaggagaaggaagctactcgatattatggagaggcatcttaggaggatatctcaggtaatcatggtttcccacgatgaagagctgaaggacgctgctgattacgtgataaggctaaggttagaaggtggaaagtcaaaggtagaggtggtgtcatga

SEQ ID NO: 45331 - DNA, 1371 bp, Pyrococcus abyssi
atgggaaagctgttcggcacctttggagtgagaggaatagccaacgaaaagataacaccagagttcactttgaaaatcggcatggccttcgggacattgctgaaaagggagggcagagaaaaaccgctggtagttgttggaagggatactagggttagcggtgaaatgctgaaagaggctttaataagcgggttgctgagcgtgggttgcgacgttatagacgttggaatagccccaactccagctattcagtgggccacaaagtactttaacgccgacggtggagcggtaataacggcctcccacaatccgccagagtacaatgggataaagctcctcgagccaaacggaatggggctaaaaaaggaaagggaagctatagttgaagaactattcttcaaggaagagtttgacagggctaagtggtacgagattggggaagttaggaaggaggatataataaagccatacattgaggccataaagagcaaagtagacgttgaagctataaagaagaggaaacccttcgttgtggttgacacggctaacggtgctggttccctaactttgccgtacctcctcagggagctcggctgtaaggtcgttacagttaacgctcaaccagatggtcacttcccaggaaggaacccggaacctaacgaggaaaatctcaaggagttcatagaaatcgtgaagtcccttggtgcagactttggcgtagcccaggatggagacgctgatagggcggtcttcatagacgagaagggtcgattcatacagggtgacaaaacattcgccttggtcgccgatgcagtcctaagggagagaggtggagggttactcgtaacgactgtggcaacatctaacttactggatgacatagcgaagaggaacaatgcgaaggttatgagaacaaaggtcggcgatttaatagttgcgaggacgctctttgagcacaacggaactattggaggagaagaaaacggaggggtaatattcccagaccacgtccttggaagggacggagctatgacggtggcgaagatagttgagatattcgcgaagagcgggaagaagttcagcgagctgatagatgagctaccaaagtactaccagataaagaccaagaggcacgtcgaaggtgataggcatggcatcgtcaacaaagtggccgagatcgctaggggcagggggtacaatgttgatacaaccgatggtgctaagataatcttcgaggacggatgggttctagttagggcaagcggaactgagccaataatcagaatatttagtgaggccaagagcgaggagaaagctaaggaatacctcaacttaggactcggcctcttggatgaagttctttcttcataa

SEQ ID NO: 45332 - DNA, 1962 bp, Pyrococcus abyssi
atgaacatcacgagtttcataaacagactcaaagagttagttgaaatcgaaagggaagctgaaatagaagcaatgagactagagatgagaaggcttagcggaatagagagggaaaggcttggaagggctattttaaacttaaacggtaaaattattggtgaagaacttggctattttctggttaagtacggtaggaatagggaaataaaaaccgaaattagtgtgggggatcttgtagttataagcaaaagagatcctttgaagagcgatctcctggggaccgttgttgaaaagggaaagaggttcatagtcgttgccctggagacagtcccagagtgggctcttagagatgtgagaatagatctttacgctaacgatataacatttaggagatggcttgaaaatttaaacacaattaagaaggctggaaaaagggcattaaggttctacttgggtttggacgagccttcccagggagaagaagtcaattttgttcctttcgataagagtttgaaccgctcccaaaggaaagcaatatccaaggctctaggtagtgaagactttttcctggttcacgggccctttggaactgggaagacaagaactttagttgagctcataagacaggaagtgaagaggggaaataaagttcttgcaacggcagaaagtaacgtggccgtggataatctcgttgaaaggttgagtagaagtggtattaagatagtaagaataggtcatcccagtagggtctctaagcatttgcatgaaacaacgttggcttacctaataacccagcatgagctctatggtgagctcagggagcttagggtaataggacaaagcttagctgagaaaagagacacctacactaagccaacaccaaagttcaggaggggtctaagcgacgaggagataataaagctggccgagaggaagaggggagctagagggctttcggccaggttaataatggagatggctgaatggataaagctgaataggcaggttcagaaggcattcgatgatgcaaggaaacttgaggaaagaatcgctagggatataataagggaagccgacgtagttttaaccacaaactcttcagcggcccttgaggttgtagattacgatacctatgatgtagctatcatagatgaggcaacgcagtcgacgataccgagcatattgattcccctaaataaagttgagaggttcgtgctcgcgggggatcataagcagttacccccaactatcttaagcctggaagcccaggaactgtctagaaccctattcgaagggttgatagagaggtatccttggaagagtgaaatgctagtcgttcagtacaggatgaacgagaggataatggaatttccgagcaaggagttctatggaggaaaaataatcgccgatgagagcgttaggggaataacattgagagatttagtcgagtatcaatccccaaatgattcctggggtaaaatcctgaaccccgaaaacgttatagtcttcatagacacttccaaggctgagaataagtgggagagacagagaaggggaagtgagagtagagagaacccacttgaggctgagatagttgccaaaatcgtcgataagcttctctccataggagttaagcctgagtggattggcgttataacgccctatgatgaccaaagggacttaattagcatgaaagttccagaggacgttgaagttaaaacggttgatggctatcaaggaagggagaaagaggttataatcctctcacttgtaaggtctaataagctaggtgagataggcttcttaaaggatttgaggaggttaaacgtctccctaacgagggctaagagaaagctcatagtggtcggtgattcttcgactctaagctctcatgagacctataagaaaatgatagaattcttcaaggaaaagggttgcttcattgagtttcccttttcgtag

SEQ ID NO: 45333 - DNA, 1116 bp, Pyrococcus abyssi
atggaaagccttaaaatagccctcgtttctgactggtactttcctaaaattgggggagttgcaattcacgttcacaatctcgccattcatcttagaaagatgggtcacgaagtttcaatagttacaaacgcccttacgaatggaaaagaaggagaactccaaaaatacggaatagatctgataaaagttcctgggctcataaaggatggaataaacctttctatgatagctaagagttccaatagcttagtcgagtaccttaaaggcttcgacgttgttcacgcccagcatgcgtttactcccctctccttgaagtccataccagctggaaataaggtaggggccttaaccctcgttacaaatcacagcgtggagttcgaaaacttctccatactcaacggattctccaagatgtcatactcctactttaagatgtaccttgggcaggtaaaagtaggaataggggtaagcaaagcctccgtctcatttctgaggaagttcaccaatgctccgattgttgagatccccaatggtgtaaacattgagaggttcaacggaaggggaagagagtggggaacaagaaacatcctgtacgttgggcgtctcgagccgaggaaaggtgtcaactatttgataagcgcgatgaagttcgttgaagggaaattgaccatagttggagacggaagcatgagaaaagttctcaagatgcaagcaaaaaagctgggagtggaagataaagtcgaattccttggatttataagccaggaagagctaatcttactatataagaaaagcgaagtattcgtcctaccatcactcagcgaggctttcgggatagttctactcgaagccatggcgagcgaggtcccagtgataggaacctcagtgggtggaattccagagataataggagatgcaggaataatagtccctcccagagactcaaaggccctagcgaacgcgataaatgcaatcctctccaatcaaaaaaccgcaaagaggctaggaaagcttggaaggaagagggttgagagactgtactcctgggatgtagtagcagagagaacggaaaggctctataggggtgaactgggtgatagtgatactaacgtttga

SEQ ID NO: 45334 - DNA, 1353 bp, Pyrococcus abyssi
atggcggttcaccctatagattatcgctacggtagcgaggaaatgaggagggtctgggaagaggaaaacaaactgcagaaactcctcgatgttgaagcggctttggctagggcccatgcaaaactcggaaacattccggaggaaagcgctagggtgatatcggaaagggcaaacacgaaatgggttaagcttgagagggtcaaggagatagaggctgaaattcaccacgatataatggccgtagtaaaagccttaagtgaggtctgcggggagcatggaaagtacgtccaccttggcgctacgtcaaatgacataatagacacggccaacgcacttctcataaaggagagtcttgccatagttgagaaggatttaaaggagctcagatctatattgaaggaactcgccaagaagcatatagataccgtatgcatagggagaacacatggacaacatgctgttccaacgacgtatggaatgaagttcgcactatggttggacgagatacagagacatatagagagacttcagcaacttaaggatagggttcttgtgggaaaaatgagaggtgcagtaggaacggcggcatcctttggagacaaggccttcgagatagagaaactcgtcatggaagatctaggcttaaagccagctaggataactaaccagataattcaaagagacgtgtacgctgaactgatgttcttcctagcattggtggcctcaaccctcgacaagatggctttggagataaggaacttgcagagaactgagatattggaggtaagcgagcccttcggggagaagcaagttggctcatcaaccatgccccacaagaggaacccgataagaactgagaaagtgtgcgggctcgccagggttctttactctaacgttattcctgccttacttaacaatcccctctggcacgaaagggatttaactaactcctcagtagagagggtaattctcccagaaagctttgttttgctcgatgaaatgctcaaggtcatgaagaaggttctcaaaggactagagttcttcccggagaacattaagaggaacctctatttaaccaagaacctgattatggccgagcctttgatgcttaagcttgccgagaaaggaatgggaagacaggaggctcacgaattggttagacagcttgctatgaaagcgtttaaagagggaagggatttgctcgaggttgttaggaaaaacgaggaagcgatgaaatatctcacagaaaacgatctagaaggcctaaaacctgaaaattacataggaaaagcaagagaaatcgtcgaaaacgttgttaattacgttgaagaaatggaaaggagaggtttatag

SEQ ID NO: 45335 - DNA, 885 bp, Pyrococcus abyssi
atggagggtgtgatagttccactcgtaactccgtttagggaagactattcaatagatttcgaggccctagagtggcacataagattcctggaggaaaaaggagttcacgggatattcgtaaattcaacgactggcgagttcaccagtttgaacacagatgaaaggaaaatgttagcggaaaaaggaagggagatcacatcgggaatgtacttggtaggaactggatccacgagcactttagaggttatagagctaagcaggcacgctgaagatattggagcggatggcatcgttatagtggccccatattactgtaagcttaaggacgaagagattcttaagcatttctcaatggtagccgagagggtagatataccaattatagtctatgcaatcccatcgtgcgcgaatccagtaccagtcgacattataagaaaggtctcactagagtattcgaacataataggagtcaaagcgagcgttgatagcctaacttatctccaagaattgatagaggtaaaggaagaaagaaaggactttagggttttcactggattagatcagtactttttatcgactttactccttgggggagacggaggaataatggcgtgtgcaaactttgcaccggaaattcaccttcaaatttggaactcattcaagagaaggaactttgaagaggcaataaaactatcaagagtccttggagagatatctaggatatacaatgtagcttcatcctttgcatcggcggtaaagttagctatgatagccaaaggattcccgataaaaccagttcttaggccacctcacgtaatcgatggagaggaagtttttaacgaaataaagggaatattaaggtcattagagaacgtcaagccgtga

SEQ ID NO: 45336 - DNA, 1374 bp, Pyrococcus abyssi
atggattatccgaggatagttgttaatcctcctggaccaaaggccaaggaattaatagagagagaaaaaagagttctctcaactggaattggagttaagctttttcctctagttcctaagagaggatttggtccttttatagaggatgttgacggcaacgttttcatagatttcttagcgggagctgcggccgcatcaactggttattctcatcctaagctagttaaagcggttaaagaacaggtcgagctcatacagcattccatgataggttacactcacagtgagagagccataagggtcgctgagaagttagtaaagatatctccaattaagaattcaaaagttctcttcggattgagcgggagtgatgccgtagatatggcgataaaggtgtcaaagttctccaccagaaggccttggatacttgctttcataggggcctaccacggccaaaccctcggtgccacttctgtggcttcgttccaagtttcgcagaagagagggtactctccgctgatgccaaacgtcttctgggttccatatccaaatccctacaggaatccctggggcataaacggctatgaagaacctcaggagctcgttaatagggtagtagagtatttagaagactacgttttctctcacgtggttcccccagatgaggttgcagccttcttcgccgagccgattcagggtgatgctggcatagtagttcctccagagaacttcttcaaagagctgaagaagttgctagatgagcatggaatacttctggtcatggacgaagttcagacgggaattgggagaactggaaagtggtttgcgagtgaatggtttgaagtaaaacccgacatgataatatttggaaagggagttgcaagcgggatgggacttagtggagtcataggaagggaagatatcatggacataacgagtggttcagcactactaactccagcggccaatcccgttatttcggcggcggcagatgcgacccttgagataatcgaagaggagaatttgcttaagaatgcaattgaagttggaagcttcataatgaaaaggctaaacgagctcaaggagcagttcgacatcataggggatgttaggggaaaaggcttaatgataggtgtcgagatagttaaggaaaatggaaggcctgatcccgagatgactgggaagatatgctggagggcgtttgagcttggccttatactgcctagctatgggatgtttggtaacgtgataaggataactccaccgcttgtactaacaaaagaggttgcagagaagggattggagattatcgagaaagctattaaagacgcgatagctggaaaagttgaaaggaaagttgtaacctggcactga

SEQ ID NO: 45337 - DNA, 1173 bp, Pyrococcus abyssi
atgagacagaagagaaagtatttcatcgctgagagggttattctcattaaaaggtcaaaaataagggagttgttcgaaagggcttcaaaaatggagaatgttatctctctaggaataggagaaccagattttgacacccccaagaacataaaagaagcttgtaagagggctttggatgaaggctggactcactacacgccaaacgctggtattcagcagttaagggaggctgtcgttgaatattacaagaagttctacgatgtagatatagatgttgaaaacgttataataacggccggtgcttatgagggaacttacctagcctttgaatcactactcgagagtggggatgaggttttaattccagaccctgcattcgtttcttacgttgaggatgcaaagcttgcagaggcgaaaccagttaggatcccactaagggaagagaacaacttcatgccagatcctgatgagttgctagagctggtaactaagaaaactaggatgatagttataaactatccaaacaatccaaccggggcgaccttagataaggaagttgccaaagccatagccgacatagctcaagactataacatctacatccttagcgacgagccctatgagcacttcatttacgatgatgctaagcattacccaatgctgaagtttgctcccgagaatacgatactagcgaactccttctcaaagacgtttgcgatgactggctggagacttggttttgttgtcgcgccttccgagattataaaggagatgataaagcttcatgcctacataataggcaacgttgcatcatttattcaggtggctggggttgaggctttgagaagtgaggagagctggaaggcagttaaagagatgaggaaggagtacaacgagagaagaaaactcgtcttaaagaggttaaaggaaatgccggggattagggttaaagaacctaaaggtgccttttacgtgttcccaagcataaaggacactggaatgtcaagtgagaaattcagcgagtggctcctcgagaaagctagagttgtagtaatcccgggaacggcttttggtaagatgggtgaaggatacgtaaggataagctacgcaactagtagggagaagcttatggaagctatggacagaatggaaaaagcccttagcgagctctaa

SEQ ID NO: 45338 - DNA, 1128 bp, Pyrococcus abyssi
atgaggttctttttaaagacgacaattctcatgggtaggggatcccttgagaacgtgaagaggataatctcggagggggagagggttctaatattctcttcaagatcaatggatagacttggcttcttaagcgaagtcgccgattacgtggaggaagccggaggagtttacgaaacgattatcggtttaccacctgaacctagcgttgagaacgttgaggaggttcttcccaaggttgaggaattttcaccagaaactttcatagcactaggcggtggaagtgtaatagacgttgcaaaggccgttaaagttttttacgatgctcctgggcttgattttgacagtgtggcaatatttagcaggttcaagaaggctcaacccctgccaaagcttaagactaggctaatagctatcccctcaacgagcggtgctggaagcgaagtttcggctgctagtgtcataaagaagggggataccaagtacacgatagttagcccagagttatgtccagattatgctatcttagaccctagactacctgagaaaatgcccagggaagttgccaggaattccggactagacgttctcgtccatgctattgaagcttacgtctcaaaggcctcaacgcccttcagcgatgccctcgcggttaaagctgctagaataatattcgagaggcttgaagatagcgtcaacggcgatgcaaaggccagagaggaagtacactatgccgcaaccatggctggaatagcattcttaaacggtagattaggcctagtccatgcgatgagtcacaaatctgcttggattggccctcatgggttggttaacgcaatattcctaccctacgttatggagtttaacatggagagggccagggaaaagtacgatgcgatggcaagagagctagggctttccagtgcggatgaactactagagaaggttaaggaacttaatgaaaagcttggagttccgaagctttcggagatagtgaaggaggaggaattcctgggcaaggtagaggatatgagcaggaaaacctacgaagatccactcgttagctttaacccagttgagccgagcgttgaagatataaagaatctctacctgagggccctccatgactga

SEQ ID NO: 45339 - DNA, 954 bp, Pyrococcus abyssi
atggtggtcagcttaaagggtagggatcttctctgtctccaggactacacgcctgaggagatatggactattctcgagacagcaaagatgctcaaaatctggcagaagataggaaagccccacagacttctcgagggtaaaaccttggcaatgatattccagaaaccctcaacgagaactagggttagcttcgaggttgcgatggctcacctaggaggacatgcactctacctaaacgctcaagacctacagcttagaaggggcgaaaccatagcggacaccgcaagggtcctaagcaggtacgtcgacgctataatggctagagtttatgaccacaaggacgttgaggatctagccaagtacgctagcgttccagttataaacggccttagcgacttctcacacccatgccaggctctagcggattacatgacgatttgggagaagaagggaactataaagggagttaaagtagtttacgtcggtgacggaaacaacgttgctcactcactcatgatagctggaaccaagcttggggccgatgtggtagtggcgaccccagagggttatgagccggatgagaaggttataaagtgggccgagcagaacgccgctgagagcggaggaagctttgagctacttcacgatccggtaaaagctgtcaaggacgctgacgttatttacacagatgtatgggcttcaatgggccaggaagctgaggctgaagagaggagaaagatcttcaggccgttccaagttaacaaggatttagttaagcatgccaagccagattacatgttcatgcactgcctaccggctcacaggggtgaagaagtcactgatgacgtcatagactctccaaatagtgtcgtctgggacgaggcggagaacaggttgcacgcccagaaagcagttctggctttattgcttggaggcgtaaagacgggcttctga

SEQ ID NO: 45340 - DNA, 459 bp, Pyrococcus abyssi
atggctgagcttaaggtttccgcgattaaggagggaaccgttatagatcacattccagccgggaaagggttgaaggttatagagatcctgaagctcggcaagttaacaaatggaggggcagttcttctagccatgaacgttccgagcaagaagcttggtagaaaagatatagttaaggttgagggtaggttcctcagcgaggaggaggttaataagatagccttggtagctccaaatgcaacggttaatataattagggactacaaggtcgttgagaagtttaaagtcgaggtccccgacgttatagagggaatactgaggtgtggcaatccaaactgcataaccaaccacgaatacgttacaacgaagttctacgttataagtagggaacctctaaaggttcgttgtcactactgtgaaagaacaatggaagaggaggagatactggctaacctttga

SEQ ID NO: 45341 - DNA, 927 bp, Pyrococcus abyssi
atggattggaaaggtagggacgtgataagtattagggacttttctaaggaagatatagagacagtccttgcaaccgctgaaagactcgagagggaattaaaagagaagggtcagctggagtatgcaaagggaaaaatcctagcaacgctgttttttgagccatctacaaggacgaggttaagctttgagagcgctatgcaccgtttaggcggagccgtcatagggtttgcggaagcctcaacgagtagcgttaagaagggtgaaagcttgagggacaccattaaaaccgttgagcagtactgcgatgtgatagtgataaggcatccaaaggaaggtgccgcaaggcttgcggcggaagttgccgaagttccggttataaacgctggagatggcagcaatcagcacccaacccaaactttacttgacctatatacgattaagaaggagtttggaaggatagatggtctaaagataggcctccttggagacttaaagtatggaagaactgtccacagcttggccgaggcattaactttctacgacgttgagctctacctaatctccccagaactcttaaggatgccgaggcatatagttgaagagctcagggagaaggggatgaaagtcgtcgagactacaacccttgaggacgtcatagggaagttagacgttctctacgtgactaggattcagaaggagagattcccggacgagcaggaataccttaaagttaagggtagctatcaggtgaacctcaaggtgttggagaaggctaaggacgagctgaggataatgcatccgttgcctagggtcgatgagatacatccggaagtggataacacgaagcatgcgatttactttaggcaggtgtttaacggtgttccagttaggatggccctcttagctctcgtcctgggggtgatttga

SEQ ID NO: 45342 - DNA, 489 bp, Pyrococcus abyssi
gtggtctctatgtgtgaaaatgagaaggaaagaaccctcgtaataataaagccagacgccgttattagggggttaattggagaaataatctcaaggtttgagaagagggggttaaagatagttggaatgaagatgatatggataagcaaggaactcgccgagaagcattacgctgagcacagagagaaacccttctttaaatcattggttgagtacataacgaggactccagtagtcgttatggtggtcgagggtaggtgcgcaatcgaagtcgttagaaagatggctggggctactgacccaaagaacgccgagcccggtacaataaggggagactttgcattggaagttagcgatgcaatatgcaacgttgtccatgcgagcgattccaaggagagcgctgagagggagataaagctttactttagagatgatgagatattcgactatcctagggccgaggattggttttatagaaaaggtatttaa

SEQ ID NO: 45343 - DNA, 1914 bp, Pyrococcus abyssi
atgtttgaatacttcccgtataagacgcttagacctcaccaagatgaatttatagagttagtcagggatgttgttaaaaggggagagaaggttataattgaggctccaactggttttggaaagactataagtgttttggctggagttcttccgcacgcgatatccttcggatacaaggtgatttacctagctagaactcacaagcagatggatagggttatagaggagctcaagaggataagagaaattgcgaaggtaagtggcattgaattcagaagcaggaaagatctctgcctccactcctacataaggacgttcgcccaagatgcttatactagtatgatagtctgcaaaagcttgaagaggcttggaaagtgcaagtactttgagaatttgaaagaaaagagggataaagttaaagagatcgttgaattcttccttgagaatccatcctatccttgggaggtcatagagtactcgaacttgcttgagctttgtccttacgaggtaacgaggaaggttggagagaaggccaacgttatagtggcgagctacctttacatggtgaacccttggataaggcaggccttccttgatgggctcggcttggaatatagtgacctcatagttatcttcgacgaagctcacaaccttccggatcaggctatatcagctttgagcgataggttaagcattaggagcgttgagagggcaattaaagaggctaacgaatatggcgagaaggatattgaaaatttcctttcaatatttctaagaggattggaaataatctacaaagaaaagcttgagaactacgagatttcggaagttcccctatctccagcttccatatttgagcacgtctcctcaatactcgggctcagggagagagacctacttagatttctccaagagatggtcgaggttggggatgccattagggaggacaaaattgagaggaacctcccaccgaggagctacgtaggtagggtcggtgagttcctttggaactggatctccttagctgatagaagcgattaccttcacgtgttcacgagggagaaaggactagcgctcgagatagtggccttagatccttctgtagcgctcgagtttcttgaagatgttcactcggccatactaatgtccggaacgttatctcctctcgaggcctttagggatataataggggtaaacgccagactcaagaagttccctaggatggtaaaatcggagaacgcaatagttctcgtcgctagagatgtctccactaggggggaagagcggagcccagtcctttacaagaagttagcagaatacatttttgaggcggttaagataattccgaagaacgttggtgtctttaccgcatcttacgaggttttagaaggactaatatcgaccaatgtgcatataaggatagaagaagagatcggaaagaaggttttcatagagaagagggatgcaagttcctcggagaatgatgcccttgtagccgaattcaaggctgaagcaaagggaaacggcggagttctctttggtgttatgggaggtagaaacagcgagggtcaagattatagtggagatgaaatgaatggtgtaatcttggtcggaataccttacgctaggcccacaccgagggttcaagctcagataaggtactacgagaagaagttcccagggaagggaaggtattacggttacttacttccagctcatagaaagctagcccaagccgctggaagggttcacaggagcgaggaagaaaagggaagcatagtaatcttagactatagggttctctggaataccgttaaaagggatctccccgattggatggttgaaacaatgcaacctgtgacgttgcccttaatgaggattaaacttaggaagttctggagggccgtgaaatga

SEQ ID NO: 45344 - DNA, 1689 bp, Pyrococcus abyssi
atgtcgggtgcaagggccctcgtgaaagccctggagaaggaaggcgtgaagcatacgtttggaataataggcggaagcataatgcccgtattcgacgagctactcgagagtagcataaggcacataacaacaaggcacgagcaaggtgcagcacatgcagctgatggttacgctagggtctcgggaaaaccaggggttgcgataacaacttcgggaccaggagctactaatctcgtcactggaatagccaacgcctacatggattcatctccaatagtagctatcacaggtcaagttcccacgcacatgattggaaagatggcattccaggagacagatataataagcataacaaagccaatcacgaagtggaattatcagataaggaatcctagggaagttccaaaggccgtaaagatggctttcactatagcaaccctcggtagaccagggccgacgttactcgactttccaaaggatgctcaaactggagaggacgaaatcaactttgatgtggatgtttctagactagtaactccctggagacctccaaagttagatgcctgtcctgaagaggtaaagaaagcagttgatatgatactctccgctgaaaggcctgtgttcatagtgggaggaggagttgtatggagcggtgctaccgaggaagtcctagcgatagcagagtacctaatgataccaataatgtccaccttcatggggaaaggagcagtacccgagaatcatccactctacattgggaaccttggaatgcatggaaagattgcagccaacaagctcctcccccagacggaccttataatagctgtcggcatgaggtggagcgatagaactgtaagcgaatttgagaactttgctccagaggctaagatcatccacatcgacatagatccaaaggaagttggaaagaacgtaaaagtagacctgggaatagtgggagatgccaagagggttctgaggagcatatacagcgaaattactaggggggtcaagaaaagggaggattggccctggttaaagaaggtgagggaattccaggagaagtacaaagaagagcttattcccctcgatggaaattatctcagaccccccgagatcttaaaggaactcagaaagattttacctgaagatgcgatagtcgcaacggaagttgggcaaaaccaaatgtgggtagcactgtacttcccaatattaaagccgaggacatttctcacttctggcggattaggaactatgggctttggattcccagctgctattggagcaaaagttgcgaagcctgacaaggtggtcatcgacatagcaggtgatggaagctttatgatgtccgagagagagttagcaacagcggtaaacgagaaccttccggtaatagtagtgatcctaaacaattcatcccttggaatggttgcccagtggcagaggatgttcttcaacagaagatacgttgctacctacttcaagaagaatcctgacttcgtgaagcttgcagaggcttatggagcccaaggcttcagagctgaaaccatggaagaacttctgaaagccgtgaaggagggtatgaattctgaagttccaaccgtcattgacgtcccgattcaccctgaggatgatgttctccccatggttcctcctggggagcacatttccaaggttgtaacaaggtattga

SEQ ID NO: 45345 - DNA, 1272 bp, Pyrococcus abyssi
atgggaatgacgatagctgagaagattttagcagatcactccgaaagggaggaggttaaacctggagaaatagtcatggccaagttggatttcgtgtttggaaacgatgtaacgatgcctctagctataaagaagtttagggaacttggagttaagagggttttcgatagggaaaggatagcgatagttctagatcacttcacgccaaacaaggatataaagagcgccgagcagtgcaaatcttcaagggagttcgccaaagagatgggaataaaatggtttttcgaaggaggaagtgtcggagttgaacactgcttacttccagagctaggtcttgttcttcctggagacttaattatcggtgcagattcgcacacatgcacgtatggtgctctcggtgccttcgcaacaggagttgggagtactgatttagccgtcgcgatggctactggggaagcctggttcagggttcccgaaaccatgaaattcatctacgagggagagctccaaccttatgtaactggtaaggatttgatccttcacacaatcggagatataggagtaaatggagccctatacaaggtcatggaattcagtggaagcgtaatagaggagctctcggtggaacagaggatgaccatgagtaatatggctatagaagctggagcaaagactgggataatagaaccggataagaaaaccctagattacgttaaggagagagcaaaaaggaagtttaaggtttacaaaagcgacgaggatgctaagtactacaaagttatcgagtacgacgttaccaactgggaacctgtagttgcctttccccatttaccggagaacacggttccaataagtaaggctgcaaagatgaacataaagatagatcaggtcttcataggttcttgcacaaatgggagaatagaagatctaagaatggcggctgaaattttagaagggcaaaaagtcgccaagtgggttaggttaatcgtcattccgtgctctccaacggtttactggaaagccttgaaggaaggtttgatagagatattcttggaggccggagctgtaataggacctcccacgtgtggaccctgtctcggaggtcacatgggagtgcttgcaagtggtgaaagggctgtctctacaactaacaggaacttcgttgggagaatggggcatccaaagagcgaggtttacttagctaacccatacgtcgccgctgcttcagctgttttgggtaggatagcatccccagaggaggtggtaaaatga

SEQ ID NO: 45346 - DNA, 1065 bp, Pyrococcus abyssi
atgaagttaagaatagcggtaattcctggggatggaatcgggaaggaggtagttgctgaaggtctaaaggtcctaaaaaaacttgaggaactctcgagggtgtcatttgagtttaaagagtatccgtttggtgctgaacattacctaaaaactggtgaaacattgccggattgggcaatagaggagttcaagaaattcgatgccatatatttcggagcgataggcgatccaagggtaaagcccggaatcctggagaggggaatactcctaaagatgcgcttcgagttggatctctacgtaaatttgagacccgttaaactttatcatcccaggttaactccgctgaaggggaaaaacaaaatcgacatcgtattcgtcagggagaacaccgagggcttgtacgctggagctggagggttcctcaggaagggaacgcctcaggagattgcagttcaggagatgataaacacgcgctttggagttgagagggttattaggtttgcatttgaatacgcaaaaagatctggaagaaaaaaggtgacgctcgttgacaaggcgaacgttctaacatatgctcatgacctctgggaaagggtctttgctgaggtttcccaggaatacgatctcgaaacggatcactactatgttgatgccatggccatgaagatgattcgttcaccggaaagctttgacgttgtggtaactcccaacatgtttggagatatactcacggatcttggagctgagatagttggtggattgggaatagctgcgtctggaaacataaatcctgaaaccaccggaatgtttgaacccgtccacggttctgctcctgatatagctggaaagaggatagcaaatcccctagctgcgatactgagcgcctcaatgatgctcgagtatttaaacctcgaaaaggagtcgaaatggattgaagaagctgttaaaagggctatagcagaaaataaggttactcctgacatgaatgggaatttgaagacttatgaagttggtgattgggttgtaaagttcttggaggtagttgctaatgaagaggagggttga

SEQ ID NO: 45347 - DNA, 2523 bp, Pyrococcus abyssi
atgatactcggaaggagtgaacctcaaaaggatgaaattaagcttagagttgctgaggccctaaagagggacgttggaagggggattgttaggttcgacaggaagtaccagaggatgataggcgttgaacccggtgatatagtggagatagaaggagaaagaataacggcggcgatagtcgctaaccctcaccccgacgatagaggtttggacataatcaggatggatggttacataaggaagaacgccggcgtaactattggagactttgtaacgattagaagagcggaggttaaagaggctaagaaagtagttcttgctccggcacagaagggcgttatagttcagattcctggggacatagtcaagaacaacctattgggaaggccagttgttaagggagatataatagttgcaagtggaaggagtgagatgtattactcaagtggtactccatttgacgagatcttcaggggcttcttcgaggctatgtcggttggctttggagagctcaagttcatggtcgtgaacacgataccaaaggggatagttcagataacatataacacggaagttgaggttctgccccaagccgttgaagttagggaggaaaagatcccagaagttacttacgaggatataggaggattaaaggaggccatagagaagataagggaaatggtggagttaccgttaaagcatcctgagctgtttgagagacttggaattgagcctcctaagggtgttctcctctatggtccaccgggaaccggtaagaccttgctggctaaagctgtagctaacgaggctaatgcctacttcatcgcaataaacgggccggagataatgagcaagtactacggagagagcgaggaaagattgagagaaatatttaaagaagctgaggagaatgccccggcaataatcttcatagacgagatagatgcgatagctccgaagagagaggaagtcgttggggaggttgagaaaagggttgtaagccagctgttaactctaatggatggtctcaagagcaggggtaaagttatcgtaatagctgcaactaataggcctgatgcgctggacccggctttaagaaggcctggaaggtttgacagggaaatagaggtaggtgttccagataagcagggtagaaaggagattctccagatacacacgagaggaatgccaatagagcccgattttgagaaagaaaccgttattaaggctttaaaggagcttgaaaaggatgataggtttgacaaggagaagatcaaaaagataatcgagaaggtctcgaaagctaagagtgaggaggaaataaaggatatactcagagaggataggaatctatacattgaggttaggacaaagcttatagataagttgcttgatgagcttgccgaggttactcatggatttgttggggctgacttagctgcactagcaagagaagcagcaatggtagtgctaagaaggctcataaaggaaggtaagataaatccggaggccgaaacaattccgagggaggttcttgaggagttaaaggtaactaaggctgacttctatgaggctttgaagatggttgagccttctgcccttagggaagtgctcattgaagttccaaacgttcactgggacgacattggaggattagaagatgtaaaacaagaactaagagaagcagtagaatggccactaaagtatccaaaggccttcaagaggctcggcatcactccaccgaaaggcgttcttctctatggcccaccgggaactggtaagaccttgctagctaaggcagttgccactgaaagccaggcaaacttcatagccataagaggacctgaagttctaagtaagtgggttggagagagcgagaaaagaataagggagatctttagaaaggctaggcaagcttcacctgctataatattcattgacgagatagatgcaattgcaccagcgaggggaactgctgagggggagaaagtaacggataggataattaaccagctactcactgagatggatggactagtggagaacagtggcgttgttgttattgctgctactaataggcctgatattttggatcctgcgttgttgaggcctgggcgttttgataggcttatcctagtgcctgctcctgatgagaaggctaggtttgagatattcaaggttcacacgaggggaatgccattagctgacgacgttgacttgaaagaattggcaagaagaacagaaggctacacaggagcagacatagcagcagtctgcagagaagcagcaatgaatgccctaaggagagcggtggctaagctctcgccggaagaacttgaagaggagagtgagaagtttctaaagagcttaatcgttacaaggaaggacttcgaagtagcgttaaagaaggtcaagccaagtgttacaaagtacatgatggaatactatagacaattcgaagagtcgagaaaaaggatggttggggagtctacgggaagggaacctgattactttactggatag

SEQ ID NO: 45348 - DNA, 1053 bp, Pyrococcus abyssi
atgggcaagcttctgaagccttcaaaggagataggcatcgttggttatggagcttacgtgccaatgtacaggataaggaatgaagaaataggaagggtctggggggtttctaactttccaatagaggaaaaggccgtcccaggattggatgaggatgccgtaacgataggtattgaagccgcaaggaacgcactgaagagggctaaaatcgaccctagggagataagagccatatggttcggtagcgagagcaagccttacgcggtaaagccttcggcaaccattatagctgaagctataggggccactccagacttggaggcagctgattttgagttcgcatgtaaagctggaaccgaggcactgcaagctgcaataggtttcgtggcatctggaatggcgaagtacgctatggccataggagccgatactgcccagggaagaccagcagatcacctcgagttcacggctggggcaggaggggctgcattcatagttggagagaaaagctcagagactttggcttactttgagggtagctactcctacgttaccgatacaccagacttttggaggagacagcatgagcactatccaaggcatggaaacaggtttactggagagcctgcctactttcaccacgtgataaccgctgctaagacgctaatggacgagctaggattaacaccagcggattttgattacgcggtgtttcaccagcccaacgttaagttcccgcttacagcggcaaaaatcctggggattccaaaggagaaggttctcccaggacttttaacgggaaaaattggaaacacctacagcggagcgaccatggtgggaatatcggcagttcttgacatagcgaagccaggagataggatactctgggtatccttcggctcgggagctggaagcgatgcgttcagcatagtggttcaagatgcaatagaggagaagagggatctagcaccaaaggtggaagattacgtgaagaggaggaaggtaatagattacgccctctacgcaaaggcaagaaggaagtacatcttgtga

SEQ ID NO: 45349 - DNA, 1167 bp, Pyrococcus abyssi
atggagaagcccataatagtcggggttggaatgaccccagttggagagcactggaggacttcgcttagggatttggccgttgaggctatactaaaagcgatggacgatgctggaattgacaaagtcgattccctatacgtaggaaatatggcatcaggctcatttgtcgagcaggaaaatcttggagctttgatagctgattgggctggtttaggtaacattccagccgttaaagttgaagctgcatgcgcctctggaggggctgcagttcaagagggtgcaaaggcagtgttaagcgggttagaggatgtcgttttagtagttggagtggaaaagatgacggatgcttggccgagcgatgctaccagatatctggcttatgcaagcgatgctgagtgggaactcttccacggggtcagcttcgtcgccttaaacgctttaataatgaggcattacatgaacacctatggatacaccgaagaagatttagcgttattcgccgtaaacgctcatgcaaacggagcaaagaatccctatgcgatgtttaagagacctataacggttgagaccgtaatgaagagcccatacattgccgatccattgaagctcttcgatgcctcaccagtttgtgatggagctgcagccgtaataataactatcccagagaaggccaaggaacttggaattccaaaggataagtgggttgaaattgcgggcatgggaagggcaatagacacgataaacctagccaatagggaggatttgctaacgctaaaagcagccaaaatagctgcggagaaggcttataagatggcaaaagtcgagcccaaggacattgatttctttgaggttcacgatgcgttcaccgttatggcggccttaagcttagaagccctgggagttgcagagaagggagaaggagcaaagcttgccaaagagggacagatagctatagatggagactatccaatacaaaccatgggaggactaaaagcgagaggacatccagttggagctactggagtttaccaaaccgtagaatccgttctccaaattagaggagaggctccaaacggaattcaagttcccgacgctgaaattggattaacccagaatataggtggaacaggttcaaacataactgtcacaatactcaggagggtttga

SEQ ID NO: 45350 - DNA, 750 bp, Pyrococcus abyssi
atgccattcgagatagtctttgaaggtgcaaaggagtttgcccagcttatagagacggccagtagacttatagatgaagccgcattcaaggttactgaggaaggaatatcgatgagggctatggatcccagcagggttgtcctgatagacctaaatctaccggctagcatcttcagcaagtacgaggtcgatggagaggagactatcggagttaacatggatcacctcaagaaagttctaaagagggggaaggccaaggaaaccttaatacttagaaagggagaggagaacttcctggagataagtctccaaggaactgcaactagaaccttcaagctaccactaatagatgttgaggagatcgaagttgacttgccagagttacccttcacggcaaaggttgttatcctgggagacgttattaaggaggcagtcaaggatgcttcgctggttagcgatagcatgaagttcatagcaaaggagaacgaattcacgatgagggccgaaggtgaaacccaggaggttgaagttaagcttacccttgaagacgaaggacttctagatattgaggttcaggaagagaccaagagcgcgtatggaatcagctacctctccgatatggtaaagggccttggaaaggccgatgaggtaacgataaagttcggaaacgagatgccgatgcaaatggagtattacataagggacgagggtaggctgatattcctcctggctcccagggttgaggagtaa

SEQ ID NO: 45351 - DNA, 333 bp, Pyrococcus abyssi
atggtgaagttctgccctaagtgcgggagtatcatgattcctgacaagaagagaggagtttttgtgtgtagaaggtgtggttacgaggaacctattaatcccgaggatgctaaggcctacaagaggacagaggaggttaagcataagcccgacgagggagttatagtggtggagcaggatttctcaaccctaccaacggccaaggttacgtgtccaaaatgcggttatcatgaagcctggtactgggaactacagacgagggctggcgacgaaccctcaacgatattctataagtgcaaaaggtgcggctacgtatggaggagctacgagtga

SEQ ID NO: 45352 - DNA, 1047 bp, Pyrococcus abyssi
atgtccgagaagatggtagctatcatgaagacgaaaccggcttacggcgctgagctcgtcgaggttgatgttccaaagccaggacctggggaggttctaataaaagttatagcgactagcatttgtggaacagacctacacatctatgagtggaacgagtgggcccaatcaaggataaagcccccacagataatgggtcatgaggttgccggtgaagtagttgaggtgggcccgggagttgagggaattgaggttggagattacgtaagcgttgaaacccacatagtttgtgggaaatgctacgcgtgtagaaggggacagtaccatgtttgtcaaaacacgaagatattcggtgtagacaccgatggtgtatttgctgagtacgcggtggttccagctcaaaacgtttggaagaatccaaagtcaattcctccggagtacgcaacccttcaagaaccacttggaaatgcagttgatactgttctggccgggccaatctctggaaagagcgttttgataactggagctggcccccttggcttacttggaattgcggtggcgaaggcctccggggcttatccggtgatagtttccgagccgagcgatttcaggagagagctagctaagaaggtcggtgcagattacgtgataaatccattcgaggaagacgtcgttaaggaagtcatggacataacggatggaaatggagttgacgtgttccttgagttcagcggagctcctaaggctttagaacagggacttcaggctgttacaccagctggaagagtatccctcctgggcctttacccagggaaggttagcatagacttcaacaatctgataatcttcaaggctctaactgtttatggaatcacaggtaggcacctctgggagacatggtacacagtttctaggctactccagagcggaaagcttaacttggacccaataataacccacaagtacaagggattcgacaagtacgaggaagccttcgagctaatgagggctggaaagacgggtaaggtagtcttcatgctcaagtga

SEQ ID NO: 45353 - DNA, 1437 bp, Pyrococcus abyssi
gtgattgccatgaggcttcctgatcacaagacaaagatagttgcaacaatagggcccgccacaagctctaggaatatgataaagaagctaatagaaaacggtgtgagcgttgtgaggctcaacttctctcacggtagctttgaggagcatgcaaaggtcatagagaaagtcagggatatatcacaaaagcttgacagaagggttgcaatattggccgacctcccaggattgaagattagagtgggcgagataaagggagggtacgtagagcttaagagaggtgagaaggtagttttgactacgagagatgttgttggggatgaaactacgattcccgtagagtacaaggacttcccaagattagtctccaagggcgacgtcatatacctaagtgacggttacatcgttcttagggttgaagaggtaaggggtcaagacgttgaggcagttgtcgtctctggtggaaaactgttctcaagaaagggaataaacattccaaaggcctacctaccagtggaggcagtaactcccagggacatggagataataaagttcgccatcgagcagggagttgatgcaataggcttaagctttgttggaagcgtttatgacgttctcaaggttaaaagtttcctcgagaagaatgatgccgaggacgtcttcgttatttcaaagatagaaagaccggacgcagtcaggaacttcgatgaaatcctgaaggcttcagatggcatcatgatagctagaggtgatcttggggttgagatgccgatagaaagattgccaatacttcagaaggagcttataagaaaggcaaacacggagggtaagccagtaataacagctactcagatgttagtttcaatgacggccgaaaaggttccaaccagagctgaagttacggacgttgccaacgcgatacttgacggaacagacgcggtcatgctctctgaggagaccgcgattggaaaattcccaatcgatgccgtcaagatgatggcaaagatagccaaggtcaccgaggagtacagggagagctttggaatgtcgaggctcagggaactcgtggaggatgggacaagggggacaataaaggaggcaatagcgagaagcataatagatgcgctctgcaccctaaacataaagtacatactaacccccactagaacgggcaggacggcaaggctcatctcgaggtttaagccaaagcagtggatatttgggttctccactaacgaaagggtttgcaacaacttgatgttcagctatggagtttatgcgttctgtctcgaggagggcttcgatgagagggacataataaggctaattaagggacttggactggttgagagtgacgacatagtgctgatgaccgagggtaagccaatagagaagaccatgggaacgaactccatcaagatattccagatagcgtga

SEQ ID NO: 45354 - DNA, 2058 bp, Pyrococcus abyssi
atgatcctagtgatagcagaaaagccgaacgttgccaggaagatagcaggtgccctctcggagaggaggcccataaggaagaccatattcggggttccctactacgaggtctttagggatggtaaaaagctgatagttgcctctgcggttggtcatctttacggtttagcaccaaagcaggatttctttggttatcctatattcgatattgagtgggtcccggtttacatagctgagaagaataaagactatgccaaggattacataaaggcactttcagtcctggctaagagggttaaagagttcatagtggcctgtgactacgatacagaaggtgaggtcatcggatacacagctttaaagtacgcatgcggtgtagatccgtctagagctaagaggatgaaattctcagctttgacaaagagagacctcttgaacgcttggcgcaatctcgagccgacgataaactttgggatggcaaacgcaggtatagcccgccacgtgcttgactggtactggggagttaatttatctagggctttgactcacgcaataaagagggcctccggaaagtgggtggtgcttagcactggaagggtccaagggccaacgttaaagtttctagttgaaagagagagagaaatacagagcttcgttccaaagccatactgggttataaagcttgtgattgaaaagaacggtcaaaaactcgtggcaaattatgaaaaagacaagatctggagtgaggaggaggccaagaagatagtcacagaggtaaagaagagcaaagcgagggtatcaaacatcgaggttaaaagacagaaaaggaatcctccagttccgtttgaccttgggactctacagagggaagcctattctgcctttggttttagcccaaagaaaaccctggatatagctcaaagcctatatgaaaagggtttcacaagctatcctaggactgaaagtcaaaaactgccaaagaacttgaactttaggttgataatccaaaacatctctagaatgccccagtatagaccttacgctcatctcctactcggcatgccagaattaaagccggttgaaggtaaaaaggaagatcctgctcatcccgctatatatccaaccggagagattcctgggcctggcgatctaagtaaagatgaagaaaagctctacgatatgatagttagaaggttcttggccttgttcatggagcccgctgtgagggaaagcgtcaaggtgacgatacttgccggtcctcacaaattcatgctctctggggcaagaacggtaaagcaggggtggcttagcgtttacggaaagtacataaagtttgacgaggtaactcttcctgagttcttcattggggagagggttagggttctccaggttaggagggagaagaaaaagacgaagcctccggctaggtattctccagcggcggttataaagaagatggaggacttgggaattgggactaaagctactagagcgcaaatcttggaaaccctgtatcaaagaggctatatagaggggaagaagagcataaaggtgactcctctggggatgaaggttatagagactttagaaaagtacgttcccgagataataagcgttgagttaacgagggaattcgagaggaagatggacctaataatgcaggggaaattaaccaaggaagaggtgatagaagaggcgaaagttaagttgacgaagatacttgaggaattcaaaaagagggaacttgagataggattggagctcgccagaatagtcgttggtgacgtgaaggatgagataaaggaagagaaacccatagttgtcggaaaatgtccgaaatgcggtggggatttaatagtgaagtacaacaagaagactggaaagaggttcgttggttgctcgaactggccgaaatgcgatgttacctacccaatccttcagaggggggagataataccgacgaataagacctgctgcaatggggcacccgttgtaataatcagggacaagggcagggacattgaaatctgcctcgacattaaatgcaagaagtggtga

SEQ ID NO: 45355 - DNA, 3339 bp, Pyrococcus abyssi
atggatagagaggagatcatcgagagattcctgagattccttagggagtacgctgaggagggtgaggagcccctatatataggtaaaataaaggatttgctcgctataactcctaagagatcaatagcgataaactggatgcatctcaactctttcgaccccgaattagcagaagaagtgcttgagaatccagaggagtgcatactagcggccgaagatgcaatacagataatcttaaaggaggatataatgagggaagacgtccccaggattcacgctaggttctacaacctcccaaaaacacttatggtcaaggaaatcggggcggaacacataaataagctaatccaagtcgagggggtagtaacaagagttaccgagataaaaccgttcgtctcttcagccgtcttcgtatgtaaggattgcggacatgagatggtggttcagcagaagccctacgaggggttcgtggctgttaagaagtgtgagaaatgcggaagcaagaacgtccagctcgatgtagagaagagcaagttcgtgaacttccagatgttcaggattcaagacaggcccgaaacgctgaagggtggccaaatgccgaggttcatagacgggatactgctagatgacatcgtggacacggctatgccgggagacagggttgtggttgtaggcatcctcagggtagtccaggagaagagggagaaagtcccaacgttcaagaaggtaatagaggttaattacattgagcccgtaagcaaggagattgaggaacttgagataacgccagaggaagagcagaaaattagggagctcgccaagaggaaggacatagttgacgcgatcgttgattcaatagcaccggcgatttacggttacagggaggttaagaagggaatagcgttagcactattcgggggagtccccaggactttaccggatggaacgaggttaagaggagatattcacgttctcctggtaggagatccgggagtcgcgaaatgcgtcgattatgaaactgaggtcgtgttgggaaacggtgagaggaagaaaataggggagatagttgagagggcaatcgaagaggcggagaagaatggaaagcttggcagggtggatgatggcttctatgcccccatagacattgaagtctattctctggatttagagacgttaaaagtgagaaaggctagagcgaacatagcgtggaagagaaccgctccaaagaagatgatgctcgtgaagaccagaggaggaaagagaataagggtcaccccaacccacccgttcttcgtccttgaggaaggaaaagttgcgatgaggaaagcgagagaccttgaggaaggtaataagatagcaactatcgaagggttgagcgtttcctgggatgaagtggccgagattttagagtacgagcctaaagatccctgggtctacgaccttcaggttcctggttatcacaactttcttgccaatgggatcttcgttcacaacagccaacttctcagatacatagcaaatttagccccaagggcaatatacacttcagggaagagcagttctgccgctgggctctgcgttgcgcctgagacattaatcataactgaaaatggaaccaaggaaatcggggaagtagttgaaagatggatgaaagagcttggcgaaatagagtacgatgatggcataagctactcgccggcgttcgagaaagtggcctccttgaacggtggaaaggttaagatgctaccggtgaggagggtatggaagctaaggtccccagggaagatgattaagataagaagcgaaagcggtaagcagataacagtaaccccggagacgaagttgctgacgataatagatggctcgctcgaatgggttgaggcgaggaagctaaagaagggtaattacgtagctgtagtcaataaagaaagaagtatcgttccaattggagatttcctagctaagttactgaaattttatggtgtagagttaaacctcaacgaagcagttgagagagatcaggctaggaagctccttgaaaccctcaagagcaaggggttaagcgatgtaacgatagaaattccagagaagcttaggagattcatcaaatgtgatagagtgaggtacgtcgacctcgttgaaatgttaagctcaatggaaggggagctcaaggaagaggtaatgctactgctcagcgacgttggcgatattcacgaggtaatccaagagaggctcaaggagatagggaaaatattagaatcagacgcctcctgggagaggatagctgaggtagaggaagttgtgagagatggccacgtctacgatttaaccgtcgagggaagccacagcttcattgcaaatgggttcgtagtccataacacggccgcggtggttagggacgagttcacgggaggctgggttctagaggctggagccctagttttggccgatgggggttacgcgctaatagatgagcttgataagatgaacgacaaggataggagcgtaattcacgaagcattggagcagcaaacgataagtctatcaaaggcagggataacggcaaccctaaatgctagaacaaccgtcatagcagcagcaaatccaaagcagggaaggttcaataggatgaaaaggatatcggaacagataaacttgcccccaactttgatgagcagattcgacctcattttcgtcctagtagatgaacctgacgaaaagatagacagcgagatagctaggcacatcctgagggtcaggaggggagaaagcgaggtagtaactcccaagatacctcacgacctcttgaggaagtacatagcgtacgccaggaaaaacgttcatccagtaataagcgaggaggcaatggaggagatagagaagtactacgtgaagatgaggaagagtgtaaagaagagtagcgaggaagagataaagccaattccaataaccgcgaggcagttggaggccctcataaggctgagcgaggctcatgctaggatgaggttaagcccgatagtcactagagaggatgccagggaagctataaagctgatggaatataccttaaggcagatagccgtggatgaaactggtcaaatcgacgttacaatcttggaggttggccagagcgcgaggaagctcagcaaggttgagaggatactcgacataatagagaagctagaggggaccagcgagaaaggggctaaaatcgatgatatcttagaagaggcgaagaagtttggaatagagaagcaagaagctagagaaatactagaaaagttgttagagcagggtcaaatatacatgccggagaacggttattacagaaccgtctga

SEQ ID NO: 45356 - DNA, 2061 bp, Pyrococcus abyssi
atggcagagaagttaattcccgttgtatgcccctggtgctccgtcgggtgtaggttgtacatagtaagcgttgacggttatcctaggaagatagagttcgattataacccaaaaactcccaacaagggaaaattatgccccaagggtgtctcatcttatcagcactacgttcatcccgataggctaaagaagcccctcaagcgagttggcgagaaaggagagggaaagttcgaggagataagttgggaagaggccatagagataatcgcaaagaaattcaaggagatattggaaagtcacggcccagaggccttagcgttcctgggtagcgagcgctgttcccttgaagataactacctcctccaaaagctcgctagagccttgggaactaacaacgttgaattcgcaggtaggctctgtcaatcatctaacttcgttgctagaagtaagatcttcggaggtccagcccagacgaatcctttcgatgacatagtaaagtctaaggtaatcctgatctgggggtacaaccctgcagccaccaatccggttctctttggtcagtactttgagaaggcaatccttgacaacggtgctaagctaatcgttgtggatccagtaaagacagaaaccgcaaagtacgctcacattcacctacaaccctacccaggaacagatttggcaatagctttagcaatgctccacgtcataatcaaggaagagctctacgacaaggatttcgttgcggagagggttaacaacttcgatgccctggctagggccgttgagaagtacaccccggagtgggcggagaagattagcggagttccggcgagcttaattcacgaagctgcggttctctttgcaactggtggaaacgcaactgtagttcttaacgagggaataaaccagcatgccaatggttcgataacagcaatggccattagcaatttaatagcgatcactgggaacatagggaaggaaggcgtgttctctggggtaatccctggggcccactgtggtctatgtgcagctgttcccggggtgaactgtgctcaactcccaggacctgttcccctcaacgaggagaccgctaaaaagttcagcgagctttggggattcgaggttccatctaagcccggtttgcattaccaggcaatattcgatgccatgcttgaggggaagatcaagggtatttacataatgggccagaacccggccagatccctagccaattcatctaagatagaggaggcactaaagagggctttcgtggtagttgccgatatattcccaacggaaacgacgaagtacgctgacatagttctccctgcagccgcatggtacgaaaagactggaaccgttataactcagaacaggagggttatgaggagcttccaggcggttaagcccccaggggaggctaagcctgattgggagataattgttatgttggcaaaatccattggacttggtgagtacttcaactactcgagcgttgacgatgttctcagggaaataaacaacgtcattccggctcttaagggagcgacaccggagaggcttgcaaagaaccttgagggttgcatgtatccatgtcccgacgagaacaccgagaccccgaggttgttcctcaagggattcccaaccaagagcggaaaggccgagctaattccagttgagtggaagcctccaggagaagttccagatgaggagtatcccttctggctcacgaacttcaggttggttggccaattccacacgggaacgatgagcaacaggactaagagcctgaagaagaggtggcctgggccttatgtgatgataaacgaaagagatgccaagagacttggaataaggagcggggacctggttagggtcgagacgaggagaggttctctcgtagctagggccgaggtcacggagaacataagggaaggcgtagttgcgatgccgtggcactggggcttcaactacctaacgaaggacgatgcaattgacgagttctctaagatgcccgagctgaaaacagctgcatgtaggatttctaaggttgaaggttga

SEQ ID NO: 45357 - DNA, 1269 bp, Pyrococcus abyssi
atggtgaactgcacgagcgattactgcgttaaggacatatccctggccccagagggtatgaagaagatagactgggtctctagattcatgcccgttctccagcacataaggagggagttcgaggagaagaaacccttcaagggggttagaattgccgcaacccttcacttagagatgaagacagcttttcttctgctaacccttaaggccggaggtgcgaaggtttcggcagcagcaagcaatcccctctcaactcaagatgacgtagttgcggccttggccaaggagggagttaaagtttacgccataaggggggagagcaaggaggagtactacgagttcatgaacaaggctctggacataagacctaacatcataatagatgacggcgccgatatggtttccctcgtccacacggagaggaaagagttgcttgacgagatatggggggccagcgaggaaaccactaccggagttataaggctcagggcgatggagagggacaaggtgttaaggtttccggttatagcggtaaacgactcgtacatgaagtacctcttcgacaaccgctacggaaccgggcaatccacgtgggacgggataatgagggccaccaacctcttagttgcgggcaagaacgtcgtagttgtaggctacggctggtgcggtaggggaatagctatgagggccagagggttgggggccactgtaatagttgtcgaggtcgacccgataaaagccttggaagccaggatggacggctttctcgtcatgagcatgaaggaagctgccaagataggggacatattcgttaccgctactggtaatataaagtgcattcgcagggagcacttcgagcttatgaaggatggcgcgataatggccaatgctggccacttcgacgtcgagatatggaagcctgacttagaagagttggcagtcgagataagcaacccgaggcctaacgtcactgagtacaagctcaaagacggaaggaggctttacctcttggccgatggaaggttggtcaacttggtcgcagctgatggccatccggctgagataatggacatgagcttcgctcttcaagccaaagccgcagagtacataaaggagaaccacgagaggttggagcccagggtttacgttctgccgagggagatagatgagatggttgcaaggataaagctccaatctatggggataaacatagaagaactcactgaggagcagaagaaatacctcgagagctggcagcacggaacatag

SEQ ID NO: 45358 - DNA, 1452 bp, Pyrococcus abyssi
atggagttttactggggggtcgttcagtcggcatttcagttcgagatgggggatccatataggaggaaccttgacactagaagtgactggtggcactgggttagggacccatataatataaagaatgaactcgttagcggtgatcttccagaggaagggataaacaactacgagctatatgagatagatcacaggttagctaaagaactcggcttaaacgcttatcaactaacgatagagtggagcaggatattcccatgccccacgtatagcgttgaagttgaagtggaaagagatgggtacggatttataaaatccgtgaaaattaggaaagaacatttggaaaaactggatgaacttgcgaataagagagaagttagacactatgagaacgttctgaaaaatctcaagaagttgaacttcacgacgttcgtgacattgaatcatcaaactaatccaatatggctacacgatcctatagaggttagggtgaacatagaaaaggccagagctaggggatgggtagatgaaagagccatcgtagagttttcgaagttcgcagcttatgtagcctggaaattcgacaagtacgtagacttctgggccacctttgatgaacctatggttaccgccgagctcgggtacctagcaccgtacgtaggatggcccccaggaattctgaacccgaaggccgctaagagcgtgataatgcaccaaataatagcacatgccagggcatatgactcgataaagaagttctcagataagcccgttggggtaatattgaacataattccggcttatcccctgaacccaagggacagcaaacatgtaaaggccgccgaaaactacgatctattccacaacaggctcttcctggaagctgtgaataagggaaagcttgacattgacataaatggagagtacgttaaggttccccatttaaagaggaacgactggatagggaacaactattacacgagggaggttgtcaagtacgtggagccaaagtacaaggagttacccttggtaactttcgttggagttgaaggatacggttattcagcaaatccgaacagcatttcaccggacaataatccaacgagcgacttcggatgggaagtttatccaaaaggactatacgattcaacggccgaggcctacgagtacagtgagatggtcttcataacggagaacgggatagcagattccaaggatatcctaagacccaggtacatagttgaccacgttaaagaggttaaaaggctcagggaaaacgggattaacgttttaggatacttccactgggccctcacggacaattacgaatgggccatggggtttaaaattagattcgggctttatgaggtcgatccaataacgaaggaaaggattccgaggaggaagagcgttgaaacttacaaaaaggttgtcaaggaggggattgaatga

SEQ ID NO: 45359 - DNA, 780 bp, Pyrococcus abyssi
atggagggcgtatataaggtaaggatagggaagccagaaaaaggatacgtggttttagttcatggacttggcgagcacataggaaggtacgagaaatttatacaagagcttgtcaagaacggtttctgcgttgtgggatttgactggccagggcatggaaagagtaaggggaagaggggacacacgagtgtagaagaggcaatgaaaattatagacgagataatctcagaaattggggagaaaccgttcctctttggacacagcttaggtggattgaccgtcattaggtacgccgaggagaggggagagaagataaagggagtagtagcctcatctccagctcttgcaaaaagcccaaggactcctgggtttatggttgccatagcgaaaatcttgggaaggattcttccgagcgtaagcttttcaaacggcatcgatccagaactgctctccaggaatccagagcgagtgaaaaggtacgtagaggatccacttgttcacgacagggtgtcagcgaagcttgggatgagcatattcaagaacatggaagaagctcacagaaaagccgagaagattaaagtgccaattctaatattggtcgggagcggagacgttataaccccacctgaaggtgccaagagattttacgagaggctgaaagttgaggacaaaaagctagtcgaattcccaggagcgtaccacgaaatattcgaggatccagagtttggaaaagaatttgaggaaacgataatcaagtggctagttgagcacgtcccttag

SEQ ID NO: 45360 - DNA, 1020 bp, Pyrococcus abyssi
atgccaagtttgatagttgtcggcggtcagtggggagatgaaggtaagggctcgataatagcataccttgcactccacgatgagcccgagataatagctaggggcggtgtcggaacgaacgctgggcacagcgtttttataaacgggaagaagtatgcagttagacagctccccactggttttatgcagaggaaggctaggcttctcgtcggggctggggttctcgttgatccagaggtgttcttccacgagcttgagcatttaaaggagtttaacgttaaggatagggtcggcatagattaccgctgtgcgataatcgaggaaaagcacaaggaacttgacaggacaaatggttaccttcacggaaagatagggacgacagggagtggttgcggcccagcaaacgccgacagggttatgaggaaggccaagcaggccaaggacattaaggagcttgagccctatctaacggacgttgcagcggagattaacgatgctctggatgaaggcgccttggttctcgtcgagggaacccagggattcgggcttagcctctactatggaacttatccctatgtaacttcgaaggacgttacagcgtcttccgttgcagcggacgttggtataggcccaactagagttgacgatgtaatagtagtgttcaagagctttcccaccagggtcggtgctggacccttcccaacagaaatgccgatggaggaggccgataggcttggcttagtggagtacggaacggtgactgggagaaggaggagagttggctggttcgacttcgagatggcgaggtacagtgcgagggtaaacggtgcaacgatgttggccataacgatgctcgataagtacgacaaggaggccttcggcgtcactgactacgacaagctacccaggaaggctaaggagtttatagaggaaatagaagagagagttggagttccggttggcctaataaagacggggccggagctggagcacataatagacctgagggagaacatctaa

SEQ ID NO: 45361 - DNA, 993 bp, Pyrococcus abyssi
atgagaatactgatggttggccactatccacctcacaggggtggcgtagcgaggcatcttaaagaggtagtcgagaggttgaggaggaggcacagcgttgacgtcctaacctatggaaccgtagccacggacgtttactccgttaaggttcccaacgtgtttgggcttagggggatttcattctcatttttggcgtcaaagaagatagtcgaacttcatgaggagaggaactacgatttgatacacgctcactacgtcggaacgacgagctttgctggggttctggctaagagaaaacttggaattcccttggttgtaactgcccacggtagcgatttggagttcatgtcgaagttgcctcttggtaggtacttcgtcaaggcctcgcttagggaggctgatgctgttactgcggtcagccatttcttagccaagagggcgatatcccttggagctaagagcgttgaagttatttcaaatggcgtttcaacttgtggagatagggttagcaagaagtacatagtcttcttggggaaggtaagcaagtacaagggcatcgatgaatttttggagctcgctagaaggtttcctgagctcgaattcttaatagcgggagagggaaacctacgagagttgccaagcaacgtcaagttcctgggctacgttaatccagatgatgttctttcccgtgcacttgccctagttctaccttctaagagggaaggctttggcatggtaatccttgaggcgaactccttctctgtcccagccttgggaaggaaagtcggtgggatacctgagttgattagggatggaaagaacgggttcttgtttgatagcattgatgaggctgaaaaattcttaagggtgcttttggacttgaaggtgaacgctaaggtgggggcgttggggaagagggttgcgagcttatactcctgggatgacgttgcaattaggtatgagaggctctataggagagttcttgagaggtga

SEQ ID NO: 45362 - DNA, 954 bp, Pyrococcus abyssi
gtgaaagttctggtgactggaggtgctggcttcataggttctcacttggtcgacaggttgatggaagatggatacgaggttagggttctcgatgaccttagtgctggtagccttgaaaatttgaatagatggcttgaaaacgaaaattttgaattcataaggggtgacatgagggactataagatagtgaaggaagcagttgatgacgtcgaggttgttttccacttagcagcgaaccctgaagttagaattagctctcaaagtccagagttgctttacgagacgaacgtcctaataacgtacaacctacttcaggccattagggagtcaaacgtgaagttcctcgtcttcacgagttcttccaccgtttacggagatgcgaatgttcttccaaccccagagagctatggtcctttggaacctataagcgtctatggtggagcaaaattggccgctgaagctttaataagtggttacgcccatatattcggtttcagggccctaatctttaggttagcaaatataattgggaaaagatcaaatcatggcgtaatctatgatttcataaacaagttaaagagaaatccaaatgagcttgaaatactcggggatgggaagcagaggaagagctatcttcacgttagcgataccataaacggtatccttcacatcttcgaatatttcaaaaggcagaacaaaatcttcgacgtctacaacttgggaaacgaggattggataactgtcaaggaaatagcggagatagtaagtgaggagatgggactttctccgaagttcaagtttactgggggagtcgatggtggaaggggctggaaaggtgatgtgaagttcatgcttcttagcatagagaaggccaagaaaactggatggaggccaaagatgaacagttacgaagctgttagaagaaccgtgagggagttgctgggggtgttgtga

SEQ ID NO: 45363 - DNA, 999 bp, Pyrococcus abyssi
atgaaagtcctaataatggctggaggttacgcaacgagactctggcccctaaccaaagataagccaaagcctctccttcccgttggaataaaaactatccttgactttataatggagaaagtcctcgagttaaacgtcgatgaagtatacatctcgacgaacaagttcttcgagcataagttcaaaccgtacgctgagaagtacggggtcgacttaattatagaggacacgtacagggaagaggagaagcttggaacaatcggggcaattaagaatgcgttggattccctaggattagacgactacttgataatagccggagataacatattctccctatcgcttagggacttcgtctccaaatttaccggtaaacctttaatagcagtttatgacgtcggtgaccttgagctcgctaagaggtatggagtcgtaatcctcgaaggtaatagggtggtaaagttcatagagaagccccaggagccaccttcaaccttaatcagcactggaatatacgccctaccaagggacgttatgggaatgatagatgagtacttgaaatacgggaacaaggacgccccaggatacttcattcaatggttgatagagagagggatcgaggtttacgcttacaaatttgatgacttctggtacgatatagggtcggctgacagctatttagaaagcttgaagatgctaatgaaggaaagctacattggtgatataaaggtcagcccatactcgaagataatcccacctgtagttattctcgatggaaccaggatagaaggcaggtcgatcataggaccctttgcttacatagggaggaactgtttaatagagaactccgacgtgagtgattcaataatctttgactccaccgtaataaggaactcaaccatctggaggtctataatcgacgagaaatgtgagataagaaatttagagctcaaaaagagcatcgtcggaggacatgcgaagatccagaggggagactaa

SEQ ID NO: 45364 - DNA, 6369 bp, Pyrococcus abyssi
atgccagttgaaaaagtgatgaaacgcgatggaaggatagtacccttcgatgagtcacgtataaggtgggctgtacaaagggcaatgtgggaagtaggagttagagacgagaggaagctggatgaggtagttaagaatattgtcaagaggattaatgaactttacgatggaaagattcctcacatagagaacatacaagatatagtcgagctcgaattgatgagagcaggcctattcgaggttgcaaaggcttacattctctacagaaagaagaaggctgaaataagggaggagaagaagaggatacttaacaagaaagagctagatgagatagataagaggttctcgataaacgctctcagggttttagcctctaggtacctaaagagggacgaaaacggaaacattattgagagccccagggagctcttcgagagagtctcgattctagcggtaatcccagatttactttacgatgagagggtattcgacaaggatggaaactacaagcaggatttaaagagggttgaatactacctggaaaactttgaaaagttcgacggaaagtattcaataggtaaatacaagctcaacaagtaccacttcgagaggatggtcaatctatacagggaactcgccgagaagggtaagatgaaggtttcgatagatgagttcctcagcatgcttgagaggggagagttcgacaagtacgagaaggaaattgaggaatatttcaagctaatgactaatcaagttttcatgcccaacactccagcgctcataaactcaggtagaccacttggaatgctctctgcttgcttcgttgttccgatagaagatgatatggagagcataatgaaagcggcacacgatgttgccatgatacagaagatgggcggtggatgtatagacggaaacgcaaagataatcttcgagaacgagggagaagagcacttaacaacaatggctgagatgtatgagaggtacagacacttaggcgaattttatgatgagaattacaacaggtggggtatagacgtttcaagcgttcctatatatgtgaaatcgttcgatccagagacgaggagagtcgtcaaggggagggtcagggcaatctggaagtatgaacttggagaggaaattcctaagtatgaaatcagaacccacaaaggaaccaaaatattaacatctccttggcatccgttcttcgttctgactcctgacttcgaagtaatagaaaagagagctgacgaactaaaggtaggagacattttgataggtggaatgcctgatggagaagatcatgaattaatattcgactactggcttgccggattcatagcagggaatggaaatctcgatgacagtgagagagagtataaagccagggaactcttagatgggatagaaaatggaattcctcccaaaatactgagaaaaggtaaaaatgcagttttatctttcataactggcttgtttgatgcagagggtcatgtaaacgataagtcaggtatcgagctcggaatggtgaacaaaaagctaatagaggctgttactcactacttgaactccctcggaataaaggcaagaatgagagagaagaggagaaaaaatggaattgactatataatgcatgtcgaagagtactcatcgcttctaaggttctatgagcttataggaaaacacctccagaataatgaaaagaaagaaaagcttgagattctcctgcacaaacacaatggaggggcatttgatctctcactaaacttcaacgccttcaaggagtgggcatccagatacggcgttgaatttaagactaacggtaaccagatcctcgccattatagggaatgaaaaggtatcccttggtcagtggcatgcgagagggcatgtctctaaggcagtccttgtgaagatgcttagaaagctctacgaggttacgaaaaacgatgaagtaaaagaaatgctccatctcattgaaagtcttgaagtcgttaaagagataacaataacgaatgaacccaagacgttctatgatctcacggtagataaatatcagaattatctagccggagagaacggaatgatcttcgtccacaatactggccttaatttctcaaaacttcgtccagaaggagacattgttggaacaactacgggggcagcctgttttactggggacacgaggatcctaacagaaaaaggtctaatcccaattgaggaaatagtacacgaaactgggaaaaaaccaaaggtagtgactcatgctggattaaaggatatcattgagacctatgataatggtgaaatggaagtattcagagttacaaccgaagatggttacgaactcaaggttactggtgaccataaattcctagtcttcgacgagaatggaaatccgacacttaagcctctcaaggaattaaaagttggagactatgtctacattctagcccctgagtggaagggtggagaatacgtagaattagatacaaatatagagctcaaaggaaagggatacaatgtcaacttaccaagcaaactcgatgagaagctcgcttatctcttaggaattatctatgccgatggccacattaggcattacttcgaaaatggaaagagaaagaattcaaaaatagagatatacctccaccaagatgaaaccgaaataaaagagaaggttaagagatacttcaaggagatttttggcattgaacctaaggagttcttaaaggaggagcagcataaggtgatccttgtaattccttcaacgaaaatagtgaagttcttagaaattaatgggctcctaaaggacaaatctgaaaatataagggtgccggaagctatattcagaagcaggccttcagtaattgctgcatttttagcaggattctttgacggggatggatcaatagaccaaaactataggatagccttcaaatccatttcaagggagttcataaaagaagctcagctcctattcctagcactaggcatagtaacaagtatacaggagtacaatccaccgaatccaaataacaaaactgtttacaccctgagagtccaaacaagggacatgaaaattaaagcatttaacgtcttaaaggaatcagttaaactttcaaagattatgaaagaagccatcagtaaacttgaagagaatggaaagaataagaagttctcgttcccatttaatgcaatttaccacataaaagatcccaagatcagagcaaagatacagagggactacaagattctctcttataactcaaaggtcactcacagggcatttataaacaacatactaaaattgaaggaggaattagggcttgacgatgaggaagttaagtactttgaaatgctatcaaagctctatccaactaagatcacaaagattgaacctctaggaaaagcccacgtctatgatcttcaagttgaagacgttcacctccttaccgggaacggaatttacacatccaatagtggtcccgtttcgttcatgcacctcatagatgccgttagtgacgtaataaagcaaggaggagtcagaagaggagcaaatatgggaattttagagatttggcatccagacattgagaagttcattcacgctaaagaaaagaacatagggacaaatgtcctctcgaacttcaacattagcgttggaatatgggaagacttctgggaggcgttaaaagaaggaaagaaatatccactaatcaacccaaggaccggagaagttgttaaggaaatcgatccaaagacactctttgaggagctagcctacatggcatgggccaaggccgatcctggagttatattctttgacataataaacaggaggaacgtcttgaaagaagcaaagggagggccaataagggctactaacccctgtgtcgtaggggaaacaagaattctaacacccgagggatacataaaggcggaagagttattcaaattagcaaaggaaaggggtaaaatggaagccatagcggtcgaaggtatagcagaggggggagaaccctacgcatattcccttgagattctcctaccaggagataagcaggttaaatacgaaaccgttcacggaaatgccgttgaagtcgcagacccagtttcagttccagcttacgtctggaaggtcgggatgaaggaagtagcccgcgtgagaacaaaggaaggctacgaaataacggcaacgctagatcacaaactaatgacgcccgaaggatggaaggagatcaaggatttaaagccaggtgacaagatactcttgcctagatttgaggttgaagaggacttcggaagcgaaagcattggagaggatttggcattcgttctcgggtggttcatcggagatggttatctcaatgtgaaagataaacgagcatggttctactttaacgcagaaaaagaagaagagattgcatggaaaataagggagatattagcgaaacgctttgaaatcaaggccgagcctcaccgctacggcaaccagattaagctcggtgtccgcggaaaggcttacgaatggcttgaaagcatcgtcaagacgaatgagaagcgcattcccgagattgtgtacagactgaagcccaacgagattgcctcgttcctacgtggtctctttagtgctgacggttacgtcgataatgacatggcaataaggcttacctcaaagagtagggagctccttagggaagttcaggacttacttctactatttggaatattgtcgaagatatatgagagaccatacaagagggaatttaagtacactactaaggatggagaggaaagaacgtatacaactgagggttattacgagctagttatagcaaactatagcaggaagatcttcgcggagaggattggtcttgaaggttacaagatggagaagcttagtctcgagaagatcaaggttgatgaacctattgttacagttgaaagcgttgaaatccttgggaagaaactcgtctatgactttacagttcctgagcatcacatgtacataagcaacggcttcatgagccataactgtggagaggagcccctctatgaatacgaatcctgtaaccttgcaagcataaatctagcaaagttcgtgaagtacgacgaaaacgggaagccatacttcgactgggacgagtacgcttacgttatccagaaggtcgcaaagtatctggacaattcgattgacgtgaacaagttcccgttacctgagatagactacaacacgaagctcaccaggaggataggcgttggaatgatgggcttagcggatgcgctctttaagcttggaataccctacaacagcgaggaaggcttcaagttcatgaggaaggttactgagtatctaaccttctacgcctacaagtactcgatagaggctgcaaagaagaggggaaccttcccactctacgaaaagactggatatccaaaaggagagctgccggtagagggattctatcacccggagatatggaacctgccatgggataaattggttgaggagataaagaagtatggagttaggaatgccatggtaacgacctgcccaccaacaggctctgtctcaatgattgcagacacgtcaagtggaattgaaccgatatttgcattggtttacaagaagagcgttaccgtcggagagttctactatgtagatccagtgtttgaggcagagcttaagaggagagggctctacagtgaggagttgcttaagaagataagcgacaactatggaagcgttcaagggctagaagagattccagaggatatgaggagggttttcgtgaccgctttagatattcactggctagaccacctgctagcacaggccaacattcagatgtggctcaccgattcagctagcaagacgataaacatgattaacgaggcgacggttgaagacgttaaggccgcttacctaatagcccacttcctgggctgtaagggagtaaccgtttacagggacggctcgctgagcgttcaggtttacagcgtcgaaggagaaaagaagaggagatacaagccgaagccgagtgaatacgcaaagaaagttctactggagatagtcgagaaggagccctggataaagaatttcataaacgtcgatgagatactaaacggaaaacgccaagagctcaacttctcattaaccggcctaaagcgtgagactcatgaggttaagaaggttgaagttaagcagcaaaacaataagattccggaggagaagataaaagagctcctgggagtggtttactgtccagtatgctatgagagggaggggaagctagtggaacttagaatggaaagcggttgtgcaacttgtccagtgtgcggatggagcaagtgcgtgatcagctga

SEQ ID NO: 45365 - DNA, 1113 bp, Pyrococcus abyssi
atgaactacgatgccctgataatcggaggtgggccagtaggaaattacctggcgagcttattggccgggaagatgagcgtagcggtagtcgagagaaagggggcatttggaggaaaggcctgtactggaataattggggcagagaactatgaaagtttaggattacccgataaagcgatattgaacgcattcaaaggagcttttttcatctcgaaaacgaaggtcttcgagatacataggcaagtcccccaagcttacctagtagatagaaaggtactcgagagggaacttgcaaagagggcaattaagagaggtgctgattactacttagcaacgaatttcgttggttttaaagatggaaaagcgatcttgcaacatcttgactctagatttgaaataaaagcgaaatattacgtaggggccgacggcgtcaacagcaaggtagctcaagaaataggagccaaaaccagaggggaagttttacggggctgggagcttgaagtcctagggaacttcaggagggagtgggttgaggtatgggtaaataaagacatcaatccagaattctttttctgggtggctccaataaacgaagaagaggccagaataggcacgttcggagatgtggaatcccttgcaaaattcctcaaggttaggaggataaacccatcgaacgttcttgagataaaatctggagccgtagtgcttggatggagaagtccttgggtcaaagataatgtcgccttagttggcgatgccgccctccacattaagccaactactgccggtggtatagtcttcggctcgtactgtgctagggccctcgccaaggcgatactcaatggtaacttggcagaatatgaaaagaattgctcctgggttaaagagcaagttaagtttgggctgagaatcaggaaggtcttcaagtcgttaactcaaaaggagattgaggaaatattcgaagttttaggctcggaagatgcaagaaaactaataatagagaaggccgactttgatgaccatgtaaaaacagcgaaggcccttttgaggaatccaaggttgcttgctagattgattaggatagccccgataatcttgagaacgctcctctga

SEQ ID NO: 45366 - DNA, 1290 bp, Pyrococcus abyssi
atgatagagcctcgtgatgaactcggaaccgcaacaactgactctgcccagaagatactccttctcggaagtggtgagctcgggaaggaaatagcgattgaagcccaaaggcttggcgtcgaggttatcgccgttgatcgctacgctaacgctccggcgatgcaggtagcccataggtcctacgttggtaacatgatggataaggatttcctttggagcgtcgtggagagggagaagccagatgccataattcctgagattgaggccataaacttggatgccctcttcgaattcgagaaggagggttactttgtagttcccaacgctagggcaacctggatcgctatgcatagggagaggcttagggaaactctagtcaaggaggctaaggttccaacatctcgctacatgtacgccacaacccttgacgagctttacgaggcctgcgagaagataggttatccgtgtcacaccaaggcaataatgagctcgtctggtaagggatcttatttcgttaaaggtccagaagatattccaaaggcctgggaggaggctaagactaaggctaggggaagtgctgagaagataatagtcgaggagcacatagacttcgacgttgagattacggagttagccgttaggcatttcgacgagaacggggagatagtgacaacgtttccaaagccagttgggcactatcaaatagatggtgactatcacgcgagctggcaacctgctgagataagcgaaaaggctgagagggaggtttacaggattgccaagaggataacggatgttctaggagggttagggcttttcggcgtcgagatgttcgttaagggagacaaggtttgggcgaacgaggtctctccaagacctcatgatacgggaatggtaaccctcgcatctcatcccccaggattctccgagtttggacttcacctcagggcagtccttggacttccaattcctggggagtgggttgatggttacagactattcccgatgctgattccagctgcgactcacgtgataaaggccaaggttaaaggatactccccgaggttcaggggattggctaaggctttgagcgttccgaatgcaactgttaggctatttggaaagcctgaagcttacgttggaaggaggcttggagtcgttttagcctgggacaaggacgttcaggaggctaagaagagggctgaaatggttgctcacatgatagagctaaggacgaggagtagtgactggcacgatcaaaattatgaaaagaggaaacaccttctctag

SEQ ID NO: 45367 - DNA, 1005 bp, Pyrococcus abyssi
atgctaacctatgcacaggccggggttgacgaggagaagactgcgagagccttaagggaaattatcagaactgcgagagaaactttcaagcttagaaaagggaaagtgggagaacctggagatataggacactatgcagccctcctagacttcggaaacttttacctcgcaatgaccaccgatggcgttggaaccaaagttctcgttgcagaggccgttggtaagtttgacaccattggaatagatatgatagccatgaacgtgaacgatttactctgcgtcggagctgagcccttagctctagtggattactttgcagtaaaagagccaaacgaagaggtattcaagcaggtagcaaagggactctataaaggtgctgaagaagctggagtagcgatagtcggaggggaaacggcagttatgcctgacctaataaatggctacgatttagctgggactgcaataggaatcgttgagaaaggtaaggttatcactggagagaggataaggcctggagattctgttataggaatttcaagctctgggattcactcgaacggcttaaccttggctaggaagctcctaattccaaagtacggtttggattacgaatacgagggaaggaaactgtgggagtggctcctagagccgacaaggatatatgttaggccaattctagagctaattaacagcgttgaggttcacggcttagcccatataaccgggggaggtttgctaaacctgaagaggctaacaaattacggctttgaacttgagatgcccccaatagagggcatatttaagcttattcacgagaacggagttcccctagatgagatgttcagggttttcaacatgggcgttggcttcatcgtggtagtcccccaggaggagaaggaagaggctttagaaatcttgagtaggcactataagagctacgaactcggaaatgtgacaagagaacttggaaaaataaaggtaaagaactacggaataacactctag

SEQ ID NO: 45368 - DNA, 723 bp, Pyrococcus abyssi
atggagctcaagggaaaagtagccctcataactggtgcatccagggggattgggagggccattgcaatcgagctcgccaagagaggagtaaacgttgttataaactacagaagcaatgaagaggaagcaaagaagacggaagagttgtgcaggcaatatggagttgaaactctacttgtgaaagcagatgtaagcaacagggaggaagttagagagatggtaaagaaggttatcgacaagttcggaagaatcgacatcctcataaataatgccgggatacttggaaaaactaaagatcccttggaagtaacggacgaagagtgggatagagtaatttcagttaacttaaaaggagctttcatagtgacccaggaagtcttgaggtacatgaagaaggggaaaatagtgaacatagcttctatagctggaaaggatggaggaaccgtgggacctcactatgcagcctctaaaggtggcttaatagctttgacattcaaccttgctaggcatctggcaccaaatatactcgtcaacgcagtagcacctgggccagttgacaccgacatgctatcatcggagatgaaggagatgttgaagaagctttcactcactggcgacattgcaaagccaagtgaagttgctcatgcggttatattcctgcttgaaaacgatcacataacaggggaagtcattgatgtgaatgggggaagattaatggattaa

SEQ ID NO: 45369 - DNA, 1857 bp, Pyrococcus abyssi
atggagaagctcaagagatttttgcccgaggatcaatacgagaagctcgctgcaataaacaatccatatctacatgagttcttggctgagtggattgagtggctaaagcctagcaaagttttcgtttgcacggattctcctgaagatgaagaatacgttaggtggaaggccctctattatggagaagaaaagatgctcgagatgccgaggcacaccgttcactacgacaattactacgatcaagccagggacaaagctaacacgaagcttctggttcccaagggagttacgttgcctttcctaaatacaatggatagggaagaggggcttaaagaaataagggaaatcatgaaggggataatgaaaggtaaagagctttttatatgcttctttgtcctaggcccaaggaattccatatttaccattccagcagttcagctcacagattcggcctacgttgcgcactctgaattcctgctttatagaaaagggtacgaggagttcaagaggttagggcctactaaaaacttcttgaagttcgtccactcggctggagagcttgatgagaggaagacaagcaagaacctcgataagagaaggatatacatagacttggtggatgaaacggtctactcagcgaacactcagtacggcgggaatacgattggtttgaagaagcttgcctttaggttgaccatacaaagggccgtaagggagggatggcttagcgagcacatgttcctcatgcgcgttaacggtccaaatggcaggaaaacgtactttactggggcctatccgagcatgtgcggtaaaacctccaccgcaatgataccctgggagaacatagttggggacgacctagttttcataaagaacgttgacgggacagcgagggcagtaaacgttgagattggggtctttggaattatagaggggataaatgagaaggacgatcctataatctggcaggttcttcactcgcctgtggagataatattctcaaacgtcctcgttaaggatgggaagccctactggaatggaatgggaatagagattccagacgaaggagagaaccacagtggaaagtggtggagggggaagagggacaaagaagggaacgaaataccgccgagccacaagaatgctcgctttaccgttagactcgaggcatttccgaacttagataaagaagcccttgagaatccatgtggagttgaagtcggtgggatgatcttcggtggcagggatccggatacgtggccacccgttagggaagcttttgactgggagcatggagtaataaccatgggagcttctctagagagcgaaacaactgccgcaaccctaggtaaggaaggagttagagcattcaatcccatgtcaatcctagacttcctgagtgtccaccttggagactacataaggaactaccttgagttcggaaggaaactgaagaaaaagccaaagatattcgccgtgaattacttcctgagagagaatggtaagtggctcaatgagaagctcgacaaagctgtttggcttaagtggatggaactcagggttcacggagatgttgaagcaatagaaacgccgatagggtacattcctaagtacgaggacttaagggagctattcaaacaagttttaaacaaggagtacaagaaggaagactacgaaaagcagttcaagataagggttccagagttgttggcgaagatagacaggatatggaatatctatgagcctatcggtaacattccagaggagctcttcaaacagctcgaagaggaaagggaaagattgctaaaagctagagagaaatatggagattatataagtcctttctctcttctttaa

SEQ ID NO: 45370 - DNA, 1458 bp, Pyrococcus abyssi
atggggaagtttgcgaagaaacttgaaagggccattaggggatacacttttgatgacgtcctcttgatccctcaagcaacagaggttgaaccaaaggatgtcgatgtttctacccagataacccccaacgttaaactgaacattccaattctaagtgcagccatggatacagttactgaatgggagatggccgtagcaatggcaagggagggaggtttgggagttatacacaggaatatgagcatagaagagcaagtggagcaagtaaagagggttaaaaaagcggagaggttcatagttgaggatgtaataacgataagtccggaggagaccgttgattttgccctcttcttaatggagaagcacgacatagatggccttccggttgtggagaacgagaaggtagtcgggataataagcaagaaggatatagcggccagggaaggcaagctagttaaggagctaatgaccaaagatgtaattacggttcctgagaacattgaggtagaggaagccctcaagataatgatagaaaacaggatcgacaggcttccagtggttgacaaggagggaaggttgattggattgataaccatgagcgacctagtggctagaaagaagtacaagaacgctgttagggatgagaacggcgaattattggtggctgcagctgtaagtccattcgacatcaggagggctatagagttagacagagcgggggctgatgttatagttgtcgacactgcacatgcccacaatctaaaggccataaaggccatgaaagagatgaggcagaaggttgatgctgactttatagttggaaacatagctaatccaaaggctgtagatgatttaacgtttgcagatgcagtaaaggttggaataggcccagggagtatatgcacaacgagaatagtggcaggagttggagttccccagataaccgcaatagcaatggttgccgatagggctcaagaatatgggctttacgttatagctgacggtggcataaagtactctggtgacatagttaaggcaatagctgctggggcagacgctgtaatgcttggtaatttgttggctggaaccaaggaggctccaggtaaagaggtgataataaacggaaggaagtacaagcagtaccgtggcatgggttctcttggagccatgatgaagggtggggccgagaggtactaccagggaggctacatgaagacgaggaagtttgttccggaaggcgttgagggggtagttccctaccggggaaccgttagtgaggttctctaccagctagtcggcggtttaaaggctggaatggggtacgttggagctaggaacattaaggagctcaaggaaaaaggggaattcgtaataataacatctgctggcttaagggagagccatccccacgatataataatcacgaatgaggctcctaactatccacttgaaaagtga

SEQ ID NO: 45371 - DNA, 1197 bp, Pyrococcus abyssi
gtggttcttatggggaagcttgactggattaaggaagagctcgaagaacttaagaaaaaaggtctttacgtgactataagggttcttcagagtgcccagggaccatgggttgttgttaatggaaaaagagttctaaacatgtgttcaaacaactatctaggcttagcggctcatccgaagattaaagaagctgcaattagagctattctggactatggtgttggagctggagcggttagaaccatagctggaactatggaacttcatgttgagcttgaggaaaagttggcaaagttcaagaagagagaggctgcaattctcttccagagtggttacaacgcaaatcttggagcaataagcgctctcctaagaaagggagaagatggtatattcctaagcgaagaactaaaccacgcgagcataatagacggaatgaggcttagcggtgcgcccaaggttatatacaagcacctcgatatggatgacctaaagaagaagctcgaggagaacaaggataagaagaagaaaataatcgtcacggatggagtattctctatggatggtgacttggctccactaccggagatagttgaactggctgagcaatatgatgcgatagtttacgttgacgatgcacacggagaaggagtgcttggaagccatggaaggggaatagttgaccacttcaacttgcatgacaaagttgactttgaaatgggaaccctcagcaaagccttcggtgtaattggtggatacgtcgctggacctgaggaagccatagagtacctcaagcagagggcgaggccattcctattctcgagtgcaatgaatccaccagacgttgccgcagctatagctgccgttgaaatacttcagaagagcgacgatttggtgaagaagctttgggataacactcacttcctccagaagggactaagggacttgggttatgatttgggcaacaccaagcatccaattacaccagtaatgctatacgatgagaagcttgcccaggagttctcgagaaggctttacgaggaatacaacatatttgcccaggcaatagtttatccaaccgttccgctcggaactgcgaggataaggcttgagccttcagcggctcacactaaggaagacctaaagcttgtaattgatgcatttgaggacttaggaaagaaaactggcttcttgaagtga

SEQ ID NO: 45372 - DNA, 849 bp, Pyrococcus abyssi
ttgttcgttatcggaagtggagcaaaacatctggaagaagaaatttctagacatggcaatttgataaacgttgagataaagaagttcccagatggagaaaaatacgtcagagttttggaaagagggaaagaagcaattgtaatccaatcaacgtaccatccccaggatgagaatttaattgaggccctcctcttgggggatgcccttagcgaggctggattcaaaaaattaaagatcgttatcccataccttgcctattccaggcaggacagggtaaccaaagagggagaaccaatcagtgtaagggcaataatgaagatgctcgggctctattacgatgagctctacgtatttgacattcacaatcccaaaaccctagaacacttcccaggaattgcaaaaaacatataccccgcggaagcgatagcgaactacttcaaggataagcttggcgaaggtctcattttagctcccgacaaaggagcccttgagagagcgaaaagagttgctgaagttttaggcttagagtacagccacttcgagaaggagagaatatctccaactgaagttagaatgaagcccgtagatgttgatgtaaatggaaaaaacgtcctaatagtggatgacataataagcacgggcgggacaatgataaaagccgccaatatactcagagaactcggagcgaaagaaatattcgttgtggcaacccacggggtctttgctgagggggcaattgagagagttagcaaagctgtgaatgagctcgcggtaaccaatacaatcccaaccgaagtttcaaagataagcatcgttgattacatagtcaagctgggtgagaaagaatga

SEQ ID NO: 45373 - DNA, 1260 bp, Pyrococcus abyssi
atgaaagcagttgttcttgcggctgggaaaggagagagattaaggccactaaccgatgataggccaaaaccgatcttgaaagtcgccaataaacccataattgagtacatacttgagaacctagacccattcgttgatgagttcattataatcgtgaaatacatgaaggagaagataattgaaactcttggtgatgaattccacggaaaacccataacgtacgtttcccaagttgaggaagagggaacggcaaaggccatttattctgcaaaagattacattgaagaggaggagttcttcgcgataaatggagatatatacttcgaacaggaagcaataaggggattgctccacgtttataagaaaacaaaagctaatgcagcactcgttgtcaagaagtttgatgatctatctcagctcgggatggtaaaaaccgaaggaggttatgtaagggaaatagttgagaaacctgggaacgttggtgggttggcgaacttgggaatttacatattcaatccagacgttttcgagtttatcgaacgaacccaggaaagcgagaggggagaatatgaaataacagataccataaacctaatgattagtgatggaaggaaagttgcgtactttgaatactccggcttctggagtgacattggaagaccttgggatcttttggaggtcaatgagtacatactcaagaccaaacttaagcatgacatcagggggactgttgaggaaggggctactataatcccaccggtggagatcggagagggaactgtggtaaggtcaggaagttacataattgggccggttaagattggaaagaactgtagaattgggcccaactgcttcataagaccctacacgagcataggggacaactgccacattggtaatgccgttgagattaagaactcgataatcatggataattcaaatgctccccatcttaactatgttggcgattcaatcgtgggggagaacacaaacctaggggctggaaccataacggcaaaccttagacacgacaacagaacgataaaggttgaaataaaaggtaaactcgaagattcgggaagaaggaagctaggagccataataggccacaacgttaagactggtataaacgttaccatatacccaggaaggaaaataggaagcggagccttagtcgggccgggagtgatagtggacaagaacattccacctaacgtcttggtcgttgcaaagcaagaaaagatagtgaaggagatatga

SEQ ID NO: 45374 - DNA, 1293 bp, Pyrococcus abyssi
ttgaccatggagaacccctatgaaattgtggccgttattgcaagggagattctcgacagtaggggcaacccaacggttgaagttgacgtccacacgccaatttccatgggaagggccgcggttccaagcggtgcctcaaccggaactcacgaggccgttgaactgagggatggcggaaagaggtaccatggaaaaggtgttaggagagcagttgagaacgtgaacaagataatagccccagaattagttggaatggatgttagatggcagagggagatagatagacttctaatagaacttgatggaaccgagaacaagagcaaccttggagcaaacgcaattctagcagtttcattagcagttgcaaaagcagcggccaatgcgctcgagttacccttataccagtatcttggtggcgtaaatgcatacgtccttcccgttccactaagcaacgtcatcaacggtggtgttcatgctggcaatgaccttgactttcaagagttcatgataatgccaataggagcaaactcgttcagggaagcgataagatgggtcagcgaaacgtaccacgtgttgaagaaggtaatagcagaaaagtacggaaagaatgcagtgaacgttggagatgagggtggatttgctcctccgatgaaggaggtaaccgaaccattagacgttcttataaaggcaatagaggaggcaggttataaacctggtgaggaaatagcgctcgcgttagatgcagcttccagcgaattctataaggatgggaagtatatagttagcggaaaagagtacacgagggaagagctgctagagctgtacaaggagctaacatcgacatatcccatagtttccatagaagatccattccacgaggaggactgggaaggattcgtgatgataactagggaactagggaagaaggttcagatagttggagacgacctcttcgtgacgaatccgaagagactaaagaagggaatagagatgggagcggcaaatgccctgctcttaaaggtcaaccagataggaacgttaaccgaggcaatggacgcagcatacatggcatttagggctggatatggagttgtagtttcccatagaagtggagagacagaagatgcaacgatagcagatttggcagttgcactaaatgcgggccagataaagactggagcacctgctaggagcgatagaaatgctaagtacaaccagcttataaggatagaggaagagcttgaaggggttgcagtttacgcgggcaagaacttcaggaaggtattcttctga

SEQ ID NO: 45375 - DNA, 2316 bp, Pyrococcus abyssi
atgataatcgatgctgattacataacggaagatggcaagccgataataaggatattcaaaaaggaaaagggagagtttaaggtagaatacgataggacgtttagaccctacatttatgctcttttaaaggatgattcggccatagatgaggttaagaagataaccgccgagaggcacggaaagatagtcaggataaccgaggttgagaaagtccagaagaaattcctaggaaggccaatagaagtctggaagctctatcttgagcatccccaggatgttccagccataagagagaagataagggaacatccagctgtagttgatatatttgaatacgacataccctttgcgaagcgctacctcatagacaagggattgactccaatggaggggaacgaggagctaacgtttctagccgttgatatagaaacattgtaccatgaaggagaggagttcgggaaagggccaataataatgatcagctacgccgacgaggaaggggccaaggtgataacttggaagagcatagacttaccttacgttgaagtggtttcgagcgagagggagatgataaagaggctcgtgaaggtaattagagagaaagatcccgacgtgataataacgtacaatggtgataatttcgactttccgtacctcttaaagagggctgaaaagctcggaataaagctcccccttggaagggacaatagcgagccgaaaatgcagaggatgggggattcattagccgtagagataaagggcagaatacacttcgatttattccccgtcataagaagaacgatcaaccttccaacatacaccctcgaagcggtttatgaggctatatttggaaagtctaaggagaaagtctatgcccatgagatagctgaggcctgggaaaccgggaaagggctagagagggtagctaagtattcaatggaagatgcgaaggtaacctttgagctcggaaaggagttcttcccgatggaagcccagctagctaggctcgttggccagccagtttgggacgtttcaaggtcgagcaccggaaacctcgttgagtggtttctccttaggaaggcctacgagagaaatgagctcgcgcccaataaaccggacgagagggaatacgagagaaggctaagagagagctatgaagggggttacgttaaggagccagagaagggattgtgggaagggatagtcagcttagactttaggtccctatatccctctataattataactcacaacgtctcaccagacactttgaatagagaaaattgcaaggaatatgacgttgccccccaagtggggcacagattctgcaaggatttcccaggattcataccaagcttactgggtaacctactggaggagagacaaaagataaaaaagagaatgaaagaaagtaaagatcccgtcgagaagaaactccttgattacagacagagagctataaaaatacttgcaaacagctattatggctattatggatatgcaaaggccagatggtactgtaaagagtgtgcagagagcgtaaccgcatggggaaggcagtacatagacctggttaggagggaacttgagagcagaggatttaaagttctctacatagacacagatggcctctacgcaacgattcctggagccaagcatgaggaaataaaagagaaggcattgaagttcgtcgagtacataaactccaagttacctgggcttcttgaattggaatacgaaggtttctacgcgagagggttcttcgtgacgaagaaaaagtacgcactaatcgacgaggaaggaaagatagttacgagggggctcgaaatagtaaggagagattggagtgaaatagcaaaggagacccaggccaaggttctcgaggcaatactcaagcacggtaacgttgatgaggccgtaaaaatagtaaaggaggttacagaaaaactcagtaaatatgaaataccacccgaaaagcttgtaatttatgagcagataacgaggcctctgagcgagtataaagcgataggccctcacgttgcagtagctaaaaggctcgcagcgaagggagtaaaagttaagccagggatggttatcggttacatagttttgaggggagacgggccaataagcaagagggccatagctatagaggagttcgatcccaaaaagcataagtacgatgccgaatactacatagagaaccaagttctgccagcggtggagaggatattgagagcatttggttatcgcaaggaggatttgaagtatcaaaaaactaaacaagtgggccttggagcatggcttaagttctag

SEQ ID NO: 45376 - DNA, 660 bp, Pyrococcus abyssi
gtggtgagtatggatctttatgagaggtggaagagaactgtagagatgctggagagagaaggtataataaggagtcttgaagttaaggaggcctttcttaagtatcctaggtacatgttcgttgaagataggtacaaaagctacgcccatatagatgagcccctcccaatccccgctggtcaaaccgttagcgctcctcacatggttgcaataatgttggagatagcaaagctcaaggagggcatgaacgttctggaggttggaacagggagtgggtggaatgctgccctcataagttacatagttaaaaccgacgtttactcgatcgaacgaatacccgagctagttgagtttgcaaagaggaaccttgaaagggctggcgttaagaatgttcacgttatcttgggggatggaagcaagggatttccgccgaaggctccatatgacgttataatagttactgcaggtgctcctaaagttcccgagcccttggtagagcagttaaagcctggaggtaggcttataattcccgtaggcagttatcacctttggcaggagttgctcgaagtcgtgaaaaagaagagtggggagataaaagttaggaaccacggtggcgttgcattcgttcccctcataggcgagtacgggtggagggaatga

SEQ ID NO: 45377 - DNA, 645 bp, Pyrococcus abyssi
atgccagagatacttaagataaagccaacaaggatggaactactgaagctgaagaggagggtcaagttagctgagagaggtcataagttgctcaaggaaaagcaagacgctctgataatggagttcttcacgatatatgatgaggccttgtcccttaggagagagctaattaagaagatggaagaagcttttgaagccctaagaagggctcaagttgacgtcggaagtttgaggcttaaggagatttccataggtgttaagcccaatgaggaaattgagataaggacgagaaatatcatgggagttagggttccactaatagaagttccagaacttaagagaaaggcaagcgataggggatatgcgttcatctccacaacatcaacagtagatgttgccgctgaaaagttcgaagaagttctagaactcgccataaggctggctgaagttgaggagtctctaaagagacttggtaaggagatagagaaaaccaagaggagggtaaacgccttagaatacataatcattccgaggatgaagaacacgattaagttcatcgagcaacacctggacgaaatggaaagggaaaacttcttcaggcttaagagggttaaggcaattcttgaggctcgccaatctatgtag

SEQ ID NO: 45378 - DNA, 1398 bp, Pyrococcus abyssi
gtgatggaaatgagcaaggagtactcaacgattagcaagatttacggtcctctaatgattgttgagggagttaagggagtcgcctacggtgaggtcgtggagatagagactgaaagcggtgaaaagaggaagggtcaagttctagacgctagagagaacttagctatagtccaggtattcgaaggtacaagagacctagacgtaaagacgaccagcgttcgctttaccggtgaaaccctgaaggttccagtaagcatggacatgctcggtaggatattcaacggcataggtaagcccatagacggtgggcccgagataatcccagaggataggagagacgttcatggggctcccctcaacccagttgctagggcttaccccagggatttcatccagacgggtatttcagccatagacggtatgaacacccttgttaggggtcagaagttgccaatattcagcggttcaggtttaccacacaaccaactcgcagcccaaatagctaggcaagctaaagttttaggggaagaggagagctttgcggttgtattcgcggccatgggtataacctacgaggaagctaacttcttcaagaagagctttgaagaaactggagcaatagaaagggcagtcctattcctaaacttagccgatgacccagctattgagagaataatcaccccaagaatggccctcacggttgccgagtatttagcctttgattacgacatgcaagtcctcgtaatactaacggacatgacaaactactgtgaagcccttagagagatctcagccgccagagaagaagttcctgggaggagaggttatccaggttacatgtacactgacttagcgacgatttacgaaagggcaggaaggataagggggaagaagggttcgataactcagatgccaatcttaaccatgccagacgatgatataactcacccgattccagacctaacgggttacattaccgagggtcaaatagttctgagcagagaactccacagaaagggaatttatccaccaatagacgttcttccaagtcttagtagattaatgaaggacggaataggaaagggaaggacaagagaagatcacccacagttggcacagcagctttacgcagcgtacgctgaaggtagatcgcttagagacttggttgcagttgttggtgaggaagcgttaagtgaaactgacaagaagtaccttgagttcgccgacagattcgagagggagttcgttgctcaaggctactatgaagataggagcatagaggaaacccttgacctcggatgggaactactctcaatactacccgagagcgagcttaagagggtaaagaaggagatgatcatgaagtaccatccgaagtacaggaagcgctcctcttaa

SEQ ID NO: 45379 - DNA, 3054 bp, Pyrococcus abyssi
atggtagctaagggtaggataattagggttaccgggcctctggttgttgctgatggaatgaaaggcgctaagatgtacgaggtcgttagggttggtgaacttggactgataggagaaataattaggcttgagggtgacaaggcggtaattcaggtttatgaagagacggctggagttaggcctggagagcctgtaattggaacaggttcatccctgagcgttgaactaggtcctgggcttttaacgtcaatatacgatggaattcagagacctcttgaggtcattagggaaaagaccggagacttcattgctagaggtgttaccgctccggctttacccagggacaagaagtggcatttcattccaaaggttaaagttggggataaggtcgttggtggagatataataggtgaggttccagagaccagcataatcacccataagataatggtgcccccaggaatagagggtgagatagtagagatagccgaggaaggcgagtacacgatagaggaagtaatagcgaaggtaaaaactccaagtggggagataaaggagctcaagatgtaccagaggtggcccgttagagtgaagaggccctacaaggagaaactacctccagaagttccgctgataactgggcagagggttatagacaccttcttcccacaggctaagggcggtaccgcggcaattcctgggccctttgggtcagggaagtgtgttgatggggatacactagttcttacgaaggaatttggcctgataaagataaaggacctctataagatactcgacggaaaggggaagaagaccgttaatggaaacgaggagtggactgagttagagaggccaataacgctctatggttacaaagatggaaaaatcgttgagataaaggcaactcacgtatataagggcttctctgctggaatgatagagataaggacaagaacggggagaaaaataaaggtaactccaatacacaagctctttacaggaagggtaaccaagaacgggctcgagataagggaagttatggcgaaggatctcaagaagggagacaggataatagttgccaagaaaatagatggtggcgagagggttaagctgaacataagagttgagcagaagagaggaaagaagattagaattcctgatgtccttgatgagaagcttgcagaattcctggggtacctaattgcggatggcacgttgaagccaagaacggttgctatatataacaatgatgagtctttactcaggagggccaatgaattagctaatgaattgttcaatatcgaaggaaagattgtaaaaggtagaacggtgaaagccctactaattcacagcaaggctttagttgagtttttcagcaaattgggagttccaaggaataagaaagcaaggacatggaaggttccgaaggaacttctcattagcgagccagaagtcgttaaagccttcataaaggcctacataatgtgtgacggatactatgatgagaataagggagagattgaaatagttacagcctcagaggaagcagcatatggattctcttacctcttggccaagctcggaatctacgcaataataagggagaagatcattggggataaagtgtactatagggttgttataagtggtgaatcaaacctagagaagcttggaatagaaagggttggaaggggatacacgagctatgacatcgttccagtggaggttgaggagctatataatgctcttggaaggccatatgctgagcttaagagagccggaatagagatacacaattacctatctggagaaaacatgagttatgagatgttcaggaagtttgcaaagttcgtaggaatggaggaaatagctgagaaccacttaactcacgtactcttcgatgagatagttgagataaggtacataagtgagggtcaagaagtctacgatgtaacgacggagactcacaacttcattggaggcaacatgccaacgctccttcacaacacggttacccagcaccagttagctaagtggagtgacgctcaggtcgttatctacatcggttgcggagagagaggaaacgagatgaccgacgttctcgaggagttccccaagctcaaggatcctaagacaggtaaaccgctcatggagagaacagttctcatagcaaacacatctaacatgcccgtggcagctagagaagcatcgatttacactggaatcacgatagccgagtacttcagggacatgggttacgatgtagctttaatggccgactcaacgtctagatgggctgaagcattaagagaaatttctggaagactagaggagatgcctggtgaagagggttatccagcttatctggcttctaagcttgcagagttctacgagagggcaggacgtgtcgtcacacttggaagcgattacagggttggtagcgtttcggtcataggagccgtctcgcccccaggaggtgacttcagcgagccagtagttcagaatacgcttagagtcgtcaaggtgttctgggccttggatgctgatctggcaagaagaaggcacttccctgctattaactggttaacgagttactccctctacgttgacgcggtaaaggactggtggcacaagaacgtcgacccagagtggaaggccatgagggacaaggcgatggagttgctccagaaagagtccgagctgcaggagatagttaggatagtaggtccggacgccctgccggagagggagagagctatacttctagtagccaggatgctcagggaggattacctacagcaggatgcctttgatgaggtagatacctactgcccaccggagaagcaggttacgatgatgagggttctccttaacttctatgataagaccatggaggcaataagcaggggagttccactggaagagatagccaagttgcccgttagggaggagataggtaggatgaagtttgagcccgacgttgggaagattaaggccttaatcgataagaccaacgagcagtttgaagagctgttcaagaagtatggggcgtga

SEQ ID NO: 45380 - DNA, 312 bp, Pyrococcus abyssi
atgaaggtcgttgttatgggggattcagacactgtaactgggtttaggctggctggagttcacgaggcttatgagttcgatttctctgaactctccatagagagggctaggaacaagttaaaggagttagttgagagggatgatgttggaataattctgatcacggagagattagctcaaagaattggagatcttccccaggttaaccttccgataatccttcagattcctgataaatttggttccatatatggtgaagagctgttaagggagatagttaggaaggccgttggtattgagatcaagaggtga

SEQ ID NO: 45381 - DNA, 900 bp, Rhodobacter capsulatus
atggccgacagacgcgatcaccggatcatcgacggcaaggcggtgcagcagcgccttttggccgggatccgcgccgagctggaggcggcggcagagacccatccggtcgggcggctggtgtcgatctcgatcggcccctcgcccgagatcgaggtctatgtccgcaatcaggcccgcgccgccgcgaccgccggtctgcccttcgaacaggtggtctgggaggcctcggcgacgcaggaggcctgcaagcgcaagatcgcggcgctgaacgatgacccctcggtgctggggatcatcctgcaacgcccggtgcccgcgcatatccatgtccgctcgctgcaatcggcgatccatccgctgaaggatgtcgaggggatgaaccccgcttcgataggcaatatcgtttacaatgacatcgcgctcgcgccctgcaccgcggcggcggcggtggagatggtgcgcgcgaccgggctgcccttgccggggcttgaagtggtgatgatcgggcattcggaaatcgtcggcaagcccgtcgccttcctgctgatggccgagggggcgacggtgacggtgtgccaccacatgacgcgctcggtcgcgatgcattcgcggcgtgccgatgtggtgatcgtggccgtcggcaaggcgcatctgatcgggccggagatgatcaagcccggcgcggcggtgatcgacatcgggatcaatcaggtcaccgatgcggcgggcaaggtgcggattctgggcgatgtggacaccgaggccgtgcgcgaggtggcgggctggatcaccccggttccgggcggcgtcgggccggtgacggtggcgatgctgatgcgcaacgcgctgaccgcgcatcgccgtcaggtggcggcgggctggctggaagccgccaaggcc

SEQ ID NO: 45382 - DNA, 1968 bp, Rhodobacter capsulatus
atgggagttcaaggacaaccctcggtcgcaccggcgcttcgggaggttccggcggggtttgagactgcgcatgcgaatggcgcgaaatatctcgagatgtatcgggaatcgctcgagaatccggatgcgttctgggggcgcgagggcaagcggctcgactggatcacgccctataccaaggtgaagaataccgatttcaccttcggcaaggtctcgatcaaatggttcgaggatggggtgctgaacgcgtccgtgaactgcatcgaccggcatctgcgcgaccgcgcgctgcaaaccgcgatcatcttcgagcccgatgacccgaaggaaccggcccgccacatcacctacaaggagctctccgaaaaggtgaaccggatggcgaatgtgctgctgtcccagggcatcatgcgcggcgaccgggtggtgatctatctgccgatgatcccggaggcggcctatgcgatgctggcctgcgcccggatcggcgcgatccattccattgttttcgcgggcttttcgcccgatgcgctggcgaaccggatcaatgattgcggcgccaaactggtgatcaccgccgacaccgcgccgcgcggcgggcggcgcacgccgctgaaagcgaacaccgatgcggcgctcttgcactgctcggacaaggtgcgctgcctggtggtcaagcacaccggcgatcagatcagctgggtgcatggccgcgatgtcgaccttttgtacctgatggagcacgtcagcccggaatgcccgccccgcccgatgaatgcggaagatccgctcttcatcctctacacctcgggctcgaccggcaaacccaaaggcgtcgtgcatacgaccggcggctacctcgtctatgccgcgatgacgcaccaatacacgtttgattacaaggacggcgacgtgttctggtgcaccgccgatgtgggctgggtgacggggcacagctacatcatctacgggcccttggcgaatggcgcgacgaccttgatgttcgagggcgtgccgaccttccccgatgcggggcggttctgggcggtgtgcgaaaagcacaaggtcaatcagttctacaccgcgccgacggcgatccgcgcgctgatgggtcagggcccggaatgggttgagaaatatgacctttcctcgcttcgggtgctggggtctgtgggcgagccgatcaaccccgaggcctgggtctggtacgacaaatatgtcggaaaagggaaatgtccgatcgtcgacaccttctggcagaccgagaccggcgggcacatgatcacgcccttgcccggcgcgacaccgacgaaaccgggctcggcgacgaacccgttctttggcgtcaagccggtggtgctggacccgcagaccgcggtgcggatcggcgaggtcgaatgcgagggggtgctctgcatttccgacagctggcccgggcagatgcggacggtctggggcgatcacgaccgcttccaggagacctatttcggccagtatcgcggctattacttcaccggcgacggctgtcggcgcgacaaggacggctattactggatcaccggccgggtcgatgacgtgatcaacgtctcggggcaccggatgggcacggccgaggtggaatcggcgctcgtcgcgcatccgcaggtggccgaggcggcggtggtgggctatccgcatgacatcaagggccagggcatctacgcctatgtgaccctgatgaacgggatcgagcccagcgaggatctgcgcaaggatctggtcaagtgggtgcgcaccgagatcggtccgatcgcctcgcccgatctgatccaatgggcgccgggcctgccgaagacgcgctcgggcaagatcatgcgccggatcctgcgcaagatcgccgagaacgactatggcgcgcttggcgacatctcgacgctggccgatccgggcgtggtgcaggagctgatcgacaaccggatgaaccgggcc

SEQ ID NO: 45383 - DNA, 924 bp, Rhodobacter capsulatus
atgacgcgaagcagtatcattctcggggcgccgatccagagcggcacccaccagccgggttgcgtgatgggaccggccagcctgcgcacggcggggttgatcgccagcctgacggcgctgggatggcggatcgaggatcagggcgatctgtcgatcggtccgcaggcggcggtggcccatgccaatcccgcggtgcatcatctggccgagacccgcgcctggatcgcgcttctggccgcgcgcgccgaggcggccgcggcgcaaagcgatctgccggtgtttctgggcggcgatcattccatgtcggcgggcacgatggcgggggttgccgcccatgccgcgcggctgggccgtccgctcttcgtgctctggcttgacgcgcatcccgatctgcattcgcttgataccaccgaaagcggcaatctgcatggcacgcccgtcgcctatgcctgcggccttggcgatttcgccgcctatccgccgctggcccatgcgatcgacccgtcgcggctgtgcatgatgggcattcgttcggtcgatccggccgagcatcgccgcattctcgagcacgggatcgaggtgcatgacatgcgcgccatcgacgagaccggcgtcgtcgcgccgctgcgggccttcatcgaccgggtcaaggcggcgaacgggctgctgcatgtcagcttcgatgtcgatttccttgacccgggcatcgcccccgcggtgggcaccaccgtgccgggcggcgccaccttccgcgaggcgcatctgatcatggaatatctgtgcgatgccggggttgtcacctcgctcgatctggtcgagctgaacccgtttctggacgagcgcggccgcaccgcttcgctgatctgcgacctggccgccagcctgttcggccgccgcgtgctggaccgtcagacccggagcttc

SEQ ID NO: 45384 - DNA, 1002 bp, Rhodobacter capsulatus
atggcgagacttgcgatcaacggcttgggccggatgggaaaactgctcttgcggcggctcatcgatctggggcgcgggcccgagatcgtgcttttgaacgacgccatgggcgacgccgaaacccatgcgctgctgctcgagttcgacacggtgcatggccgctggccgaccccggttgccgccaccgaaaccgggcttcagatcgcggggcagcgcatccggctgacgcgggaaaagacccttgaagccctgcccctggccgagatcggggtcgatctggtgctcgattgcaccgggcagttcaagaccgcggccaaggtccagccctatttcgatgcaggcgtgcgcaaggtcgtcgtttcggccccggtcaaggatacgggcgcgctgaacctcgtctatggcgtgaaccacgtgctttacgatggcagccagcggctgatcacggcggcgtcctgcaccaccaactgcctggcccccatcgtgaaggtgatccacgaagcgcttgggatcaaacacggatccatcaccacactgcatgacgtgacgaacacgcaaacgatcgtcgaccgccccgcgaaagacctgcgccgggcgcggtcggcgctgatgaacctcattcccaccaccaccggctcggccacggcgatcacgctgatctatcccgagctgaaagggcggctcaatggccatgccgtccgggtgccgcttttgaatgcctcgctgaccgattgcgtcttcgaacttgaccgcccgaccacggtcgcagaggtgaacagccttctgcagaccgccgccgagggagggctgaacggcatcctcggtttcgagacgcggccgctggtgtcgtcggatttcaccaacgacccgcgctcggcggtgatcgacggcccctcgacgatggtggtcaatggcacgcagctcaagctttacgcctggtatgacaacgaatggggctatgtctgccggatggccgatatcgcccgaatggtggcggggtcg

SEQ ID NO: 45385 - DNA, 2172 bp, Rhodobacter capsulatus
atgacacatgcgctttcgccccgccaacaggaagacatcgccctcggctcgccgcagatgacggcgctgcggggcctgttcctgatctgcctgcaccacggcgtcaccctgccggtcaccgaaatccccgcgctggaagagggctccatcgccccccggcttgaagcgacctttcagcgcgcgggctttcgcagccgccagatcagcggcggcacttggcgcacggcgaaggggctcggctcggcctatccggcgctgtgcgagggcaaggacggccgctggttcatccttgcccataccgtcgatctgcccgccgggccgcatgccgccatccttgaccccgcgcgcgaaggcgagggcatcctgttcctgccgcaagcggagttcgaggcgcgctggtcggggcggctgatcctggcgcggctgcgcaagaccgaactttcggcacggcgtccctttggtctgggctggttcatgccggcgctgctggagcaacgcgcgctgtttggcggcgtggcggtggcggtggtggcgggcaacctcattgcctttgccctgcccttcctgatgcaggtgatgattgacagcgtgatttcctcgcatgcctggaacacgctggcggcggtgctgtcggtctatgtgtttctggtgctgttcgacgcggctttcagctatgtgcgccagcgcctgatgcagatctgcggcgggcggctcgatgcgcggatcggcgcggcggtgcatgcgcatctgttgtcgctgcccttgtcgatgttcgagacgacggccgcgggcgttctggcccgcaacatgcaactgactgaaaagataaggcattttctggtcgggcggttgtttcagacgatgctggatgccgcgcttttgccggttctgctgacgcttctggcgcttttgtcggggctgatgacgctggtcgttctgggctttgcgctgaccatcgcggggcttctggcggtgtttttgcccgcgctgcagcgccgtctttcggcgctttacgacgccgaggcggggcggcaggcgcatctggtcgagacgctgcacaacatgcgcacggtgaaggcgctggtgctggaaggcacgcggcgcgggctttgggaaaccgcgctggcgcgcacgatccgcagccagtggcaggtgggggaactttccgccaccgtcagcgcgctaacctcgctgatggagcggctgatgcaggtcgcggtgctgggccttggcgccgaacaggtgctctcggggcagatcagcgtcggcactttggtcgccttcatgatgctttcggggcgggtcaccggccccctggtgcagatcgtcgggctgatcaacgaatggcaggaagcggcgctggccgtgcgcacgctccgcggcgtgatggaccatccgcccgaacgcggccccgaggtgcggccgatccgcccgcccctgcgcggggcgatccggatcgaggatctgtgcttcacctatcccggcaccgcgacgcccgcgctcgatcatctgacgctcgacatcgccgccgggcaggtgatcggcattgtcgggcgttcgggctcgggcaagacgacgctgacgcggctgctgcagggcatcggctcggcgcaatcgggccgcatcctttacgacggcaatgacgcgcgccacatcgaccttgaccatctgcgccgttcggtcggcatcgtgctgcaggaaaacgtgctgttccgcggcaccttgcgcgaaaacatcgcgctcgcccgtcccgatgccagccacgaggcggtgctgcgcgccgcgacgctggcgggggcggcggaattcatcgaccggctgccgcaggggctcgacaccccggtcgaggaaggcggggcgaacctttcgggcgggcaacggcaacgcatcgcgctcgcgcgcgcgctgctcgccgatccgccgatcctgatcctggacgaggcgaccagcgcgcttgaccccgaatccgaggcggtggtgaaccgcaacctcgccgccatcgcgcaggggcgcacggtgatcgtggtctcgcaccggatgagttcgctggcgcattcggatgcgatcctggtgctggatcgcggccggatcgaggatttcgcgccccatgcggtgcttctggcgcgctcgccgacctatcgacatctgtggctgcaacaggcggggcagacg

SEQ ID NO: 45386 - DNA, 3255 bp, Rhodobacter capsulatus
atgcatgtcgtcttccgcgaaagccacgggctcgaggaaaccgcggtgccgaccgatctgggtcagcgcccggcggatcttgtggtgctgtcgctctctgacagcgatctgggggctttcgcggcgggctggaaacgcgcgggcgggcggctgccctcgctgcggctggccaatctggtggcgctgaaacatccgatttcggtcgatacttacgttgaaaacacgctgtcgggggcgaaggggatcctgatccggctgatcggcggcgaggcttactggccctatggtctggcctcggtgcaggatctgtgccgccgcaaggggattgccttggccgtccttcccgccgatggccgcgccgatgaccggctcgatgcgctctcgaccctgccggtttcgacgctgcggcggctcaaggagctttgcgatgcgggcggcgcggtggcggcgcaggcggccttggcgcagctggccctggcctccggcctttacgcccccccggtgccgggcgacaagcgcctgcccgactgggggttttacgacccggccgcgggcgtgatccccgcgcccgagggggacggccccctggcgctggtcagcttctaccgctcttatctgaccgccgccgataccgcgccgatcgatgcgctgatccatggcctgcgcgcgcgcggtttcgcggcttgcggcctctttgcgccctcgctcaaatccgaggggctgggcgatgcgctgcaagcccggctggacggccgcgcccccgcgctcgtcgtcaacgcgaccgccttttcggcgcagggcgcggatggcacgacgccctttgaccgctatgatgtgccggtgtttcaggtcgcgctctccaccgcccgcaagcgcgactgggccttggccgaccgcggcctttcgcctgccgatctggccatgcatgtcgtgctgcccgaggtcgatggccgtctgttcgccggtgtcgtctccttcaaggcgcccgagccgcgcgaccccgatctggaattttcccgcttcgcccatcgccccgatccggcgcgggtcgaggccgcgctggaccggatctgcggctggcaccgcttgcggcaaaccccggcggcggatcgcaagctggcggtggtgctgtccacctatcccggccggtcctggcagatggcccatgcggtggggctggatgcgctcgcctcgaccgaggctttgctggcccagcttgcgaccgagggctatgcgattgcccccggtgccgcacttgagacactgacgaccgcgcgtctgacctggccgctttcggattatctcaccgcgctggacaccctgcctgaaaagctgcgcgccgatctgaccgcggcctgggggccgcccgaggctgaccccgcctgcgccgacggtgcctttcacttcgccgccctgcgccgcggcgccgcgctgatcgcgctgcagcccgaacgcggcgatgtgcaaacccgcgacggcgagtatcacgacctgtcccgcgtgccgcggcatggctatgtcgccttttatctctggctgcgggccttgggcctcgacgcgctggtgcatatgggcgcgcatggcacgctcgaatggctgccgggcaaggccgttgcgctgtcggaaagctgctggcctgaggcgctttgcccgctgcccgtcatttatccctttatcgtcaatgacccgggcgaggcggcgcaggcgaaacggcgcctttcggccgtgactttgggccatctgccgccgcccctgtcgcaagccgccgtgcccgaggggatggcgcggctcgaacggcttttggacgaatattccaccgccgacgggttggacccggcccggcgcgaccggctgatcgccgacatccgcgacgaggcccgcgcgagcggcgtcgaagacgatctgggcattcccgccaccgcctcggccgcggaagcgatcacccgcatcgaccgttttgtctgcgatatcaaggaaagcctgtttggcgacgggctgcatgtgctggggcagggcgcctgcggggctgccgaacaggcggggctttcggcggccttggcgggcaaacgcgtgccccccggcccctcgggcagcccggcgcgcgggcgcgcggacgtgctgccgaccgggcgcaacctgttctccgtcgatccccgggcggtgcccagccgtgccgcccatgcccaaggcgtgaagctggccgaggagctgcttcgaaaacatctgcaggatcatggcgactggccgcgcggtctggtcgtcgatctttggggctcggccacgatgcgcaccgcgggcgaggaattcgccatggcgctgcatctggccggtctgaaaccggtctgggacgagggcgccgcccgggtttcgggggtcgaggtgatcgcgcttgcgcttctgggccgcccacgcatcgacgtgaccctgcgcgtttcgggccttttccgcgatatcttccccggccttgcgcagctcttcgagaccggcgccgaggcgctggccacgcgcgaggaaacgcccgaggacaacccctaccgggctgcggccccgcgcgtcttcgggccgcgtcccggccaatacgggctgaacatgggcccggcgctggaggcctttacccccgaagcccgcgcaagggccggcgaggcctggctggcggcctcctcctacacgattgacaagaaaggcgaaatccgctccgaccgggcggggctggaagcccgcctgatgggggccgacagtttcgtgcatgcccaggatctgcccgaaagcgatatcctgctggcctcggattacgccgcgcatgaggccgggtttgccgccgcccttgcgcgtctgggcgccgaggccccggcgctttatcatctggacgccaccgacccgacccggccccgcgcccgctcgctgcccgaggagatcgcccgcgtcgtgcgcgcgcgcgccgcgaacccggcctgggccgatgggatgatgcggcacggcttccgcggcggggcggaaatcgccgcgacgctcgaccacatggcggctttcgcgcatctggcccaagtcgtgcccgcgcatctgttcgacctttaccacgaggcgacgctgggccgcgacgaggtgcgcgactttctggcccgcgaaaaccccgaggcgctggcggcgatgcgcgatctgtttcaacgcctggccgaggcgggcctctggctgacgcggcgcaattcgattgcggcaagcctcgaggaaaggctagaagcgcgccaacccgaagga

SEQ ID NO: 45387 - DNA, 756 bp, Rhodobacter capsulatus
agactgacaggcaaaagggcgctcatcaccggcgccgcgcgcggcatcgggcgggccttcgccgaggcctatctgcgcgagggcgccgatgtcaccatcggcgacatcaaccttgaaggcgcgcgaaagaccgccgcggaaatcggctgcgcggcggtgcatctggacgtgaccgatcaagccagcatcgacgccgcgatggcggtgatgcgggcgggcggcggcatcgacattctgatcaacaacgccgcgatcttcaccgccgcgccgatcgacgaaatcacccgggccgattacgaccgcgtctttgcgatcaacgtcgcgggcacgctgttcaccctgcaggcggcggccagggaaatgatcgcgcagggccgtggcggcaagatcatcaacatggcctcccaagcgggacggcgcggcgaaagccttgtcgcggtctattgcgcctcgaaagccgccgtcatcagcctgacgcaatcggccgggctgaacctgatcgcgcatggcatcaacgtcaacgccatcgcgccgggcgtggtcgatggcgagcattgggacggcgtcgacgccttctttgcgaaatacgaaaagaaacccctgggccagaagaagaaagaggtcggcgcgtccgtcccctttggccgcatgggaactgccgcggacctcaccggcatggcgatcttccttgccactcccgaggccgattacatcgtcgcccagacgtataacgtcgacggcggcaactggatgagc

SEQ ID NO: 45388 - DNA, 672 bp, Rhodobacter capsulatus
atgttcgatctgatcatcttcgactgcgacggcgtgctgatcgacagcgagatcatctcggcgcagatgctgattgcggaactcgcgctgaacggcgtgacgatcgatctcgattatgtggcgacgcattttctgggccgctcctatccaacggtgctgcagcaggtgcgccgcgatttcgcgctggatctgcccaccgatttcgaaacccgctaccgcgaacggctgctggcggcctttgaacgtgatatgcaggtgatgccgggggtggcggcgctgctggaccggctcaccctgccctggtgcgtggcgacctcctcctcgcgcccgcgggccgagcgttcgttggaaattgccgatctttcccaaagggttggaagccgtctttacactgcctcccaggtcgaacgcggcaagcccgcgcccgatcttttcctgcttgcggcgcggcagatgggcgccgatccggcccgctgcctggtgatcgaggacagcctgaacggcatccgcgccgggctggccgcggggatgacggtctggcgcttcaccggcggcagccatctgcgcggccgcgatctgaccgcgcccgaggacgcccgcccggcgcttgatttcgacgatttcgggcagctcggcgccttgctgcccggcgcctttgacggaaagaccccc

SEQ ID NO: 45389 - DNA, 1395 bp, Rhodobacter capsulatus
atgagccccgccgccgaggcctttgcgcgtctgagggcgggcgatgcccggcggcggaccgagttcaccgtgcaaaagcgccgtgcggtgctgaagcggctggcgtccgaaatccgcgcccgcgaggccgagatcatggcggccttggctgccgatctgggcaagcccgcggtcgaggtgcggatttcggaaatcatcccgatcctgtcggaaatccgccatacctcgcggcatctgaaggcttgggcgggggtgcggcgggtgcgtccgacgctctcgatgatcggcacgcgcgcgacgatccggccggaacccaaaggcacggtgctgatcctcgcgccctggaactatcccctgtgtctggctttggggcctttggtcagcgcgatcgcggcgggcaatgcggcggtggtgaagccctcggaactggcgcccgccacctcggcgctggtggcaaagatcgttgccgcctgcctgcccgaagatctggtggcggtggttgaaggcggcgtcgagaccgcgaccgcgcttctggcgcagcccttcgatcatatcttcttcaccggctcgcccgcggtgggcaaggtggtgatggcggcggcggcgaaaacgctcgcctcggtcacgctggagctgggcggcaagtcgcccgtcatcctgggccccgatgccgatctgaaaaaggcggcgcggatggtggcctggggcaagtttcagaacgccgggcagacctgcatcgcgcccgatcacgtcttcgtcccccgcgcgcaggaggcggggttcaccaaggcgctgcgggcggaaatcgcgcggatgtatggcgcccgcccgcaggcctcgcgcagttttgcccggctgattggcgcgaaacatttcgaacgcgtgcgcggcatggtcaccgaggccgtcggccatggcgccaccctgatcacgggcggcgaggcggaggccgccagccgttaccttgcgcccacggtgctgacgcatgtgcccgccgatgccgcgctcatgcgcgaggagatcttcggccccgtcctgccggtgatcgcctatgatgatctgggcgccgttctggccgggatcgaggcgggggaaaagccgctggcgctttatgtctttgcccgcgaccggaagctgattgcgcggatctgcgccgccacgacctcgggcgcggtgggggtgaatgtgacgcttgcgcatttcctgcatctcaatctgccctttggcgggatcggccaatcggggctgggcgcggcgcacgggcgctggggctttcaagccttttcccatgaaaaaccggtgcttgagaaccgttttgcggtgcttgacccgttgatgccgccctatggcaagctttcggcccggctggcgcggctggtgcaggcgctggtcggc

SEQ ID NO: 45390 - DNA, 786 bp, Rhodobacter capsulatus
cgcttcgccccgtcgcccaccggcccgctgcatctgggccatgcctttgcggcgatcctggcccatgacatggcccgggcggcgggcgggcggtttttgctgcgcatcgaggatatcgaccgcgcgcgtgcgaaaccgcagtgggaggcgcagcttctggacgatctgcgctggctcgggatcacctgggacgggccggtgctgcggcagtccgaccgtctgccgctctatcgcgacgcccttgaaaggctgtggcaaagggggctcgtctacagctgcacctgcagccggcgcgacatcgaacaggccgcctcggccccgcaggagggggcgccccttggccccgacggcatcgtctatcccggcagctgccgcgacaagggccgcccgcgcccgggccaagccctgcccgaaaccgcgctgcggctgcgcatggaccttgccgcgaccgagacaggctttgaggagaccggccccgcgcatcgcggctggcacgagatccgccccgaaacgatgatccgcgccgtcggcgatgtcgttctggcgcggcgggagatgggcacatcttatcacctttcggtggtgctcgatgatgcggcgcagggcgtgacccatgtcacccgcggcgaagacctgttcgaggcgacctgcatccatgtcacgctgcagcgcctgctcggcctgccggtgccggtctatcaccaccacgggctgatccgcgacgatgcgggcaagcgtctggccaagcgcgacaatgcccgggcgctgtcgaaataccgcgccgag

SEQ ID NO: 45391 - DNA, 1440 bp, Rhodobacter capsulatus
attcgcgaggccctcaccttcgatgatgtccttctggttcccgcagcctcaagcgtgctgccctcggaggccgatgtttccacccgcgtcacgcgctcgatccgtctgaacatcccgctgctttcgtcggcgatggacacggtgaccgaggcgaacatggcgatcgccatggcgcaggcgggcggcatgggggtgatccaccgcaacctgacggtggaaaaacaggcttccgaagtgcgccgggtgaagcgcttcgaatccggcatcgtctacaacccgatcacgctcacgcccgagcagacgctcgccgatgcaaaggcgctgcgcgaacgctacaatgtctcgggctttccggtcgtcgatgttgcgggcaaggtcgtcggcatcgtgacgaaccgcgacatgcgctttgccaccgatgacgcgacgccggtccatgcgatgatgacgcgcgagaatctggcgatgctgcgcgaaccggccgaccgcgacgaggcgatgagcctgatgaaagcccgccggatcgagaaacttctggtggtgaatgccgacggcaagctgaccgggcttctgacgctgaaggacagcgaacattcggtgctgcacccgcaggcctgcaaggacgaaaagggccgtctgcgcgttgccgccgcctcgacggtgggcgatgcgggctatgaacgctcggtcgcgctgatcgaggcgggctgcgatctgatcgtgatcgacaccgcgcatggccattccgaaggcgtggcgaaagcggtcgagcggatcaagctcttcgcgcccggggtgcaggtctgcgcgggcaacgtcgccacggccgaggcgacgaaggcgctgatcggggcgggcgcggatgcggtcaaggtcggcatcggtccgggctcgatctgcaccacgcggatcgtcgcgggggtcggcgtgccgcagctctcggcgatcatggatgcctgttcgggcgcgggcgacgtgccgatcattgcggacggcggcatcaaattctcgggcgatttcgccaaagccatcgcggcgggcgcctcctgcgccatggtgggctcggcgatcgcgggcacggatgaaagccccggcgaggtgatcctctatcagggccggtcctacaaatcctatcgcggcatgggctcgctcggtgcgatggcgcgcggctcggccgaccgctatttccagaaggacgccgcctccgacaagcttgtgcccgaggggatcgaggggcaggtgccctacaagggcccggtggcgacggtcattcaccagatggtgggcgggctgcgcgcggcgatgggctacaccggccatgccaccgtggcctcgatgcagggcggctgccagttcgtccgcatcaccggcgccgggctgaaggaaagccacgtccatgacgtgcagatcacccgcgaaagcccgaactaccgcatcggc

SEQ ID NO: 45392 - DNA, 969 bp, Rhodobacter capsulatus
acgatcagagcggtggtccgtggcgtggggcattacctgcccgcccgcgtggtggagaatgccgagttcgagggcaagctcgacacgacggatgaatggatccggtcccgcaccgggatcgaacggcgccatttcgcggccgagggggaaaccacctcgcagctggcgatcaaggcggccgcggcggcgctggccgatgcggggctgagcgcggcggatatcgatgcgatcgtggtcgcgacctcgacgccggatttcaccttcccgtcggttgcgacgatggtgcaggcggggcttggcaacaccaatgcctttgcctttgacgtgcaggcggtctgcgccggcttcgtctttgcgctggcgaatgcgaacgggatgatcctgtcgggccaggcgaaacgggtgctggtgatcggcgccgagacgttttcgcggatcatggactgggccgatcgcggcacctgcgttctgttcggcgacggcgccggggcgctgatcctcgaggcggccgagggcgcgggcacggccgccgaccgcggcattctggcaagcgacctgcattcggacggccgctaccgggaattgctttacgtcgatggcggggtgtcgaccaacggccagtccggccatctgcggatgcagggcaatgccgtcttcaaacatgcggtgcaaaaactggccgagaccgcgcatgcggcgctcgccaaggccggtctgacgcccgaggacgtgagctggatcgtgccgcatcaggcgaacctgcgcatcatcaccgccacggcggaacggatgggggtgccgatggagcgggtggtggtgacggtggccgatcacggcaacacctctgccgcatcgattcccctggcgctctcgacggcgcgggcgcgcgggcagatcaaggcgggggatctgatcgtgaccgaggcgatcggcggcggtctggcctggggatcggtggtcctgcgctgg

SEQ ID NO: 45393 - DNA, 1209 bp, Rhodobacter capsulatus
atgtcgaagatcaaggtagcgaatcccatcgtcgagatggacggcgacgagatgacccggatcatctgggatttcatcaagaaaaagctgatcctgccctatcttgacgtcgaccttctctattacgatctcggcatcgaggaacgcgaccgcaccaacgaccagatcaccatcgattccgcgctgaagacgaaagaggtcggcgtggcggtgaaatgcgccacgatcacccccgacgaggcccgggtggccgaattcaacctcaagcagatgtggaaatcgcccaacggcacgatccgcaacatcctcggcggcgtgatcttccgcgagccgatcatctgcaagaacgtgccgcgcctggtgccgggctggacccagccgatcgtgatcggccgtcacgcctttggcgatcaataccgcgccaccgatttccacttccccggcaagggcacgctgacgatgaaattcgtcggcgaggatggcacggtgatcgaaaagaccgtctttgacgcccccgccgccggggtggcgatggggatgtacaacctcgaccagtcgatcatcgacttcgcccgctcctcgatgaactatggcctgctcaagggctggccggtctatctatcgaccaagaacaccatcctcaaggcctatgacggccgcttcaaggatctgttccagaaggtctacgaggaagaattcgccgacaagttcaaggccgcgggcatccattacgaacaccgtctgatcgacgacatggtggcttcggcgctgaaatggtcgggcggctatgtctgggcctgcaagaactacgatggcgacgtgcagtcggacaccgtggcacagggcttcggctcgctgggcctgatgacctcggttctgatgacgcccgatggcaagatcgtcgaggccgaggccgcgcatggcaccgtcacccgtcactatcgccagcatcaggccggcaaggagacctcgacgaactcgatcgcctcgatcttcgcctggaccggcggcctcaagcatcgcgcgaagctcgacgacaacgcggcgctgatgaactttgcccagacgctggaaaaggtctgcgtgcagaccgtcgaagacggcttcatgaccaaggatctgtcgcttctggtcggccccgatcagaaatggctgaccaccatgggctatctggaaaaggtcgacgaatatctgaacaaggcgctggcg

SEQ ID NO: 45394 - DNA, 1200 bp, Rhodobacter capsulatus
agacgtgtcgtcatcaccggggccggaacggtcaatgcgctggccccggatgtgcagggcaccttcgccgcgatggcagaggggcggtgcggcatcgggccgctcgactttcccgatgtcgagcggctgacgatccggatcggcgcgcaggtgcgggactttgcccccgaaagccatttcgacaagggcaagctgtcgctttacgaccgcttcacgcaattcgcgctggtcgcggcgcggcaggcgatggcgcaggcggggcagccgcaggaaagctgtgatcacacccgctggggtgcgatcatcggcaccgcgggcggcggcaatgcgacggtgaacgaggcctatcgcgcggtttatgccgagggcaagaaccgggtgcatcctttcaccgtgccgcggctgatgggcaatgcggcggcgtcgcatctttcgatggaattcgggctgatggggcccagtttcgcggtggcgacggcctgcgccagttcgaaccatgcgctgggtctggcgtttcagatgatccgcgcggggctcgccgatggcatgctggcgggcggggcggaatcgatgctgaatttcggcgggctgaaggcctgggaagggctgcgggtgatgtcgcccgacggctgccgcccgttcagcgccagccgcaacggcatggtgcagggcgagggcgcaggcgtcttcgtgcttgaaacgctcgaaggcgccaaggcccgcggcgccgagattctggccgagatcaagggcttcgccatgacctcggacgcaagcgacatcgtcatgccctcgcgcgagggggcggcgcgggcaatgcgtctggcgcttgcggatgccgggttgccgcccgaggcggtggaatatgtcaacgcccatggcaccggcacggcggccaatgacaagaccgaggcggcggcgctgtcggatatcttcggcgcgcatctgccgcggcttccggtcagttccaccaaggcgatgcacggccattgcatcggcgccaccggggcgatcgagcttctggcctgtctgatggcgttgaacgacggggtgatcgcgccgacgctcggctttgacgcagccgatcccgactgcccgctcgatgtcgtgcccggcacggcgcgtcaggcgcgggtcgacacggtgatgagcaatgcctttgcctttggcggtctgaacgcggtgctgatcctttccaaa

SEQ ID NO: 45395 - DNA, 438 bp, Rhodobacter capsulatus
atcgtgctggtggggatgatgggcgcgggcaagaccgcggtgggcaccgcgctggcgcgggcgctgcgggtgccgtttcacgacagcgacgaggagatcgtcagggcggcgcagcgttcggttgccgagatcttcgaacgcgatggcgagccgttctttcgcgcccgcgaatcggaggtgatcgagcggctgctctcgggcacgcccggggtggtctcgaccggcggcggggcgtttttgtcagaggcgaaccgggcgatgatcgcgcggctgggggtctcggtctggctgcaggcggatctggagctgctctggacccgggtcaagggcaagacgacgcggccgcttttgcgcaccgccgatcccaaggcgacgctggccgagctgatcgagcggcgctatcccgtctatgcgctggcgcagctggcggtggaggcc

SEQ ID NO: 45396 - DNA, 1089 bp, Rhodobacter capsulatus
gaagtggtgaaggtggagctgggcgcgcgcgcctatgaggtgcggatcggggccgggcttctggcgcgggccggggcggaaatcgcgcccttgctgcgcaagcccaaggtggcggtggtggccgacgcgaccgtggccgggctgcatctggaggcgctgcgggcgggcctcggcgatgtcgagatggtgtcgatgacgctgccctcgggcgaaggaaccaaaagctggccgcatttcgagcgtgtctgcgaatggcttctggcgcaaagggtcgagcgcaaggatatcgtcgtggcctttggcgggggcgtgatcggcgatctggtgggctttgccgcggcagtgttgcggcgcggcgtgcgcttcgtgcagatcccgacgacgcttctggcgcaggtcgacagttcggtcggcggcaagaccgggatcaatgtcgcggcgggcaagaacctgatcggcgcctttcatcagccttcgctggttctggccgatatcgggctgctcgatacgctcgccccgcgcgattttctggccggttatggcgaggtggtgaaatacgggcttctgggcgatgcggcgtttttcgactggctcgaggcgaacggcccggcgatggcggcgggcgaccgggccttgcggcaatatgcggtgaaacgctcggtcgagatgaaggccgagatcgtcgcgcgcgacgagaccgaggagggcgaccgggctttgctgaatctcggtcacaccttctgtcatgcgctggaggcggcgacgggttattccgaccggctgctgcatggcgagggggtggcgatcggctgtgcgctggcgtttgagctgagccaacggctggggctttgttcgcaagaggcgccaagccgtgtgcgggcgcatttgcgcgacatgaagatgaaggtggaactgtctgatattccgggggaattgccggatgccgaggggctgatcgcgcttatgggccaggacaagaaagtgctggatggcaagctgcgcttcattctggcgcgggggatcggcgcggcttttgtcacttcggacgtgccgcgtgaggtgctgaaagacctgctgaccgaggccctg

SEQ ID NO: 45397 - DNA, 1381 bp, Rhodobacter capsulatus
ccgaagggagtggactatggccaaggcatggatgaaatcggactggcgcgcgaagccgcgggtgcagatgcccgattatcccgacgctgcggccctgaccgcggtcgaggcgcagctgggcaagatgccgccgctggtctttgccggtgaggcgcggcggctgaaggccgatctggcgaaggccgcgaagggcgaggcgttcctgttgcagggcggcgattgcgccgaaagcttcaccgaattttccgccgacaacctgcgcgacaccttcaaggtgttgttgcagatggcgatcgtgctgacctggggggcgaaggttccggtgatcaaggtcgggcggatggccgggcaattcgccaagccgcgctcggcgccgaccgaaatcatcggcggcgtcgaatatccgagttaccgcggcgatatcgtgaacgggttcgaagcgacgcaggaagcccggctgcccgatccgaaccggatgctgcaggcctatacccaggcggcggcctcgctcaatctgctgcgggcgttttcgaccggcggctatgccgatattcaccgggtgcaaagctggatttcgggctttaccgacgaggccgatgccgcgcgctatcgcgaagtggcggagcggatctcggatgcgatggatttcatggccgccgcgggcgtgacctcggagacggcgcatcagctgggcaaggtcgatttctacaccagccacgaggcgctgctgctggaatatgaagaggcgctgtgccggatcgacagcacgacggggctgccgatcgcgggctcgggtcacatgctgtggatcggggaccggacccggcaggtcgatggtgcgcatgtcgaattctgccgcggcgtgcaaaacccgatcgggctgaaatgcggtccctcgaccaccgaggaagatctcaagctgttgatggcgaagcttaatccgcaaaatgaaccggggcggctgacgctgatcgcgcgctttggcgcgggcaaggtgggcgagcatctgccgcggctgatccgcaccgtgcaggccgaaggggcgcaggtgctttggacctgcgatccgatgcatggcaacacgatcaaatcggcctcgggcttcaagacgcggccgttcgattccgtgctgcgcgaggtgcgcgagttctttgccatccacaaggccgaggccacgatcccgggcggcgtgcatttcgagatgaccggcaaggatgtgaccgaatgcaccggcggcgtgcgggcggtctctgacgaagacctgtcgagccgctatcacaccgcctgcgatccgcggctgaacgccagccaatcgctggaactggccttcctcgtcgccgaggagctgcaggacctgcgcgtgatgaaaaaggctgcgggg

SEQ ID NO: 45398 - DNA, 1509 bp, Rhodobacter capsulatus
agtggcacggagatgacgatgggcagagattggtggcgtggcgcagtgatctaccagatttatccgcgcagttttcaggattcgaacggcgacggcatcggagacctgaaaggcatcaccgaaaggctgccccatgtcgccgcgctcggggtcgattcgatctggctcagcccgatcttccgctcgccgatggacgacatgggctatgacgtctcggattatcgcgatatcgatccggtgttcggcacgcttgcggatttcgacgcgctggtggcgcgcgcccatgatctgggtctcaaggtgatcatcgaccaggtgctcagccattcctcggaccgccatccctggtttgccgattcgaagcggcgcggtcccaaggcggactggtatgtctgggccgatccgaagcccgacggatcgccgccgaacaactggcagtcggtctttggcggctcgtcctgggaatggtcgcccgagcgcggccagtattatctgcacaatttcctgatctcgcagcccgatctgaacctgcgcaatcccgaggtccaggacgagatgctcgaggtgttgcggttctggcttgatcgcggcgtcgacggcttccggctcgacacggtgaactattacatccacgatggcgcgctgcgcgacaacccgccgatgccccccgatccgacgcgctggccgccggtctcgacctatgacatgcaagaccatgcccatgacaagaaccggccggaaaaccttgatttccttgcgcgaatgcgcaagcttctggatcagtacgagaaccgctgcatggtcggcgagatcggcgaagtcccccatcgcgcgctgcctttgatggcggaatacacttccggaacggcgcatctgcacatggcctacagcttcgacatgctggggccgaaattcgccccggcgcatttccgcagggtgcttgacggctttttccgcgcggcccccgacggctggccctcctggtccttctccaaccatgatgtgaaccgccatgtcacccgctgggccggatacggcgatcaggatgcggtggcgaaactggcgatctcgatgctggcctccttcgagggcacgatcggcctttatcagggcgaggaactgggccagaccgaaaccgacctcgcctatgaggagctgaccgatccgcccgggctgcgcttctggccagagaacaaggggcgtgacggctgtcggacgccgatggtctgggacggcaccgcgcagggcggcttcagcacggtcaagccctggcttccggtcaaggccccgcgccttgcgcgcaacgtcgccgctcaggaggctgatctcgcctcggtgctgcaccattaccgcgccgttctggccttccgccgcgccagcgccgcgctgcgcaccggccgcacccgcttcctcgacctgcccgatccggtgctgggcttccggcgcgaaaccgacacggaaagcctgacctgcctcttcaatctcggccccgatccggtgactctcagc

SEQ ID NO: 45399 - DNA, 2337 bp, Rhodobacter capsulatus
gcggaaatcctgcgccatctgacctattccatgggcaaggatgcgggccatgcctcgctttacgactggcgcatggcattgagccttgcgctgcgtgatcacattgtcggaccctggttcgacgccacccggcaaacctatgaacaggggcgcaagcgggtctattacctgtcgatggaattcctgatcggccgggtgcttgaagatgccgcgatcaatctgggcatgcgggcgattgcgcgcgaggccatcgaggggctggggcaggactggcatcaggtcgtcgaagatgaaccggatgcggcgcttgggaacggcggtctgggacggcttgcggcctgttacatggaaagcatggcaacgctgggctgtgcgggttatggctatgggatccgctacgagcacgggcttttccggcagtggttcgatggcggccgccaggtggagacccccgaggactggctgaaacagcgtcacccctgggaattcgagcggcccgaagtctgttatgagatcgggttcaagggcacggtcgagatcgtgaatggcaaatcggtctgggccccggcggaaacggtgatcgccgaagcttatgacatgccggtgatcggctggcagggacgctgggcaaacaccttgcggctttgggcggcaaagccgacgacgcttttcgatctggcccgcttcaaccatggggatttcgccgctgccgccgagccggaggccctggcgcgcacgctcagccgggtgctttatccggatgacaccacttttcagggcaaggaactgcgcctgaaacaggaatatttcctgacctcggcggcgttgcaggacatcttgcgccgtcatctgacggccggtctggcgctgaccgatctgcccgatcatgtcgcgatccagatgaatgatacgcatcccgcgatcgccggccccgagctgatccggctgctcagcgacgtgcatggcatgagtttcgaagaggcgctggagatcggcgtcaaatgtctgggttataccaaccacacgcttttgcccgaggcgctggaacgctgggcgacctatctgatgggctcggtgctgccgcggcacatgcagatcatcgaggcgatcgacgcctggcatttgcggatgaatccgacgcggccgcattatgtggggatcgtcaagcatcacgaggtgcggatgggcgagctggccttcatcacctcgcacaaggtcaacggcgtttcggcgctgcatacggagctggtgaagaagaacctgttccccgagcttgacaagctgcatcccgggcggatcatcaaccagaccaacggggtgacgccgcggcgctggttgcgcatggccaacccggcgctgtcgcggttgattaccggggcgatcgggcagggttgggaggccgatctcgaccgcctgcgcgaactggataaactgagcgaagacaaagtcttccgggatgactttgcgaaagccaagcgcgcgaacaaggtcgctttggcggagtggatcgcgcagacgcagggggtggtggtcaacccggacgcgttgttcgatgtgcaggtcaagcgcatccacgaatacaagcggcagttgctgaacatcctgcagacgattgccgaatggcatgtcatccgctccaacccgacggccgaggtggtgccgcgggtgaagatcttcggcggcaaggcggcgcccggctatcaggccgccaaagaggtgatccggctgatcaacgatgtggcgcgggtggtcaacaacgatccctatgtcggcgaccggctgaagatcgtttatccgccgaattacaatgtctcgatggccgagcggctgatcccggccgcggatctgtccgaacagatctcgaccgcgggcaaggaggcctcgggcaccggcaacatgaaattcgcgctgaacggggcgctgaccatcgggacgctggatggcgccaatgtggagatccgcgacgaggtcggggcggagaatttcttcctgttcggtctgacggcggaagaggtgacggagcggcgcaaggatcccgaacatgcccgccatgcgatcctgaaaagccagccgttgcaggacgtgctgcagatgatcgccgaggggcgtttctgtcccgaggagccgagccgctatcacgggcttgtccataacatgtggcacagcgattatttcctggtcgcgtcggatttcgaggcctatcgcgatgcgcagacggaagtggaccagaccttcgccgagccggatcggtggtggcggatggcgatcctgaacacggcgcggatggggtttttctcctccgaccgcgccattcgtggttacatgacggatatttgg

SEQ ID NO: 45400 - DNA, 2148 bp, Rhodobacter capsulatus
atcttgtctgccgaggcgctggcgctggccgagggccggcatgacgatcctttttcgattctgggctggcatcagaccccggaaggggggcgtctggtggcgctcgtgccgggggccgaacatgtctgggcaatttcccgcgagaccggggcagaagctgagcttcaacatgtaaccaacggactcttcgcaggaaaatgggaaggcggcagatatcgtctgcgcgcccgcaatgcccaatccacctgggatttcgaggatgcctatgccttcggtccggtgcttggcgagatcgacgaatatctgatcggagagggcacgcatcgtcgtctgtggcaggttctgggcgcgcatgtgatctggcacgaggggatccgcggcgtgcatttcgcagtctgggcgccctcggcgcggcgggtttcggtcgtcggaaatttcaacatctgggatggccgccgacatcagatgcgccgtcgcggcgcgacgggggtttgggagatcttcgtgccgggcctgatggcgggcgaagtttacaaatatgagatcctgtcggccgatggcgtcgttcagcctttcaaggccgatccggtgggatttggcgccgagcatccgccgcagacggcgtctcaggtccgcgagcttggactgcatctgtggggcgacggcgcctggatcgggcaacgccagaagatgcaggacattcatgcaccgatttcgatttatgaggtgcatctcggctcctggcgacgggtctgggatcagggcggacgcgctctgagctatcacgaactggcggggcaacttgtcgattacgtcgtcgagatggggttcacgcatatcgagcttttgccgataaccgaatttccctttgatggctcctggggctatcagccgatcgggctttatgcgccaacgatccgccatgggcgccctgaggaattcgcggcttttgtcgatgccgcgcatcgccggggtgtcggggtgatcctggattgggtgccgggccatttcccgaccgacgatcatgggctgcgccgcttcgacgggaccgcgctttatgaacatgccgatccgaaagaagggttccatcaggactggaacacgttgatctacaattacggccggcgcgaagtgaagaatttccttctggccaacgcgctgttctggcttgaggaatatcacctcgacgggcttcgggtcgatgcagtggcctcgatgctctatcgcgactattcgcggcgggacggcgaatgggtgcccaatattcatggcggacgagaaaatctggaggcgatcgactttctgaaagaggtcaatgcagaggcctatggcggcgccccggggatcatgacggtggccgaggaaagcaccgccttttcgggggtgacccggccggtgcatctgggcgggcttggcttcggctacaagtggaacatgggctggatgaatgacagcctgcggtatttttcccgcgatccgatccatcgccgctggcatcacaacgaacttaccttcgcaagttcatacacttacagcgagaactttatcctgccgatcagtcacgacgaggtcgttcacggcaaggggtcgatgctgggcaagatgccgggagacgggttgcagaaattcgccaacctgcgggccttctatgcgtaccaatgggcgcatccgggcaagaagctgctcttcatggggcaggagttcgcgcaggggcgcgaatgggcgcatcagggggcccttgactggcaccttctggacgacccgctgcaccgcggcatgcaggcgttggtgcgcgatctgaacaagctttaccgcgataccccggccttgcattggggcgattgcgacccctccggtttcgactggatcgaggcggatgatgccgaagcgtcggtttatgttttcgaacgtcgtgccccgggcgcagatcctgtcgtggtggcggccaatctgacgcctctcgaccgcacctatcgcatcggcctgccccaggcggggacatggtgcgagatcttcaattccgacagcggctattatggcggtgccaactggggcaatctcggcgcgatcgaggccgacgagatcgccaccacgcgacgcccgttcagcgccgaggtctatctgccaccactctccgtggtgatgttc

SEQ ID NO: 45401 - DNA, 1266 bp, Rhodobacter capsulatus
atgaaaccgcaaccgaaccagaggctttcgtcacaggccatggccttcgttctggcgggcggtcgggggagccgtctgaaggagctgaccgacaggcgcgcgaaacctgcggtctattttggcggcaagacacgcatcatcgatttcgccctgtcgaatgcgctcaactccggcattcgcaagatggcgatcgcgacacaatacaaggcgcacagcctgatccggcacatgcagcgcggctggaacttcttccgcgcggaacgtaatgaatatcttgatattcttccggcaagtcagcggatcgacgaaagcaaatggtatctgggcaccgccgatgcggtggcgcagaacatcgacatcatcgaagattatgacgtcaaatatgtgatcattctggctggcgatcacatctacaagatggattatgaggtgatgttgctgcagcatgtgctgagcaaggccgatgtgacgatcggttgtctgaccgtgccgagagccgaggcctccgccttcggctgtatggcggcggacaagaccgggcgcatcacccagttcatcgagaaaccggccaatccgccggggctgcccgaagatccgacccattcgctggtctcgatggggatctatgtcttcgactgggtgttcctgcgcgagttgctgatccgcgatgccgaggatccccattccagccatgatttcggtcacgacctgatcccgcagatcgtgaaatatggcaaggcgatggcgcatcggttctcggaaagctgcgtgacgtcgggtctggaacacgagccttattggcgcgacgtcggcacgatcgacgcgttctggcaggccaatatagacctgacggaattcacgccgaagcttgatctttatgacaatgcctggccgatctggacctatgccgagatcgtgccgccggcgaaattcatccatgacgaagacgggcggcgcggcagtgcggtcagttcgctgatctcgggggattgcatcgtttcgggttccgaagtgcgcaactcgcttctgttcaccgggtgccggtcgcatagttggtcgacagttcaacatgttgtcgccctcccttatgtcgatatcggcgaacgtgcccagctcacgcgttgcgtcatcgaccgcggggtgaaggttccgccgggacttgtcgtcggggtggacccggaagaagatgcgaagtggttccgccggaccgagggcgggatcgtgctgatcacgcaaagcatgcttgacgcccgtgcggcagccctg

SEQ ID NO: 45402 - DNA, 1431 bp, Rhodobacter capsulatus
acggcgatgaaacgtgttctttccgttgcgtccgaggcggttccgctggtgaaaaccggtggcctggccgatgttgtgggggccttgcccgaagcgcttgcggggcagggctgggagatgcgggtgatgcttcccgcctatcgtggcgtgctggatcggcttgcggccacgaccgtggtctggagcgatccggacctttttggcggaccggccgaggtgcatctgggcaaggtcgggacgatggaggtgatggcgctgagcgcgccgcatctctacgatcgggcgggcggtccctattccgatctccacggtgatttcggcgacaatgccgagaggtttgccgctttgtgctgggcggcggcagctgtggcgcgcgagggcgcggaggactggcggccggatgtgctgcatgcgcatgactggcaaggcgcccttgcgcctgcttatctgcgctatgccggggcgtcgttgccaagcctgatcacgattcacaacatggcctttcagggccgtgtgggggccgacaagatgggcgccctgcgcttgccacgcgaggcgttccaccgggatgggtatgagttctggggagacatctcgaccctgaaggccggtctgacgactgccgatgcgattaccaccgtcagtccccgctacgccgaggaactgatgcgcggcgaatatggtcaggggcttgaaggggtcattgccgcgcgggccggtgtggttgtcggtattctgaatggcatcgatgaccgggtatggaatccggaaaccgacccggagtgcatttctttctctgtgacgaacatctccggaaaatcaaaaaatcgcaaagcgttgcaggctgaatttcaacttgaaaagaagatcgacgaacctttggtgatcctcgtctcgcggctgacggcgcaaaaggggatcgaccttctgccgcctgcggtcgaggagctggtcgccagagggggggcgcttgccctgcttggctctggcgattcctgggccgaagatctcgtgcgcggtctggccgcacgcttccccggccgggtcggggtgcggatcggttacgacgaatcgttgagccatcggatgtttgcgggcgcagatgcggtgcttgtgccctcgcgcttcgagccctgcggtctgacccagctttatgggttgcgttacggctgcctgccccttgtttccgcggtcggcggccttgccgacacggtgatcggggcttccccggcaagcctggcggggcaagcggcgacgggcgtcgtgttccatccggtcgatgccttggcgctgcgacaggggatgcggcagctgtgcgatctgcatgccgatcgcaggatctggaccgcgatgatgaagcgggcaatgaagtccgatcttgggtggtcgcggtctgccgcccgttacgcggcactttatgaacggttgctg

SEQ ID NO: 45403 - DNA, 1992 bp, Rhodobacter capsulatus
gcgatgaagatcggaccgggaagggcagagatcctgggggcaatcccggtttccggcggcgtgaatttcgctcttttttctgcccatgcggaaaaggtcgagctttgccttttcgacggtgaccaggagacccgacttgtcctgccggggcgtgccggggatgtgtggcatgggtttgttcccggcctggttccgggtgcggaatacggatatcgtgtctatggaccctgggccccggagatcggtcaccggttcaacccgtccaagctgctcgtcgatccctatgcgcgggccctgacgggccctctggtctgggggccgtcaatgcaggggggcgtcggcgcgacccggccggatcggcgcgattccgccgcgtcaacggcgcgcgggatcgtctgcgaaattcagaagccactttgggatcggcctacaagaacctggtcgcaaacgattatttacgaagcgcatgtgcgtgggctgacgatgcagcaccccgaagtcccggcggccttgagagggggctatgaggctgtcgcgtcgccgccgatcatcgagcatctgaaacggctcggggtcactgcgcttgaactcttgcctgtcgcggcctttatcgatgaccgctttctggtcgagaaggggctgcgcaattactgggggtatcagccgatcgggttcatggcccccgatccgcggtatggcacgcgtgagagctttcgcgccatggtccgggctttgcatgcggccgggatcgaggtcatcctggacgtcgtcttcaatcacgcgggcgagggcgatgggaccggtccgaccgtgagcctgcgcggaattgacaataattcctattacaggttgtgtgaaggtgggcgctcttacgtcaatgacactgggacggggaatacgctcaaccttgcgcatccgatggttctgcgtctggtgatggatgccttgcgtcactgggtcgaggaaatgggggtcgatggcttccgcttcgatctggccacgacgcttggccgggcctcgacgggagagttcaaggaactggcttcgctgatctctgcgatccggcaggacccggttctcaacgcggtgaaactgattgcggaaccttgggacatcggtcccggcggctatcgcctgggcgcttttccttacccgttcgtggagtggaacgatcgcttccgcgatggtgtgcggcagttctggcggggggatgccgggttgattccggaactggcgcggcgcgttgcgggctctgcggagatcttcgatcatcgtggccgacccgcgacgacgtcggtcaactttcttacggcccatgatgggttcaccttgcatgaccttgtttcctatgcggaaaagcgaaacgaggcgaatggtgaaaacaatcgcgacggtcacaatgcgaatttctcgcaggctttgcctgatgccggtgcgaaggcgtcgcgaaagcgggcgatgctggcgaccctgatgctgtcgcaaggtgtcccgatgctgcttgccggggatgaactgggcaattcgcaagcggggaacaacaacgcttatgcgcaggacaatccgatcggctgggtagattggcagaccgcggacgaggggctgattgcctttgtgtcgcgtctcatccggctgcgccgagaccatcctgtcttgcgacagacccgtttcctgcatgccaagatccgcgctcaggacggggttcgcgacctgatctggcggctgccttccggtgccgaactgtcctcgcaagattggcatgacgcccagtcgcgctgtctttgcgccgaggtgcggggcgccgccgagggtcccccgggtcttgcctcgggggaagcgatgtttgccgtcttcaacgcgggaggggcgaccgaggtgcatctgccagacggcgcgtggcggctgctgatcgacacggccgaacctgatcgccccgaagccccgcattttgccgcagcgacttgcgttgccgcgcaatccgttcaactgttc

SEQ ID NO: 45404 - DNA, 1626 bp, Rhodobacter capsulatus
tccatgaccacccatccgacacgcccgttcgagggccagaaacccgggacgtccgggttgcgcaagaaaacgcccgtcttcatgcaaccgggctatctcgagaatttcgtccaaagcacgttcgatgcgatcggcggagttgccggaaagacgctcgtcctcgggggcgatggccgctatttcggcgtcgaagctgctcaagtgatcctgaagatcgcggcagctggcggtgcggcgcggatgatcgtggggcaggggtcctggctctcgacgcctgcggcctccaacttgatccgtctgcgcaaggccgatggcggcatcatcctttccgcaagtcacaatccgggcggccccgacgaggatttcggggtcaagtacaacatggccaatggcggtcccgcgccggaggcggtgacggacgcgatatttgcacgcacgcaggtcatcgactcttatcggaagctcgacgcgccagatgtcaatctgacgatggtcggtgaaagccgcttgggcgacatggtggtggacgtcatcgacccggtgtcggcctatgccgacatgatggaatccatttttgatttcaaggcgttgcggggtctctttcacgagggattcgcgatgcggatggacagcatgtgcgccatcaccggtccctatgcggtggagattttcgaaaaccggctgggcgctgcgaaaggcacggtcgttcacgaacaaccgcttccggattttggcggcatgcatccggatccgaatccgacctgggcacatgagttgatggccgagatgatgggccccgatgcgcccgatttcggggcggcttcggacggcgacggggaccgcaacatgattgtcggtcgcggcatctatgtgtcgccctcggacagccttgccgtcatcgccgccaatgcgcatctggtgcccggttatgcgcaaggtctgaagggggtggcgcggtcgatgccgacctctgccgccgttgatcgggtggccgaggccttgaaactggcgtgttatgaaacgccgacggggtggaaattcttcggcaatctgatggatgccggacgggtcagcctttgcggcgaagaaagcttcggtaccgggtccgaccatgttcgggaaaaggacgggctctgggccgtgctgatgtggctgaacatcattgcggcccggaacatgggcgtggccgaaatcatggcggatcattgggagaccttcgggcggaattactattcgcggcacgactacgaggctttgccggtcgatcaggccaacgccatgctcggtgatttgcgcgatcggctgtcttccttgaaagggacgcaagttcaggggcttgtggtgcaagatgcagatgagttcagctatgaagatccggtcgacggctcgatttccgcacatcagggctttcgcatcctgttcgaaggtggctcgcgcgcggtcttgcgtctgtccggaaccggcaccgaaggcgcaacgctgcgggtctatctggagcggtatgtcgccggaccggagggcctgacagaagatcctcagcacgctttggcgccgatcatcgcggcgacagaggatcttgtcgggatcaaggcccgaacgggacggaaaggcccggatgtgatcacc

SEQ ID NO: 45405 - DNA, 993 bp, Rhodobacter capsulatus
atggcgatcgagcttgaaggtctcgggcttagcccggaactggcggatgtgatgacccggctggcgcgtgtgggggcggatctggcccgcaccattgcccgcaacggggtggaaacggacctggcggcgggcgtcggcaccaatgccgggggcgatggtcaaaaggcgctcgacgtgatggcggacgacgccttccgcgaggcgctgacgggcaccgccgtcgcttattatgcttccgaagaacaggacgaagtggtgacgctgggcaaaggtacgctcgccttggccatcgatccgctcgacggctcctcgaacatcgatgtgaacgtgtcgatcggcacgatcttctcgatcttcccggcgaccgacgatccgaacaccagcttcctgcgcaagggctcggaacagatcgcgggcggctatatcatctacgggccacaatgcgcgctggtgtgcagcttcgggcgcggcgtgcatcactgggtgcttgatctcgacagccgcagcttcaagcgcctgcccgacatcaaggcattgccgcaagacacgtcggaatatgcgatcaacgcctcgaactaccggcattggccctcgccgatccgcgccttcatcgacgatctggtggcgggcgccgaggggccgcgcgggcgcaacttcaacatgcgctggatcgcctcgctcgttgccgaaacccaccgcatcctgatgcgcggcggcgtgttcctctatccgggcgacgaacgcaagggctatgcccgcggccgtctgcgccatgtctatgaatgtgcgccgatcgcctttctgatcacgcaagtgggcggcggcgccaccgacggctgcgaggacatcctctccgccctgcccgacaagctgcatgcgcgcacgcccttcgttttcggctgcgcggccaaggtggcccgcgtcaccgcctatcacgacctgcccggggaggagacctcggcactcttcaacacccgcggtcttttccggagc

SEQ ID NO: 45406 - DNA, 1971 bp, Rhodobacter capsulatus
atgaaggatctcgatatggcgcaggaaacgcggatggccaatgccatccgggcgctggcgatggatgcggtggaacaggcgaaatccgggcatcccggcatgccgatgggcatggccgatgtcgccaccgttcttttcaaccgtttcatgaagatcgacccggcggcgccgaaatggcccgaccgtgaccgcttcgtgctgtccgcgggtcatggctcgatgctgctttatgcgctgcaccatctgctcggctatgccgacatggatatcgcgcagctgaaaaacttccgccagcttggcgcccgcaccgccggccatcccgaatatggccatgccgacggcatcgagatgacgaccggcccgctcggtcaggggattgcgaccgcggtcggcatggcgctggccgagcgcatgaagaacgcacgttatggcgatgatctggttgatcatttcacctatgtcatcgccggggacggctgcctgatggagggcatcagccacgaggcgatcgacctggccgggcatctggggctgggccgtctgatcgtgttttgggatgacaaccgcatcaccatcgacggcgacaccgatctttcgacctcgaccgatcagaaggcgcgctttgccgcctcgggctggcatgtgcaatcctgcgacggtcatgcgccccatgagatcgccgccgcgatcgaggccgccaaggccgacccgcgcccctcgatgatcgcctgccgcacggtgatcggctttggcgcgccgaacaagcagggcggccacgatgtgcacggcgcgcccttgggcgccgaggaaatcgccgccgcgcgggctttccttgactggccgcatgcccctttcgagatcccttccgaactcaccgcggcctggggccgggttgcggcacggggggcttcggcgcgggccaactgggaggcgcggttgcaaaaccacgcggcccgcgccgacttcatcaaggccgaggccgacgacacctcggccctgcccgccgccatcgcggcctataaggcgcgtctttccgccgacaagccgaaagtggcgacgcgcaaggccagcgagatggcgctcgaggtggtgaatgccaccctgccccactccgttggcggctcggccgatctgaccggctcgaacctgacccggtcgaaggggatggtctcggtgaagccgggcgcctttgcgggcaactatattcactacggcatccgcgaacacgggatggcggcggcgatgaacggcatagcgctgcatggcggcctgcgcccctatggcggcaccttcatggcctttgccgattactgccgcccgtccattcgcctctcggcgctgatgggggttccggtcacctatgtgatgacgcatgactcgattggtctgggcgaggacgggccgacccaccagccggtcgagcatctggcctcgctgcgggcgatcccgaacctgaacgtgatccgccccgccgatgcggtcgagaccgccgaggcctgggaaatcgccatgacctccaaggcgacgccgaacctgctggtgctgtcgcggcagaacctgccgacgctgcgcaccacccatacggccgagaacctgaccgcgcgcggcgcctatctcttgcgcggtcccgaggaccggcaggtgacgctgatcgccaccggctccgaggtcgagattgcgctcgccgccgccgatcagctggcgaaagaggggatccgcgccgccgtcgtctctgccccctgctttgaacttttcgcggcgcaaccgcgcgattatgtgacgaaggttctgggcacggcgccgcgggtgggctgcgaggcggcgatccggcaaggctggtgcatgctgcttgggcccaccgatgcctttgtcggcatgaccggctttggtgcctcggcccctgccccgcagctttatcaacacttcaacatcaccgcagaggcgcttgtctctgaagcaaaaaacctgatc

SEQ ID NO: 45407 - DNA, 999 bp, Rhodobacter capsulatus
atgaccgtcaaagttgccatcaacggttttggccgcatcggccgcaacgtgctgcgtgccatcgtcgagtcgggccgcaccgatatcgaagtcgtcgcgatcaacgaccttggcccggtggaaaccaacgcccatctgctgcgcttcgattctgtccacggccgcttcccggcgaccgtgaccaccggcgaggactggatcgacgtcggtcgcggcccgatcaaggtcaccgcgatccgcaacccggccgagctgccctggggcaatgtcgatgtcgcgctggaatgcaccggcatcttcaccaccaaggagaaggccgcggcccatctgcaaaatggctcgaagcgcgtcctggtctcggcgccctgcgacaatgccgacaagacgatcgtttttggcgtgaaccacgccacgctgagtgccgaagacctggtcgtgtcgaacgcctcctgcaccacgaactgcctgagccccgttgcgaaagcgctgaatgacgcgatcgggatcacgaaaggcttcatgacgacgatccacagctataccggcgatcagccgacgctcgacacgatgcacaaggatctctaccgcgcccgtgccgccgcgctgagcatgatcccgacctcgaccggggctgccaaggccgtgggtctggtgctgcccgaactcaagggcaagctcgacggcgtcgcgatccgggttcccaccccgaacgtctccgtcgtcgatctggtcttcgaagccgcccgtgacaccagcgtggcggaagtgaacgccgcgatccgcgccgccgccgatggcccgctgaaaggcgtgctgggctataccgaccagcccaacgtctcgtcggacttcaatcacgatccgcattcctcggtcttccacatggatcagaccaaggtgatggagggccggatggtccgcatcctgtcgtggtatgacaatgaatggggcttctcgaaccgcatggccgataccgccgtggcgatgggcaagctgatc

SEQ ID NO: 45408 - DNA, 1062 bp, Rhodobacter capsulatus
atggcactgatcacccttcggcaactgttggaccatgctgcggaatattcctacggtgtgcccgccttcaacatcaacaacatggaacagggcctcgccatcatggaggccgccaaggccgtcgatgcgccggtcatcatccaggcctcgcgtggcgcccggtcctatgccaatgacatcatgctggcgaagatgatcgaggccttggccgcgatctatccggatattccgctctgcatgcaccaggaccacggcaacaacgaagccacctgcatgaccgcgatccgtcacggcttcacctcggtgatgatggacggctcgctcgagggcgacgccaagaccccggccagctacgagtacaacgtcgacatcaccgagcgcgtctcgcgcatggcgcattgggtcggcgcctcggtcgagggcgagctgggcgttctgggttcgctcgaaaccgggcaaggcgaggccgaggatggccacggcgccgaaggcgttctggatcacagccagctgctcaccgaccccgatcaggccgttgatttcgtgaagaaaacccaagtcgacgcgctggcgatcgcctgcggcacctcgcatggcgcctacaagttcagccgcaagcccgatggcgagatcctggcgatgtcggtgatcgaggcgatccacaagaaactgccgaacacccaccttgtcatgcacggctcgtcctcggtgccgcaggatctgcaggacatcatcaacgaattcggcggggcgatgccgcaaaccttcggcgtgccggtcgaggaaatcgtgcgcggcatcaagatgggcgtgcgcaaggtcaatatcgacaccgactgccgcatggcgatgaccgggcagttccgccgcatcgccgagcagaacaaggccgaattcgacccgcgcaaattcctgaagcccgcgatggatgcgatgcgcgatctgtgcaaggcgcgtctcgaggccttcggcaccgcgggccatgcgtcgaaaatcaaggtcatcccgatggatgacatggcgaaacgctatgccagcggctcgcttgcgccgaaaaccgcc

SEQ ID NO: 45409 - DNA, 672 bp, Rhodobacter capsulatus
aaggcgctgatcttcgacgttgacggcactttggcggaaaccgaggaagtgcatcggcaggccttcaacgagactttcgcggcccagggactggactggcactggtcgaaggaagattatcggacgcttctgcgcaccaccggcggcaaggagcggatggcgaaacatcgggagaccgtgggctccggcccctccgatgtggacatcgccgcgctgcaccaagcgaagacgcaacgctatgtcgagatcatcgcctcgggtcaggtcggcctgctgcccggtgtcgcggcgctgatcgaccgggcaaaagcttcgggacttcgtctcgccatcgccaccacgaccacgcgggcaaatgtggatgcgctgatcgccgccaccttccgcaggcctgccggggacatcttcgaggtgatcgccgccggggacgaggtggcgcagaagaaacccgcccccgatgtctatctgctggctttgcagggtcttggactgccgcccgcggcgtgcctggccttcgaggacagccgtgccggtctcgcctcggccaaggcggccgagcttcgggtggttctgacgccttcggaatacacccgcggcgacgatttcacggccgcagactggctgatccccgatctgacccgcgccgcgaccaaagcgatcccggagctgccc

SEQ ID NO: 45410 - DNA, 771 bp, Rhodobacter capsulatus
atgagcctgaagggcaagacggcggtgatcaccggatccaattcggggatcgggcttggggtggcgcgcgaactggcgcgggccggggccgatgtggtgctgaactccttcaccgatcgccccgaggatcatgccctggccgcagcgcttggcgccgaattcggggtgacggcgcgctacatcaaggccgacatgtcgcagggcgcggagtgccgggcgctggtggcgcaggcgggacgctgcgacattctggtgaacaatgcgggcatccagcatgtggcgccggtcgatcagttcccggtcgagaaatgggatgccatcatcgcgatcaatctcagctcggcctttcacaccacggcggcggccttgccgctgatgcgggcggcgggctgggggcgggtggtcaacatcgcctcggcgcatgggctgaccgcctcgccgttcaaatcggcctatgtggcggccaagcatggcattgtcggcttcaccaagacggtggcgctggaaaccgccgaggagccgatcacctgcaatgcgatctgtccgggctatgtgctgacgccactggtcgaggcgcagatccccgatcagatgaaggtgcacgggatggaccgcgagacggtgatccgcgaggtgatgctgacgcggcaaccctcgaagcagttcgccacggtcgagcaactggggggaacgacggtcttcctgtgtgccgaggcggcggcgcagatcaccggcacgacgatttctgtggatggcggctggacggcgctg

SEQ ID NO: 45411 - DNA, 1002 bp, Rhodobacter capsulatus
atgaccctgatcacccccccctttcccaccaatcgcctgcgccggatgcgccgcaccgaagccctgcgtgacctcgcgcaggaaaaccggttgtcggtcaaggacctgatctggccgatcttcatcaccgacgttcccggcgccgatgtcgagatctcctcgatgccgggggttgtccgccgcaccatggacggcgcgctgaaagcggccgaggaagccgcgacgctgggcattcccgcgatctgcctgttcccctacaccgatccggcggtgaagaccgagacctgcgaaatggcctggcagcccgacaacttcaccaaccgggtgatcgcggcgatgaagcaggcggtgcccgaggtcgcgatcatgaccgatatcgcgctcgatccctataacgccaacggccatgacgggcttgtccgcgacggcatcatcctgaacgacgaaaccaccgaggcgctggtgaagatggcgctcgcccaggccgcggccggggccgacatccttgggccgtccgacatgatggatggccgcgtgggcgcgatccggcaggcgatggaggccgcgggtcacaaggatatcgccattctcagctatgccgcgaaatatgcctcggccttctatggcccgttccgcgatgcggtcggcgcctcaagtgcgctcaagggcgacaagaagacctatcagatgaaccccgccaacagcgccgaggccctgcgcaatgtcgcccgcgacatcgccgagggcgccgacatggtgatggtgaaaccgggcatgccctatctcgacatcgtgcgtcaggtgaaggatgcctttggcatgccgacctatgcctatcaggtctcgggcgaatatgcgatgctgatggcggcggtgcagaatggctggctcaaccatgacaaggtgatgctggaaagcctgatggccttccgccgcgccggctgcgatggcgttctgacctatttcgctcccgcggcggcgaagctgatcggcgcctgaccg

SEQ ID NO: 45412 - DNA, 546 bp, Rhodobacter capsulatus
atgtcgcaaagcggttacgtaatcgaccagatgatctcggccaaagccatcgcggcccgggtcgaggcacttggcgccgaaatcaccgaggccttcaaggacaccgaccgtctggtggtggtgggcctgttgcgcggctccttcgtcttcatcgccgatctgatccgggaaatcggcgtgccctgcgaggtcgatttccttgaggcctcaagctatggcaacgagaccacctcaacccgagaggtccgcgttctcaaggacttgcgcggcataattggcggacgcgacgtgctggtcgtggaagatatcatcgacaccggacatacgatttcgaaagtgatggagatgttgcgggcacgcgcaccgcggcggatcgaatgctgcgccatgctcgacaagccgtcgcgccgcgaggtcgatgtgaaggcgcgctggaccggttttgagatccccgatgaattcgttgtcggctacgggctcgactatgcgcaaaaccaccgcaaccttcccttcatcggcacggtccgcttcaccgatccgcagaag

SEQ ID NO: 45413 - DNA, 1551 bp, Rhodobacter capsulatus
accttccttgagaaatcccccgactggtggcgcggtgcggtgatctatcagatctacccgcgcagctttcaggacacgaatggcgacggggtcggcgatctgcccgggatcacccggcggctggatcacgtggccgggttgggcgtcgatgcgatctggatttcgcccttcttcacctcgccgatgaaggatttcggctatgacgtcagcgattattgcgatgtcgatccgcttttcggcacgctcgccgatttcgacgcgctgatcgcgcgggcgcatgagctcgggctgaaagtgctgatcgaccttgttctgtcgcacacctccgaccagcatccctggtttcaggaaagccgccaaagccgggggaacccgaaagccgactggtatgtctgggccgagccgaaacccgatggtacggcgccgaacaactggctgtcgatctttggcggtccggcctgggcctgggatgcccggcgcgaacaatattatctgcacaatttcctgaccgcgcagcccgatctgaacttccattgccccgccgttcaggaggcgcttctgggcgtggcgaagttctggcttgatcgcggggtggatggcttccggctcgatacgatcaacttctacatgcatgatgccgagctgcgcgacaacccgccactgccggtcgaagagcgcaacgatcagaccgcgcccaaggtcaacccttacaatcaccagcgccatctttacgacaagaaccacccgcagaacattgtttttctgcgaaaattgcgcaagctgatggatggatacaaggccgccgccgtgggcgagatcggcgacagccagcgcggcctcgagatcctgggcgaatacacttctggccccgacgcgatgcagatgtcctacgcgttcgaactcctgtcgggccatgcggccttgagtgccgggtatatcgccgaggtcttccgcaagctcgagaccgtcgcccccgagggctgggcctgctgggcctattccaaccacgatgtcatgcgtcacatcagtcgctggggcctctccgaagccgcggcgcgctgctacacgacgctgctgatgtgcctcaagggctcggtctgcctctatcagggcgaggaactgggcctgcccgaggccgagatcgcctatgaggatctgcaggacccctatggcaaggaattctggcccgagttcaagggccgtgacggctgccgcacgccgatggtctggcagggcaacgatccgcagggcggattttcgacggtgaagccctggttgccggttcccgccgcccattgcgcccttgcgcccgatgttgtcgcaggcgatcccggcgcgctgatccatcattatcgtcaggctatcgcgctgcgccatgcccatccggccttggcaaaggggacgatgaccgggatctcggccgaggcgggcgtgctgcggtttctgcgttcggagggcgaaaccgagctgctttgcctgttcaacctgaccgataatccggcaactgtcagctgcccggggaaatgggaggcgctggagggcgccttgccg

SEQ ID NO: 45414 - DNA, 2145 bp, Rhodobacter capsulatus
aaggcgaccggcaaatgcccggtgatgcatggcgcgatgacggcggcgggggtgtcgaacaccagctggtggccgaatgcgctcaatcttgacatcctgcatcagcatgacaccaagggcaacccgttgaacgggttcgattatcgcgccgcggtcaaggggctcgacgtggcggcgctgcgcgccgatctgcatgcactcatgaccgacagccagccctggtggccggctgactggggccattacggcgggctgatgatccgcatggcctggcacgcggcgggcagctatcgcgcggcggacgggcgcggcggcggcaataccggcaaccagcgctttgcgccgctgaattcctggcccgacaacgtcagcctcgacaaggcgcggcggcttctgtggccgatcaagaagaaatacggcaatgccgtcagctgggccgatctgatcctgttcgcgggcacggtggcttacgagtcgatggggctgaagaccttcggtttcggctttggccgcgaagatatctgggcgccggaaaaggacgtctattggggcgcggaaaaggactggctggcgccgtccgatggccgctatggcgatctggcaaagcccgagacgatggaaaaccccctggccgcggtgcagatggggctgatctatgtgaaccccgagggggtgaacggccagcccgatccggcccgcacggcgctgcatatccgcgagactttcgcgcggatggggatgaatgacgaggaaaccgtggccctgaccgcgggcggccatacggtcggcaaggcgcatggcaatggcgatgccaaggcgctggggccggacccggaagcagccgatgtgaccgatcagggccttggctggtcgaacccgcatatgggcggcaaggcggcgcaggccgtcacctcggggatcgagggcgcctggaccacgcatccgacgcgctgggacatgggctatttcgagatgctcttcggccatgactgggagctgacgaaatcccccgcgggcgcctggcagtggaagccggtgacgatcgccgaggaggcgaagccgctcgatgcgaccgacctgaccacccgccacgatcccctgatgaccgatgccgacatggcgatgaaggtcgatccggtctacaatgcgatctgtcagaagttcatggccgatccggccgccttcgacgacgctttcgcgcgcgcctggttcaagctgctgcatcgcgacatggggccgaaggcgcgctacatcggccccgatgtgcccgccgaggatctgatctggcaggacccggtgccgcagggcccgaccggctgggacgtggccaaggtcaaggcgcagattgcggcttcggggctttcggttgccgatctggtggcgacggcctgggattcggcgcgcaccttccggcagtcggattatcgcggcggcgcgaatggcgcccggatccggctggcgccgcaaaaggactgggcgggcaacgagcccgagcgtctggcgcgggtgcttgcggtgctcgaaccgatcgcggcggcggcgggggcctcggtcgccgatgtgatcgtgctggcgggcaatctgggcgtggaacaggccgcggcggcggcgggtttcgcgctggaggtgcccttcacccccggtcgcggcgatgcgaccgcggcgatgacggacgggccgtcctttgacgtgctggagccggtgcatgacggcttccgcaactggctgaaggcggattacgcggtctcgcccgaggagctgcttctggaccgggcgcagctgatggggctgacggcgccggaaatgacggtgcttctgggcggtctgcgggtcatcggcgccaatcacggggccaatccgcagggcgtcttcaccgagcgtccgggcgtgctttcgaccgatttcttcgtcacgctgaccgacatggggctgagctggcaccgggtcgggggcggctacgagctgcgcgaccgcgccaccggggcggtgaaatacggcgccagccgcgtcgatctggtcttcggctcgaacgcgatcctgcgcgcctatgccgagctttacgcgcaagacgacgccgcgggcaagttcgtgaccgatttcaccgccgcctgggtcaaggtgatgcaggccgaccgcttcgatctg

SEQ ID NO: 45415 - DNA, 807 bp, Rhodobacter capsulatus
gatcttgcagtgaccggggtgcccttcgaccaggccgtcacccatcggccgggcacccgcttcgggccgcgggccatccgcgaagcctcgacgctgcaggccttcgacgcgccctatggctggggcttcgatccgttcagcgagctggcgatagccgattacggcgatctggccttcgactatgcccatacggccagctttcccgaccgggtgaccgatcacatcgcaggcattctggcgcagggcgcgggggtgatcacgctggggggcgatcacttcatcaccctgccgatcctgcgcgcctttgccgcccatcacggccccgtcgcgctggtccatttcgacgcccattccgacagctgggctgatgacgacatgagccggatcgaccacggcaccttcctgtacaaggcgctgaaactgggcttcgtcgcccccgagaccacggtttccgtcggcatccgcaccgacaaccccgacacctgcggcgtgaccattctggatgcgcccttcgtgcatcaggcgggcgtcgccgaaaccgtggcgcggatccgcgcggtggcgggcgaccggccgacctacatcagcttcgacatcgacggcctcgatccggcctttgccccgggcacgggcacgccggtctggggcggtctggccagctggcaggcggcggcgatcctgcgcgggctggccgggatcaatctggtcggcggcgatgtcgtcgaggtctcgccgccctatgaccccaccggcgccaccgcgattgcgggcgcccatgtcgccacggagttgatcgcgctttacggt

SEQ ID NO: 45416 - DNA, 420 bp, Rhodobacter capsulatus
atggccatcgaacgcacgctttcgatcatcaaacccgacgcgacgcgccgcaacctcaccggcaagatcaatgccaaattcgaggaagcgggcctgcgcatcgtcgcgcaaaaacgcatcaagctgagcctggaacaggccggcaaattctacgaagtgcacaaggaacgccccttctatggcgagctgtgcgaattcatggcgtccgagccggtcgtcgtgcaagtgctcgaaggcgaaggcgcgatcgccaagaaccgcgaagtgatgggcgccaccaacccggccaacgccgtcgatggcaccatccgcaaggaattcgccctctcggtcggcgaaaactcggtccacggctcggatgcgccggaaaccgccgcggtcgaaatcgccttcttcttctcgggcctcgaactggtcggc

SEQ ID NO: 45417 - DNA, 1278 bp, Rhodobacter capsulatus
atgagcacgatcatcgacatccacgcgcgcgaaattctcgacagccgcggcaatccgaccgtcgaggtggacgtcaccctcgaagacggcacgatgggccgggccgccgtgccctcgggcgcctcgaccggcgcgcatgaggcggtggaacgccgcgacggcgacaagtcgcgctacatgggcaagggcgtgctggaagccgtgatggcggtcaatggcgagattgccgagaacctggtgggcgaggacgtcaccgatcaggaaggcatcgacaagctgatgatcgagcttgatggcacccacaacaagggccgtctgggcgcgaatgcgatccttggcgtctcgctcgcctgcgccaaggccgcggccgatttcaccgcgcagccgctttaccgctatgtcggcggcacctcggcccgcgtcctgccggtgccgatgatgaacatcatcaacggcggcgaacatgccgacaacccgatcgacattcaggaattcatgatcatgccggtcagcgcgggcaatatccgcgacgccgtgcgcatggggtccgaagtcttccacacgctgaagaaagagttgtcggccaagggcctctcgactggccttggcgacgagggcggctttgcgccgatgctcgcctcgacccgcgacgcgctcgacttcatcctgaaggcgatcgaaaaggcgggctacaaaccgggcgaggatatctatctggcgcttgactgcgcctcgaccgaatatttcaagggcggcaaatacgagatgaagggcgagggcctgtcgctgacctcggccgagaatgtcgattacctggccaagctttgcaccgaatatccgatcatctcgatcgaggacggctgcgccgaggatgactgggaaggctggaagctgctgaccgatgcgctgggcgacaaggtgcagctggtcggcgacgatctgttcgtcaccaacccggcgcgtctggccgagggcatcaagaaaggcgtcgccaatgcgatgctggtgaaggtgaaccagatcggctcgctttccgaaacgctgaaggcggtcgagatggcgcatcgcgcgcgctacaccaacgtgatgtcgcaccgttcgggcgaaaccgaggatgcgacgatcgccgatctcgccgtcgccacgaactgcggccagatcaagaccggctcgctcgcccggtcggaccggctggcgaaatacaaccagctgatccgcatcgaggaaatgctgggcgagaccgccgaatacatgggccgcgccattctgaagtaagcc

SEQ ID NO: 45418 - DNA, 1188 bp, Rhodobacter capsulatus
atggcttggaaaacgctcgacgagatggatcttgcgggcaaggtggtgctcgtgcgcgtcgatatcaacgtgccggtggaaaacggggtggtgaccgacgcgacgcggatcgaaaagatcgcgcccacggtcaaggacatccttgccaaggggggcaagccggtgctgctggcgcatttcggccgcccgaaaggcaagccggtgccggaaatgagcctgcgtccgctggtgccggaactggccaaggcgctgggcgtgccggtgaaattcgccgaagactgcatcggtgccccggcgaagaccgccgttgcggcgctggccgcgggcgaggtgctgctgttggaaaacacccgcttccatgccggtgaggaaaagaacgatcccgagctgagcgccgcgatggccgcgctgggcgaggtctatgtgaacgacgccttctcggcggcgcaccgggcgcatagctccaccgaaggcgtggcgcatatccttccggcggtggcggggcggctgatggcggccgagctgaaggcgctggaagcggctttgggcaatccggtgcgtccggtctgcgccgtggtgggcggggccaaggtctcgaccaagcttgatcttttgggcaatctggtgaccaaggtcgatcatctggtgatcggcggcggcatggcgaacaccttccttgtggcgcagggcatcgatgtcggcaagtcgctggcggaacgcgagatggcggaaaccgcgcgcgagatcctggaaaaggccgccgcggcgggctgtgcgattcacctgcccgccgatgtggtggtggcgcgcgagttcaaggcgggcgccgagaacgaggttgtcggcaatgccgattgcccggccgatgcgatgatcctggatgccgggccgaaatcggtcgaggaaatcgccaaggtcttcgaggcgtcgaagacgctgatctggaacgggccgctgggcgccttcgagatcgcgccctttgacgcggcgacgaatgcggcggcgcaaaaggcggccgatctgaccaaggcgggcaagctcgtgtccgtcgcgggcgggggcgacaccgtggcggcgctgaacaaggcgggcgcggccgaggatttcagctatatctcgaccgcgggcggggccttcctggaatggatggaaggcaaggaactgcccggcgtcgcggcgctgatgaaa

SEQ ID NO: 45419 - DNA, 945 bp, Rhodobacter capsulatus
tcgaaggaagaattgctcacatattaccgtgacatgctgatgatccgccggttcgaggaaaaggccggtcagctttatggcatgggcctgatcggcggtttctgccatctgtatatcgggcaggaagcggtggtcgtggggctggaagccgcgacgaagccgggcgacaagcgcatcacctcgtatcgcgatcacggccacatgctggcctgcggcatggaccccaagggcgtgatggcggaactgaccgggcgcgaggggggcttgtccaagggcaagggcggctcgatgcacatgttctcgaaagaaaagcatttctacggcgggcacggcatcgtcggcgcgcaggtgccgctgggcgcggggctggccttcgccgacaaatatctgggcaatgacaatgtgacgtttgcctatttcggtgacggcgcggcgaaccagggccaggtctacgagaccttcaacatggcggcgctttggaagctgccggtgattttcgtgatcgaaaacaaccaatatgcgatggggacggcgcagaaacgctcgacctcgacgcccgacatctacatgcgcggcgaggctttcggcattccgggcgagatcgtcgatggcatggatgtgctggcggtgaaggcagcctcggaaaaggcggttgcgcattgccgctcgggcgcggggccgtacattctggaagtgaaaacctatcgctaccgcggccattcgatgtcggacccggcgaaataccgcacccgcgaggaagtgcagaagatgcgcgacgaacgcgatgcgattgaaaacgtgcgggagttgctgatttcctcgggtcaggcgacggatgaggacctcaaggccatcgaccgcgagatcaaggcgatcgtgaacgaggcggcggagttttcgaaggaaagccccgagcccgcgttgaccgagctttggaccgacatt

SEQ ID NO: 45420 - DNA, 1351 bp, Rhodobacter capsulatus
atggcaattgacgtgttgatgcccgcgctgtctccgacgatggaagagggcacgctggcgaaatggctggtgaaggcgggggatgtggtcaaatcgggccagatcctcgccgagatcgagaccgacaaggcgacgatggaattcgaggcggtggacgagggcacggtggtggaactgctggtggccgagggcacttcgggggtgaaggtgaatgcgccgatcctgcggctttcgggcgagggtgtcgaagcggcgcccgtgccgaaggcggcgccggtggcgaaggcccctgccccggttgtggcggccccggtcgcggcggcgccggtcgtgtcgaaagcctcggccgattggccggaaggcacggcgatgaagacgatgtcggtgcgcgaagctttgcgcgaggcgatggctgaggagatgcgggccgatcagacggtgttcctgatgggcgagaagtcggcgaatatcagggcgcctacaaggtgtcccaagggctgcttgatgaattcggcgcgcaacgggtgatcgacacgccgattacggagcatggcttcaccggcatcgcggtcggcgccgcctttggcgggctgaagccgatcgtcgaattcatgaccttcaacttcgccatgcaggcgatcgaccagatcatcaactcggcggcgaagacgctttacatgtcgggcggtcagctcggctgtccgatcgtcttccgcggcgcgaacggggcggcggcgcgcgttgcggcgcagcacagtcaggattatgccgcctggtatgcgcagatccccggtctgaaagtggtgatgccctattcggcggccgatgcgaagggcttgctgaaatccgcgatccgcgacccgaacccggtgattttcctcgaaaacgagatcctgtacgggcggtccttcgaggtgccggtgcttgacgatttcaccgtgcccttcggcaaggcgcggatctggcgcgagggcaccgatgtcacgctcgtcagtttcggaatcgggatggcgcatgcgctggaggccgccgacaagctggcggccgaggggatctcggccgaggtgatcgacctgcgcaccctgcggccgattgactatgatacggttctggcctcggtgatgaagacgaaccgctgtgtcacggtggaggaaggctggccggtgggttcgatcggcaaccatctgtccgcaacgatcatggaacgcgcgtcgattatctcgatgcaccggtgatcaactgcacggggaaagacgtgccgatgccctatgcggcgaaccttgagaaactggcgctggtgacctcggacgaggtcgtcgcggcggtcaaacgcgtctgctatcggtgaggg

SEQ ID NO: 45421 - DNA, 1251 bp, Rhodobacter capsulatus
atggctgtggaaatcctgatgcccgctttgtcccccacgatggaggagggcacgctggcaaaatggctggtcaaggaaggcgatgcggtcaaatcgggccagatcatcgccgagatcgagaccgacaaggcgacgatggaattcgaggcggtcgatgaaggcgtgatcggcaagcttctggtggccgagggcacttcgggggtgaaggtgaatgccgccatcgccgtgctgatcgaagagggcggcagcgccgaggttgcgccggtggcgaaggccgcggcccctgccccggtcgcagcgcctgcggtggcgacgcccgcggcgccggtcgtgccgaaagcggcgggcgcgcggatcttcgcctcgcccttggcgcggcggattgcggccgacaaggggctggatctggcggcgatttcggggtccggcccgcatgggcggatcgtcaaggccgatgtcgaaggcgcggtggcgaaacccgcgcctgcggcggctccggtccttgtggcggcccctgctccggcacccgtctcggctgcgacggtcgcgaagctttatgagggccgggcctataccgagatcccgctcgatggcatgcgtcgggtgattgcggcgcggctgaccgaggcgaagcagacgatcccgcatttctacctgcgccgcgaggtgcgtctggatgcgcttttgtccttccgcgaggagctgaaccggcagctttcggcgcgcggcgtcaagctttcggtgaatgatttcatcatcaaggccagtgccctggcgctgcaggcgattccggcggcgaatgcagtctgggcgggggatcgggtgctgcagatgcaggcctcggacgtggccgtggccgtggcgatcgagggcgggcttttcacccccgtgctgcaggatgccgatacgaaatcgctgagccagctgtcggcgcagatgaaggatctggccaagcgcgcgcgggaccggaaactcgccccgcacgaatatcagggcgggtcgtttgcgatctcgaacctggggatgatggggatcgaaagcttcgacgcggtgatcaacccgccgcatggcgcgattctggccgtgggcgcgggggtgaagaaacccgtggtgagcgcttcgggcacgatcgaggtggccacgatgatggcgctgacgctctcggtcgatcaccgggtgatcgacggcgcgctgggggccgagcttctggccgcgatcgtgtccaatctggaaaacccgatggcgatgctg

SEQ ID NO: 45422 - DNA, 1052 bp, Rhodobacter capsulatus
gacccgaaagagcaacgcaaggtggacgagttcatcctttacggcgtggctgcgcgggtgcaggcggtgaaggattccggctgggagcccgaggacgaggaagcccggtgccggaccggcgtgatgatcggctcgggcatcggcgggttgcagacgattgccgaaaccgcggtgctgatcaaggagaaggggcccaaacgcgtcagcccgttcttcatcccggcggcgctgatcaacctggtctcggggcaggtttcgatccgcttcggcttcaaggggccgaaccatgcggtggtgacggcctgcgcgaccggcgcccatgcgatcggcgatgcggcgcggctgattgcgcttggcgatgccgatgtgatggtggcgggcggcgccgagaacccgatttcggaaatcggcattgccgggttcaacgcctgcaaggcgctctcgacgaagcgggcggacgaccccaaggcggcaagccgcccctgggatgcggaccgcgacggtttcgtgatgggcgagggcgcgggctgtgtcgtgctggaagaatatgaacacgcgaaaggcgcggcgcgaagatctatgccgaggtgctgggctatgggctctcgggcgatgcctatcacatcaccgcgccgtccgaggatggcgacggcggcttccgcgcgatgacggcggcggtgaagcgcgcggggattgatccgggcgagattgattacgtcaatgcgcatggcacctcgaccatggccgacacgatcgagctgggcgcggtcgagcggcttttgggcgatgcggcctcgaaggcgacgatgtcgtccacgaaatcggcgatcgggcatttgctgggggctgcgggcgcggtcgaggcgatcttctgcattctggcgatccgcgatcaggtggcgccgccgacgctgaacctcgacactccggcggtggcggcgaagatcgatctggcgccgaaagtggcggtgaagcgcaagatcgacgtggcgatgtcgaacagcttcggctttggcggtaccaatgcggccttgatcctgggcaaggtgcgc

SEQ ID NO: 45423 - DNA, 228 bp, Rhodobacter capsulatus
atgagcgacatcgcggatcgtgtgaagaagatcgtcgtggagcatctgggcgtggaagaggacaaggtcaccgagaccgcctcgttcatcgacgatctcggcgccgacagccttgacaccgtggaactggtgatggctttcgaagaagaattcggcatcgagatcccggatgacgccgccgaaaccatccagacctttggcgatgcggtgaaattcatcaccgaagcc

SEQ ID NO: 45424 - DNA, 739 bp, Rhodobacter capsulatus
atgtttgatctgactgggaaatcggcgctggtgacgggcgcttcgggcggcattggcggcgaggtggcgaaggcgctgcatgccgccggggccaaggtggcgctgtcgggcacgcgggtcgagccgctggagaagctggcggcggactgggcgagcgggcctttgtctgccccgcgaacctctcggacccggcctcggtcgaggcgctgccgaagggccctcgaggcgatgggtctgtggatatcttgtgacacgcgggatcaccgggataacctgttcatgcggatgtcggacgaggaatgggcagcgtgatcgacgtcaacctgacggcctcgttccggctgacgcgcggcgtgctggccccatgatgaaggcgccgctgggggcggatcgtcaatatcacctcggtcgtggggcaaccggcaacccggggcagggcaattatgccgccgccaaggcggggctgaccggcatgtcgaaatcgctggcctatgaagtcgcaagccgcggcatcacggtgaactgcgtcgcgccgggcttcatcgccacggcgatgaccgacaagctgaacgacgagcagaaggcgaagatcctgacgcagatcccggccgggcggatgggcgcggccgaggagatcgcggcggcggtgctttatctggcctcgcccgaggcgggttatgtcaccggcacgacgctgagcgtcaacggcggcatggcgatgatctgaggcccgccggtg

SEQ ID NO: 45425 - DNA, 906 bp, Rhodobacter capsulatus
gtggcatgggtgttccccggtcagggggcgcagactatcgggatgggcaaggcgctggccgaggcctatccggcggcgaaggcggtctttgacgaggtcgacgcggctttgggcgaaaagctgagcgcgctgatctgggagggcgagatcgagcggctgaccctgacggccaatgcgcagccggcgctgatggcgacctcgctcgccgccgttgcggcgctgaaagcggaaggcatcgaggtggggcaggcggcctttgtggccgggcacagccttggggaatattcggcgctgtgtgcggcgggggccttgagcctggccgatacggcgcggcttttgcgcatccgcggcgaggcgatgcaatcggcggtgccggtgggcgtgggcgcgatggcggctttgctggggctcgatttcgccaccgcggccgaggttgcggccgaggcggcgcagggcgaggtctgtcaggccgcgaatgacaacgacccggcgcaggtggtggtgtcgggccacaaggcggcggtcgagcgcgcggtcgagatcgccaagggcaagggcgcgaagcgggcggtgatgctgccggtctcggcgcccttccactgcgcgctgatgcagcccgccgccgaccggatggccgaggctttggcggcggtgacggtgtcggcgccggtcgtgccggtggtggcgaatgtgcgcgccgaggccgtgtgcgaccccgcgaccattcgtcagctgctggtggaacaggtcaccggatcggtgcgctggcgcgagtcggtgctgtggatggtgggccagggcgtgaccgacttctgcgaagtgggcgcgggcaaggcgctgtcggggatgatcaagcgcatcgccaaggacaccacgcaaaaggctgtcggcacgcccgaggatgtg

SEQ ID NO: 45426 - DNA, 1731 bp, Rhodobacter capsulatus
ctggccgcggtggtggccctgacatgtttcggcaccgcgcaggcgggcggcgtgaccgaggaggatctgcgcaacgaccagcagaccgcgggcgacgtggtgacgaacgggatggggcgcgatctgcagcggttcagcccgcttgccacgctcaaccgcgacaacgtcaagaacctgatgcccgcctgggccttcagcctgggcggcgagaagcagcgcggccaggaaagccagccgatcgtctatgacggcgtcatgtacatcaccggctcctattcgcggctttacgcgatcgacatccacaccggcaaggagatttggcaatatgacgcccgcctgcccgagggcatcctgccctgctgcgacgtgatcaaccgcggcgcggcgatctatggcgacaatgtctatttcggcacccttgatgcccgcatcgtcgcgctcgaccgcaagaccggcgatgtgaaatggaacaagaagatcgccgattacaaggaaggctattcctacaccgccgcgccgctgatcgtgaacgggctcgtcatcaccggcaattcgggcggcgaattcggcatcgtcggcgaggtgcaggcgcgcaatgcggagacgggcgagctggtctggacccggccgatgatcgagggccacatgggcacgctgaacggcaagccctcgacgatgacgggcacgctgaacgcgacctggccgggcgatctgtggaagaccggcggcggcgccacctggcttggcggcagctatgatgccgagaccgacacgctggtcttcggcgcgggcaacccggcgccctggaacagccatctgcgcaacgcgggcacgcccaccgagggtaacaagggcgacaacctttacgccgcctcgcgcgtggggatcgacccggcgacgggcgagatcaagtggcacttccagaccaccccgcgcgagggctgggatttcgacggcgtgaacgaggtggtgggctttgtcgacaaggacggcaacaagcgctttgccaccgccgaccgcaacggtttcttttatgtgctcaaccgcgcggacggcaaattcgtcaacgcctggcccttcgtgaagaacatcacctgggccaagggcatcgatgaaaccggccgtccgatctacaacgaggagaaccgccccggtgcccccgatgccgcggccgaagcggccaagggccagcagatctttgccgtgccctcgttcctgggcggcaagaactggatgccgatggcctacagccagaccacggggctcttctatgtcccctcgaacgaatgggggatggatatctggaacgagccgatcaattacaagaagggcgcggcttacctgggcgcgggcttcacgatcaagccgctcttcgaggattacatcggctcgctcaaggcgatcgatccgaatacgggcgcggtgaaatgggaatacaagaacgacgcgccgctgtgggggggcgtgatgaccaccgcgggcaagctggtcttcaccggcaaccccgagggcgagttcatggcgctggacgcggaaaccggcgaaaagctgtggtcgttccagaccggctcgggcatcgtcggccagccgatcacctgggaacaggacggcgagcaatatgtctcgatcatctcgggctggggcggcgcggtgccgctttggggcggcgaagtggccaagcgcgtcaactatctgaaccagggcggcacggtctggaccttccggctgccc

SEQ ID NO: 45427 - DNA, 426 bp, Rhodobacter capsulatus
gatctgagcctgatcaagcggatcatcccgcaccgttaccctttcctgatggtcgacaaggtgcgcgacatcgtgcctttcgaaagcgcggtggggatcaaatgcgtgaccaacaacgagccgcaattcaccggccatttccccgaggaaccggtgatgccgggggtgatgatcgtcgaagccatggcgcagacggcggcggtggtcgtgggcatttcgatgaacgtgatcgacaagccgcttggcacctatttcatggcgatcgacggctgcaagttccgccgcaaggtggttccgggcgacgttcttgaaatgcatgtcacggtcaagcgcggcggcggcaaggtgtggaaattccttggcgaatcctttgtcgaggggcagctggcggcgaccgccgaattcaccgcgatgatggatctgaag

SEQ ID NO: 45428 - DNA, 1482 bp, Rhodobacter capsulatus
tcgcccttcaagccgcgctacgacaatttcatcggcggcaaatggaccccgccggtcgggggcaagtatttcgacaacatcacgccgatcaccggcgagaagatctgcgaagttgccgcctcgaccgcggcggatgtcgagctggcgctcgatgccgcccatgccgcgaaaggcgactggggcaccacctcggccgcgcatcgctcgaacgtgcttttgaagatcgccgaccggctggagcagaaccttgacctgctcgccgccgccgagacctgggacaacggcaagccgatccgcgaaaccaccgccgccgatatccccctttccgtcgaccatttccgctatttcgcgggggtgctgcgcgggcaggaaggctcgatgtcggaaatcgacaatgacaccgtcgcctatcactatcacgagccgctgggcgtcgtcgggcagatcatcccgtggaacttctcgatcctgatggcggcgtggaaactggccccggcgctggcggcgggcaactgcatcgtgctgaaaccggccgaacagaccccctccgcgatcatggtgctgatcgacgtgatcaaggacctgctgccgccgggtgtgctgaacatcgtcaacggcatgggccccgatgtcggcgcgccgctcgcgcgctcgaaccggatcgcgaagatcgccttcaccggctcgaccgagaccggccgcaagatcatgcaatatgcgaccgagaacctgatcccggtgacgctggagctgggcggcaagtcgccgaacatcttcttttcggatgtgatggcgaaagatgacgccttcctcgacaaggcggtcgagggtttcgttctgttcgccttcaaccagggcgaggtctgcacctgcccgtcgcgcgcgctcattcaggaggacatctacgaagagttcatcgcccgcgccattgcccgggtgaaggcgatcaagcagggcgacccgcgcctgatggagacgatggtcggcgcgcaggccagccaggaacagcaggacaagatcctgtcctatctcaagatcggccgcgaggaaggcgcgcaggtcctgtgcggcggcgatgcggcaagccttggcggcgatctggcgaacggcttctacatccagccgacgatcctcaagggtcacaacaagatgcgggtcttccaggaggaaatcttcgggccggtcgtgtcggtgaccaccttcaaggacgaggacgaagccctgcatatcgccaatgacacgatgtacggcctgggcgccggcgtctggtcgcgcgacatcaacacctgctaccgctttggccgccacatccaggccgggcgcgtctgggtgaacaactaccacgcctatccggcccatgcggcctttggcggctacaagcaatcgggcatcgggcgtgaaacccacaagatgatgctcgatcactaccagcagaccaagaacatgctggtcagctacaacccgaacaagctgggcttcttc

SEQ ID NO: 45429 - DNA, 731 bp, Rhodobacter capsulatus
cgcagaaaattggccgcgggcaactggaagatgaacggcaccaaggcaagcttggccgaagtggcggcgctgatcgcggcgcatcccgatccgaaatccgaagttctgctgtgcccgcccgcgacgctggtcgcggcgatggtggcgacggcggcgggcaggatcgcggtcggcgggcaggattgccacatgaaggccgcgggcgcgcataccggtgacatcgcggccgaaatgctggccgattgcggcgcctcccatgtgatcctcggccattccgaacgccgcgccgatcatggcgaaagctcggagatggtttgcgccaaggccaccgctgccgcgccgcgggtctggtcgcggtgatctgcgttggcgagaccgaagcgcagcgcgatgcgggcgagacgctggcactggtcggcgcgcagctggcgggctcggttccggacggcgccaccgcggcgaatactgtcatcgcctacgaacccgtctgggcgatcggcaccggccgcacgccgacgctggaacagatcgccgaagtgcatgatttcctgcgcgcggaactggtcgcgcgcttcggcgccgagggcgaaggcatgcggcttctttacggcggctcggtgaaaccctcgaacgcgaccgagatctttgccacctcgaatgtcgatggcgcgctggtgggcggcgcttcgctcaaggccgccgatttcggcgcgatcctgagcgcgctcgac

SEQ ID NO: 45430 - DNA, 1638 bp, Rhodobacter capsulatus
atgtatgaatattccgacttcgacgaagccttcgtgcgcaaccgcgtggcgcagtttcgcgatcaggtggcgcgacggctggacggcagcctgaccgaggaggaattccgcccgctgcggctgatgaacgggctttatctgcagctgcatgcctacatgctgcgcgtcgccatcccctatggcacgctctcgtcgaaccagatgcgggcgctcgccgatgtggccgaccggttcgaccgcggctatggccatttcaccacccgccagaacatccagttcaactggatcaagctgaccgacacgcccgacattctggagcggctcgccgatgacgggctgcatgcgatccagacctcgggcaattgcatccgcaacgtcacgaccgacgcctttgccggggccgccgcggatgaaatcgaagacccccgcccctatgcggagctgatccggcaatggtcctcggatcatgccgaattccagttcctgccgcgcaagttcaagatcgcgatcaccggcagcccggaggaccgcgccgcgatccgcgcccatgatgtcgggctgcaactgatccagcgcgggggcgaaaccggctttcgcgtgctggtgggcggcgggctggggcgcacgccgatgctggcgcccgagctgcgcgatttccttccgaaagccgatctgctgccctatctggaggcgatcctggccgcctacaacctgatcgggcggcgcgacaacaaatacaaggcgcggatcaagatcaccgtcttcgagaccgggatcgagcccttccgcgatctggtagagcaggaattcgagcgtatccgcccgcaattcaccggcgccgatcaggcgcttctggcggaaatcaccccgcatttcgccctgcccgatctggtcgcgaaagaccccgccccctttgccgcggcgcaggtcaccgacccggctttcgcggcctgggtcaagcactcggtcaccgatcacaagcgccccgatcatgcggtggtgacgatctcggtcaagaccccgggcgaggaaccgggcgatgtctcggcggcgcagatgcgggccgttgccgatctggccgatctgcatggctacggcgagctgcggatttcccacatgcagaacatcgttctgccccatgtcgcgcgcgccgatctgcccgcccttcatgccgcgctgcgcaaggtcgggctggcggcggcgaatgtcgggctgatttccgacatgatcgcctgcccggggatggattactgcgcgctggccaccgcccgctcgatcccgctcgcgcaagagatcgcgcagcatttcgagacgctggggctggtcgaaaccatcgggccgctgcctctgaaaatctctggctgcatcaatgcctgcggtcatcaccatctgggcgccatcggcatccttgggcttgatcgcgccggggccgagaattaccagatcacccttggcggtgccgagggccccgaagccgcgatcggcgaaaagatggggccgggctttgcctatgacgcggttgtcccggcgatcgagcggctggtgcgtgcctatctgacgcttcggctttcggagggcgaaaccttccttgccgcgctgcaccggcttggccgcgagcccttccgcgccgcgctttat

SEQ ID NO: 45431 - DNA, 625 bp, Rhodobacter capsulatus
ttcggtgatggaaaaggcgctggccgatcccgacaccgggcgggtggcgatggtcagctcgttcggcgcggaatcggtcgtgcttttgcacatggtctccttgatcgccccggcgacgccggtgcttttcgtcgacacgatgatgctgtttccggaaacgctcgcctatcagcaggaggtcgcctcgaaactgggcctgtcggagattcgcaccatccgcgcgaccaaggccgcgctggcgctggatgaccccgacggcacgctttatcagttcaacaccgatgcctgctgcaatctgcgcaagaccgtgccgctggaaaccgcgcttgcgggttttgacgcctggatcaccgggcgcaagcgttatcagggcgcgacccgggccgagatcgatttctttgaagtcgaaacccccaaccggatgaagatcaatccgctggcgcattgggggcgcgaggatctggaagaatacatggtgcaaaaccgcctgccccggcatccgctggtggccaagggctatccctcgatcggttgcgcgccctgcacctcgccggtgaaaccgggcgaagatccgcgcgcaggccgttggcgcggctcgcaaaagaccgaatgcggcatccatttc

SEQ ID NO: 45432 - DNA, 1474 bp, Rhodobacter capsulatus
atgaaagagatcggacattggatcgacggcaagatggtcgcgggcacttcgggccgctttgccgaggtgatgaacccggccacgggcgaggtgcgggcgaaagtggcgctggccaccaaggcggaacttgacgccgccgtcgccgccgccgaacgcgcgcagcccggctgggccgcaacgaacccgcagcgccgcgcccgggtgatgatgaaattcgccgatctgatcaacacccatatggacgagctggccgaactcgtctcggtcgagcatggcaaggtgctggccgatggccgcggcgacgtgcaacgcgggctcgaggtgatcgaggtctgcatgggcgcacccgcgatgctgaagggcgaatataccgatggcgcgggtccggggatcgacatctatgcgatgcgccagccgctgggcgttgtcgcggggatcacgcccttcaacttccccgccatgatcccgctgtggaaaatgggtccggcgctctcggcgggcaatgcgatggtgctgaaaccgtccgagcgctgcccctcgaccgcgctgcgtctggcggaactggccaaggaagcgggcctgcccgatggcgtgctgcaggtggtgaacggcgacaaggacgcggtcgatgcgatccttgacaacgagaccatccaggccgtgggctttgtcggctcgacgccgatcgcgcaatatatctatggccgcgcctgtgcgaatggcaaacgcgcgcagtgctttggcggcgccaagaaccacatgctgatcatgcccgatgccgacatggacaaagccgccgatgcgctggtgggcgcgggctacggtgcggcgggggaacgctgcatggcgatctcggtcgcggtgccggtgggcaagggcacggccgaggcgctgatctcgcggctgatcccgaagatcgaaaagctgaaggtcggccccttatacgggcggcgccgatgtcgatttcgggccggtgatcaccgcacaggcgcgtgaccggatcgaggggctgatcgcctcgggcgtggaacagggcgcgcaactgctcatcgacgggcggggcctgacgatccagggctatgaaaacgggttctacaccggcccgtcgctgttcgaccacgtcacccccgagatggagatctacaagcaggagatcttcggcccggtgctgagcgtcgtgcgcgccgagagctacgaggaggcgctgaagctggtcatggacaacgactacggcaacggcacggcgatcttcacggcggatggcgacaccgcgcgcgatttcgccagccgggtcaatgtcggcatggtcgggatcaacttcccgatcccggtgccgctgtcctattacagcttcggcggctggaagaaatcggcctttggcgatctgaaccaatacgggcccgacgccttccgcttctacaccaagacgaaaaccgtcactgcgcgctggttctcggggatcaaggatggcgtg

SEQ ID NO: 45433 - DNA, 1299 bp, Rhodobacter capsulatus
gcccatcacatgcacccgttcaccgatggcgacggtctggcgaagaaaggcgcgcggatcatcaccaaggcgaaaggcgtctgggtgaccgacagcgaaggcgcggaaatccttgacggaatggccgggctctggtgcgtcaacgtcggttatggccgcgaagagctggtcgaggcggcggcgcggcagatgcgccagctgccgttttacaacaccttcttccagacctcgcatatcccggcgatccagctggcgaagcgtctggcagagcttgccccgggcgatctgaaccatgtcttcttcaacggctcgggctcggattcgaacgacaccaacatccgcatggtgcggcgctactggcaggcgctggaaaagcccgaaaagaatgtgatcatttcgcgctggaacggctatcacggctcgaccatgggggcggccagcctcggcgggatgaagggcatgcatgcgcagggcgggctgccgatcccgggcgtcgtgcatatcgaccagcccgactggtggtcggagggcggcgatctgacccccgaggcgttcggtctggcccgcgcccgtcagcttgaggaaaagatcctggagatcggcgccgaaaacgtcgcggccttcatcggcgagccggtgcaggggccgggcggcgtgatcgttccgcccgcgacctactggccggaaatccagcgcatctgccgccaatacgacatcctgctgatcgccgacgaggtcatcaccggctttggccggaccggcaactggttcggctgccagaccttcgggatcacgccggacatcatgacggtggccaagggtctgacctcgggctacatcccgatgggcgcctcgatcgtctcggacagggtcgcggcggtgatcaacggctcggatgaattcgcgcatggctacacctattcgggccatccggtcgcggccgccgtcgcgctggagaacctgcgcctgctggacgaggacggcatcgtcgcccgcgtggcggcggaaaccgcgccttacctcaaggcgaaatgggaaggtctggcggcgcatcccttggtgggcgaggcgaagatcgtcggcatgatgggctcgatcgcgctgacgccgaacaaggaaacccgggccaaattcgcgtcgaaatccggcacggtcggctatatctgccgcgagcgctgctttgccaacaacctcgtcatgcgccatgtcggcgaccggatgatcatttcgccgcctctggtcatcacccccgccgaaatcgacatcctgatcgcgcgggcgttgaaatcgctggatgaa

SEQ ID NO: 45434 - DNA, 2217 bp, Rhodobacter capsulatus
gtcggcggcatggattgcgccgcctgtgcgggcaaggtccgcagcgcggtggagcggctgccgggcgtcgaggcggtggagatcgcgctgatgagcgagcggctgcgggcgcggctgaccccgggcgcgaccagcccgggcgagctggaacgcacggtgacgcggctgggttacacgatcacccgcatcggcgccgcgccgccgctgccgctgctgaaaccccgccacgatcacgggcatgaccacgggcatgacgggcacgaccacggcggcgccccggcctgcggctgtggcggttgcggctgcggtgcggcggcccccgcgcccgcgccggcccccgaagtgaccgccgaagtgaccgccgcgcccctgccgcccgccgcgccctggctgcgcgggccgaaggcggcgcggctgttctggtcggcgggcgggctcgccctcgcctggggcgtcgcgctgatgctgcccgcgctggcggcgcctgccttcgcgctggcctgtctgggcgcgctgttcccggtggcgcggcaggccctggcgctggcacgggtcgggcagcccttcagcatcgagatgctgatgacggtggcggccatcggcgcgctgatgatcggcgccgcggccgaggcggcgatggtggtggtgctctttgctctgggcgagcttttggaatcgattgccgccgcccgcgcgcgcgacgggctgcgggcgctggcccggcagatgccggaaaccgcgcttctggagcgggacggacagacgcgcgaggtggcggcggcgaccctgcagccggggcagatcctgcggctgcgcccgggcgaccgcgccccggtcgatgccgagatcgtcgagggggtctcgggcctcgatgaaagcgcggtgaccggggaaagcgtgccggtgacgcgcggcccgggcgaccgggttctggcgggctcgatcaacaccgaggcgctgttgcggctgcgggtgacgcgcgcggcggcggacagcacgctggcgcggatcgcgcggatggtggccgaggccgaggcggccaaggccccggtcgaacgcttcatcgaccgcttcagccgctggtacatgccgctgatcgtcggtctggcggcgctggtggcggtgctgccgccgctcttgaccggggcggattggggcgtctggatctatcgcgcgctggcgctgttgctgatcggctgcccctgcgcgctggtgatttcggtgcccgcggcgatggcggcggcgctctcgaccggggcgcggcgcgggcttctggtcaagggcggcgcggtgatcgaggcgctggcgcggctgcggcttgtggcgctcgacaagaccggcacgctgacgccgggccgcccgcttgtgaccgatcttcggcccgccgccggggttgcggtcgccgatctgctggcccatgcggcggcggtcgaggcggggtcctcgcatcccctggcgcgggcgatcctggcacgcgccgcagccgagggggtgacggcccccgccgccacggccgcccgggtgatcccgggggtgggggccgaggcgcagatcgccggggcgctgtggcgcattgcggcgcctgccgcgggcaacccgcaggcggcggcgctgcaggccgaggcgaagacggtggtcgaactttgccgcgacggcgttccgcaggggctgattgccctgcgcgacgagccccggcccgaggcgggcgcggcgctggcggcgctgcgggcgcttgggctggacagcgtgatgctgaccggcgatgccgaggccccggcgcgggcgctggcggcgcccttggggcttgcggtcaaggcggggcttctgcccgaggacaaatgcgccgaggtgacgcggctttcggcgcaggggggcgtgctgatgctgggcgacggcatcaacgacgccccggcgctgcgggcggccgatgtcggcgtggcgatcggggcggggaccgatgtggcgatcgagaccgccgatgcggtgctgatgcgcaacgacctgaccgatctgcccgcgctgatccggctgtcgcggcagaccctgggcaacatccgccagaatgtcgccatcgcgctggggctgaaggcggtgtttctggtcacctcggttttcgggatcaccgggctctggatcgcggttctggccgataccggggcgacggtgctggtgacggcgaatgcgctgcggctgctgcgctatgatccgcgccgcgcg

SEQ ID NO: 45435 - DNA, 615 bp, Rhodobacter capsulatus
gtcgaggcccgctcgggcaaggcgacctcggcggtgatcttcctgcatggctatggcgcggatggcgacgacctgctgggtctggccgagccgctcgccccgcatctgccgaacacgctgttcctcgcccccgacgcgcccgaggagtgcgtgaccaatccctttgggcggcaatggtttccgatcccgtggctcgatggctctgcccccgaagaggccgccgcggggctgacacgctcctcggaagatctgaacgccttcctggatcaggtgatggcggccgaggggctggcggcggcgcagatcgcgcttctgggcttttcgcagggcacgatgatggcgctgcaggtggcgccgcggcgcgcgcaggcgctggcgggcgtcgtcggcttttccgggcggcttctgcgcgccgatgcgctggccgccgagacggtgacgaagccgccgatgctgctgcttcatggcgatgtcgatcagatcgtgcccttcggcgatctgaaacaggccgccgatgcgctgagcgcggccgggttcgatctgcgcacccatgtgatgcgcggcaccgggcatggcatctcgcccgacgggctgggtcaggcgctggccttcctg

SEQ ID NO: 45436 - DNA, 1095 bp, Rhodobacter capsulatus
catagtttctctccgcggaccgaaatcgtcttcggcgaagggctgctggaacgcttgcaggcctatcgcggccagcgcgtcggcatcgtgaccgatgaattcatggcccgctcgggtccgcttgatcgcgttctggcgcatctggacggctgcaccgtcaagatcttcgccgaagccatccccgagccgccgctcgccaccgtttccgcaggcgcccgcctgttcgccgacttccgccccgatgtggtgctggcgctgggcggcggctcgcccatcgatgcggcgaaagccatcctggcggtggtgcgcggcatcgaccccagccatccgatccgtctggttgcgatcccgacgaccagcggcaccggctccgaggtcaccgccttcgcggtgatctcggaccctgccaacaaccggaaattcccgctgatttccaacgacctgatccccgatgtggcgatccttgacccggaattcgtgcgcaccgcaccgcccagggtcaccgccgataccggcatggatgtgatcacccatgcgatcgaggcggtggtggcgcgcggcgcctcgaacttcaccgacgcttttgccgaaaaggcgctggaactggcctttgcggcgctgccccgggcttacgacaacggcaacgatctggccgcccgcgatgcgatgcatcaggcctcgtgcctggcgggcatggcctttaccgaggcggggctgggcctcaaccacgggctggcccatgcgatcggcggccggctgcatctggtgcatggccgcatcaacgcggtgctcttgccccatgtcatcgcctggaacgccggtctgtcggacgacgcgcccggctgccgcgagaccgccagccgctacgcccgcatcgccgcccgggtggggcttgacgtgccgggcacgcgggcgggtgtcgttgcgctgatccgggcgatcgaggcgctgaatgcgcgcttcggcatcccttcctcgctgcgcggccttggcgtcgcgatcgaggagtatcgtcgggcgatccccgaccttgcggcagccgcctttgcggatgcctgcaccgcgggcaatccgcgccgtcccgcgctggcagat

SEQ ID NO: 45437 - DNA, 1323 bp, Rhodobacter capsulatus
gaccgcgcccatgtctggcaccacctgagccagcacaagccctatgaaaccagcgatccgcgggtcttcgtcgagggccgggggatgcggctttgggatgcgaccgggcgcgaatttctggatgcgacctcgggcggggtctggacggtgaacctcggctatggccgcaaggatgttgtcgaggccgtcgcggcgcagcttctggcgctgccctattatgcgggcgcggcgggcaccgtgcccggggcgcgctatgccgaggcgctgatcgcgaagatgccggggctgtcgcgggtctattattccaactcgggctccgaggcgaacgagaaggtctacaagatggtgcggcagatctcgcaccgccatcacggtggccgcaaggggaaaatccttttccgggaaagggattaccacggcaccaccattgccgcgctggccacctcggggcaggcgcagcgggccgagcactacgggcctttccccgacggcttcgtgagcgtgccgcattgcctcgaataccgggcgcaatgggactgcgccaattacggcgagcgcgccgccgatgcgatcgaagaggtgatcctgcgcgaggggcccgacagcatcggctgcctcgtgctggaaccgatcaccgcgggcgggggcgtgatcgtgccgcccgcgggctattgggaaaaggtgagccacatctgccgcaaatacaacatcttgctgcatctggacgaggtcgtctgcgggctcggccgcaccggcgcctggttcggctatcagcactatggcattcagcccgatttcgtcaccatggcgaagggcgtggccgcgggctatgcggcgatttcctgcaccgtgacgaccgaggcggtctttgagctgttcaaggatgcgcccagcgatccgctgtgccatttccgcgacatctccacctttggcggctgcacggcggggcctgcggcggcgctcgaaaccctgcggatcatcgaggaggaggggcttttgcagaacaccgcgcagatgggggaacggctgctggcgaaccttcgggatctggccgaacggcatgcggtgattggcgacgtgcgcggcaagggcctgttttgcggcgcggaactggtggccgaccggcgcacgaaagagccgctggccgaggcgaaggtgcaggcggtcgtggccgattgcgccgcgcagggcgtgctgatcggcgccaccaaccgctcgatccccgggctcaataccacgctctgccttgccccggcgctgatcgcctcggaagccgagatcgaccgcatcaccgagacgatcgacgccgccctgcgccgcctg

SEQ ID NO: 45438 - DNA, 867 bp, Rhodobacter capsulatus
ccggtttcgggccttgatctgccgcgctttgccggcgtgcccagcttcatgcgcctgccgcatgtgccccttgatcacccccgtttagccgaggtgcagatcggtctgatcggcgcgccctgggatggcggcacgacgaaccgccccgggccgcggcacgggccgcgccagctgcgcgatgcctcgacgatgatccgggcggtgaacggcgcaacccgggtggcgcccttcgatctggcccgctgcgccgatctgggcgatgtggcgcccaatccgggcgatctgatggacagccttgcgcggatcgaggcgttttatgatcgcgtcgtcgcggcgggcatccggccgctgacggcggggggggaccatctgtgcacgctgccgatcctgcgcgcgctggcaaaggcgcgtccggtcgggctgatccagttcgacagccacagcgacctgaacgacgtctatttcggcaccgcccgctacacccatggcacccccttccgccgcgcggtggaagaggggctgatcgatccgagccgctattgcctgatcggcctgcgcggcaccgctttcggccacgaggatctggatttcgccgccgcgaccggcatccgcatcattccggtggccgagctgcatgcccgcggcgcggccgaggtgatggccgaagcgcgggcgatcgcgggcagcgggccgacctatgtcacctatgacatcgatttcgtcgatccggctttcgcgcccggcaccggcacgcccgaagtgggcggcccgacctcctggacggcgctggaggtggcgcgggggctgcgcgggctcgacattatcggcgccgatctggtcgaggtctcgccgcccttcgatccggcg

SEQ ID NO: 45439 - DNA, 600 bp, Rhodobacter capsulatus
cccaaacgcacccttgtcatcgaccttgacgcctgcaccggctgtcacgcctgcaccatcgcctgcaagggctggcagaatgcgaacgaggacacccggctgcccgatgccgacgcctatggcaaggcccccttcggtgcctttctcaaccgcgtgcattcctacgaggtgatcgcggacggggccccggcgcggctgatccactatccgcgcacctgcgtgcattgcgaaaatccgccctgcgtgccggtctgcccgaccggggcgagccagcagaccgccgatggtctggtgcagatcgacgccagccgctgtctgggctgcgggctttgcgcctgggcctgcccctatggcgcgcgggaacttgatccggtggcgggggtgatgcgcaaatgcaccctttgcgccaatcgcatcgacgatcccgcaaggcccgcggaagaccgcattcccgcctgtgtccgggcctgtcccaccggcgcgcggcatttcggcgatcccgccgacgccgaaagcccgcttggccggttggtcgccgaccgcggcggcttcgcgccgatgcccgaattcggcacgaagcccagcagccgctacctgccg

SEQ ID NO: 45440 - DNA, 1470 bp, Rhodobacter capsulatus
ttggcgctggagacgttccagcacatccatgcgctttcgctgcgctatcacatcacccgcaagaccggggggctgtcccgcatcgtcgagcgcggcgtgaagggcgtcgattttcttctgcgcttcatgctgttttcggtcgggccgctgatcctggaactgacgctggtgacgctgatcttcgccttcctgttcgactggcgctatgcgctggtcgtcgtcggcacgatctggacctatgtcacctacaccttccgcgtcaccgaatggcgggtggcgatccgcaagaagatgaacgacgccgacacggcggcgaaccagaaggcgatcgacagccttttgaacttcgagacggtgaaatatttcagcgccgaaaagcgcgaggcggcgcggtatgacgcctcgatggagcgttacgagggcgcggcggtgaagaccgggcaaagcctggccgcgctgaacgcggggcagacgctgatcatcaccgcggggctggtggccgtgatggtgatggcggcgatggaggtgcaggcgggcacgctgacggtgggcgatttcgtcatggtgcaggcctacatgatccagatcaccatgcccttgagcttccttggcacggtctaccgcgagatccggcaggcgctcgtcgacatgggcgagatgttcgacctgctgcatcaaccggccgagatcaccgatgcgcccggggcgaagccgctggcggtttcgggcggggccattgccttcaagggcgtcgatttcgcctattccccggaacggccgatcctgaaggggatcgatctggcggtggcggcggggcagaaggtggcgctggtggggccgtccgggtcgggcaagtcgacgatcgggcggcttctgttccggttctatgaggtgaccggcggggcgatcagcatcgacgggcaggatgtgcgcgacgtgacgcaggaaagcctgcatgccgccatcggcgtcgtgccgcaagatacggtgcttttcaacgacacgatccgctacaacatcgcctatggccgggccgaggcgacgcaagaggacatcgaggcggcggcgcgggcggcgaagatccatgatttcgtgatgtccctgcccgagggctacgacacccaggtgggcgagcgcggcctgaaactgtcgggcggggaaaagcagcgggtgggcattgcgcgcacgctgttgaagaacccgccgatcctgcttctggacgaggcgacctcggcgctcgatacccagaccgaacgcgacattcaggaaagcctcgatgcgatggggcgggggcgcacggtgatcgtgatcgcgcaccggctttccacgattgccgatgccgaccggatcgtggttctggaagcgggcgagatcgtcgaggaaggcacgcatgaggcgcttttggcgcgcgcgggccgctatgccgcgatgtgggcggcgcaatcggccgaggaagccgcagaggcggcc

SEQ ID NO: 45441 - DNA, 768 bp, Rhodobacter capsulatus
atgacggcaggcttgatggcgggaaaacggggcctgatcatggggctcgccaatgacaagtcgatcgcctggggcatcgccaaggcgttgggcgatgcgggcgccgaactggccttctcctatcagggagaggcgctgaaaaagcgcgtcgaacctctggccgcaagccttggcacgccgcttctgttcgaatgcgacgtcgcgaacgaagacagcatggatgcgctcttcgcgggcctcaaggacgcctgggggacgctggatttcgtcgtccatgcgatcgggttttcggacaagaacgagctgcgcggccgttatgtcgacacctcgcgcggcaacttcaccatgacgatggacatttcggtctattccttcaccgccgtctgcgcccgcgccgccgcgatgatgccgaacggcggttcgttgctgacgctgacctattacggcgccgaacaggtgatgccgcattacaacgtgatgggcgtggcgaaagcggcgctggaagcttcggtgaaatacatcgccgaggatctgggcaagcttggcatccgctgcaacgcgatctcggccgggccgatcaagacgctggccgcttcgggcatcggcgatttccgctacatcatgaagtggaacgagctgaacagcccgctgcgccgcaacgtgacccaggaagaggtcggcaaggccgcgctttacctgctctcggatctgggctcgggcaccacgggcgagaacctgcatgtcgatgcgggctatcatgttgtcggc

SEQ ID NO: 45442 - DNA, 963 bp, Rhodobacter capsulatus
atcaacgtcagccaagccgcgccggtcgatccgccgccgcgcgcgctgcggcaggcgatcgccgaggccgcgctcgacaccccctctgcgcatctttacgggcccgtccttggaaatggcgatctgcgcgccgaagtggcggcgcaatggtcggtggcctatggcggcacgatccgcccggcgcaggtcgcgatcacccagggctgcaatcaagccttctgcgcggcgattgccacgctggcgggcgcaggcgatgaagttcttctgccaacgccctggtatttcaaccataaaatgtggctcgacatggcgggggtgcgcaccgtgccgctgccgaccgggccggggcttttgcccgacccggatcatgcggcggcgcggatcacgcctgccacccgcgccatcgtgctggtcacgcccaacaacccgggcggcgtcgaatatccggccgatcttgtgcgcgcctttgccgatctggcccgccgtcacgggatcgcgctgatcctggacgagacctaccgcgatttcgacgcccgcaacggcgccccgcatgaccttttcaccgatcccgactgggacgaggggctgatccagctttattccttttccaaggcctaccggctgaccggccaccgcgtcggcgccatcgtcgccagccccgcgcggctggccgaggtggagaaattccttgataccgtcgcgatctgcccgggccagctgggccagatcgcggcgctttgggggatgcgcaacctgcgcgactgggtcgcgggcgagcgcgccgagatcctgtcgcgccgcgccgcgatgacggcggggctggccgccctgcccggctgggaaacgctcggctgtggcgcctatttcgcctatgtcgcgcatccctcgcccctgcccgcgcccgactttgcaaaacgccttgtcgccgaggcctcggtgctggccctgcccggcacgatgttc

SEQ ID NO: 45443 - DNA, 1404 bp, Rhodobacter capsulatus
gccgcaatgtcgcaaaagatcgtcacccgcttcgccccctcgcccaccggctacctgcatatcggcggcgcccggacggcgcttttcaactggctctttgcccgcggccatggcggcaccttcctgctcaggatcgaggataccgaccgtgcccgctcgacccccgcggcgacggcggcgatcctcaaggggcttgactggcttggcctggattatgacggcgaggtggtgagccagttcgaccgggccccccgccatgccgaagtcgcgcgcgagatgctggcccgcggcgccgcctacaagtgtttcgccacccaggaggaaatcgaagccttccgcgaggcggcaagggccgaggggcgctcgacgctgttccagtcgccctggcgcgacgccgaccccgcgacgcatccggatgcgccctatgcgatccggctgaaggccccgcgcgagggtgcgacggtgatcgccgacaaggtgcagggcgaggtgacggtgcggaacgaccagctcgacgatatggtttgtttacgctcggatggtacaccgacctatatgcttgccgttgtcgtcgatgaccacgacatgggcgtcacccacatcatccggggcgacgaccatctgatcaacgcggcgcggcagatgcaggtgtatcacgcgatgggctgggaggtgccggtgttcgcgcatatcccgcttatccacgggcctgacggcaagaaactgtccaagcgtcacggcgcggtgggtttggaagaatatcaggccatgggctatccggccgcgggcatgcgcaactatctggcgcggctgggctggagccatggcgatgacgaggtcttcaccgacgcgcaggcgcaggaatggttcgagctggagggaatcggccgcgcgccctcgcggctcgacttcaagaagctcgaaaatgtctgcggccatcacatgggccagatcgccgatgacgatctgatcgcccagatttcgggctatctggaggcggccaagctgcccgccctgaccgggacgcaattggcggctttgcacaaggccctgcccgtggtgaaatcgggggcgaagacctttggtcaactgctggaaaaggcgcgcttcgcgctgatctgccgtcccgtcgagatcgacgcgaaggcgatggcggcgcttgatccggtatcccgtggtatactgaaagaattgacgccgcagctgcaaaatgctagctgggtgcgtgaggagctcgaaagcgtggtcgcgcgggtggccgaggcgcatggactgggccttggcaagatcgcggcgccgctgcgcgccgcgctggcgggacgggcggcaacgccctcggtcttcgacatgatggaattgctgggccgcgaggaagtgctggcccggctgagcgatcaggcggcc

SEQ ID NO: 45444 - DNA, 531 bp, Rhodobacter capsulatus
ctgcgcgcgatcttgtgggacatggacggcacgcttctggacagcgagccggtgcatcggctctccttcgtcgatgcggcgcgggcctgcggtctgacgctgcccgcggatttccacgaaggcctgatcggcaaaagcgaggatgcgatccatgcgatccttgcggccgaacacgggctgacgctgtcccttgcgcattggtccgagctgcgtttcgccgcctatctggcccgcatcgaggaggtgcatcccttccggatcgccaccgatctttgggcgcgggcgcaagcggcggggctttctcaggcgatcgtgtcgaactcgcccgaggggatcgtgcgggcgaacctgacccggctggggctggcccccggagcggtgcgcacggtcagccgtcacgatgtccgccgcggcaagcccgatcccgagccctatctgctggcgctcgcacggcttggcctgccgcccgagacggtggcggtggtcgaggacagcgccgcggggctggcggcggcccgggcggcggggctt

SEQ ID NO: 45445 - DNA, 1587 bp, Rhodobacter capsulatus
cgccatcttgtcggggtcgatgtcggcaccggctctgcccgcgccggggtctttgacctgaccggccatcttctgggcaccgaccaccacccgatcacgcttttccgcgaggaaggctcggtcgtcgagcaatcgagcgccgagatctgggcggcggtcggccgcgcggtgcagggcgcgctcaaggcggcgggtctgacgggcgcggatgtcgccgggatcggctttgacgccacctgttcgctggtggtgctggatccggcggggcggtccttgccggtcggcccctcgggggatcccgcgcgcgatgtgatcgtctggatggatcaccgcgccaccgcgcagaccgagcggatcaacgcgacgaaacaccgggtgctggagtatgtcggcggccggatctcgcccgagatggagacgccgaagctgttgtggctcaaggaacaccgccgcgaaacctttgatgccgcggggcatttctttgatctgaccgatttcctgacctggaaggcgacgggctcggcggcgcgctcgatctgcaccgtgacctgcaaatggacctatatgggccatgaaagccgttgggatgaaagctatttccgccagatcgggcttgcggacctggccgaggaaggctttgcccgcatcggcaccgaagtcgtcatgcccggcaccgccttgggcgcgggcctgaccgaggctgccgcgcgggatctgggtcttttgcccggcacgcccgttgcggcggggctgatcgatgcccatgcgggcggtgtcggcaccgtcggcgccgcgggcgaggggggggctgtggcgaatctggcttacgtcttcggcacctcgtcgtgcaccatgaccaccaccgaagatcccgtcttcgttccgggcgtctggggcccctattattcggcgatggtgccgggggcctggctcaacgagggcggtcagtctgccgccggggctgcgatcgatcagcttctgcggttccatcccgcctctgccgaggcgtcggccgccgcctcccgtgccgggctttccctccccgcctggcttgcgcgccgtgccgaggccctggcaggggcggggggcgaggtggcccgtctggcggcggggctgcatgtggtgcccgagtttctgggcaaccgcgcgccgcatgccgacccctatacccgcgcgctgatcgccgggctggggatggaggacgatcttgacaaccttgttgcgctttatgtcgcggggatttgcgggctgggctacgggctgcgccagatccttgaagtgcaggcgaaacgcggcgcctcggtcgcgacgatcgtgatcagcggcggggcggggcggtcggatctggtgcgccagatcctggccgatgcgaccggcgtgccggtggccgcgcccgacaccgaggagccggtgctgctcggctccgcgatcctggccgcggtggcggcgggggcggcgcccgatgtggccaccggcatggcgcagatgtcgcgcatcgcgcgacgctacccgccgggggaagcggccctgcgcgccttccacgacgcccgtttcgcgcttttcgagaagtttcaggtgcttgcgcgc

SEQ ID NO: 45446 - DNA, 1582 bp, Rhodobacter capsulatus
catgccgcgaccgtcaaggaccggcatatcctcgatcttttcgccgccgatcccgaccgcgccgcccgtttcagcgccgaattcgggtcctggttcttcgatttctcgaaaaccaacatcgatgccgcggggctgaagctgctgatcgatctggcggaaaagaccggcgttgccgcacgccgcgacgcgatgttcgcgggcgaaaagatcaacgagaccgagggccgggcggtgctgcacatggcctggcgcaacttccgcgacacgatcacggtcgatggccacgacgtcatgcccgccttgcgcgacacccttggccggatgcaggatttcgccgaagacgtgcgcacgggccgtttcaccgggcaggggggccggattaccgatgtggtcaatatcggcatcggcggctcggatctggggccggtgatggcctcggtcgcctgcacgtcttttgccgacgggccgcggctgcatttcatctcgaatgtcgatggcgcccatgcccatgacgtgctctcggggctgaacccggaaacgacgctggtgatcgtggcgtccaagaccttcaccacgatcgagacgatgaccaatgccgaaaccgcccgcgcctggatggcggcgaaggtcacggacccggcggcgcaattctccgcgatctcgaccgcgaccgacaggacggcggctttcggcatcccgcccgagcgcgtcttcggcttcgaggattgggtgggcgggcgctattcggtctggtcgccgatcgggctcagcctgatgatcggcatcggcccgggctatttcgccgaattccacgccggcgccgccgcgatggaccgccatttccgcgaggcgccgctggcggaaaacctgcccgttctgctcgcgctggtcggcatctggcacaatcaggtgctgggccatgccacccgcgccgtgctgccctatgaacagcgcctcgcccggctgcccgcctatctgcagcagctggaaatggagagcaacggcaagcgcgtctcgatggacggcgccgatctgccctggcattccggtccggtggtctggggcgagcccggcacgaacggccagcacgccttttaccagctgatccatcagggcacccgggtcgtgccttgcgaattcctcctcgctgcgcggggccgcgagccctatctcgaacatcagcaccttctgctcgtcgccaattgcctggcccagtccgaggcgcttctgcgcggccgctcgcttgcggaagcgacggagatcatggcgaaaaagggcctgaccggggcagagctggaccgccaggcccgccaccgcgtcttccccggcaaccgcccctcgacgacgctgctgatcgaggtgctcacccccttcacgcttggcggcatcgtcgcgctttacgaacatcgggtcttcgtcgagggcgtgatcctgggcatcaacagcttcgaccaatggggggtcgagctgggcaaggaactggcgctggcgctggctccggtgctcgagggcagctcggaaggcgcgggcaaggacggctcgacgctccggcctcgcccgacgcatccgcgcggcgcgggcc

SEQ ID NO: 45447 - DNA, 1464 bp, Rhodobacter capsulatus
atggtgtcgcgcgtcattccggtcgatcttttcgatctcgtgatcttcggagccacgggcgatcttgcgcagcgcaagatcctgcccgggctttaccgccgctttcacgccggtcagatgcccgaaggcgcgcggatcatcggcgccgcccgctccgacatggatgccgagggctttcgcgcccaggtgaccaaggcgatcgccgatttcgtcgatccggcgaaacatgacgcggcgaccatcgccgcctttctgcaaagccttgactatgtctcggtcgatgcgacgggcgagggcggctgggacagtctcaaggccaaggtcgatcccgcgcggatcaatgccttctatttctcggtcgcgccgatgctgttcggccccctggccgaccggctcaaggcgcatgggatcgccggggatcagtcgcgcatcgtggtggaaaaacccttcggccgcgatctggcctcggcccgggccttgaacgccaccttggccgcgcatttcgaggaaagccagatctaccggatcgaccattatctgggcaaggagacggtgcagaacctgatggcggtgcggttcgccaacatcctgttcgagccgctttggaacgcacaatatatcgaccatgtgcagatcaccgtggccgaaaccgtgggtgtcggcgggcgcggcagctattacgacaaatcgggcgcgatgcgcgacatggtgcaaaaccacctgatgcagctgttgtgcctgatcgcgatggagccgccctatcacttcgaccccgatgcggtgcgcgatgaaaaggtcaaggtgatccgggccttgcagcccgttcccgcggccgacatcgtgcgcgggcaatatctgggcgtgaaggccacggccgggcgggccgagcagccgggctatctggccgacagcgaaaaccccgacagccgcaccgaaagctatatcgcgctcaaggtgcaggtggcgaactggcgctggcagggcacgccgttctatctgcgcaccggcaagcggctgcggggccgggccagtgaaatcgccatcaccttcaaggcgccgccgcattcgatcttcgatcaggaagaagccagctggcgcgaaaacgtgcttgtcatccggctgcaaccggacgagggcatgaatctgaaagtgatgatcaaggaaccgggtccgggggggatgcgtctggtgcaggtgccgcttgacatgtcctttgccgaggctctgggcgaggatggcgccgacattcctgacgcttatgaacgcctcatcatggatgtgatccgcggcaaccagacccttttcatgcgcggcgacgaggtcgaggccgcctgggcctggaccgatccgatcatcgcgggctgggaggcccggggcgaccggccgcggccctatgacgccgggtcttcggggccggaagatgccttgatgctgatgcaccgcgacggccgtcgctggcgggag

SEQ ID NO: 45448 - DNA, 702 bp, Rhodobacter capsulatus
ctgatcaccggcggcgcgaagcggatcggcgccgagatggcacgggggttcgccgcccgcggctttcgcgtggtgctgcattacaacagctcctcgaccgaggccgaggcgctggcgggtgagctgaaccagtcgggcgagatctgccgtctggtgcaggccgacctgtccgacgcggccgcggtgcagcgggtctttgacgtggcgcagggttttctgggccgggtcgatgtgcttttgaacaacgcctcgaacttcatgaacgacgacatcttcagcctgagcgatgcgaagatggacgcgcatttcgcggtgaacctgaaggcgccgctggcgctcgccgcacggatggcggcgcaggacaggagcggcgaagatgcgctgatcctgaacatgctcgacaacaaggtgctggcgctgaacccggatttcttctcctacacgctgtccaaggccgcgctgcatgccgcgaccgagatgctggcgatgcgctttggcggttgcccgcgggtcaatggcatcgccccggcgatcacgctgatttccggcaagcaaaccccggagaatttcgagaaatcgagccgcatcaaccccttgggcattcaggttcaaccggccgatctggtgcgcacggcgctttacttctgggaggccaagggcgtgacgggcgaggtgatcgcggtcgatggcggccagacgctg

SEQ ID NO: 45449 - DNA, 585 bp, Rhodobacter capsulatus
gcccttgtcaccggcgcctcgcgcgggctcggctttgccatcgccgaagagctggcggccgagggctggcacatcatggcggtggcgcgcaccgtgggcgggctcgaggcgctcgatgacgtcattcaggccaagggcggctcggcgacgctcgcacctttggacatcaccaagcccgaggaaatggaaacccttgccaatggcatcctcgggcgctggggcgggctgcagctgtggatccacaccgcggtccatgccgcgccgctttcccccgccgcgcattccgacgccaaggacatggaaaaatcggtggcgacgaacctgaccggcaccgcgacgctgatcccgctgatcgacccgcttctgcgcgcgggggacggcacggcggtcttcttcgaggatgaccgggcgggccagccctatttcggctcttacggcgcgacgaaggcggcgcagatcgcgctggcccgcagctatgcggtcgaggcggcgaagatcggcccgaaggtgaagatcgtcgcgccgcggccgatggccaccgccgtgcgggcgcgcttcttcccgtccgaggaccgcacgccgctg

SEQ ID NO: 45450 - DNA, 597 bp, Rhodobacter capsulatus
ttcctttacgcgctgcgctcgaagggcgtgaccgatgcccggatcctgtcggcgatggaacgcatcgaccgcggcgctttcgtgcgcggcatctttgccgaacgcgcctatgaggacatgccgctgccgatcgcctgcgggcagacgatctcgcaaccctcggtcgtcggtctgatgacgcaggcgctggccgtgggcccgcgcgaccgggtgctggaaatcggcaccggctctggctatcaggccgcggtgctgtcgcttttgtgccgccgcgtctatacggtcgaccgccaccgccgtctggtgcgcgaggcgcaggcggtcttcgaggcgctgtcgctgcccaatatcgtcgcgctggccaccgatggctcgcgcgggctgcccgatcaggcgccttttgaccggatcctggtcaccgccgccgccgaggacccgccggggccgctgttgtcgcagctgaagatcggcggtatcatggtgcttccggtcggccagtccgacaccgtgcaaagcctgatccgcgtgacccgactggaaaccggcttcgattacgaggagttgcgcccggtgcgcttcgtgccgctggtcgagggc

SEQ ID NO: 45451 - DNA, 774 bp, Rhodobacter capsulatus
atgaagatcgccaccttcaacatcaacggcatcaaggcccgcgccgaggccctgcccgcctggctgcgcgcggccgagcccgatgtcgtgctgctgcaggagatcaagtcgaccgacgaagccttcccgcaggaggtgctggacggtaccggctacacggtgcacacgcacgggcagaaaagcttcaacggcgtcgcgatcctgagccggttgccgctggaggatgtgacgcgcggcctgcccggcgacgacagtgacgaccaggcccgctggatcgaggcgacggtgatcggcacccgcgcggtgcgggtctgcgggctgtatctgcccaatggcaaccccgcgccggggccgaagtatgactacaagctggcctggatggcgcggatgcaggcgcgggtggaaaccctgctgcgcagcgaggagccgctggttttcgcgggcgattacaacgtgatcccgcaagacgaggatgccgcgaaaccggaaagctggcgcgcggatgcgctggccctgcccgagacccgcgcggcgttccggcggatcgtgaaccttggcctgaccgatgccttccgcgcccgcgtgccgggcccggggcagtattcgttctgggattatcaggcgggggcctggcaaaagaacaacggcatccgcatcgaccacctgctgctttcgccgcaggcggccgatctgttgcgcgatgcgggcatcgacaaggaggtccgcgcgggcgagaaaccctcggaccatgtcccggtctggatcgatctggac

SEQ ID NO: 45452 - DNA, 708 bp, Rhodobacter capsulatus
cttctgagccttgaaaacatcgagctttattacgatcacgtctatgcgctcaagggcgtgtcgctcaatctggccgagggcgagacggtggccctgatcggcgcgaacggggcggggaaatcctcgatcctgcgcgcgatcaccggcctgcgcaaaccgcgcgcgggcacgatcacctatcgcggcgaccggatcgacggcaaatccccggccgagatcgtgaaaatgggcatcgccatggtgcccgaggggcggcgggtgtttccgctgatgtcggtcagggacaatctgctgatgggcgctttcacccgctccgacacggccgggatcgcgcgttcgcttgaggccgtgctgacccggtttccgcggctgaaggaacgctatggccagcaggcggggacgctttcgggcggcgagcagcagatgatggtgatcggccgggcgctgatggcggcgccgaagcttttgttgcttgacgagccctcgcttgggatcgcgccgaagctggtgcaggacatcgcccgcgccatcgtggcgatcagccgcgacgagggcgtgtcggtgctgctggtggagcagaacagccgcatggcgctgtcgatttcggcgcgtgcctatgcgctctcgaccggcactgtcgcgctttcgggcgcctcggccgacctcatgcacgacccgcggatcaaggcggcttatctgggcggagac

SEQ ID NO: 45453 - DNA, 1479 bp, Rhodobacter capsulatus
ttggcctattggcaggggcttgccgaaaagctgacgctgcgcacccgccacttcatcggcggcgactatctgccctcggccgatggccgcaccttccagacgatcaacccggccaatggcgccgttctggccgaggtcgcccgcggcggtcaggccgagatcgaccgcgccgtgtcggtcgcccgcaaggtctttcgctccggcgtctggtcaaagatggagccgcgcgcccgcatggcggtgctggagaaattcgccgcgctgatcgaggcgcatggcgaggaattcgccgtccttgacagcctcgacatgggcaagccggtgatggacatgatgaacatcgacgtgcccttttcggccacgacgatcaagttcttcggggaatcgatcgacaagttccacggtcaggtgacggcgacggcgacgaccgcgctgcattacatcctcaatcagccgctcggcgtcgtcggcatcatcacgccctggaactatccgctgatgatggcggcgtggaagctgggcccggcgctcgccaccggcaattcggtggtgctgaaaccggccgagcaatcgccgctttcggcctgtctgctggccgagttgttcatcgaggcgggcggtccgcccggcgtcttgaacgttgtccagggtctgggcgaggaggcgggcaaggcgctggcgctgcacatggatgtcgacaagatcgccttcaccggctcgaccgaggtcggcaagcttctgatgatctatgccggtcagtcgaacatgaagcgcgtgacgaccgaatgcggcggcaagaccccgcagatcattctgggcgactgggacgatctggacaccgccgcgacctatgcggtgaacggcatcttcggcaatcagggcgaggtctgcaacgcgggctcgcgcatccttgtggcgcgggaattgcacgacgcctttgtcgagaaattcatcgccacggcaaagcagaatttcatcctcggcgacccgctcgatcccgcgacgacgatggggcccttggtcaccaccgaccagcaggcgcgcgttctgggctatatcgcgaagggccgcgccgagggggcggtgctggcgctgggcggcggcacgcctgcgggcctgtcgcacggtgcctatgtggagccgacgctgttcaccggggtcaacaatgccatgaccatcgcgcgcgaggaaatctttggcccggtcggcacgatcattccgatcgacgggctcgaagacgggctcgaaatcgccaatgactcgccctatgggctggccgcttcggtctggacccgcgatctggccaaggcgcataccttcgggcgcgagatggaggcgggcgtgtgctgggtgaactgcttcgatcacggcgacatgacctcgctttggggcgggttcaagcagaccggcaacggtcgcgacaagtgtttcgaggcgctgtcgcaatatacccagacgaaatcggtctggatcaatctg

SEQ ID NO: 45454 - DNA, 285 bp, Rhodobacter capsulatus
atggcattcaaaccgctgcatgaccgcgtgctggtcaaacgcgttcaaagcgaagaaaaaaccaagggcggcctgatcatccccgatacggcgaaggaaaaaccggccgagggcgaagttgtcgccgtgggcgcgggtgcgcgcaaggattcgggcgagctgatcgcccccgccgtcgccgtgggcgaccgcatcctgttcggcaaatggtcgggcaccgaagtgacgcttgatggcgtcgaaatgctgatcatgaaagagtcggacatcatggggatcatctcg

SEQ ID NO: 45455 - DNA, 969 bp, Rhodobacter capsulatus
aaataccagattgtcggcatcggcaacgccatcgtcgatgtgatcgcgcaatgtgacgatgaattcctggccgcgatgggcatcgaaaagggcatcatgcagctgatcgagcgcgagcgcgccgaaaagctttatgccgcgatggccgagcggaccgaggcgcccggcggctcggtcggcaacacgatcgcggggctgggcaaccttggcctgacggcggccttcatcggccgcgtcgccgatgacactttgggccatttctacaaggccgcgctgaatgccgagggcacggatttcccgaacccgccggtgaagggcgccgatctgccctcgtcgcgctcgatgatcttcgtgacgcccgatggcgagcgctcgatgaacacctatctggggatctcggccgagctttcgaccgaggatgtggcgcttgaggtggtcgagaacaccgagatgctgttccttgagggctatcttttcgacaaggatcacggcaaggcggggttcctgaaagccgcgcagggctgccaccgcggcggcgggcgggccgggatctcgctttccgacccgttctgcgtcgatcggcatcgcgacagcttccgccgtctggtcagggacgagatggatttcgcgctgggcaatgaacatgaatgggcctcgctctaccagaccgatctggagagcgcgctgcaacaggcggcctccgaatgcgggctggtggtctgcacccgctcgggcgccgatgtggtggtgatccggggcgaagaacgggtggaagtgccggtgaaccgggtggtgccggtcgatgcgacgggggcgggcgatcagttcgcggccgggttcctttatggcatcgccaccggtcaaagccttgaagtggcgggcaagatgggctgcattgccgcggccgaggtgatcagccattacggcgcgcggccggaaaccgacattctggcgcagttcaaacaggcc

SEQ ID NO: 45456 - DNA, 911 bp, Rhodobacter capsulatus
atgatcctgagttgtggtgaagcgctgatcgacatgctgccgcggcaaggcacggcgggcgaggcctgttttgcgccccatgcgggggggtcggtgttcaatacggcgatcgcgctggggcgtctgggggtgcgggccgggtttctgtcggggatttcgaccgatcttttcggcgaggtgctgatcgggacactggcggcgtcaaatgtcgatgcggggctggcgatccgctctgaccggccgacgacgctggccttcgtgaagctggtggatggtcacgcaagctacgcattttacgacgaaaataccgccggacggatgatccttcccggtgatctgcccgcgcttccggccgcggtgcgggcgcttttcttcggcggcatctcgctgcccgtcgatccctgcggcggcacctacgaagccctgatggcgcgcgaagcggcgagccgggtcaccatgattgacccgaacatccgccccggtttcatccgcgacgaggccgcctatcgcgcgcgcctggcgcggatgatcgcgctggccgacatcgtgaaactctcggacgaggatctgcgctggctggaaggcccgggcgagatcgcggcgctggcgcaggggctgctgcgccgtgggccgaagctggtcttcgtcaccgagggcggcaccggcgcgcatgctttcggcgccggactgtccgttttcgcccccgcgcagcgggtgacggtggtcgataccgtcggcgcgggcgacacgttcaacgcgggcgttctggcggcgctcgaccgggcgggacggctgacgaaagccgctgtcgcggcggccgatgcgccgcttgtgtcggcctgtctggcgcttggcaatgcggccgccgcgatcaccgtcagccgtgcgggcgccaacccgccctgggcaga

SEQ ID NO: 45457 - DNA, 1299 bp, Rhodobacter capsulatus
acctttgaaaacctcggccttgcgccgatgctgctgaaaaatcttgcgggccttggcctgaccaagccgacgccgatccaggcgcagggcattccgcatatcgtgcgcggccgcgacatcctgggcctggcccagaccgggaccggcaagaccgccgctttcggcctgccgatgctgacccgcatcctggcctatggcaagcgcccggcgccgaaaaccgtgcgtgcgctggtgcttgcgccgacgcgggaacttgcgacgcagatccatgacaaccttgccgcctatgccgagggcgccccggtgcgcatccagcgcgtcgtcggcggggcttcgctgaacgtgcaggcggaaaaactgtccaagggctgcgacgtgctgatcgccacgccgggccggttgatcgacctgatcgaacgccgcgcgctggtgctgagcgagacgaaatatctggtgctcgacgaggccgaccagatgctcgacatcggtttcatccatgcgctgcgccgcatcgccaagctgatcccggcagagcggcagacgctgctgttctcggccacgatgccgaagctgatggaggaactggcggccagctacctctccgacccgatccgggtcgaggtcgccacccccggcaaggccgccgaaaagatcgaccagggcgtgcatttcaccacccagggcgaaaaggcggcccttctggccgaatatatctcgcgccatccgggcgaattggccgtggtcttcaaccgcaccaagcatggctcggacaagctgaccaagcttttggaaaaatggggtttttcggtcaccgccatccatggcaacaaaagccaggggcagcgggaacgggcgctttcggcgttccgcgccagcgaggtgcaggtgctggtggcgaccgatgtggccgcgcgcgggcttgatattccgcaggtggcgcatgtctacaactacgacctgccgaacgtgccggaaaactacgtgcaccgcatcggccgcaccgcgcgggccgggcgcgatggccgcgccgtggccttctgcggtccgctcgaaatgagcgatctgcgcgcgatcgaagccgcgatgggggcgaagatcccggtcatcggcggcgaagcccatgccgaaggcggcagccgtcccgcgccggggcgcagcggccagccgaagaaaccgcatcgcggtcagggcccgaaacccgcccgcgagggcgaggcgaaaccggcccgcaagcccgatgcgaaaccggcggcgaaacgcggcggccgcgccgagggacatgcgcccgcgggcggacag

SEQ ID NO: 45458 - DNA, 811 bp, Rhodobacter capsulatus
atggatatcgacattcaagagatctcgaagctcttcggcacgacggcggcgctgcatccggtgtcgctcgccattccctcgggggcgctggtggcgcttctgggcccctcgggctcgggcaagacgacgcttctgcggattctgggcgggcttgaattcccgacctcggggcgggtgctgtttgacggccaggacgccaccaacctgcgggtgcaggatcgccgcgcgggcttcgtgtttcaaagctatgctttgttccggcacatgacggtgtttgaaaacatcgcctacgggctgcgcgcccggccgcgggccgagcggccgccgaagctggaaatcgcccggcgggtggcgcggcttctggagctgatccagctgcccgacatcggatcgcgctatcccagccagctttcgggcgggcaacggcagcgggtggcgctggcgcgggcgctggcgatcgagccgcggatgctgcttctggacgagcccttcggcgcgctggatgccaaggtccgcaaggagctgcgccaggggctgcgcgacattcacgacgccaccggcctgaccacggtcttcgtgacccatgatcaggaagaggcgatggagctggccgacatggtggtggtgatgtcgatgggccggatcgagcagatcggccgcccgaacgacatccgcgcccgcccggccagcagtttcgtgcgcgatttcatcaccgcttgacctcggtctggccaaggccatcgccttggcccggcggatcattggtccgatgacccccgagggcccaaaggccctcgggcagcgcccgccc

SEQ ID NO: 45459 - DNA, 2481 bp, Rhodobacter capsulatus
gtgatacccctgaccagcgaacttgtggccatcggcaagacggccaccgacaaggccgatgccatcgcgcaggccgtcgacctgctcaccgcggcgggcaagatcgacccgcgctacggccagagcatgatgggccgcgaggccgtcgcgaatacctttctgggcaacgggatcgctataccgcatggcctgccgcaggaccgcgacctgatccatgacacggcgattgcggtggtgcagctgcccgcgggggtcgaatgggcgccgggcgacaccgcgcgtctggtcgtcgcgatcgcggcgaaatcggatgaacacctgcaggtgctgagcaacctgaccgacgttctgggcgacgaggccgaggccgagcggctggcgacgacgctggacgccgcggtgatcgtggcgcggctgaccggggcggcggcgcccgtggcggccccggccgagacgcccgcggatttcgcgcagggcatcgacgtggtggtgacgggcgcgcatgggctgcatgcccggcccgcaacgacgctggtcgatctggccaagggttttgcggccgagatccgcatccgcaacggcgccaaggtcgcgaatggcaaaagcctgatttcgctgctcaatctgggcgcggcgcagggcgcggccctgcgcatcagcgccgaaggggcagatgcgaccgcggctttggcggcgatcgccgcggcctttgaggccgggcttgaagacgaagaagataccggtgcggcggcccccgaagccgcgacgcccggtctgacgggggcgggggcgtcgatggcatcctacgaggggcgcacccttgtgggcatctcctcctcgccgggctacgcgcttgcccccgtcttccgctttgcccgcgacgaggtggtctttgacaccgacgccgcggatgcggcctttgaaaccgaccggctcgacaccgcgctgcagaccgcctggcacgagctggaagagctgcacgacgaggtctggaagacatccggccccgcccgcgccgcgatcttccgcgcgcatcaggagtttttgcacgaccccgaaatggtcgccgaggcgaaggcgctgatcgggcagggccgctcggccgggtttgcctggcaccgggtcttttccgaccgcgccgacatgctgggggcgatgaaggatgcggtgctgtcgggccgcgccatcgatctgcgcgatgcgggccagcgcgtgctgcagcatctgggccgggtgcggacgggcgagacgcatctgcccaccgcgccctgcatccttctggccgatgacctgacgccctccgataccgcgcggctcgatccggcgctggtgcggggccttgccacggcgcagggcgggccgacctcgcatacctcgatcattgcccgcgcgctcgatattccggcggtggcgggggtcgggccgcggctccttgatcttgcgaccggcacgccggttctgctggatggcggcgcgggcgtgatcgtcgtggctccgaccgaggctgacaaggcccgggccgagaccgcgatggcggcgctgacggcgcaacgcgagctggaggcgcgcgaacgctacaagcccgcgctgacggtcgatggcgcgcgtgtcgaggtggtcgccaatatctccgacgtggccgaggccatcgcctcggtcgaggcgggggccgagggcgtggggcttttgcgcaccgaattcctgttcgtgaaccgcgaggccccgcccggcgaagacgaacagctggcgatctatgccgccatgctttcggcgctgaacgggctgccgatcatcatccgcacgctggatgtgggcggcgacaaggaaatcccctatctgcgcatgcccgttgaacaaaacccgttcctgggcgagcgcggcatccgcttttgcctgtcgcacgaagacctgttccgcacccagctgcgggcgatctaccgcgcctcggccggggggcaggtccgcatcatgttcccgatgatcgcgatgatcgaggagctggaaaccgcccgccgcatcgccgaggaggtccggctggaggtcggcgccgcgccggtcgagatcggcatcatgatcgagatcccctccgccgtgatgatggcgccggaactggcgaaacgggtcgatttcttctcgatcggcacgaatgacctgacgcaatatgcgctggcgatggaccggatgcatccggtgctggcaaaacaggccgacgggctgcatccggcggtgctgcggctgatcgacagcaccgtgcgcgcggccgaggccgcgaggatctgggtcggcgcctgcggcggcatcgcgggcgatccggtgggggcggcggtgctctcggggctgggggtgcgggaactctcggtctcgatcccggcggtggcggggatcaaggcgcagctgcgccactctgcgatggcggaaaaccgggatctggcgcgccgcgcgctggcctgcacgaccgcggccgaagtgcgggggctgaaa

SEQ ID NO: 45460 - DNA, 1275 bp, Rhodobacter capsulatus
ctgaccaccgacgccgatgatttcgagacccgtttcaccgcccttctggggatgaagcgcgaggacagccccgatgtcgatgcgacggtggccgcgatcatcgccgaggtgcgcgaccgcggcgatgcggcggtgatcgactacacctcgaaattcgaccggctcgacctgacccccgcgacgctcgctttttcgaaagccgagatcgcggccgaaatcgcccgcgtgcccgcggccgagcgcgcggcgctggaactcgcggcagagcgcatccgcgcctatcacgcccggcagatgccggtgagggaagagcgctggaccgaggcctcgggggcggagctgggctggcgctggtcgcccgtttcggccgccgggctttacgtgccgggggggcttgcctcctatccctcgtcggttttgatgaatgcgatcccggccaaggtggcgggggtggagcggctggtggtcgtctgcccgacgcccgggggcgcggtcaatccgctggtgcttctggcggccgagatcgccggggtggacacggtttaccgcatcggcggggcgcaggcggtggcggcgctggcttacggcacggcgacgattgcgcccgtcgacaagatcaccgggccgggcaacgctttcgtggcggcggcgaagcggcgggtctttggccgggtcggcatcgacatgatcgccgggccctcggaaattctggtgatcgcggatgagaccgcgaaccccgactgggtggcgctggatctgctgagccaggccgaacacgaccaatcggcgcaggcgctgatcctgacgccggatgccgggttcgcgaaagccgtgacggcggcggtggaaaagcggctggaaacgctggagcggcgcgcgattgcaggcgccagctggcgcgatttcggcgcggtgatcgtcacccgcgatctggccgaggcggcgatgctttctaaccgcgtcgcccccgaacaccttgagctgtgcgtcgccgaccccgaggcgctgtctgcccggatcacccatgccggggcgatcttccttggccaatggacgcccgaggcgatcggcgattatgtcggcgggccgaaccacgttctgcccacggcgcgctcggcgcggttttcctcgggcctttcggtgatggatttcctcaagcgcacgacgctcgccaaaatgacgcccgaagccctgcgcgccattggccccgccgccgagacgctggcgatttcggaaagcctgcaggcgcatgggctttcggtccgcgcgcgtctg

SEQ ID NO: 45461 - DNA, 1266 bp, Rhodobacter capsulatus
gtggacagcatccttgtgcgcggcaacgggccgctttccgggcaaatcccgatcgcgggggccaagaacgcctgcctggcgctgatgcccgcgacgctgctgtcggaagaaccgctgacgctgaccaatgcgccgcggctctccgacatccgcacgatgacgcagcttctggccagcctcggcgccgaggtgaccgcgctgcaggacggcaaggtgctggccacctcgtgccacggcgcgatcaacccggtcgccgattatgacatcgtgcggaagatgcgggcctcgaatctggtgctgggcccgcttctggcgcggctgggccatgcggtcgtctcgctgccgggcggttgcgcgatcggggcgcggccgatggacattcacatcgatgcgctgaccgctttgggcgccgagatcgagctgaaggaaggctatctgcacgcccaggcccgcggcgggctgaaaggggcggtgcacgagatgcgctttgcttccgtcggcgcgaccgagaatttcctgatggcggcggttctggccaagggcacgtccgtgctgaaaaacgccgcgcgagagcccgaaatcgtcgatctggcccgctgcctgcgcgcgatgggggccgagatcgagggcgagggcacctcggacatcaccattcagggcgtcgaccggctgcacggggcaacccatcccgtggtcaccgaccggatcgagctgggcacctacatgctggcgcctgcgatctgcggcggcgaggtggaatgcctgggtggccggatcgcgctggtcgaaagcttctgcgagaaactggatgccgccgggatctcggtcgaggaaaccgcacgcgggctgaaggtgaaacgcaagaacggccgcatccgcgccgtcgatgtggtgaccgagcctttcccggggttcccgaccgatctgcaggcgcagatgatggcgcttttgtgcacggccgaggggacttcggtgctggaggagcgcattttcgagaatcgcttcatgcatgcgcccgagctggcgcggatgggggcacggatcgaggtgcatggcggtgttgcaaaagtgcatggcgtcgaccggctgaaaggcgcccgggtcatggcaactgatttgcgggcctcggtttccctgattctggccggcttggccgccgaaggcgagacagtggtcagtcgtgtttaccaccttgatcgcggctacgaacgggtggaagaaaagctgcgcgccgtcggggcgcagatcgaacgggtgaagggcgaa

SEQ ID NO: 45462 - DNA, 2412 bp, Rhodobacter capsulatus
aaacaaggacagacaatgaccgcactcccctccacccatccggtcctgccgctgcgcgacatcgtggtgttcccgcacatgatcgtgccgcttttcgtcggccgcgagaaatccgtccgcgcccttgaagaggtgatggccgacgaccggcagatcctgctggccagccagatcgacccgtcgatcgacgaccccacccatgaggggatcttccgcgtcggcgtgctcgccaatgtgctgcagctgctgaaactgcccgacggcacggtcaaggtgctggtcgagggcaaaagccgggtgcggatcaccgatttcgtcgaaaacgaccgcttcttcgaggcgcaggccgaaaccctgaccgaggtcgagggcgatcgcgacacgatcaaggcgcttctgcgctcggtcgccgaggaattcgaacgctacgccaagatcaagaagaacatccccgaagaggcgatggccgcggtgtccgaaacccgcgaggccgacaagctcgccgatctcgtctcgggccatctcgggcttgaggtcaagctcaagcaggagctgctggaaacgctggatatttccgagcggctggaaaaggtctacgggctgatgcagggcgaggtctcggtcctgcaggtcgagaagaagatcaagtcgcgcgtcaagtcgcagatggaaaagacgcagcgcgaatattacctgaacgaacagatgaagcccattcagcgcgagctgggcgatggcgaggacggtcagaacgagctcaacgagcttgaggaaaagatcgcccgcacgaaactgtcgaaggaagccaaggacaaggccgagggcgagctgaagaagctgcgctcgatgagcccgatgtcggccgaggcgacggtggtgcgcaactatctggactggctgctcaatctgccctggggcgtgaaaagccgggtgaagaaggatctgatcggcgccgaaaaggtgctcgatgccgatcactacgggctggaaaaggtcaaggaacgcatcgtcgaatatctggcggtgcaggcgcggtcggacaagctgaaggggccgatcctgtgccttgtcggtccgccgggcgtcggcaaaacctcgctcgggcggtccgttgcccgcgcgacggggcgggaattcatccgcatcagccttggcggcgtgcgcgatgaatcggagattcgcggccaccggcgcacctatatcgggtccatgccgggcaagatcatccaagcgctgaaaaaggccaagaccaccaacccgatgatcctgctcgatgaaatcgacaagatggggcatgatttccgcggcgatccggcctcggcgcttttggaggttctcgacccggaacagaacggcaccttcgtcgatcactacctcgaggtcgaatatgacctctcgaacgtgatgttcctgaccacggcgaacagctacaacatgcccgggccgcttctggaccggatggagatcatttcgcttgcgggctacaccgaggacgaaaaatccgagatcgcccgtcagcacctgatccccaagcaggtcaaggcgcatgggctgaagaagggcgaattcaccctgaccgacggcgcgctgtcggatatcgtgcgctattacacccgcgaagccggggtgcggaacctggaacgcgagatcgcgaaaaccgcccgcaaggcggtgaccgagatcctcaaggccaagggcgcggtgaaatcggtcacggtcgatgaggcgaagctgggcgattatctgggcgtgaagcggcaccgctatggtctggccgaggccgaggatcaggtgggcgtcgtcaccggtctggcctggacctcggtcggcggcgatctgttgcacatcgaggcgctgaaactgcccggcaaggggcggatgaagaccacgggcaagctgggcgacgtgatgaaggaatcgatcgaggcggcgtcgagctatgtccgctcgatcgcgccggaaatcggggtgaagccgccgaaattcgagacgctggacattcacgtccacgtccccgatggcgcgacgccgaaggacggtccctcggccgggctggcgatggtgacctcgatcgtctcggttctgaccggcattccggtgcgcaaggacatcgcgatgaccggggaagtgtcgcttcgcggcaatgcgatgccgatcgggggcctcaaggaaaaactgctggcggcgctgcgcggcggcatcaagaccgtgctgatccccgaggaaaacgaaaaggatctggccgacatcccggccaacgtcaaggaagggctggagatcatcccggtgacccatgtccgcgaggttctgacccgtgcgctggtgcgcgcccccgagccggtggaatgggacgaggccgccgaggaagccgccgccgccgcccgggccgctgccaaggccgaagcggcgggc

SEQ ID NO: 45463 - DNA, 1329 bp, Rhodobacter capsulatus
atgttcgacaagatcctgatcgccaaccggggcgagatcgcgctgcgcgtgatccgtgcctgccgcgagatggggatcgcctcggtggcggtgcattccaccgctgacgccgacgccatgcatgtgcgcatggccgatgaaagcgtctgcatcgggccgaacccctcttcggaaagctacctttccattcccgcgatcgtcgccgcctgcgaaatcaccggcgcgcaggcgatccacccgggctatggcttcctgtcggaaaacgccaccttcgtgcaggtgctcgaagatcacggcatcaccttcatcggcccgaaggcggaacatatccgcatcatgggcgacaagatcaccgccaaggacacggcgaaaaagctgggaattccggtggttccgggctctgacggcggtgtgcccgacttcgaggcggcgaagaaggccgccgccgagatgggctatcccgtcatcatcaaggccaccgcgggcggcggcgggcgcggcatgaaagtggcgcaatcggaggcggaactcgaaatcgccttccgcaccgcgcgcagcgaggccaaggccgccttcggcaatgacgaggtctatatggagaaatatctccaaaggccgcgtcacatcgaggtgcagatcttcggcgacggccgcggccgcgccgtgcatctgggcgagcgcgattgcagcttgcagcgccgccaccagaaggtgttcgaagaggcccccggcccctgcatcacccccgaacagcgcgcccgcatcggcggcatctgcgccaaggcgatgggcgagctgggctattccggcgcgggcacgatcgaattcctctatgaagacggcgaattctacttcatcgagatgaacacccgcctgcaggtggaacatccggtgaccgagggcatcttcggcgtcgatctcgtccgcgaacagatccgcgtcgcggcgggcgaagaaatagaattcacgcaggaaaacctgcagatccgcggccatgcgatcgaggtgcggatcaatgccgaacggctgccgaacttcgccccctgccccggcaagatcacgcaataccacgcccccggcgggctgggggtgcggatcgattcggcgctttatgacggctacaagatcccgccctattacgacagcctgatcggcaagctgatcgtgcacggccgcgaccgcaacgaggcgctggcccggctgaaccgcgccttgggcgagctgatcgtcgatggcgtcgacaccacgatcccgctgttccggcaattgctggaagagcccgacatcctgaagggcgattactcgatccactggctcgagaaatggctg

SEQ ID NO: 45464 - DNA, 1571 bp, Rhodobacter capsulatus
ccgaggaggatcgaatgtccgtccgtctgctgctttccaccgccgcgctggccctgaccgccggggcggcccaggccgattacacgctgcacatcctgcatacgaacgatctgcattcgcggatcgaggagatcaacaaatacgacagcacctgttccgagaaggacgccgccgaggcgaaatgctttggcggcatcgcccgcgtcgcggcgaaggtggcggcgctgcggacagagctggcggggcagaatgtgatcgtgctggatgcgggcgatcagttccagggctcgcttttctacaccacctacaagggcgcggacaccgccgaattcatgtcgaagatcggctatgatgcgatggcggtgggcaaccacgaattcgacgacggtcccgagggtctggcggcttttgttgcaaaagtgcaatttccgctggtctccggcaacctggatctgagccgctcatcgctaaaggacaagatcttcgatacggtcgtgctgcaggccgggggcgagaagatcggtctggtctcggctttggcgaccgatacggtggaaacttcctcgcccgggcccgacatcacctttcaggacgagatcgaaagcctgaaggccgatgttcaggcgctgaccgatcagggggtgacgaagatcattgcgatcccgcacacgggtttcgtcaaggatcaggagatcgccgccgccgttccggggatcgacgcggtggtgggcgggcattcgcacacgctgttcggcccgaagggcgccgcctatccgacgatggtcggcggggtgccggtcgtctcggcctatgcctattcgaaatatctgggccatctggtgttgaccttcgacgatgcgggccatctgaaatcggcgggcggggaacccattctgctcgatgcctcggtcacgcccgatgcggcggtggcggcgcgggtggcggagctggccaagccgctgcaggagatccgcgacaaggtcgttgccgaaagcacctccgagatcgacggatcgcgcgatcattgtcggcagacggaatgcgcgatgggcaatctggtggccgaggcgatgctggaccgggtcaaggatcagggcatcgcgattgcgatcacgaatggcgggggcttgcgggcctcgatcgatgccgggccggtgacgatgggcgaggtgctgaccgttctgccgttccagaacacgctctcgaccttcgaggcgaagggggcgacgattctggcggcgctggaaaacggcgtcggcgcggtcgaggagggcgaggggcggtttccgcaggtggcggggctgagatacagcttcgatccggccaagcccgcgggggcgcgcgtcagcgcggtgcaggtggcgaccgcgctcggctgggcgccgcttgacgtaacggcaacctatggcgtggtgaccaacaacttcctgcgcggcggcggcgacggctacaggatgttcgcggccgaggggatgaatgcctatgacttcggtcccgatctggccgatgtgacggcggaatttctggcacggcactcgccctatgcggcggccgtcgatggccggatcacc

SEQ ID NO: 45465 - DNA, 1008 bp, Rhodobacter capsulatus
cttgacccggaaactgcgcatggtctggcgctgaaagccctgcagatggggcttgtgcccggttgcggcccggtgaccggggcgcggctggcaacgacggtggcggggctggcgctgcggaatccggtggggctggcggcaggattcgacaagaacgcggtggcgctggggccgctgatgcgggcaggcttcggatttctcgaggtcggcgccgcgaccccgcgcccgcaggaaggcaatccgaaaccgcggctgtggcggctggcggaagatcgcgcggtgatcaaccgcttcggtttcaacaacgaggggatggagccgatcgcggcccgtctggcggcgcggcccgcgggcgtgccggtcgggctgaaccttggcgcgaacaaggacagcgccgaccgggccgccgatttcgccacggtgctgaagcgcgccggcgcgcatatcgactttgccacggtgaacgtgtcctcgcccaataccgaaaagctgcgcgacctgcagggcaaggaggcgctcgcggcgcttttgcgcggggtccttgcagcgcgggcggaactgggccgtccgctgccggtcttcctgaagatcgcgccggatctgagcccggcggagctggaggacgtggccgaggtcgcccgtgcggtggggatcgacgggatcgtggcgacaaacaccacgctctcgcgcgaaggtttgaaaagtgcaagttcaagccaggcgggcgggctttcgggcgcgcccttgttcgaaaagtccacgcgggtactggcacatctctcgaagctgacagaggggaaactgccgctgatcggcgtcggcgggatttcctcggccgaggaagcctatgaaaagatccgcgccggggcctcggcggtgcagctttactcggcgatggtctacaaggggatcggtctggcggccgaggtcgcgcgcggcctggatgcgcttttggcgcgcgacggctttgcttcggtcgcggaagccgtgggcaccggtcgcagccgc

SEQ ID NO: 45466 - DNA, 1968 bp, Rhodobacter capsulatus
atggggaagcaggaacaggtggtcgcagcgcccgagatgcgggaggttccggcggggtttgagactgcgcatgcgaatggcgcgaaatatctcgagatgtatcgggaatcgctcgagaatccggatgcgttctgggggcgcgagggcaagcggctcgactggatcacgccctataccaaggtgaagaataccgatttcaccttcggcaaggtctcgatcaaatggttcgaggatggggtgctgaacgcgtccgtgaactgcatcgaccggcatctgcgcgaccgcgcgctgcagaccgcgatcatcttcgagcccgatgacccgaaggaaccggcgcgtcacatcacctacaaggagctctccgaaaaggtgaaccggatggcgaacgtgctgctcagccagggcatcatgcgcggcgaccgggtggtgatctatctgccgatgatccccgaggcggcctatgcgatgctcgcctgcgcccggatcggggccatccattccattgttttcgcaggcttttcgcccgatgcgctggcgaaccggatcaatgattgcggcgccaaactggtgatcaccgccgataccgcgccgcggggtggccgccgcacgccgctgaaggcgaataccgatgccgcccttctgcactgctcggacaaggtgcgctgccttgtcgtcaagcacaccggcgatcagatcagctgggtgcatggccgcgatgtcgaccttttgtacctgatggagcacgtcagcccggaatgcccgccccgcccgatgaatgcggaagatccgctcttcatcctctacacctcgggctcgaccggcaaacccaaaggcgtcgtgcatacgacgggcggctacctcgtctatgccgcgatgacgcaccaatacacgtttgattacaaggacggcgacgtgttctggtgcaccgccgatgtgggctgggtgacgggtcccagctacatcatctacgggcccttggcgaacggcgcgacgacgctgatgttcgagggcgtgccgacctggcccgatgcggggcggttctgggcggtgtgcgaaaagcacaaggtcaatcagttctacaccgcgccgacggcgatccgcgcgctgatgggtcagggcccggaatgggttgagaaatatgacctttcctcgcttcgggtgctgggctcggtgggcgagccgatcaaccccgaggcctgggtctggtacgacaaatatgtcggaaaagggaaatgtccgatcgtcgacaccttctggcagaccgagaccggcgggcacatgatcacgcccttgcccggcgcgacaccgacgaaaccgggctcggcgacgaacccgttctttggcgtcaagccggtggtgctggacccgcagaccgcggtgcggatcggcgaggtcgaatgcgagggggtgctctgcatttccgacagctggcccgggcagatgcggacggtctggggcgatcacgaccgcttccaggagacctatttcggccagtatcgcggctattacttcaccggcgacggctgtcggcgcgacaaggacggctattactggatcaccggccgggtcgatgacgtgatcaacgtctcggggcaccggatgggcacggccgaggtggaatcggcgctcgtcgcgcatccgcaggtggccgaggcggcggtggtgggctatccgcatgacatcaagggccagggcatctacgcctatgtgaccctgatgaacgggatcgagccttccgaggatctgcgcaaggatctggtgaaatgggtccgcaccgagatcggcccgatcgcctcgcccgatctgatccaatgggcgccgggcctgccgaagacgcgctcgggcaagatcatgcgccggatcctgcgcaagatcgccgagaacgactatggcgcgcttggcgacatctcgacgctggccgatccgggcgtggtgcaggagctgatcgacaaccggatgaaccgggcc

SEQ ID NO: 45467 - DNA, 3315 bp, Rhodobacter capsulatus
cccgaggccgaggttctgcaggcgcttgtcgcgcaggcggcgctgccgcagccgcagcttgaccggatcgcggcacgcggcgccgatctggtggcgcggatccgggccgaggcgaagccgagcctgatggaacattttctggcgcaatacgggctgtcgacgcgcgagggcgtggcgctgatgtgtctggccgaggcgatgctgcgcgtgcccgacaccgccacgatcgacgcgctgatcgaggacaagatcgcgccctcggactggggcaagcatctgggcacggcggcctcctcgctggtcaatgcctcgacctgggccctgatgctgacgggcaaggtgctggatgacggcgcgggcggcatcgcgggcacgttgcggggcgccatgcggcggctgggcgagcccgtcatccgcgccgccgtgggtcaggcgatgcgcgagatgggccggcagtttgtcttgggcgaaaccattgaaaaggcgctggaacgcgccgaaaagcgcgaggcggagggctatacgttcagctatgacatgctgggcgaggcggcgctgacggcggcggatgccgagcgttaccggctggcctatgcgcaggcgatcacggcgatcggcaaggccgcgacccggggctcgatcgcggccaatccggggatttcgatcaagctttcggcgctgcatccgcgctatgaggtggcgcaggaggcgcgggtcatggccgagctggtgccggtcgtgcgcgatctggcgcgggcggcggcgcgggcggggattgcgctccatatcgacgccgaggaacaggaccggctggccttgtccctgcgggtgatggcggcggtgatcgccgatcccgagaccgcgggctgggagggctttggcgccgtcgtgcaggcctatggcaagcgcgccggggcggcgattgacgcgctcgccgcgatggcacgggcggccgggcggcgcatcaacatccggctggtgaagggcgcctattgggatgccgaaatgaagcgcgcccaggtcgaggggcacccgggctttccgcttttcacttcgaaaaccgggaccgatgtcgcctatatctgcctggctgcgaagctcttcgggctgaacgactgcatctatccgcaatttgcgacgcataatgcgcatacggtcgcggcggtgctggagatggcggcgggccgcccgttcgagttccagcgcctgcacgggatgggggcgcggctgcatgacatcgtgctgcgcgagaccggcgggcgctgccggatctacgcgccggtgggggcgcatcgcgacctgctcgcctatctggtgcggcggcttttggagaacggcgcgaattcgtctttcgtgaaccagatcgtcaatgaaagcgtgccgcctgccgaggtcgcggcctgtccctttgcggcgctgcccacggcgcgggcgccgcgcgggcttctggcgcctgcggatctgttcggcgcgggacgggtcaatgcgcaaggcttcgatctgagcgacccggaggttctggcgcggatcgaggcggcgcgggatgtgaccctgcccgatgcggcgccgatcgtggcggggccggtctcgggcaccttgcgcccggtgcggaacccggccaccggcgcggtcgtggcgcaggtgaccgaggccgatgcggcgacggtggctctggcgctggacgccgcgcaggtctggtcggcgcccgccgccacgcgggccgcggtgctgtgccgcgctgccgatctgtacgaggaaaacttcggcccgatctttgccgccttggcgcaagaggcgggcaagaccttgggcgatgccgtgtcggaactgcgcgaggctgttgatttcctgcgctattatgcggcagaaggggcggcggatacgcgccccccgcgcggtgccgtggtggcgatcagcccctggaactttccgcttgcgatcttcaccgggcaggtcgcggcggccctgatggcggggaatgcggtgctggccaagcccgccgaacagacgccgatcatcgcggcgctggcggtgcggctgctgcatcaggccggggttcccgagacggcgctgcagcttttgccgggcgatggccccaccgtcggcgccgcgctgacccgcgatccgcgcgtggcgggcgtggtcttcaccggctcgaccgagaccgcgcagatcatcgcccgtgccatggccgcgcatctggcgcccggcacgccgctgattgcggaaaccggcgggctcaatgcgatggtcgtcgacagcaccgcgctgcccgaacaggcggtgcgcgatgtcgtcgcctcggccttccgctcggccgggcaacgctgctcggcgctgcgctgtctttacgttcaggacgatatcgccccgcatctgatcgggatgctgaaaggcgcgatggaggagctggtttcgggcgatccggcgcggctttcgaccgatgtcggcccggtgatcgacgccgaggccaaggccgggatcgagacctatctggccgcgaacaaggcgcgcatcctgcatcgcagcaccgcgcccgagggcggccatttcgtcgccccggcgctgctgcaggtcggcggcattgccgatctggagcgcgaaatcttcggcccggtgttgcatcttgcaacattcgccgccgaggatctgcccgcggtgatcgcggcgatcaatgcgcgcggctacgggctgaccttcgggctgcattcgcgcatcgatgcccgtgtcgaaaccgtggccgagacgatccgggcgggcaacatctatgtgaatcgcaaccagatcggcgcggtcgtgggcagtcaaccctttggcggcgaggggctttccggcaccggcccgaaagcgggcgggccgctctatctgaaccgcttctacgcgccagagcctgtcgtggcggtcggcggctggacagaggctgcaacgcccatcctgcccgaagcgagagagacgcagctggacgagatcttcctgcccggcccgacgggcgagctgaaccggctgacgcggcatcaacgcggcccgatcctctgccttgggccgggggccgaagcagcttcggcgcaggcggcggcggttgtggcgctgggcgggcaggcggttcaggcaagcggggccgtgtcccccaaggctttggaaacgctgacacctttggccggtgtgctgtggtggggcgcggccgagatgggccgtgcctatgcgcaggcgctggcggtgcggcccgggccgctggtgccgctgatcactgccaaacccgatctggcccatgttgcgcatgaacgccatctctgcgtcgacacgacggccgcgggc

SEQ ID NO: 45468 - DNA, 1434 bp, Rhodobacter capsulatus
gttctggccatcgatcagggcacgacgaacaccaaggctctggtggtcgcgggcgacgggtcggtgctggcccgcgccgcggccccgctggtgacgcagtacccgcaatccggctgggcggaacaatcggccgaggccctctgggcctcggtgcagcaggtgatcgcgcaggcgttgcaggcggcgcccggcccggtcgatgccatcgccatcgccaaccagcgcgagacgctggtgctgtgggatgcggtcacccatcagccgctctgcccggcgatgatctggcaatgccggcgcacggccgaggattgcgcggcgctggcggcgaccggcatcggcccggtggtcgcggcggcgacggggcttggtctcaacccgctgtttccggcctcgaaactggcctgggctttgcgcaacatccccgccgtggcggccgcgcaggacagcgggcggctgcgggcgggcacggtcgatgcctggcttttgtggaacctgaccggcggcgcggtgcatgcgaccgatcattcgaacgccgcgcgcacgcttttgttcgacaccgcaagcctgagcttctcgcccgagcttgccgcgatctttgccgtgccgatggcctgcctgccgcagcccttgccctcggacagcctgttcggcacgacggccgcgggggtgacggcgctgcctgcgggcgtgtccattcacgcgatgatgggcgacagccatgccgcgctttacggccatggcgtgcgcgcgcccggtgcggtcaaggcgacctatggcacgggctcctcgctgatgacgctgacgccggcgcgcgtgacgtcacgccacgggctttcggggacgatcggctggacggaccggcagggcacggcctatgcgctggaaggcaatatcaccgtctccgcgcaggcggcggccttcatggcgaaactgctggggctcgcggatgcccgggcgctctcggatctggcgcagaccgtgcccgatgcgggcggcgtgagcttcgttccggcgctggcggggcttggcgcgccgcattggaacgacgcggcccgcggcacgctgaccggcatgagccatgccaccggccccgcccatctggcgcgggcggcgcttgacgccatcgcgcatcagatcgccgatgtcttcgaggcgatgcaggccgatatcggccatccgctggcggcgctttcggccgatggcggcgcttcgggcaatgatttcctgatgcagctgcaggccgatctgatcggccgtccggtgcaggtcgcggcgctggaagaggtgggggcgatgggcgtggccgcgatggcgatggcggcccttggccaccggctgccgctcgccgcgccgaaaccgccgttccaccccggcctgcgaccggccgagcgcgaccggcaacgccgcgcctgggcccatgccgtcgcccaggcc

SEQ ID NO: 45469 - DNA, 1670 bp, Rhodobacter capsulatus
ggccatccgggcggcgatttttccgccatcgacattctggcgacgctttatttcggggtgatgcgccatgacgcgacccgccccgactgggccgagcgggaccggttcatcatgtcgaagggccatgcgaccggcgcgctttacaccgcgctttgtgccgcgggctatttccccgagggctggttgcagacctacatgcagccgcgctcgaagctgaacgggcacccgaaccgcaactatctgccggggatcgagacgaacaccgggcccttgggccacggtttcccggtggcgacgggcatcgcgattgcggggcagctgaccggggcggactatcgcaccttcgttctgaccggcgacggcgaacagcaggagggctcgaactgggaagcggcgatgacggccgggttccgcaagcttgaaaacctgacgctgatcatcgaccgcaaccggctgcagcagggccaatcgaccgaggagacctcggggatggaaccgctggacgagagataccgcgccttcgggtttgaggtggcggtggtcgatggccatgatcttggtgcgcttttggatgtgctctcggccgcgcccaagggccggggcaagccgctttgcgtgatcgccaatacggtcaagggcaagggcgtgtccttcatggaaaatcaggcgaaatggcaccacggcgtgcccgatgatgcgcaattcgcgcaagcgatgaaggagctggtgtgatgtcgcatgctgcaccgatcaaggcgggtctggccgattgccgcaatgcctgggtggaaacgctcgaggctttggcggccgaggatgagcgcatcgtcgccgtggtgaacgactcggtcggctcgtcgaagctgaacgggtttcagaagaaattccccgaccggctgatcaatgtcggcattgccgaacagctgatggtgggcgtggccgcggggctggcgaacgggggccggatccccttcgtctcggcggcctcgtgctttctgaccgggcgcgcgctcgaacaggtcaaggccgatgtggcctatgccgggttcaacgtgaagctggtcggtcaatcctcgggcgtggcttatggcgaattgggcgcgacgcaccattcgatcgaggatttcgcctggctgcggcccctgacgacgatcaccaccatcgcccccgccgatgcctgggaaaccgcggaagcggtgaaatgggcggcgggccatgacgggccggtctatctgcggctgtcgcgcatgccggtgcccgatctcgacattccgggccgcaaattcacccccggcaaggccgaggtggtgcgcaagggcggcgatgtcacggtgattgcctgcggaacgacggtgcatctggcggccgaggccgcggaccggctgtcggacaagggcctttcggtaagggttctgaacatggccacgatcaatcccatcgatgttgacgccattctggcggcggcgcgcgaaaccggcgccatcgtcacggtcgaggaagcctcggtccgcgggggcctgggcggcgcggtggcggaaatcaccgcgggcgaatgcccggtgccggtcgaacggctgggctttccgggcttcgtgcccaccggctcgaccgaatggctgttcgaggaatacgggctttccgtcgcggggatctcggcggcggtgcgcaag

SEQ ID NO: 45470 - DNA, 1227 bp, Rhodobacter capsulatus
atgcggcgcgtcgtcatcaccgggctgggcatcgtcagccccatcggcaactctgccgaagaggtttcggccagcctgcgggccggtcgctcgggcatcgtctttgcccccgaatatgccgaacgcggtttccgcagccagatccatggcgcgccgcagatcgtgctggaagaccatatcgacaagcgcaacctgcgcttcatgggccgcggcgccgcctacaacttcctgtcgatggaacaggcgatccgcgattcggggcttgaggaaagcgacatctcgaacccgcgcaccgggctgatcatgggctcgggcgggccctcgacctcgaacttcttcgaggcgcatcagaccgtgctgcaaaagggcgcgcccaagcgcatggggccgttcatggtgacgcgctgcatgtcgtcgacgaactcggcctgtctggcgacgcccttcaagatcaagggcgtgaactattcgatcacctcggcctgctcgacctcggcgcattgcatcggcaacgcggccgaactgatccagatgggcaagcaggacatcatcttcgccggcggcggcgaggaactggactggacgctgtcgtgcctctttgacgcgatgggcgcgatgtcgtcgaaatacaacgacacgccgaccaccgcggcccgcgccttcgacgcgacccgcgacggctttgtcatcgcgggcggcggcggcgtgctggttctggaggaactcgaacatgcgaaagcccgtggcgcgaagatctatgccgaagtgaccggctacggcgcgacttcggacggctatgacatggtcgccccctcgggcgagggcggcgaacgctcgatgcggctggcgctgggcacgctgcccgaaggccgccagatcacctatatcaacgcgcatggcacctcgacccccgcgggcgacgtgaccgaggtcgaggccgtccgccgcgtcttcggcgcgggcaaggtgccgccgatctcgtccacgaaatcgctgaccggccacagcctcggcgcgaccggcgtgcatgaggcgatctattgccttttgatgatgcagggcaaattcatcaccgcttccgcaaacgtcaccgagctggatcccgcgatcaagcccgaggaaatcgccaccaagctggtcgaaaacgtcgagttcgactcggttctgtcgaacagcttcggctttggcggcaccaatgcgacgctggtgatgagcgcttacaagggc

SEQ ID NO: 45471 - DNA, 792 bp, Rhodobacter capsulatus
gtgttcctgtttgcgggccgggccgaatatgccgagaaatacggtcccgcggcggcggatctggcggcgcgcggctatggcacgctggtgatcgactggcgcggacaggggctgtcggaccggctgatcgccgatccggtcaagggcttcgtcggcaagttcagcgattatcagcgcgatgtcgatgcgatgctggcggcggcggcgcagcttgatctgccgcggccctgggtcgtgctggcgcattcgatgggcggcacgattgcgctgcgccgtctgatgggaacgcatccctttgctgccgttgccttttccgcgccgatgtggggcgtgggcctgccccgggcgatccggcctttcgggccggtgctggcgcggatgaccggatcaagcccctttgcgctgcgctatgcgccgggttgggggccggtcaccttcgtgcatcgcgcggggtttcacgacaatttcctgaccaccgatcccgacatgtgggcgctgctgctgcggcaggtggccaaggcgccggggctggcgatcgccggggcctctctgcactgggtggccgaggcggtgctggaatgcgaagccttggccgacgtgcccgcgcccgacctgccctgccattgcgcccttggcacgcgggagaggatcgtgccgaaggcgccgatccgcgaccgcatggcgagctggccgcgcgcggagcttgccctttacgacggcgccgagcacgaggtgatgatggaaggccccgcgatgcgggcgcggttctacgacgcctgcgccgcgctgttc

SEQ ID NO: 45472 - DNA, 1278 bp, Rhodobacter capsulatus
ccgatgaccgaccaggcctttgacacgctgcaaattcacgcgggcgccgaacccgatcccgcgacgggcgcgcggcaggtgccgatttaccagaccacctcctatgtcttcaaggacgccgaccatgccgcgcgcctgttcgggctgcaggaggtgggctatatctattcccgcctgaccaacccgaccgtttcggcactggccgcccgcgttgcggcgcttgaaggcggcgtgggcgcggtctgctgctcgtccggccatgcggcgcagatcatggcgctgtttccgctgatggggccggggctgaacatcgtcgcctcgacccggctttacggcggcacgatcacccagttcagccagaccatcaaacgcttcggctggtcctgcacctttgtcgatttcgacgatctggcggcgctcgaggccgcggtggatgacaacacccgggcgatcttttgcgaatcgatctcgaacccgggcggctacatcaccgacctgcccgccgtcgcggcggtggcgaacaaggtcggcctgccgctcattgtcgacaacacgctggcctcgccttatctctgccgcccgatcgagcatggcgcgacgctggttgtccattccgccacgaaatacctgaccggcaacggcacggtgacgggcggggtgatcgtcgattcgggcaagttcgactggtcggcctcgggcaagttccccagcctttcggcgcccgaacccgcctatcacgggctgaagttccacgaggcactcggcccgatggccttcaccttccattcgatcgccgtcgggctgcgcgatctgggcatgacgatgaacccgcagggcgcgcattacacgctgatggggatcgagacgctcagcctgcgcatggacaagcacgtcgccaatgcgaaggcggtggcggaatggctggccaaagacccgcgcatcgacttcgtcacctgggccgggctgccctcctcgccctggcacgaacgcgccgagcggctttgcccgaagggggcgggggcgcttttcaccgtcgcggtcaagggcggctatgaggcctgcgtgaaattggtcaacaatctcaagctgttcagccatgtggcaaacctgggcgacgcgcgctcgctgatcatccattcggcctcgaccacgcaccgtcagctgaccgaggaacagcagatcaaggcgggggcggcgccgaatgtggtgcggctctcgatcgggatcgagaatgccgccgatctgatcgccgatctggatcaggctctggccgccgcc

SEQ ID NO: 45473 - DNA, 1314 bp, Rhodobacter capsulatus
tggctgaaggagcatcccgaggtgcgcaccattcgcgtggctgcggcggacctcaacggggtggcaaggggtaagcgcatacccgcacgtttcgcaagcaaggttttttccgagggaacacggtttccgttctcggtgatgaacctcgacatctggggcgaggacatcgaggaaagtccgctggtgtttgaaaccggcgactgcgatggcctgttgcgcccgaccgagaggggcttcatgccgatgccctggctcgaggcaccgacggcgcttctgccgatctggatgtttcacatggatggccgcccctattcgggcgatccacggcaggcgctggcgcgggtcaaggaccgctacaccgaaaagggcctgacgcccgtggtggcgacggaacttgaattcttcctgatcgacgacagcggcacgaagctgcgcgtgccgccctcgccccgttccggcaagcgccgcaccgggggggaaatcctgtcgctgcgggcgcttgacgcctttgacggcttcttcaccgcgctttacgaggcctgcgaggtgatggacattcccgcagatacggcgatttccgaggccggcccggggcagttcgagatcaacctgatgcatcaggccgatccgctgaaggccgccgatgacacctggctgttcaagatgctggtcaagggtctggcgcggcagcacggctttgccgcctcgttcatggcgaaaccctatgatctgtggtcgggcaacgggatgcacacgcatttctcgatcctcgatcagaacggcgagaacatcttcaacgatggcaccgaaaagggctcggatgcgctgcggtccgcggtggcgggctgtctggcggcgctgccgggatcgacgctgatctttgcgccgcatcagaacagctacacccggctggtgcccaatgcccatgcgcccacgggcatcggctgggcctatgagaaccgcaccgcggccttgcggatcccgtcttcggggcccgcggcgcggcggatcgagcatcgggtggcggggggcgacgtgaacccctatctgatgatcgcggcgatccttggtgcggcgctggtcgggcttgaagacaagatggtccccgacgagccgatcgtcggcaatgcctatgcgcaatatctgccgcagctgcccgcaacgtggaacctcgcgatcaaccagttcgacagctgcccgctgatcaagcgcatcttcgaagaagagctgatcgagaacttcctgatgaccaagcgtcaggagatccactacatggcggaactgtccgaagaagagcagaccgagctttacctc

SEQ ID NO: 45474 - DNA, 996 bp, Rhodobacter capsulatus
atgggctacaaggtcgtcgtcgtcggtgccacgggcaacgttggcaaggaaatgctgaacattctcgccgagcgcgagtttccggtggacgaaatcgcggcgctggcgtcgcgcaagtcgcttggcaccgaagtcagctttggcgaccgaactttgaagacccaggacctcgacacgttcgatttcaccggctgggacatcgcgctcttcgcgatcggctcggacgcgacgaaagtctacgcgccgaaagccgcgtcgcagggctgcgtggtgatcgacaactcctcgctgtaccgttacgacccggaaatcccgctgatcgtgcccgaggtgaacgctgatgacgtcgtgcgctacaccaacaagatgatcatcgcgaacccgaactgctcgaccgcgcagatggtggtggcgctgaaaccgctgcatgaccgcgcgaaaatcaagcgcgtcgtggtctcgacctatcaatcggtctcgggcaccggcaaggaagcgatggacgagctttggaaccagaccaagggcatgtatgtccccggtcaggaagtcgcgcccaaggtttaccccaagcagatcgccttcaacgtgatcccgcatatcgacgtcttccttgattccggcgagaccaaggaagaatggaagatggtggccgagacgaagaagatccttgatccgtcgatcaaagtcaccgcgacctgcgtgcgcgtgccggtcttcgtcggccattcggaagcggtgaacatcgagttcgaggaattcctcgactgggaagaagcgaccgagatcctgcgcgaagccccgggcgtgctcgtcgtcgacaagcgtgaagccggtggctacatcacgccggtcgaatgcgtcggcgaatatgccacctacatctcgcgcatccggcaggacagcacgatcgagaacgggctgaacctgtggtgcgtctcggacaacctgcgcaagggcgcggcgctgaatgcggtgcagatcgccgaagtgctg

SEQ ID NO: 45475 - DNA, 690 bp, Rhodobacter capsulatus
atgctgaccctcgataacctcctgatcgaacaggatgatttccgcctgagcgcggatttcgccatccccccggccgcgcgggtggcgcttttgggcccctcgggcgcggggaaatcgacgctgcttgcgacgctggcggggtttctggcgcccggccgtggccggatcctgtggcgcggcgccgacatcaccggtctggcgccgggggcgcggccgctctcgatcctgtttcaggaccagaacctgtttccgcatctgaacgtggcgcagaacctcgggcttggcctgtcgccaaagctgcggctggcccgtgccgatcacgcgcagatcgcggcggcgctcgaccgggtcgggctttcggggctgggggatcggcggcccgcgacgctttcgggcgggcagcaaagccgggtggcgctggcgcgctgtctgttgcgggcgaaaccgcttctgcttctggacgagccctttgccgcgctgggccccgcgctcaaatccgacatgctggcgctggtggccgagatcgccgcggaccagcacgccaccgtgctgatggtcagccacgagcccgccgatgccgtcgcgctttgcccgcaaaccgtgctggtggccgagggcgtcgcccatccgcccgccgccaccgcgggccttctggctgatccgccgcccgcccttgccgcctatctgggc

SEQ ID NO: 45476 - DNA, 1365 bp, Rhodobacter capsulatus
gaaaaggctttgatcgtcaaacgcttgcgggcaatcctgccgcgcgattcggtgatcgacgatccggcggaaacccgggcctatgaatgcgatgcgctctcggcctatcgctgcgcgcccctggcggtcgtgctgccgcgcaccaccgaagaagtcgcggcctgcctgaagctgtgccacgagatgggcgttccggtggtgccgcgcggcgcgggaacctcgcttgccgggggctcgatgccctcggccgatgccgtcgtgctggggctggcgcggatgaaccgggtgctggaggtcgattacgccaaccgcttcatccgggtcgaggccgggcgcacgaacctctccgtcaccggcgcgatcgagggcgagggctggttctacgcccccgacccctccagccagctcgcctgcgcgatcgcgggcaatatcgggatgaattcgggcggcgcgcattgtctcaaatacggcgtcaccaccaacaacctgctgggcgtcaagctggtcaccatgcagggcgaggtggtcgagatcggcgggccttattgtgacgcgggcgggttggaccttttgggcgtcatctgcggctcggaagggcaattgggcgtggtgaccgaggccactttgcgcatcctgcgccagcccgaaggcgcgcggccggtgctgatcgggttttcctcaaacgaggtcgcgggcgcctgcgtcgccgacatcatccgcgcgggcatcctgcccgtggcgatcgaattcatggaccgcccctgcatcgaggcgaccgaggccttttgccatgcgggctaccccgattgcgaggcgctcttgatcgtcgaatgcgagggcagcccggccgagatcgccgagcagctgggcctgatccggcagattgcgacgggccatgacccggtggagttccgcgaggcgcaatcgcccgaggaggcgaagcggatctggctgggccgcaaatcggcctttggcgcgatggggcaaaagggcgattacatgtgtctcgatgggacgattccggtttccgccctgccgatggtgctgcgccggatcggcgagatctcgcgcgacttcgggctggaggtcggcaatgtctttcacgcgggcgatggcaacatgcacccgttgatcatctacaacgccaatcagcccgggcagcaggaactgtgcgagcggatgggggcggagatcctgaagctgtgcgtcgaggcgggcggctgtctgaccggcgaacatggcgtggggatcgaaaagcgcgatctgatggcggtgcaattcgcgcccgaggatctggaggcgcagatgcgggtcaaggatgtgtttgatccgaagtggttgctgaatgccgcgaaggtgtttccg

SEQ ID NO: 45477 - DNA, 642 bp, Rhodobacter capsulatus
atgctcgaattcgacaatgtcagcaagtccttctggaccggcaagcggcgcaaggtcatcctggaccgggcgtctttccgcgtcgaactgggcaattcgctgggcattcttgcgccgaacggcaccggcaagacgacgatcatcaacatgatggcggggctcgaaaaacccgacgagggcgagatccgcaagacctgccggatctcgtttccgctgggcttcatgggcggcgtcgtaccgcgtcattccggccgcgagaacacccgcttcatcgcccgcctttacgggcttgaccccgattacgtcgaagccttctgccgctggctctgcgggcttgaagaatatttcgacatgccggtgggcacctacagccagggcatgcgggcgcggctgacctttgccttgctgctggcgctggaattcgacatctacctgatcgacgaggggatgccctcgaccaccgatgtcgaattcaaccgcaaggccggggcgatcctgcgcgaccggctgagagaagcgacggtgatcgtcgtctcgcatcaggccagcacgttggagaagttctgccgctcggcggcggtgctgcgcgacgggcagctttacatgttcgacactctggaagaagcgaaacggatgtatgac

SEQ ID NO: 45478 - DNA, 1584 bp, Rhodobacter capsulatus
gcgcgacttgttgcggaggatctgatgacgactcatctgctggttctggatgcgggcacgggctcgggccgggccgttgttttcgaccgggcgggcaaccaggtcggcgtggcgcaggaagaatggcgccatctgcccgaacccggcgtgcccggctcgatggcctttgacatcgcggggggctgggcgctgttgcggcgctgcattcagggcgcgctggccagctgcgggctgaccggccgcgacatcgccgcgatcagcgccacctcgatgcgcgaggcgatcgtgctttatgacggcgcggggcgggaaatctgggcctgcgccaatgtcgacagccgcgccggcgccgaggtggccgagctgcgggcccgctcggccggtttcgagcgcgacttctatgacatctccggcgaggcctttgcgctgggcgccctgccccggctgaactgggtgcggcggcacgcccccgaggttttcgaacgggtgcgggcgatctcgatggtgaacgactggatcggcaagcggctgaccggggaaatcacggtggagccgacgaatggctcgacgaacgggcttctggatctgacgacgcggcaatggtcggaggttctgatcgccaaggccgggcttgaccgcgcgatctttccgcgcatcgtcgagccgggcacggtgatcggcgaggtgacggccgcggccgccgccgataccgggctgcgcgcaggcacgccggtggtggcgggcggcggcgatgtgcagctgggcgcgatcgggctgggcgtggtcgaacttggcgcggcggcggttctggggggtactttctggcagcaggtggtgaacatcccgcagggcaaggtggatgaaaccatgcggctgcgggtgaatgcggcggcgctgccggggatgaaccaggccgaggcgctgacctttttcgtcggcctgacggcgcgctggttccgcgatgccttctgtcaggaagaggtgcgacgggcggccgagaccggccgtgacgcctatgcgctgatggaagagctggcgatgcaggttccggccgggtcgcacgggatcatcccggtcttttccgatgcgatggatttcggcaactggtatcacgccgcgccctcgctgctgaacctgtcgatcgatccggcggtggccaacaagggctcgatcttccgggcgattcaggaaaatgcggcgatcgtcgcggcagtgaacctggcccgggtcgaggctttcgcgggcgtcggcggcaccgggccgctggtccttgcgggcggcgcggccaagggggtgctctggccgcagatcctggccgatgtgaccggccgcgagatccacattccggtggtgcgcgaggcgacggccttgggcggcgcggcggcggcggcgacgggcgtgggccagttcgccaccatcgccgaggccgggcgggccttcgtgcgctgggaccggacgatccgccccgacgcgaccaatcgcgcggtctacgacgaggcccgcgggcgctggcaggccgcctatgcggcgcaaaaggcgctggtcgatgccgggctgaccacctcgatgtggcgcgccccgggc

SEQ ID NO: 45479 - DNA, 1841 bp, Rhodobacter capsulatus
ccgccgagacctacgacactctcgccgcccggcatgtctcgctcgcccgggtgcttgcccttttcgccccctatcggcgccgcatcgccggggtggtcgcgctgatgctgcttgccgccgcgatcggtctggccgggccgttcctgttgcgcgccgtgatcgatgtggcgctgcccgggcaggatctggggctgctcctgcttctggtcggcggcatggtcacggtggcgctggccgccgcggcggtgggcgcctggcaggtggtgctgaccgcgcgcatcggccaggcgatcctgcacgatctgcgggtccggctttacgcgcatctgcaaagcctgtcgctgcgcttcttcaccggcacccggacgggcgaggtgcaatcgcgcatcgcgggcgacatttcgggcctgcaggcgatgctgaccgagaccgcctcggaactcggccgggcgctgtccgcggtggtgatgaccgccatcgccatcgtgatcctggattggcggctggcgcttttcgttctggtcatcgtgccgggcacggtgctgatcagccaccgcgtcgccaggctgcgcgaggcgctgatgtggcagcgtcaggcccgggccgccgatctttccgccgcggtgcaggagacgctctcggtgccggggatcattctggcccgcacgatggggcgcggcccgcatctgacgcgccgctttgcgcggctctcggacgatctggcgcggcttgacgcgcgggcgcagacggcgggcgaagggcagtggatgctgatcggctttgcgctcgccgttctgcccgcgctgacgctgctcgcaggcgggctgttgatgcgcagcgacgatccggccagcatcggcacgctggtggcgatgatcgcgctgcaggaacagcttctgtggccctttgaacagcttctggaaatcggccgcgacctgcgcaagactcgcgcgctcttcgcccggatcttcgaatatctcgacacgccggtcgaaattacggagcgcccggcgccggtcacgctggagcgtgcccggatgcgcggcgccatcgagctggaccatgtcagcttttcctatgccggcgccgcccgcccggcggtggacgatatcagcctgaacatcccggcgggcagccatgtcgccatcgtcgggccgaccggctcgggcaagacgacgctcggctatctcttggcgcggctttacgatgtcgatcacggcgcgatccgtttcgacgggatcgacctgcgcgatctgagcttcgggacgctgtcgcagatgctgggcgtggtctcgcaggaaccctatctgctgcatgcctcggtggcggaaaacctgcgctttgcccgccccgaggcgagtgacgccgagctgatcgccgcggcgaaagtggcgcagatccacgatcatatcgccgccctgcccgagggctacgagacccgggttggcgaaggcgggttccgcttttcgggcggcgagaaacagcgtctggcgctggcccgcacgatcctgcgcgacccgccgatcctgcttctggacgaggcgacgagcgcgctcgatacccgcaccgaaagggcgatgtcggaagcgctcgacgggctggcaagggggcgcaccaccatcactatcgcgcatcggctctcgacggtgcggcatgccgaccggatcgtggtgatgcaggccgggcgggtggtcgaagagggcccgcatgagaccttgcgcgcgcaaggcggtctttacgccaaactgctgcgcggcacctgagcgcgggatgcgggcctgtgttcagtccctgcatctggtgggccatgttgcgcgcgatcagcttccggacggacgttg

SEQ ID NO: 45480 - DNA, 777 bp, Rhodobacter capsulatus
atgaccgggcaacttgcgggccgcaccatcttcatcaccggctcgggcggcgtgctgggatcaacctatgtgcgccggatgctggaccaaggcgcccgggtcgtcgcgaccgatctgccggggcaccgggccgaggcgctgcaggcggcccatgcgggcaacgcggccttccgcttctacgatctcgacgtgggcgacgaggcgcaggtgaccgagattttcaaacgcgttcttgccgatggctgggagccgaacgtggtgctgaacaatgccgcgatcaccggcgagatgctgatgggcgcgggcaagcccttcccggatttcgccgatacctcggtcgcggatttcgaacgcaccctgcgcaccaacctcaccggcgccttcatggtggcccggcagatggaccgcgatatcgtcgggcgctggccggcaacgctgatcaatgtggcgtcgatgtatgctttgaacggcgcgcatcacccgatctatgacggcatgccgttcaagaatttctcggcttacggcgtgaccaaggcgggcatccacgggctgacggtctggctcgcgggctactgggcgccgcgcggcgccaccgtcaacaccatcgccccgggcgcggtcttcaacaaccattccgaggaattccagcgccgcgtgggcgagctgatcatgatgggccgcatggccaagcccgatgaaatcgccgatgcgatgctgttcctgtgctcggcgggggcgggttacatgaccgggcagctggtcaatgtcgatggcggg

SEQ ID NO: 45481 - DNA, 1416 bp, Rhodobacter capsulatus
atggcaagcaaaggcaaagtgacccaggtcatcggcgccgtcgtcgacgtgcagttcgaagacggcctcccggcgattctgaacgcccttgaaaccaccaacaacggcaagcgcctcgttctcgaagtggcgcagcacctgggcgagaacaccgtccgcaccatcgcgatggacgcgaccgagggtctcgtgcgcggcgcggccgtgtccgacaccggcggcccgatcaccgttccggtgggcaacgccaccctgggccgcatcctgaacgtcatcggcgagccggtggacgaacgcggtgacgtgtcgaaagccgaagcccgggcgatccaccagcccgcgcccgatttcgcggcgcagtcgacggaaagccagatcctcgtcaccggcatcaaggtgatcgacctgctcgccccctattccaagggcggcaagatcggtctcttcggcggcgccggtgtgggcaagaccgttctgatcatggaactgatcaacaacatcgcgaaagtgcactcgggcttctcggtgttcgcgggcgttggcgaacggacccgtgagggcaacgacctttaccacgagatgatcgaatcgggcgttatcaacctcgagaagctcgaagaatcgaaagtggcgctggtctacggccagatgaacgaacccccgggggcccgtgcccgcgtggcgctgaccggcctgaccctggcggaacagttccgcgaccagtcgggcaccgacgtgctgttcttcgtcgacaacatcttccgcttcacccaggccggttcggaagtgtcggcgctccttggccgtatcccctcggccgtgggctaccagccgacgctggccaccgacatgggcgcgctgcaagaacgcatcacctcgaccaaagccggttcgatcacctcggttcaggccatctacgttccggccgacgaccttaccgacccggccccggccacgtcctttgcccacctcgacgccacgaccgttctgtcgcgtgcgatctcggaactcgggatctacccggccgtcgacccgctcgactccacctcgcggatccttgacccgcaagtcgtcggcgaagagcactatcaggtcgcccgtgacgtccaagggatgctgcaacgctacaagtcgctgcaggacatcatcgccatcctcggcatggacgaactgtcggaagaagacaagctgacggtggcccgcgcccggaagatccagcgcttcctgtcgcagcccttcgacgtggcgaaagtcttcaccggctcggacggcgtgcaggttccgctcgaagacaccatcaagtcgttcaaggcggtggttgcgggcgaatacgaccacctgccggaagcggccttctacatggtcggcggcatcgatgacgtgatcgcgaaagcccagcgcctcgccgctgcggcg

SEQ ID NO: 45482 - DNA, 870 bp, Rhodobacter capsulatus
atgcccagccttaaggacctcaagaaccggatcgtgagtgtcaagaacactcgcaagatcacgaaagcgatgcagatggtcgcggcggcgaaacttcgccgcgcccaggaaagcgccgaagctgcccggccctatgccgagcggatgaacgccgtgatgtcgagccttgccggtgcggtgggctcgaccgacggtgcgccgcgcctacttgcgggcacgggctccgacaaggtccatctcctcgtcatcatgacgggcgagcgcgggctttgcggcggcttcaacgccaatatcgcgaaactcgcgaaggcgaaggcgatggaactgctggcccagggcaagacggtgaagatcctcaccgtcggcaagaaaggtcgcgacgcgctgcgtcgtgatctgggccagtattacatcgatcacatcgacctgagcgacgtgaagaaactgagctacccggtggcgcagaagatttcgcaaaacatcatcgaccgcttcgaggcgggcgaatacgatgtggcgacgatcttcttctcggtcttccagagcgtgatcagccaggtgccgaccgccaagcaggtgatcccggcgcagttcgaaaccgatgcggcctcggcctcggcggtttacgactacgaaccgggcgatcaggaaatcctgaccgcgctgctgccgcgtgcggtggccacggcgatctttgccgcgctgctggaaaacaacgcgtccttcaacggggcgcagatgtcggccatggacaacgccacccgcaacgcgggtgacatgatcgatcgcttgaccatcgagtataaccgctcgcgtcaggccgccatcaccaaagagctcatcgaaatcatctcgggcgccgaggcgctc

SEQ ID NO: 45483 - DNA, 1527 bp, Rhodobacter capsulatus
atgggcatccaagcagctgagatttctgcgatcctcaaggagcagatcaagaacttcgggcaggatgcccaggtcgccgaagtgggccgcgtgctctcggtcggtgacgggatcgcgcgcgtgcacgggctcgacaacgtccaggcgggcgagatggtcgaattccccggcggcatccgcgggatggcgctgaaccttgaagtcgacaacgtcgggatcgtgatcttcgggtcggaccgcgacatcaaggaaggcgacaccgtcaagcgcaccaacgccatcgtggacgttccggcgggcgaaggcctgctgggccgcgtcgtggacggccttggcaacccgatcgacggcaagggcccgatcgtggcgaaagagcgtcgcatcgccgacgtcaaagccccgggcatcattccgcggaaatcggtgcatgagccgatggcgaccggcctcaagtcggtcgacgcgatgatcccgatcggccgcggccagcgcgagctgatcatcggcgaccgtcagaccggcaagaccgcgatcgcgctcgacaccattctgaaccagaagtcgtacaacgacgccaacccgggcaacaagctgcactgcttctatgtcgccatcgggcagaagcgctcgaccgtggcgcagctggtgaagaagctcgaagaagccggcgcgatggaatacaccaccgtcgtcgccgcgaccgcttcggacccggcgccgatgcagttccttgccccctattcggcgaccgcgatggcggaatacttccgcgacaacggcatgcacgcgctgatcatctatgatgacctctcgaagcaagccgtggcctatcgtcagatgtcgctgctgctgcgccgtccgccggggcgtgaagcctatccgggcgacgtgttctatctgcactcgcgcctgctggaacgttcggcgaaactgaacgaggatttcggttcgggctcgctgaccgcgctgccggtcatcgaaacccagggcggcgacgtgtcggccttcatcccgaccaacgtgatctcgatcaccgacggtcagatcttcctggaaaccgaactgttctaccagggcatccgcccggccgtgaacaccggtctctcggtgtcgcgcgtcggttcgtcggcccagaccaactcgatgaagtcggttgccggtccggtgaaactggagcttgcgcagtatcgcgaaatggccgcctttgcgcagttcggttccgaccttgacgccgcgacgcaaaagctgctgaaccgcggtgcccgtctgaccgagctgatgaaacagccgcaatattcgccgctgaccaacgccgaaatcgtggcggtgatctttgcgggcaccaacggcttcctcgatgccgttccggtgaaggaagtcggccggttcgagaaaggcctgctggcctatctgcgctcgacccgcaaggacgtgcttgagtggctcaccaaggaagaccccaagatcaagggcgacgccgagaagaagctcaaagacgcgatcgccgagttcgccaagaccttcgct

SEQ ID NO: 45484 - DNA, 558 bp, Rhodobacter capsulatus
gtgtccgaaccagcttcgatttccgcagccattgccgggcgttatgccacggccatcttcgacctcgcgcaggaggccaagggcatcgacgcgctctcggccgacgtggacgcgctgacggccgccttggccggttcggccgagctgcgtgacctgatttcctcgccggtctacacccgcgaggagcagggggacgcgatcgccgcggtggctgcgaagatgggcctgtcggcgccgcttgccaacggtctgaaactgatggcgacgaagcgccgtctgttcgcgctgccgcagctgctcaagggcctggccgccgcgatcgccgaagccaagggcgagatgaccgcggatgtcacctcggccaccgcgctgagcgcggcgcaggccgagaagctggcggcgacgctggcgaaacagacgggcaagaccgtcaaactgaacgtcgccgtcgatgaaagcctcatcggtggcatgatcgtcaagctgggttcgcgcatgatcgacaccacggtcaaagccaaactcgcttcccttcagaacgccatgaaagaggtcgga

SEQ ID NO: 45485 - DNA, 2220 bp, Rhodobacter capsulatus
ttttcgaccacgctcgagcaagcaattcacgccgcactggcgctggccaacacgcgcaaacatgaactggcgacgctcgaacatcttctgctcgcgctgatcgacgagcccgacgccagccgcgtgatgcgcgcctgcggcgtcgatcttggcgagttgcgcaccaccctgaccgagttcatcgacgatgatctctcgacgctgatcaccgaagtcgaaggctcggaagccgtgccgaccgccgccttccagcgggtgatccagcgcgccgcgatccatgtgcaaagctcgggccggaccgaggtgacgggggcgaatgtccttgtcgcgatctttgcggaacgggaatcgaacgcggccttcttcctgcaggagcaggacatgacccgttacgacgcggtcaatttcatcgcccatggcgtggccaaggatccggccttcggcgaaagccgtcccgtcatcggcgccgaggaggaaaccgccaaggccgaagccgcgcaaccgggcgaggcgaaggaatccgcgcttggcaaatactgcgtgaacctgaaccagaaatcgcaaaagggtgacatcgacccgctgatcggccgcgccgaagaggtggaacgctgcattcaggtgctctgccgccgccgcaagaacaacccgcttctggtgggcgatccgggcgtgggcaagaccgccatcgccgagggtctggcgctgaagatcacccgcggcgagacgcccgacatcctggcccgctcgacgatctattcgctcgacatgggggcgcttctggcgggcacccgctatcgcggcgatttcgaggaacggctgaaagcggtgatgaaggagctcgaggatcaccccgatgcgatcctcttcatcgacgagatccatacggtgatcggggcgggcgccacttcgggcggggcgatggatgcctcgaacctgctcaagcccgcgctgcagggcggcaagctgcgctgcatgggctcgaccacctacaaggaattccgtcagcacttcgaaaaggaccgcgcgctgagccgccggttccagaagatcgacgtgaacgagccctcggtcggcgacagcatcaagatcctgatggggctgaaaccctatttcgaggaacatcacgacgtgcgctacaccaacgacgcgatcaagtcggcggtggaactggcggcgcgctacatccatgaccgcaagctgcccgacaaggcgatcgacgtgatcgacgaggcgggggcggcgcagcacctgctgcccgacagcaagaagcgcaagaccttgggcgcgaaagagatcgaggccgtggtggcgaagatcgcccgcatcccgccgaaaagcgtgtcgaaagacgatgccgcgatcctgcgcgatctggaaaagacgctcaagcgcgtggtcttcggtcaggacaaggcgatcgagacgctggcctcggcgatcaagctggcccgcgccggtctgcgcgagccggaaaagccgatcggcaactacctgttcgcggggccgaccggcgtcggcaagaccgaggtggcgaaacagctggccaatacgctgggggtggagctgctgcgcttcgacatgtcggaatacatggagaaacacgcggtcagccgtctgatcggcgcgcctccgggctatgtcggcttcgatcagggcgggcttctgaccgatggcgtcgatcagcatccgcattgcgtgctgctgctcgacgagatcgaaaaggcgcattcggacgtgttcaacatcctgctgcaggtgatggaccacggcaagctgaccgatcacaacggccgtcaggtcgatttccgcaacgtgatcctgatcatgacctcgaacgcgggggcggcggagcaggcgaaatcggcgatcggctttggccgcgaacgccgcgagggcgaggatacggcggcaatcgaacgcaccttcacgccggaattccgcaaccgtctggatgcggtggtcagcttcgcgccgctgccgcgcgacacgatcctgcaggtggtggacaagttcgtgctgcagcttgaagcgcagctgatcgaccgcaacgtccatatcgagctgacgcccgaagccgccgaatggctggcggtcaagggctatgacgacaagatgggcgcgcgtccgctgggccgggtcattcaggagcacatcaagaaacccctggcggaagaacttctgttcggccgcctgatcaagggcggtgtggtccgggtg

SEQ ID NO: 45486 - DNA, 1050 bp, Rhodobacter capsulatus
atccgcccccagcccggcatcctcgacatcgccctttacgagggcggcgcttcgcatgtggccggcatcagcgatgcgatcaagctcagctcgaacgagaacccgcacggggcctcggaccgggccaaggaggcgttctcgcgcacggtgcacaagctgcaccgctacccttccaccgaccatgccgcgctgcgtcaggcgattggcgacgtgcacgggcttgaccccgcgcggatcatctgcggcgtcggttcggatgaaatcatccgcatgatcgtcaacgcctatgccgggccgaaggacgaggtggtgcacagcgaacacggcttcctgatgtatcgcatcgccgcgctgggcgcgggggcgacgccggtttcggtgcccgaacgcgaacgcacgctggatgttgacgcgatcctgaaggcctgcgggaaaaagacgaagctcgtcttcatcgccaatccgaacaacccgaccggcacgatggtcgggctggcagagctggaacggctggccatgggcattccgaaacaggcgatgctgatcatcgacagcgcctatgcggaatatgtcgagggctatgacggcggcgcagacctggcctcgcggctgcccaacgtgatgatgacgcgcaccttttccaagatctacgggctgggcgggctgcgcatcggctggggttacgggccgaaagacatcatcgacgtgctcaaccgcatccgcgatccgttcaacctctcgacctcgcagctggaaaccgccgaggccgcggtgcgcgatcaggattgggtggtgcaatcgcggtcggaaaacgcccggctgcggcattggctgtcggaggccctggccgaacgcggcgtgcccaatgacacctcgatggcgaatttcgtgctggcgcggttcgggtccgaagccgaggccgaggcctgcgacgaattcctgaaaaaggacgggctgatcgtgcggcgcgtggccagctacgggctgccgcattgcctgcgcatcaccgtgggcgacgaaccctcgtgccggcgcgtggcgcatatgatc

SEQ ID NO: 45487 - DNA, 738 bp, Rhodobacter capsulatus
gtctttgtcgtcaccgggggcggttcggggctgggggcggccgtggcgcggatggtggttgatgcgggcggcaaggtggtgatcgtcgatctgaacgccgaagcgggcatggccatggcctcggatctgggcgcggcctcgcggttttgccgcgccgatgtgacgcaggagggggacggccgcgccgccatcgatctggcggtctcggtcttcgggcggcttgatgcgctggtgaattgcgcgggcatcgcgccgggggaaaagatcctcggccgcgaggggccgcaccggctggagagtttcgcccgggcggtgacggtgaaccttgtcggcaccttcaacatgctgcggctggcggccgaggcgatggcgggcaatgcccccggcccgggcggcgagcgcggggtgatcgtcaacaccgcctccatcgcggcctttgacgggcagatcggacaggcggcctatgcggcctccaagggcggcgtcgcggcgctgacgcttccggcggcgcgggaactggcccggcacggcatccgcgtcgtcacggtggcgccggggatctttcgcacgccgatgatggcggggctgccgcaggaggtgcaggacagtctgggcgcctcggtgcccttcccgaaccggctgggggacccggcggaatatgccgcgctcgtgcgccatatctgcgaaaaccagatgctgaatggcgaggtgctgcggctcgacggcgctttgcggatg

SEQ ID NO: 45488 - DNA, 1167 bp, Rhodobacter capsulatus
atggatccggtggtgatcgcgggggcggcccgcacgccgatgggcggctttcagggcgcgttttcagagcttgccgcggccgatctgggcgcggtggcgcttggcgcggcgcttgaccgggcgggcgttccggccgctgaggtcgacgaggtgctgatgggctgcgtcctgcccgcggggcaaggtcaggccccggcgcggcaggcggcgctgaaagcgggtctaccgcttgcggcgggggcgacaacgatcaacaagatgtgcggttcggggatgaaggccgcaatgctgggccatgaccttttgctggcgggctcggcgcgggtcgtgctggcgggcggcatggagagcatgacgaatgccccctatctgttgccgaaagcgcgcggcgggctgcggctggggcatgggcaggtgctcgatcacatgtttctggacgggctcgaggatgcctatgatcgcggccggttgatgggcacctttgccgaggattgcgccgaagccttcggcttcacccggcaggcgcaggacgattacgcgattgcgtctttgacccgggcgcaggcggcaattgccagcggggctttcgcggctgaaatcgcgccggtggaggcaggccgggccgggctcatcaccaccgacgagcagccgggcaaggcgcggctggacaagatcgcgacgctgaaaccggccttccggccgggcggcacggtgacggcggcgaattcctcctcgatctcggacggggcggcggcgctggtgctgatgcgcgcctccgaggccgaggcccgcgggctgacgccgctcgcccgggtgctgggtcatgcgacccatgccgatgcgccgaacctgtttccgaccgccccgatcggcgcgctgacgaaactggcggaaaagctcgatctggatctgcgccggatcgatctgttcgaggtgaacgaggcctttgcggtggtcgcgatggcggcgatggcggcgctggatctgccgcatgaccgggtgaacccgcatggcggcgcctgtgcattggggcatccgatcggcgcttcgggggcgcgggtgctggtcacgctgctggcggcgctgcggcggcacgggctgagaaccggcgtcgcgacgctctgcatcggcggcggcgaggccacggcgatggcggtggagctgatg

SEQ ID NO: 45489 - DNA, 1230 bp, Rhodobacter capsulatus
atcgacaccatgggccaggcggcccggaccgcggcggccgagctggcctttgccccggcgccgcgcaagcgggccgcgctgatcgccgccgccgaggccgtcgccgcgcgtcaggacgagatcctggccgccaatgccgaagacatgatctttggccgcgacaagggcctgtcccccgcgatgctggaccggctgaggctggatgaaacccgcctgcgcggcatcgtcgaggggctgcgcgccgtcgccgaacagcacgatccggtgggcgaggtgatcgcggaatgggaccggccgacggggctgcacatccagcgcgtccgcacacccctgggcgtgatcggcgtcatctacgaatcgcggcccaacgtgacggccgatgccggtgcgctgtgcctcaaggcgggcaatgcggtgatcttgcgcggcggctcggaaagcttccattccagccgggcgattcacgcctgcatggttgccgggctgaaggccgccgatctgcccgaagcggcgatccagctggtccccacccgtgaccgggcggcggtggcggcgatgctgcgcgccgtggcccatatcgacgtgatcgtgccgcgcggcggcaaggggctcgtgggtctggtgcaggccgaggcccgggtgccggttttcgcgcatctggagggcatctgtcacatctacgccgatgccgatgccgatctggagaaagcccgccgtgtggtggtgaatgcgaaaacccgccggacgggcatttgcggtgcgatggaatgcctgctgatcgaccgggcgttttacgcaaaacacggcgcggtgctgatcgaagacctgatcgcgaagggcgtcgagatgcgggtttcggccgatctggcgcatatcccgggcaccaaaccggcggcggaggaggatttcggccgtgaattcctcgacatgatctgcgcggcgaagcttgtggacggcgtcgatggcgccattgcccatatccgccgctacggttcaagccacaccgaatcgatcctgacggaaaacgacgccaccgcggcacggttctttgaacggctcgacagcgccatcctgatgcgcaacgcctcgacgcagtttgccgatggcggcgaattcggcatgggggcggaaatcggcatcgccacgggcaagctgcatgcgcgcggcccggtgggggccgagcagctgacctcgttcaaatatctggtgcgcggcgacggcacgatccgt

SEQ ID NO: 45490 - DNA, 2855 bp, Rhodobacter capsulatus
gacatgggcacgccgaaacgcgagggcgcgccggtgcatctgaccatcgacggcgtcgaggtcaccgtgcccgcgggcacctcggtgctgcgcgccgcggccgaggccgggatttccattccgaaactttgcgccactgacaatgtggagccggtggggtcgtgccgtctgtgcatggtggaaatcgaggggatgcggggcacgccgacctcctgcaccaccccggttgcgcccgggatgcgggtgcatacgcagacgccgcagctgcagaaactgcgccgcggcgtgatggagctttatatctcggaccatccgctcgattgcctgacctgcgcggcgaatggcgattgcgaattgcaggacatggcgggcgccgtcggcctgcgcgaggtccgctatcaggcgaaggacacccatttcgcgcgccgcgatgccacggggccgaacccgcgttacatccccaaggacaattccaacccctatttcagctatgatccggcgaaatgcatcgtctgcatgcgctgtgtgcgcgcctgcgaggaagtgcagggcactttcgcgctgacggtgatggggcgcggctttgacgcccggatctcgcccgcggcgcccgatttcctgtcctcggattgcgtgtcctgcggcgcctgcgtgcaggcctgcccgacggcgaccttggtcgaaaagtcggtcgaaaggatcggcacgccggaacgcaaggtggtcaccacctgcgcctattgcggcgtcggttgcagcttcgaggcgcatatgctgggcgatcagctggtgcgcatggtgccctggaaaggcggcgcggcgaaccggggccacagctgcgtcaagggccgcttcgcttacggctatgcgacgcaccaggaccgcatcctcaagccgatgatccgcgacaagatcaccgacccctggcgcgaggtgaactggaccgaggcgctggacttcaccgcaacaaggctgcgggcgctgcgcgacagccacggggcggatgccctgggcgtcatcacctcctcgcgctgcacgaacgaagaaacatacctcgtgcaaaagcttgcccgcgcggttttcggcaccaacaacaccgacacttgcgcgcgggtctgccattcgcccaccggctacgggctgaaacagaccttcggcacctcggccggaacgcaggatttcgacagcgtcgaggagaccgatctggcgctggtcatcggcgcgaatccgaccgatgggcacccggttttcgcctcgcgcctgcgcaagcggctgcgggcgggggcgaaactcattgtcgtcgatccgcgccggatcgatctgctgaacacgccgcaccggggcgaggcctggcatctgcagctgaagcccggcaccaatgtcgcggtgatgacggcgatggcgcatgtgatcgtgaccgagcagatctttgacaagcgcttcatcggggatcgctgcgattgggacgaatgggcggattacgccgaattcgtcgcgaacccggagtatgcgcccgaggcggtggaaagcctgaccggggttccggcgggattgctgcgtcaggccgcccgggcctatgcggcggcgccgaatgccgcgatctactatggccttggcgtgaccgagcacagccaagggtcaaccacggtcatcgcgattgccaacctcgcgatgatgaccggcaatatcgggcggcccggtgtcggcgtgaacccgctgcgggggcagaacaacgtgcagggcagctgcgacatgggcagcttcccgcatgaattcccgggctatcgccatgtctccgacgatgcgacgcggggccttttcgaacgcacctggggcgtcaccctgtcgtccgaacccgggctgcggatcccgaacatgctcgatgccgccgtcgagggccggttcaaggcgctttacgttcagggcgaggacatcctgcaatcggaccccgatacgcggcatgtctcggccgggctggcggcaatggatctggtgatcgtccatgatcttttcctgaacgagacgcgaattacgcccatgtcttcctgcccggttcgacctttctggaaaaggacggcaccttcaccaatgcggaacgccgcatcaaccgggtgcgccgggtgatggcgccaaaggcgggctttgccgattgggaggtgacgcagatgctggccaatgcgctgggggcgggctggcattacacgcacccgtctgaaatcatggccgaaatcgccgcgacgacgccgggtttcgccgcggtcacctacgaaatgctggacgcccgcggctcggtgcaatggccctgcaacgaaaaagcccccgaaggctcgccgatcatgcatgtcgagggcttcgtgcgcggcaagggccggttcatccgcacggcctacctgccgaccgacgaaaagaccgggccgcggttcccgcttctgctgacgacggggcggattctgagccaatacaacgtcggcgcgcagacgcggcggaccgaaaacaccgtctggcatggcgaggaccggctggagatccacccgaccgatgccgagacgcggggcatccgtgacggcgactgggtgcggctggcgtcccgcgcgggggaaaccaccttgcgggcgacggtgacggaccgggtcagccccggcgtcgtctacaccaccttccaccaccccgacacgcaggccaatgtggtcaccaccgacacttccgactgggcgacgaactgcccggaatacaaggtgacggcggtgcaggtggcggcgtcgaacgggccctcggactggcagcaggattatgcggcgcaggcggcggccgcgcggcggatcgaggcggccgaatgagcctgcccgccggtgcgg

SEQ ID NO: 45491 - DNA, 1278 bp, Rhodobacter capsulatus
caaccgcttcgccttggcatcgcggggcttggcaccgtcggcattggcgtggtgaagatcgtgcaacgccatgccgatcttctggccgcccgcagcggccgcccggtggtgatcaccgcggtttccgcccgcgaccgcacgaagaaccgcgatgccgatctgtcgggctatgcctgggaaaccgacccggtggcgctggctttgcgcgacgatgtcgatgtgctcgtcgaggtgatgggcggccatgaaggcccggccaaggacgcgaccgaagccgcgctgaaggcgggcaaggatgtcgtcaccgcgaacaaggcgcttttggcccatcacggtcaggctctggcggaactggccgagggtctgggccgggtgatccgttatgaggccgccgtggccgggggcatccccgtgatcaaggcgctgaccgaggggctggcgggcaaccagatccgccgcgtcatgggggtgatgaacggcacctgcaactacatcctgacccggatggaaaccgcgggcctgccctatgagacggtcttcgaggaagcccggcagctgggctatctggaggccgatccgaacctggacgtcggggggatcgacgcgggccacaagctctcgatcctggcctccatcgccttcggcaccaaggtcagcttcgccaatgtcgtgctggaagggatcggctgcatctcgatcgacgatatccgccgcgccggggacatgggctacaagatcaagcttctgggcgtggcgcagatgaccggccgcgggctggaacagcggatgatgccctgccttgtgcccgcggcctcgcccttggggcagctgcagggcggcaccaacatggtggtgatcgagggcgactcggtcggccagatcgtcttgcgcggcgcgggggcgggcgaaggcccgacggcatccgcggtgatgggcgacgtgcttgacatcgcgcgcgggctgcggctgccgaccttcgggcaaccggcggcaggcctcgccgatccgatcccggccgcggtctcggcgcccgcgccctattacctgcgcctcgagctgatggacaagccgggcgcgctggccaaggtcgccgcagtgctgggcgaagcgggcgtctcgatttcccgcatgcgccaatacggccacgaggacacctcggccccggtcctgatcgtgacccacaagaccacccgcgatgcgatcgacgtggcgatcgcggccctgcccgcgaccggcgtcgtgctgggcgccccggtggcgcttcggatcgaagaagtc

SEQ ID NO: 45492 - DNA, 504 bp, Rhodobacter capsulatus
atccgcaccatcgccgatttcccgcatgaggggatcatgttccgcgatgtcaccacgctctttgccgatccgcgcggcttccgcatggcgatcgaccagcttctgcacccctgggcgggcgagcagatcgacaaggtcgtcggccttgaggcgcgcggcttcattctgggcggcgccatcgcgcaccagctgtccaagggcttcgtgccgatccggaaaaagggcaagctgcccgggcagacgatttcgcaatcctacaagctcgaatatggcgaagcgatcatggagctgcatgacgacgcgatccagccgggcgaaaaggtgctggtggtcgatgatctgctggcgacgggcggcacctgcgaggcggcgatcaagctggtcgagcgtctgggcggcgagattgtcggctgttccttcatcgtcgatctgccggaactgggcgggcgcaacctgctgcgcgatctgggcatgcaggtgcatgtgctgtgcgaattcgacggc

SEQ ID NO: 45493 - DNA, 1350 bp, Rhodobacter capsulatus
gtgccggggctgtggctgggggaggccgagccgcgctatctggaagagccgcgcggacgttggcgcggtcaggcgggggtgctggcgcggccggaaagcgtggcgcaggtctcggcgcttctggccttttgtcatgccgaagccgtgggggtcgtgccctttggcggcggcaccgggctggtcggcgggcaggtggcgcccgaggggccggcgccggtgcttctcagcctggagcggatgcgggcggtgcgacaggtcacgccgcaggcgctggtgatcgaggcgggggcgacgctgcaggcggtgcaggacgcggcggcggcggcgggcaagcgctttccgctgacgctggcctcgcaaggttccgcgcagatcggcggctgtctggcgaccaatgcgggcggggtgaacgtgctgcgctatggctcggcgcgggctttgtgtctggggctggaggtcgtgctggccgatggcacgatctggcacgggctgaagcggctggccaaggacaacaccggctatgatctgcgcgatctgatcatcggctcggaagggtctttggggatcatcaccgcggccagtctgcggctgcacgagccccccgcggtcgagggggtggcgctcatggccgtgccgtcccccgcggcggcggtgcagcttctcggcctcgcacaggcgcggtttgcgggctgtgtctcggcctttgaactgatctcggggcaggggctggcgttcttgcgcgaagtcggccccgaggtggcgctgccctttgccgccgatcccgactggtcggtgctgatcgagctgggcctgcccgccgggatggcggccgaggcggccttcgccgatctgtacgaggccgcgggcgatctggtgacggatgcggtcgtggcgcaatcgggggcgcaggcggcagcgctttgggcgatgcgcgaatcgatcccgctggccaaccggcgcatcggcgcgatttccagccatgacatcgccgtgccggtggccgacattcccgccttcatcgccgccgcgaccgagcggctggccgatatgggcgattttcgcatcaactgtttcggccatgtcggcgacggcaacctgcatttcaacgtcttcccggccggggggcggcggcgcgacgattacgagccgatccgcagcgcggtgatggcggcggtgcatcggctggtcgtggacagtttcgacggctcgatttcggccgaacacggcatcgggcggctgaaggtgggcgagctggcgcgcagcgcggacccggcgaagatggagatgatgcgggcgatcaaatcggcgctggatccgcgcggcatcctcaatcccggggtgatcctgccc

SEQ ID NO: 45494 - DNA, 1197 bp, Rhodobacter capsulatus
accacgctgcccaacggcctgcgcatcgtcaccgagcgcatgccgggccttgcctcggcctcggtcggcgtctgggtgctggcgggcggccgccatgaacggctggaacagaacggcatcgcgcattttctggagcacatggccttcaagggcacgaagacccgcacggcgctgcagatcgccgaggcgatcgaggatgtgggcggctatatcaacgcctatacctcgcgcgaggcgacggcctattacgcccgcgtgctgaaggccgatgtcggtttggcgctcgatgtgatttccgacatcgtgctgaactcggtcttcgatccgcgcgaaatcgaggtcgagcgtcatgtgatcttgcaggaaatcggtcaggcgctcgatacgcccgacgacatcatcttcgactggctgcaggaggccgcctatcccgatcaggcgatggggcgcacgatcctcgggccgtcggagaacatcgaacgcttcggccgcgaggatttcgagcggttcgtggcggaacattacgggccggatcagatgatcctctcggcggcaggcgccgtcgatcacgccgcgatcgtgaaacaggccgagcggcttttcggccatctgcgcccgatcggcgcccccgcggtgcagctggcgcgctggtcgggcaatgaacggcgcgagctgaaagacctggaacaggtgcatttcgcgctcgccttcgaggggccgggctatcgcgacgccgatctttacaccgcgcaggtctatgcgacggcgctgggcggcggcatgtcttcgcggctgttccagaagatccgcgaggaacgggggctctgctattcgatcttcgcgcaggccggggcctatgacgacaccgggatgatcacgatttacgcgggcacctcgggcgaggaagtggcggatctctgcggtctgaccatcgacgagctgaaacgcgcggccgaggacatgaccgaggccgaagtggcgcgggcgcgggcgcagatgaaggcgggaatgctgatggggctggaaagcccgtcaagccgcgccgagcggatggcgcgcaatctggcgatctggggccgggtgccggggctggacgaggtctcgacgctgatcgatggcgtgacggtcgaggcggtgcggtcctatgccgggcggatgatcgcgcaggatcgcacggcgctggcgctttacgggccc

SEQ ID NO: 45495 - DNA, 1005 bp, Rhodobacter capsulatus
gtgccctttgtcggccccgaaacgcaggaacgcctgcgcggccgcccgtttcgggcgcggcttggcgcgaatgaaaacggcttcggaccctccccccgcgcgatcgccgcgatggcggcggcggcgggcgaggcctggatgtatggcgacccggaaaaccacgatctgaaggtggcgctggcccacgcgcatggctgcggcgtcgaaaatgtggtcgtgggcgaggggatcgacgggcttctgggcacgctctgccggatggttctgaaaccgggcgatgcggtggtgacctcggagggcgcctatccgaccttcaatttccatgtcgcgggctttggcggggtcctgcacaaggcgccctaccgcaacgatgccgaagaccccgaggcgcttttggcgctggcgcagcaggtccggccgaagctcctttacatcgccaatccggacaatccgatggccagccatcacccgggcgcggtgatcgccgcgatgctggatcacctgcccgaaggcacactgatggtgcttgacgaggcctatgtcgaactcgcccccgagggcacggcggcgccggttgcggccgatgacccccgggtgatccggatgcgcaccttttcgaaggcgcatgggctggcaggcgcccgggtgggctatgcgctcggcgcggcgccgctgattgccgccttcgacaagatccgcaaccatttcggcatcagccggatcagccaggccggtacccttgcggcgctgtcggacaccacctggcaggtctacatgcgccgtctggtggcggcctcgcgcgatcggattgcggcgattgcggcagataacgggctgagcgccctgccctcggcgacgaatttcgtcgccgtcgattgcggcggggacggcgcctttgcccgcgccgtgctggaggagctgaccgccgccgacatcttcgtgcgcaagcccgccgtcgcgccgatggaccgctgcatccgcatctcctgcgggccggaggccgag

SEQ ID NO: 45496 - DNA, 561 bp, Rhodobacter capsulatus
gatttcgccgcccgccgcaccatgatggtcgacacccaggttcgccccaatgacgtgacgaaattcccgatcatcgaagcgatgctggccgtcccccgcgaggcctatgtgcccgatgcccgccgcgaggccgcctatgtcggcgaaaacctcgatctggggcaggggcgctggctgctcgagccgcgcaatttcgccaagatgctcgatgcgctcgatatccagcccggcgatctcgtgctcgatatcggggcgggcatgggctattcctcggccgtcctcgcgcggatggcgaaagccgtcgtcgcgctggaggaaggcacgctggccgcctcggccgaggcgcatctgtcggtgcaggacatcgagggcgtgaccgtcgtcgaagggcggctggaggcgggcgtcgccgacgaggggccctatgacgcgatcgtgatcgagggcggcgtcgagcaggtgcccgcggcgatcgaggcgcagctgaaggaaggcggccggatcgcggcgatcttcatgcaggggcccctgggcacggtgcggatcggccgcaagatcgat

SEQ ID NO: 45497 - DNA, 927 bp, Rhodobacter capsulatus
tttcttgacatccacaccaccagcccggccgatctgcgctcgatgatcgacagcgcccgcgcgatgaagaccgcccgcctcggccgcccgaaaggcgcgctcgatgacgatcagccgctggcgggctgcatggtggcgctgattttcgaaaaaccctcgacccggacccgcgtcagcttcgatgtcggcgtgcggcagatgggcgggcagaccatggtgctctcgggcaaggaaatgcagctgggccatggcgagaccatcgccgacaccgcccgggtgctgtcgcgctatgtggatctgatcatgatccgcaccttcgaagaggcgacgctgctcgagatggcggaatatgcctcggttcccgtcatcaacgggctgacgaaccgcacccatccctgccagatcatggccgacatcatgacctatgaggaacaccgcggccccattgccgggcgcaaggtggtctggtcgggcgacggcaacaatgtctgtgccagcttcctgcaggcggcggggcagttcgggttcgatttgaccttcaccgggccgcaggcgcttgatcccgaacgcgactggatcgagtttgcgcgctccaagggggtgaatgtggtgatcgagcgcgatccggccaaggcggtcgaaggcgccgatctggtcgtcaccgacacctgggtcagcatgcacgacccggaatcggccaaggaacgccgccacaaccagctgcgcccctatcaggtgaacgagacgctgatggccaaggcgaaacccgatgcgcttttcatgcattgcctgcccgcgcatcgcaatgacgaggcgaccagcgccgtgatggacgggccgcattcggtgatcttcgacgaggcggagaaccggctgcatgcgcaaaaggcgatcatgcgctgggctttgggcaagtgaaggctgggg

SEQ ID NO: 45498 - DNA, 1174 bp, Rhodobacter capsulatus
cctttttcaggagccgcaaatgatcgcttccgtgctgccgacctacacccgtgcccccctcgccttcgtgcgcggcgagggctcctggctttggaccgcggatggcagccgatatctggatctgggcgccgggatcgcggtcaatgcgctgggccatgccgcgcccgaccttgtggcgacgctgaccgaacaggcgggcaagctctggcatgtctcgaacctttaccggatcccggaacaggaacggctggccgacatgctggtggccaagaccttcgccgataccgtcttcttcaccaattcggggaccgaggcctgcgaactcgcggtgaagatggtgcgcaagcatttctacgacaagggccagccggagcggaccgagatcctgaccttctcgggcgccttccacggccggtcttcggccgcgatcgccgcggcggggacggaaaagatggtcaagggcttcggcccgctgctgcccggcttcgtccatctgccctggggcgaccttgacgcggtgaaagccgccgtcaccgaaaccacggcggcgatcctgatcgaacccattcagggcgaaggcggcatccgccccgcgcccgagggcttcctgcgcgcgctgcgcgaaatctgcgacgaaaccggcacgcttctggtctttgacgaggtgcaatgcggcgtcgcgcggaccggcaagctgttcgcgcatgaatgggcgggcgtcacgccggatgtgatgatggtggccaagggcatcggcggcggcttccccttgggcgcggtgctggccaccgaagacgcggcttcggggatgatcgcgggcacgcatggctcgacctatggcggcaacccgctgggctgtgccatcggcgcgaagatgatcgagatcgtcaccgcgccgggctttctggacgaggtcagccgcaaggcgggcttcctgcgccagtggctcgaaggtcttgtcgccgcccatcccgacatctttgaggaggtgcgcggtcagggcctgatgctgggcctgcggctcaagctgccgcccggggatgtggtcaaggcggcctatgcgcagaacctgctgaccgtgcccgcggccgataatgtgctgcggcttctgcccgcgctgaccatctccgaagacgacatggccgaggccgtccgccgccttgatgccgcccgc

SEQ ID NO: 45499 - DNA, 1791 bp, Rhodobacter capsulatus
cggtcgaaaccgaagggagagccgatggcccgcagacccgccaccccgctggaagaccgcccgaaaccgaaacgtgtgggcgcgatccggggtcttgcccccttcatcgccccctatcggcgtctggcgctggccaccgccgcggcgctggtgctgaccgccatggtgacgctgatcctgccgatcgccgcgcgccgcgtggtggacgggttccagcagggtggcgagatgctcgacagctatttcctggccgcccatgtcatcgccgcggccctggcgctgggcaccgggctgcgctactggctggtcacccgctttggcgagcgcgtcgtggccgacatccgcaaggcggtcttcggccgggtgatcgagctgtcccccgccttttacgaaaagatcctgaccggcgagatcatctcgcgcatcaccaccgacaccacgctgatcctgtcgctgctgggctcctcgatctcggtggcggcgcgcaacatcctgatcctgctgggcgggttgaccatgcttctggtcacctcggcgaagctgaccgggctggtgcttttgatcgtgccgctggtcatcgtgccgatcgtcgtcatgggccgccgcctgcgccggctgagccgcgaaaatcaggactggatcgcctcttcctcgggctcggcctccgaggcgctgagttccgtgcagacggtgcaggccttcacccacgaggcgctgacccgcaaggccttttccgaggtcaccgaaaaggcccttgcttccgccaatgaccgcatcaccacccgcgcgatcatgacgatgatcgtgattttcctggtctttgccgggattgtcggcgtcctttggatcggcgcgcgcgacgtgcaggcggggctgatgacggtgggccagctggtgcaattcgtcatctatgcgatcatggtttcggccgcggtcggcgcgctgaccgaaatctggggcgaggtgcagcgcgccgcgggcgcgaccgaacggctggtggagctgctgcatgcgggcgacacggtcaccgatccggcgcggccgctggcgctgcccagcccggtgaaaggcgccatcgcctttgaggacgtcaccttccattacccgtcgcggcccgagacttcggccctgaacgcggtcagcctgcaggttgcgccgggcgagacggtggcgctggtcggcccttcgggggcagggaaaaccacgatcatccagctgatcgagcggttttatgaccccgaacaggggcggatcacgctcgatggcatcgacctgcgcgatctggcccgggccgaatatcgccgcgcgctggcgcttgtgccgcaggacccggtgatctttgccgccagcgcccgtgaaaacatccgcttcggccgcccggacgccagcgatgccgaggtcgaggccgccgcccgcgcggcctatgcccatgatttcctgaccgcgctgccgcagggctttgatacctatgtgggggaacgcggcatcatgctctcgggcgggcagaagcagcgcatcgccattgcccgggcgatcctgcgcgatgcgccggtgctgctgctcgacgaggcgacctcggcgctggatgcggcctccgagcgcgcggtgcaggcggcggtcgatgatctgcgcgccacccgcaccaccctcatcgtcgcgcatcggctggccacggtgaaaaaggccgaccggatcgtcgtcttcgatcagggccggatcgtggcgcagggcacccacgaagccttggtggccgagggcgggctttacgccgaactggcgcggctgcagttc

SEQ ID NO: 45500 - DNA, 1542 bp, Rhodobacter capsulatus
aaggatcattccctgaccatgacctgggccgaagtgctggcccgggtgacgcaggcggcgaacctgctgcgccggatgggcgtgggggaaaaggacacggtggcctatctgctgcccaacagcctggaaaccgcggtggtgcttctgggtggggcgacggcggggatcgtcaatccgatcaaccctttgctggagcccgagcagatttccgcgatcctgcgcgagaccaaagccaaggtgctggtgacgctgaaaagcttcccgaaatccgacatcgcgcaaaaggcggccgaggcggtcaagcacgcgccgaatgtcaagacgatcctggaagtcgatctgaaccgctacctgaccgcgccgaaaagctggatcgtgccctttgtccggccgaaaacgcatttccgccatcacgccgatgtctatgatttcaacaccgcctgcgacggccagcccgccgacaagctggtgtttgccgatgcgaccgccgaccgcgtcgccgcctatttccataccggcggcaccaccggcatgccgaaagtggcgcagcacaagtattcgggcatggtctacaacggctggcttggcggcacgcttctgttccgccacaccgacgtgatgatctgcccgctgccgcttttccacgtctttgccgcctatccgatcctgatgtcggccatccattccggcgcccatgtcgtcttccccacccccgcgggctatcgcggcgagggggtcttcgacaatttctggaagctggtcgaacgctggcaggtgaccttcctgatcaccgtgcccaccgccatcgccgcgctgatgcagcgcaaggtcgatgccgatatctcgtcgctgcgcacggcaatctcgggctccgcccccctgccggtcgagctttacaaccgcttcaaggacgcgaccggggtcgagatctgcgagggctacgggctgaccgaagccacctgccttgtctcgatcaacccggtcgacgggctgaaaaaggtcggctcggtcggcatccccctgccctattcgcacgtccggatcctgcgcaagaccgaggccgggttcgtcgaatgcgccgccgacgaggtgggcgagatctgcgtcgccaacccgggcgtgttcgacggctcgacctataccgaagtggacaagaaccacgacctctttgccgaggaacgtttcctgcgcaccggcgatctgggccggatcgacccggacggatacctctggatcaccggccgcgccaaggatctgatcatccgcggcggtcacaacatcgacccggccgagatcgaggaggcgctgctgtcgcatccctccatcgcctttgccggtgcgatcggccagcccgacgcctttgcgggcgaattgccctgcgcctatgtcgagctgatcaaggaggccacgatcacgcccgaagagctgatggcgcatgccaaacgccacatccacgaacgcgccgccgtgcccaagcacatcgaggtgctggacgagctgccgaagaccgcggtgggcaagatcttcaagcccgacctgcgc

SEQ ID NO: 45501 - DNA, 1254 bp, Rhodobacter capsulatus
acctcgcccgacctgtccgcccgccgtgccgccgccatcgccaagggcgttggcgtgacgacgcagatctatgccgaacgcgccgagaacgcggaaatctgggacaagaacggcacccgttacatcgacttcgccgcgggcatcgccgtggtgaacaccggccaccgtcacccgcgggtgatcgaggcggtcaaggcgcagctcgatgccttcacccacacctgccatcaggtcgtgccttacgaaaactacgtcatcctggccgagcgtctgaacgccgccgtgcccggtgactttgcgaagaagacgatcttcgccaccaccggcgccgaagccgttgaaaacgcgatcaagattgcccgccactacaccggccgcgccgggatcgtcgcctttgcgggcggtttccacggccgcaccttcatgggcatgacgctgaccggcaaggtgcagccctacaaggccggcttcggcccgatgatgaacgacgtctggcacctgcccttcccctgcccgctgcatggcgtgacgggcgaggacgccgtggcggcgctggagcgtctgttcaaggccgatatcgaacccgcccgcgtcgccgcgatcatcgtcgagccggtgcagggcgagggcggcttctacccggtgcccgagggcttcatgcgcaaactgcgcgagatcgccgacaagaacggcatcgtcctgatcgccgacgaggtgcagaccggctttgcccgcaccggcaagctctttgcgatggaacatcacggggttgccgccgatatcaccaccatggccaaggggctgggcggcggcttcccgatctcggcggtgaccggccgcgccgacatcatggacagcccgaacccgggcggccttggcggcacctatgccggggcgccgattgccgtggccgcggcgcatgccgttcttgacgtgatcgaggacgagcagctctgcgcccgtgccgagcgtctgggcgcgcggctgaaacagcgtctggcggcgctgcaggacagcgtgccggagatcatcgacatccgcggcccgggcttcatgaacgcggtcgagttcaacgtcgcgggcagtgacacgccgaacccggagatgaccaaccgcgtccgcgaagaggcgctgaagcgcggtctgatcctgctcacctgcggcgtttacggcaacgtcatccgtttcctcgccccgctgaccatccaggacgcggtctttgacgaggcgctggacatcctcgaagcctcgatc

SEQ ID NO: 45502 - DNA, 1584 bp, Rhodobacter capsulatus
ttcgactatgtcattctcggcggcggctcggccgggtcggtgctggcggcgcggctgagcgagaatccggccacgcgcgtctgtctggtcgaggcgggcgatgcggcgcgggatattctggtgcgggcgcctgccttggtcgcggcgctggtgcccgggtatctttacgcccacaactgggcgctgcacaccgttccgcagcccgggctgaacgggcggcgggggtttcagccgcggggcagggggctgggcggctcgtccgcgatcaatgcgatgctgtatgtgcgcggtcatccctcggattacgaccgttgggcggccgagggggctgtgggctgggactgggccgcctgtcagccgtggtttctgaaatccgaacgcaacatgcgcggggcgtccgcgcatcatggggccgatggcccgttgcaggtgggcgatcagcgccgcccgcggccgatcacccgcgctttcgtgcaggcctgcggcgcggtggactgcccggaaaccgacgacttcaacggcgcgtgtcaggagggggccgcgccctttcaggtcacgcaattctgggatggtccgaaaaagggcgagcgctgttccgccgcggcggcctatctgcatccggtgatggaccggcccaatctgaccgtgctgaccggggcacgggcggaaaaggtcttgatttccgaggggcgcgccaccggggcgctggtgcggcaggggcggcaccggctgcggctggaggcggcgcgggaggtgatcctctcggcaggcgctttcggctcgccgcagcttctgatgctctcgggtatcgggccgggggcgcatctgcgcgatctgggcattgatgtcgtgcaggatctgcccggggtgggggcaaacctgcaggaccatctggattacacgatttcgcatttttcgccccgccgcgatgtcgtggggctcaatccgcgcgggctgtggcggctggccagggccgcgggcggctggatgcggcatggcgaggggctcttcgcctcgcccatggccgaggggggggcgtttttgcgctctgcgcccggggtcacggtgcccgatctgcagatccatttcgtcgtcggcattgtcgatgcccacatgcgcaagctgcatgtcgcggacggctggtcggcgcatatctgcgtgctgcggccgcaatcgcgggggacggtgcggctggcgtcgaagaacccgcgcaaggcgcccttgatcgacccggcctttctggccgatccgcgcgacgaagccctgatgctgcgggcggcgcggatgctggaagagatcgtgggcgcggcggccctggcgccctggcggggcgacaggctttatccgcatgacgggtcagaggccgggctgatggccgatatccgcgcgcgcgccgacacgatctatcacccggtcggcacctgccgcatgggcaccgatgcgatagcggtggtggatccgcaacttcgggtgcgcgggatcgaggggctgcgggtcgtagatgcctcggtcatgcccagcctcattggcggcaacaccaatgcgcccaccatcatgatcgccgaacgcgcggctgcgatgatc

SEQ ID NO: 45503 - DNA, 1404 bp, Rhodobacter capsulatus
atgagacgccttcgcaatgtcaagatcgtggctacgcttggccccgcatcttccgattacaagaccatccgcgccctgttcgaggccggtgccgacgtgttccgcctgaacatgagccacggcacccatgccgaacacaaggtccgctacgacatcatccgccagatcgaggccgacaccggccgtccggtcgcggtgctggccgatctgcagggcccgaagctgcgcgtcggcacctttgccgccggcgccgccgatctggaagagggcgagcccttccgcttcgatctcgacccgaccgagggcgacggccaccgggtctgcctgccgcatcccgagattttcgccgcgctggaagttggcgcccgcctgctggtcaatgacggcaagatccgcctgcgcgtcaccgcctgcggcccggatttcgccgattgcatcgtcaccgtcggcggcacgatttcgaaccgcaagggcgtgaacgtgcccgatgtggtgctgccgcttgccgcgctttcggccaaggaccgcgacgatctggaattcgcctgcgatctgggcgccgactggctggcgctgagcttcgtgcagcgccccgaggacgtgatcgaggccaaggccctggcccgcggccgcgcgcaggtgctctcgaagatcgagaagccgcaggccgaacgcgcctttgacgagatcctcaaggtctcggacgggatcatggtcgcccgcggcgatctgggggtggagctgccggtcgaatccgtgccgccgatccagaagcggctgatccgcaagtgccgggccgccgccaagcccgtcatcgtggcaacgcagatgctggaaagcatgatcgaaagcccgatgccgacgcgggccgaaatctccgacgtcgccaccgcgatctacgagggcgccgatgcgatcatgctctcggccgaatccgccgccgggcgctatccggtcgaggcagtgcagacgatgaacgccgtcgcccgctcggtcgaaagcgatcccacctatcgcgacatcatcgaggcgtcgcgctcggccaagcggcagaccgtggccgatggcatcgtcgccgccgcgcgcgagatcgccgaaaccaccgatgtctccgccatctgctgctacacgcaatcggggaaaaccgtcgcgctggtctgccgcgaacggccccgcgtgccggtgatcgcgctttcgccgatcacccagaccctgcgcaagctttgcctgaactggggcgtgcatgcggtgcgctgcgacgaggtcagccgcttcaaggaagccgtggtcaatgccgcccgcgccgcgcgcgactatggtttcgccgatgaaagtcatcagatcatcgtcatcgccggggtgcccttcaacgtgcaggggacgacgaacatcctgcgcgtggcg

SEQ ID NO: 45504 - DNA, 1266 bp, Rhodobacter capsulatus
atggatcattttctctaccgcaatggcgtgctgcatgccgaggacgtggccctgaccgagattgcggccgccgtcggcacgcccttctacgtctattccgccgcgaccctgacccggcatttccagctcttcgatgccgcgctggcgggcaccgatcatctggtctgtttcgcgatcaagtcgaattcgaacctggcggtgctgaagctgctgggcgatctgggcgcggggatggatgtggtctcgggcggcgaataccgccgcgcgaaagccgcgggcgtgccgggcgaccgcatcgtcttttccggcgtcggcaagacgcgcgacgaaatccggctggcgctgaccgggggcatccggcagttcaacgtcgaaagcgaacccgagctgcgggcgatatcggaaattgccacggcgctgggcgtcaccgcgccgattgccttgcgggtgaaccccgatgtcgatgccaagacccatgaaaagatcgccaccggcaagtcggaaaacaagttcggcattccgattgccaaggcccgcgcggtttatgccgaggccgcgaaactgcccgggatcgaggtgatcggcgtcgatgtccatatcggcagccagctgaccgatctggcgccgtttgaagccgccttcaccaaggtccgcgagctgacgctggcgctgcgcgaggatggccacaagatccgccgcctcgatctggggggcggccttggcatcccctatcaccagcgctcgaacgaggcgccgcccctgcccaccgattacggcgcgatgatcacccgcgttctgggcgatctgggctgcgagatcgagatcgaaccggggcggctgatttccggcaatgccgggctgatggtgacctcggtcatctatctgaaggaaggcgaggggcggaacttcctgatcgtcgatgcggcgatgaacgatctggtccggccctcgatgtatggcgcgcatcacgacatcgtcccggtgatcgagcccgcgccgggccttgcgccgcagcccttcgatgtcgtcggcccggtctgcgagacgggcgacaccttcaccaagggccgcgagctgccgccgatggccgagggcgatctggtcgccttccgctcggccggggcttacggcgcggtgatggcgtccgaatacaattcccgcccgctgatccccgaggtgctggtcagcggggatcacttcgccgtcatccggcaaagaccgagctttgaggaaatgctggcccgcgatagcatccccgaatggctc

SEQ ID NO: 45505 - DNA, 1371 bp, Rhodobacter capsulatus
atgaccgacgacacgaactcctcgaacgccatgtggggcgggcgctttgccgccggtccggacgcgatcatggaggcgatcaacgcctcgatctcgttcgacaagcggctttacgcacaggatatccgcggcagccgggcccatgcggcgatgctggccgcgacgggtattctcacgaatagcgatgccgaggcgatcggggaagggttgctcacggtcttgtcagagatcgaggcgggcgatttcccgttttcgaccgcgcttgaggacatccacatgaatgtcgaggcgcggctgaaggcgctgatcggcgaaccggcggggcggctgcacacggcgcggagccgcaacgaccaggtggcgaccgatttccggctttgggtccgcgatcaggccgatgcggcgatcacctcgctgacggcgctgatgaaggtgctggtggcgcaagccgaaaagggcgccgattgggtgatgccgggcttcacccatctgcagacggcgcagccggtgacctggggccatcacatgatggcctatgtcgagatgttcgcccgcgaccggagccgctttgaagacgcgcgcaagcggatgaacgaatgcccgctcggctcggcggcgctggcgggcacgggcttcccgatcgaccggcacatgacggcgcaggctttgggctttgaccggccgatggcaaacagcctggatggcgtgtcggaccgcgatttcgcgctcgaattcctgtccgcggcggcgatctgctcggtccacctcagccgtctggcagaggaactggtgatctggtcctcggcgcagttccgcttcgtggcgatgtcggacaaatggtcgacgggctcctcgatcatgccgcaaaagcgcaaccccgatgcggcagagctgatccgggcgaagatcggccgggtgctgggcgcggctgtcgcgctcttcaccgtgatgaagggcctgccgctcgcctattccaaggacatgcaggaagacaaggaacaggtcttcgatgccgccgacacgctgatgctggccttggcggcgatgaccgggatgatgtcggatctgacggtgaacaccgcgaaactggaagccgcggcctcgtcgggcttttccaccgcgacggaccttgccgactggctggtgcgcgaggccggtctgcccttccgcgacgcccatcacgtcaccggctcgctcgtcgcgctggcggagaagaagggctgcgatctgcccgatctgagcctcgaagagctgaaatccgcccatccggcgctgaccgaggcggtctattccgtgcttggggttcacaattcggtcgcctcgcggcaatcctacggtggcactgcccccgatcaggtccgcgcccaggtg

SEQ ID NO: 45506 - DNA, 1167 bp, Rhodobacter capsulatus
atgaccaatgtcgtcatcgtctcggcggcccggaccgccgtgggcagcttcaacggcgctttcgccaacacgcccgcgcatgagctgggcgccgcggcgatcgaggccgtggtggcgcgggcgggcatcgacaaggcggaggtctcggaaaccatcctcggtcaggtgctgaccgccggtcagggccagaacccggcgcgtcaggcgcatatcaaggccggtctgccgatcgaatcggccgcctggggcatcaaccaggtttgcggctcgggcctgcgcacggtggcgctcggcgcgcagcacatccagcttggcgatgcggcgatcgtcgtggccgggggccaggaaagcatgtcgctgtccgcccatgtcgcgcatctgcgcgcgggcaccaagatgggcgacatgaagatgatcgattcgatgatcaaggacgggctttgggacgcgttcaacggctatcacatgggccagaccgcggaaaacgtcgcggcacaatggggcatcacccgcgagatgcaggacgaattcgcccttgccagccagaacaaggccgaagccgcgcaaaaggcgggcaagttcgtcgatgaaatcatccccttcacggtgaagacccgcaagggcgacatcgtcgtcgatgccgatgaatacatccgtcacggcgcgacgctcgaatcgatgcaaaagctgaaaccggccttcaccaaggatggcacggtgaccgcgggcaacgcctcgggcatcaatgatggcgccgcggtcgtgctcttgatgaccgaggaagaggcggcgaaacgcggtctgacgccgctggcccggatcgcgtcctacgccaccgcggggcttgacccgtcgatcatgggctgcggcccgatcccggcctcgcgcaaggcgctggaaaaggcgggctggaccgccgccgatctggaccggatcgaggcgaacgaggctttcgcggcccaggcctgcgcggtgaacaaggacatgggctgggacgtgtcgaaggtgaacgtcaacggcggcgccatcgccatcggccacccgatcggcgcctcgggctgccggatcctgaacacgcttgtctttgaaatgaaacgttcgggcgcgaaaaagggtctggcgacgctgtgcatcggcggcggcatgggcgtggccatgtgcctggaa

SEQ ID NO: 45507 - DNA, 714 bp, Rhodobacter capsulatus
atgtccagagttgcactcgtcaccgggggatcgcgcggcattggcgccgcgatctcgatggcactgaaggacgccggttacaccgtcgccgcgaactatgccggcaatgacgaagccgccgcgaaattcaccgccgagaccgggatcaagacctacaaatggtcggtcgccgattacgacgcctgcgccgcgggcatcgcccaggtcgaggccgatctgggcccggtcgacgtgctggtgaacaatgcgggcatcacccgcgacgcgcccttccacaagatgacccgcgaccaatgggatcaggtgatcggcaccaacctgaacggcatcttcaacatgacgcatccgctctggaacggcatgcgcgaccgcaaattcggccggatcatcaacatttcctcgatcaacggccaaaagggccagttcgcccaggcgaactattccgcggccaaggcgggcgacatcggcttcaccaaggcgctggcgcaggaaggggcgcgggcggggatcaccgtcaacgcgatctgcccgggctatatcgccaccgaaatggtgatggcggtgcccgaaaaggtgcgcgagcagatcatcgcgacgatcccggtcggccgtctgggcgaaaccggcgatatcgcgcgctgcgtggtgttcctcgcctcggatgatgcgggcttcatcaccggcgcgacgctgaccgcgaacggcggccaatac

SEQ ID NO: 45508 - DNA, 936 bp, Rhodobacter capsulatus
atggcggcggtgaatgcgctgatccgcgagcggatgagttcggaacatgccccccgcatccccgaggtcacggcgcatctgatcgaggcgggcggcaagcggctgcggccgatgctgacgctcgctgcggcgcggctggtgggctatggcgggccgttccatgtgcatctggcggcgacggtcgaattcatccacaccgcgacgctgttgcatgatgacgtggtcgacgaaagccgccagcgccgcggccgtccgacggcgaacctgctttgggacaacaaatcctcggttctggtgggggattatctgtttgcccgctccttccagctgatgaccgacaccggcaacatgcgggtgatggagatcctggccaacgcttcggccgtgatcgccgagggcgaggtgctgcagctgacggcggcgcagaatctggcgacgaccgaggacatctatctgcgggtgatccgcggcaagacggcggcgctcttttccgccgcgaccgaggtcggcggcatcatcggcggcgcccccgaggatcaggtgcaggcgcttttcgattatggcgacgcgctcggcatcgccttccagatcgtcgatgacctgctggattacggcggcaaatcggccgagatcggcaagaacaccggcgacgatttccgcgagcgcaagctgacgatgccggtgatcaaggccgtcgcgctggccgatgaggcggaacgcgccttctggaagcgggtgatcgaaaagggcgaccagcaggacggcgaccttgaacacgcgatggcgctgatgacgaagcacggcacgctggaagcgacgcggctggcggcgatcggctggaccgacaccgcccgcaaggcgctggcgaaactgccggatcatccgctgcggcagatgctggacgatctggccgattacgtcgtcgaacgggtgcgc

SEQ ID NO: 45509 - DNA, 891 bp, Rhodobacter capsulatus
gcgaagatcatcgacggcaaggcgttcgcggccagggtgcgggccgaggtcgcaacgcatgtggcgcggctgcaggagacgcagggcctgaccccgggtctggccgtggtgctggtgggcgaagacccggcgagccaggtttatgtgaagaacaagggcatccagacccgcgaagtcgggatgaactcctatgagcacaagctgtcggcggacacttcggaagccgatctgctggcgctgatcgcgcggctgaatgccgatccggcggtgcatggcattctggtgcagctgccgctgccgaaacatctggatgccgatctggtgatcaatgccatcgatccggccaaggacgtggacgggttccacatctcgaacgtcgggcttctgggcaccgggcaaaaggcgatggtgccctgcacgcccttgggctgcctgatgatgctgcgcgaccatcacggatcgcttgcggggctgactgcggtcgtcgtcgggcgttcgaacatcgtcggcaagccgatggcgcaactgctgctggccgacagctgcaccgtcaccatcgcgcattcgcgcaccaaggatctggccgaggtgtgccgacgcgccgacattctggttgccgccgtggggcgccccgagatgatcccgggcgattgggtgaaaccgggggcgacggtgatcgacgtgggcatcaaccgcatcgagcgcgacggcaagggcaagctggtgggcgacgtgcatttcgacagcgccgttcaggttgcgggcgcgatcaccccggttccgggcggggtcgggccgatgaccatcgcctgtcttctggccaatacgctgaccgcctgctgccgggcgcatggtctggccgaacccgagggcctgaccgcctgagcccgc

SEQ ID NO: 45510 - DNA, 1887 bp, Rhodobacter capsulatus
aatctgcgcaacatcgccttctgggccctgctgttcgtgctcatcctggtgctgttcaacctgctcggcagcgggcagggtccgctcaatgcccggcaagtgtcctattccgacttcatcgccgccgtggacaagggcgacgtgaagcaggtgcaactggatggcgaggatgtgcgctaccaggacagcaagggcgacaattactcgaccacaaaggaaggcaccgacgccatcgccgacaagctggtggccaagggcatcaccgtcaatgtggtcaagcagcagcaatcgggtctgatgtcgatcctgggcgtctggctgcccttccttgtcatgatcgggctttgggtcttcttcatgaaccggatgcagggcggcggcaaaggcggcgcgatgggctttggcaagtccaaggccaagcttttgaccgaaaagcacggccgggtgacctttgacgatgtcgcgggcatcgacgaggccaaggaagagcttgaggaaatcgtcgaattcctgcgcaacccgcagaaattcagccgtctgggcggcaagatcccgaaaggcgcgctgctcgttggcccgcccggcaccgggaaaaccctgctggcccgcgcgattgccggggaagccggtgtgcccttcttcaccatctcgggctctgatttcgtcgagatgttcgtgggtgtcggcgccagccgtgtccgtgacatgttcgatcaggcgaagaagaacgcgccctgcatcgtcttcatcgacgagatcgacgccgtgggccgggcccgcggcgtcggcatcggcggcggcaacgacgaacgcgagcagacgctgaaccagcttctggtcgagatggacgggttcgaggcgaacgaggggatcatcatcgtcgcggcgacgaaccgcaaggacgtgcttgatccggcgctgctgcgtccgggccgcttcgaccggcagatccatgtgccgaaccccgatatcaagggccgcgaaaagatcctgtcggtgcacgcgaacaagatcccgcgcgggccggatgtcgatctgcgcaccatcgcccgcggcacccccggtttctcgggtgccgatctggcgaacctggtgaacgaggccgcgctgatggccgcgcgggttgggcgtcgcttcgtgacgatggaagatttcgaaaacgccaaggacaaggtgatgatgggggtcgagcggcgctcgatggtgctgacccccgagcagaaggaaatgaccgcctatcacgaggccgggcatgccgtcgtcggcatgaagctgccgaaatgcgacccggtctacaaggcgacgatcattccgcgcggtcaggcgctggggatggtggtcagcctgcccgagatggaccggctgaactaccacaaggacgaggccaagcagaagatcgccatgaccatggcgggcaaggcggccgagatcctgaaatggggcgaagaggccgtctcgaacggtccggcgggcgacatcatgcaagccagcgcgatcgcgcgggcgatggtgatgcgctgggggatgtcggacaaggtcggcaatatcgactattccgaagcgcatgagggctatcagggcaataccgcgggcttctcggtctcgaccaagaccaaggagctgatcgaggaagaggtccgcatcctgatcgagaacggctatatcgaggcgcggcgcatccttgaggaaaacatcgaggaatgggaacggctggcgcagggtcttctggaatatgaaaccctgaccggcgacgagatccgcaaggtgatggcgggcgagacgctgggcggcgatgacgaccggccctcgggcagcctgcccacggtgacctcgttgccgcgcacgaaacccgtggccaagcccggcatcgcgcccgaaccgaatgcc

SEQ ID NO: 45511 - DNA, 1446 bp, Rhodobacter capsulatus
attctggcgctggatcagggcacgacctcgacccgggcgattgtctttgatgcgggcctgcgcccgctggccacggcaagccgcgaatttccgcagatctttccggcgcccggctgggtcgaacatgacccggaggcgatctgggccaccgtgctttccacgatccgcgaggccttggcgcaggccggtccggtggcggcgctgggcctgaccaaccagcgcgagaccacggtgatctgggaccgggcaacgggggtgccgctccacaatgccatcgtctggcaggaccgccgcaccgccgagatttgcgccgatctgcgcgcggcgggccttgaggcgaggatgacggcgaaaaccggcctgctgcttgacccgtatttctcggggaccaaggtgaaatggctgctcgacacgatccccggcgcgcgggaacgggccgagcgcggggaactggcctttggcaccatcgacagtttcctgatctggcggctgaccggcggccgggtgcatgcgaccgatgcgacgaatgccgcgcggacgctgctttacgacatcggccgcaatgcctgggacgcggaaatctgcgcgcttctgggcgtacccatggcgcttttgcccgaggtgaaggattgcgccgatgatttcggggtgacggatccggcgctgttcggggccgcgatcccgatcaccggggtggcgggcgatcagcaggcggcgacggtggggcaggcctgtttcgcccccggcatgctgaaatcgacctatggcaccggctgttttgcgcttttgaacaccggggctgcgcgggtcgtgtcgcaaaaccggcttctgaccaccatcgcctatcgtctgaacggagagaccacctatgcgctggaaggctcgatcttcattgccggggcggtggtgcaatggctgcgcgacgggctgggcctgatcgcgcgggcggcagagacgcaagatctggccgaggccgccgatccggcgcaggatctggtgatcgtgcccgcctttaccgggctgggggcgccttactgggcccccgattgtcgcggcgccatctatgggctgacccgcaacaccgggcctgccgaatttgcccgggcggcgcttgaaagcgtcgggctgcagacgcgcgacctgctcgaggcgatgcgggccgattggggcgcggcggggcaaaacgtgctgcgcgtcgatggcggcatggcggcgagcgactggacgatgcaatatctggccgacattctgggcgcgccggttgatcgcccggtcatcaccgaaaccacggcgctcggcgcggcctatctggcggggcttggcgccgggatctgcccgccgcctgcggagttcgcggcgcagtgggcgcttgaccgccgcttcacccccgcgatggccgagacggagcgggcacggaaactggcccgctggcagcgcgcggtggcg

SEQ ID NO: 45512 - DNA, 1533 bp, Rhodobacter capsulatus
caacccggggtcgtcgatcttttcatcatcggcgggggggtgaacggctgcggcatcgcccgcgacgcggcggggcgggggctttccgtgaccttggccgaacagggggatctggcgcaggggacctcctcggcctcgaccaagctgtttcatggcgggctgcgctatctcgaattcttcgaattccgtctggtgcgcgaggcgctggaggaacgcgagacgcttctggtcgcgatgccgcatatttcctggcccttgcgcttcgtgctgccggtgcatgcggggatccggttcgacacgacaacgcccacaagccgactgttgaacctgatgttcccgtggatgaaggggcggcgtccggcgtggctgctgcggctggggctttttctttatgacagcatgggcgggcgcaagatcctgccgggcacgcgcaagctggatctgacgcgcgacaagatcggccgggcgctgaagccggggatggggctggcctgggaatattccgattgctgggtcgatgatgcgcggcttgtggtgctgaatgcccgcgatgcgcaggcgcggggggccaatgtgctggtgggcacccgtgtcaccgcggcggcgcggcagggtgatctgtggcgcatcgagaccgaggggcccgcgggcaaggccgtgcatctggcccgcggtctggtcaatgccgccgggccctgggtcgggcaggttctggggctgatcgaagggccgaaacccgcggcgcaggtgcggctggtgcgcggcagtcatatcgtcacccgcaggctgcacgacgatccgcgggcgctgttcctgcagggatcggacgggcggatcatcttcatcattccctatgagcaggatttttccctgatcggcaccaccgaggccgcgcatgaggccgcccccgaggccgcggcctgttcggcggccgagcgcgattacctgctggccttcgtctcgcaatatctggccaagcccgtcaccgcccgggatgtcgtctggtcctatgccggggtgcggccgctttatgacgatggggcgagttccgccaccgcggcctcgcgcgattatgtgctggatctgcaggccggggggccggttctgctcaatgtctttggcggcaagatcaccacctatcgccgtctggccgaggcggccctggcgaagctggcgccgcatttccccggtcttggcccggactggaccgcccgcgtgcccttgcccgggggggatttctttcagaccggggtcaaggcgctgatcgagcggttgcgggtgcgctatgcctttctggggcaggcgggggcggggcggatggtgcgggcttatggcaccgaggctttcgccattctgggcgaggcgaagacccgtgccgatctgggccgcgatttcggcgcaggcctctccgaggccgaggtgatctggctgatggaccgcgaatgggcgcgccgggccgaggatgtggtctggaggcgcacgaaactgggcctgcggctgagcgccgatcagattgcggtgcttgaccgcttc

SEQ ID NO: 45513 - DNA, 606 bp, Rhodobacter capsulatus
cttgcccttgcgcttgcccttgccacccccgcctttgccgaggaattccgggtgatcccgccgcccgccgtggatgcggcggcgctgaccggcccggaaaccgcgatcttcgcgggcggctgcttctggggcgtgcagggggtgtttcagcacctgaacggcgtgatcagcgccacctcgggctatgcgggcggcacggcggcgacagcccattacgatcaggtctcgggcggcgagaccggccatgccgaagccgtgcaggtggtcttcgacccgaagcagatcagctatggcgacctgttgcaggtgttcttttccgtcgcgcatgatccgacgcagctgaaccgtcagggccccgatgtcgggccgcaataccgctcggccctgtttcccgtgaccgaggatcaggcccggatcgcgaaagcctatatcgaccagctgggccgcgcccgcgcctttgacgccgcgatcgtcacgcagctggaccccggcgccgccttttacccggccgaggcctatcaccagaacttcctgaccctgaaccccgaccacccctatatcgttcaggtggacatgccgaagatcgccgcgctggagcggatgttc

SEQ ID NO: 45514 - DNA, 1503 bp, Rhodobacter capsulatus
cgcccgaatattcttgtcatcatggtggatcaggccaacgggacgctgtttcccgacggtccggccccgttcctgcacacgccgcatctgaagcgtctggcgaagcggtccacccgctttgccaatacctacacggccagccccttgtgtgcccccgcgcgggcgtccttcatgtcggggcagttgccgtcccgcacgcgggtttacgacaatgcggccgaattcgcctcggacattccgaccttcgcgcatcacctgcgccgggcgggctatgccacgacgctttcgggcaagatgcatttcgtcggccccgatcagctgcatggcttcgaggaacggctgacgaccgacatttacccggccgatttcggctggacgcccgattacaccaagccgggcgagcggatcgactggtggtatcacaacctcggctcggtcaccggcgcgggcgtggccgagatcaccaaccagatggaatatgacgacgaggtcgcctatcacgccacgcgcaagctttacgacctgtcgcggcggcaggacgaccggccctggtgtctgacggtgtccttcacccatccacacgacccctatgtggcgcgcaagcggttctgggatctttacgaggaaagtccggcgctggaccccaccgtgcctgcgctgcctttcgaggatcaggacccgcagtcgcggcgtattctggaatcctgtgatttcagaaatttcgaaataacccccgaaatgatccgccgtgcccgccaggggtattttgcctcgatcagctacatcgatgaaaagataggggaaatccttgacgttctggaacgcgggcggatggcggacaacacgatcatcgtcttcgtctcggatcatggcgacatgctgggcgagcgcggcttgtggttcaagatgaacttcttcgagggctcggcgcgggtgccgatgatgattgccgcgcccggctggaaacccgggcggatcgacacgccggtctcgacgcttgacatcacgccgacgctggcggccttggcggggatcgacatttccacgttggcgcgctggaccgacggggtcgatctggacccggtggcgcaaggcggggcccgcgccgcggtgccgatggaatatgccgcggaatcgacgatcgcgccgatggtctgcctgcgcgaggggcgttacaagctgatgctctgtgccgtcgatccgccgatgctttacgacctcgaagccgatccgcaagaactggtcaatctggccaccgcgcccgaacatgcggatacactgaagcggctgaccgatcaggcgctgacgcgttgggatctgggcgccttcgatgcggcggtgcgcgaaagccaggcgcggcgctgggcggtttatgacgcgctgcgcaacggcgcctatttcccttgggattaccagccgctgcaaaaggcgtcggaacgctacatgcgcaaccacatggacctgaacgtgctggaggaaaaccagcgctatccgcgcggcgag

SEQ ID NO: 45515 - DNA, 1155 bp, Rhodobacter capsulatus
gggctggatgacgagctggagatgatccgcgaccagttccaccgctatgccgaggaacgggtgatcccgaacgcccatgactggcacctgaaagacgagttgatcccgatggagatcatcgaggaactggcagaactgggcgtcttcggcctgaccatccccgaggaatacggcgggctcggcctgtccaaggcctcgatggtcgttgtgaccgaggaactctcgcgcggttatatcggcgtcggcagccttggcacgcgctcggaaatcgccgcggaactgatcctctgcggcggcaccgaagaacagaaacagaagtggctgccgggccttgcctcgggggaaatcctgtccaccgcggtcttcaccgaaccgaacaccggctcggacctgggcagcctgcgcacccgcgcggtcaaggatggcgatgattgggtgatcaccggcaacaagacctggatcacccatgcgcagcgcacccatgtgatgacgcttctggcccggaccgagcccgacaccaccgactggcgcgggctttccatgttccttgccgaaaagaccccgggcaccgacgaaaaccccttccccacccccggcatgaccggcggcgagatcgaggttctgggctatcgcggcatgaaggaatacgagctgggctttgacggcttccgggtcaagggcgagaaccttctgggcggcgagaccggccggggcttcaagcagctgatggaaacctttgaatcggcgcggattcagaccgcggcgcgggccgtcggcgtggcgcaggccgcctgcgagatcggcatgcgctatgcgatcgaccgcaagcaattcggcaagtcgctgatcgaattcccccgcgtcggcggcaagcttgcgatgatggcggtcgaaatcatgatcgcgcggcagctgacctatttctcggcctgggaaaaggatcacggccaccgctgcgacgtcgaagccgggatggcgaagctgctgggcgcccgtgtcgcctgggcggcggcggacaatgcgctgcagatccacggcggcaacggctttgcgctcgaatatgcgatctcgcgcattctgtgtgacgcccggatcctcaacatcttcgagggcgcggcggaaattcaggcgcaggtgattgcccggcgtctgctg

SEQ ID NO: 45516 - DNA, 1107 bp, Rhodobacter capsulatus
gagcggtttgcgaacctgcccgaatatgcgtttccgcggctgcggacgctgctcgaccacctgaaaccggggggcgagcctgttgccatgacgatcggcgagccgcgccacccgatgcccgatttcgtcgggccggtgctggcggccagcctgtcggaattcggccagtatcccgccaatgacggcacgcctgcgcttttggcggcgatttccggctggctggggcggcgttacggcgtcgatgtggcgcaaaaccggctgatggtgctgaacggcacgcgcgaggggctgttcaacgccgcgattgcgctttgcccggaaaccaagcgcggcaagcgcccggtcgttctggtgccgaacccgttctatcaggtctatgccgtcgccgccgcgaccgtgggcgccgaggtggtcttcgttccggcgagcgaggagaccggcttcctgcccgattacgaaagcctgcccgccgagatcctcgaccgcaccacgatcgcttatctctgctcgcccgccaatccgcagggctcggtggccggtcgcgactatctggcccggctgctcgccttggcggaaaagcatgatttccggctgttttccgacgaatgctattccgagctttggcgcaatgccccgccgcccggggcaatcgaagtggcggccgagaccggcaccgatcccgagcgggtggtgatctttcattcgctctcgaaacgctcgaacctgccggggctgcggtcgggcttttgtgccgccggtccgcaggcgatgcagcgcataaggcagctgcgcgcctatgcgggcgcgcccctgccgcagccgattcagcgcgtttcggaacgtgcctgggcggatgaggcgcatgtgatccaaaaccgcgcgctttatgcggagaaatatgccgatgccgcggaaatcttcagcggtgtcaacagcttccgtctgcctgagggcggcttcttcctgtggctgccggtcgagaacggcgaggaagcggcggtgaagctgtggaccgaaaccggggtccgtgtcctgccgggggcctatctggcccgcgacgtgaacggcgaaaaccccggcaagggctatatccgggtggccttggtc

SEQ ID NO: 45517 - DNA, 774 bp, Rhodobacter capsulatus
cttgccacctggaacatcaactcggtccgcctgcgcgaagcgctggtgtgcaagctgatgaccgaggaggcgcccgatgtcctgtgcctgcaggaatgcaagagcccggtcgacaagatccccttcgccgcctttgccgagctgggctaccgctatcacgtcgcgcgcgggcaaaagggctacaacggtgtcgcgatcctgtcgaaactgccgatggtcgaggcgggggcgggcgattacgccaatcttggccatgcccgccacatcgccgggcggctggaaaacggcgtcaccatccacaatttctacgtgcccgcaggcggtgacatcccggaccgggcggaaaacgagaaattcggccagaagctcgatttcctcagccatatgcgtgacgatttccacgcccagcggccggaccgggcgattctggtcggcgatctgaacattgcgccgcgcgaggacgacgtctggaaccacaaggcgctgctcaagatcgtctcgcatacgccgatcgaggtcgagcatctcgccgccgcccaagatgcgggcggctgggtcgatgtcacccgtgccgatatccccgaggggcagctttattcctggtggtcctatcgctcgcccgattgggacggcgccgacaagggccgcaggctggatcacatctgggcgacgcccgacattgcaggcgcggcgcatggcagccgcatcctgcgcgccgcgcggggatgggagcagccctcggaccatgccccggtctttgcgacattcgatctt

SEQ ID NO: 45518 - DNA, 1137 bp, Rhodobacter capsulatus
tccggttcgatcgtgaaaccgaagaaatccgtggccctgtccggggtggtggcgggcaatactgcgctgtgcagcgtcggccagaccggcaacgacctgcattaccgtggttttgacattcttgaaattgccgaatcttgcgaattcgaggaagtggcacatctgctgatccatggcaccctgccgacgctggcggagctggccagctatcgcaccaagctgcgggcgctgcgcgggctgcccttggccgtgcgccagacgctcgaggcgatcccggccgccgcgcatccgatggatgtgctgcgctcgggcgtctcggccttgggctgcgtgctgcccgaggccgccgatcacaacacgcccggcgcgcgcgacattgccgaccggctgatcgcggtgcagggctcgatgctgctttactggtatcacttcgcgcagaacggccgccgcatcgaggtcgaaaccgaagacgacagcatcgccgggcatttcctgcatctgctgcatggccgccccgcgggcgaggaagccgtgcgggcgctgcacaccacgctcaacctttatgccgaacacgagttcaacgcctcgaccttcaccgcgcgcaccatcgcggggaccggatcggatctttattcctgcgtcgcgggcgccatcggcgcgttgcgcgggccgaaacacggcggcgcgaatgaacaggccttcgaaatccagaagcgctacgccacccccgacgcggccgaggccgatatccgcgcccgggtggccgcgaaagaggtgatcatcggctttggtcatcccgtctacacgatcgccgatccgcgcaatgtggtgatcaagcaggtggcgcggcggctggcgctgcatcacggcgcgctgcggatgttcgacatcgccgagcggatcgaacaggtgatggccgagacgaaggcgatgtttccgaacctcgactggtattcggcggtctcctatcatcagctgggcgtgccgacgatgctgttcacgccgatcttcgtcatcgcccgcagcgcgggctggggggcgcatgtgatcgagcaacggctggacggcaagatcatccgcccttcggcgaattacaccggccccgaaacccgggccttcctgccccttgaagcccgc

SEQ ID NO: 45519 - DNA, 1236 bp, Rhodobacter capsulatus
gtgaccgacgatctggcctttgatgccgcccatgtctggcatccctacacggcgcggttcaccgccgcaccgcagcacaagatcgtcgccgccaaggggatctggctgacgctggaagacgggcggcagatgatcgacgcgatgtcttcctggtggtgcgcggccttcggccatgcgcccgaaccgctggtgcgggcgctgcaggcgcaggccgcgaccctgccgcatgtgatgttcggcgggctgacgcatcgccccgccatcgaactgacccgccgtctggtcagggccctgcccgaggggctggatcaggttttctattccgacagcggctcggtcgcggtcgaggtggcggtgaagatggcggttcaggcgcagctggcgcaggggcggcgcgggcgcacccggctggccacggcgcgcggcggctatcacggcgacacctggacggcgatgagcctctgcgacccggaggccgggatgcatgcccatttcggaagcgccatcgcgccgcagcatttcgttgcccgcccgccggtggcctatggcgccgactggcccgaggacgaccggcggaacgggctggccgaggtcgaagcgctgttcgagcggcacggcgcgcagatcgccgccttcatcctcgagcccatcgtgcagggcgccagcggcatgcatttccatcaccccgcctatctacgcggcctgcgggcgctttgcgaccgccatgacatcgcgctgatcttcgacgagatcgccaccggcttcagccgcaccggcagcgatttcgcgctgcacagggccggggtggtgcccgacatcctctgtctgggcaaggcgctgaccggcggcatgatgagccttgccgcgacggtcgcaacccgcgatctggccgggcgggtgggcgccttgatgcacgggccgaccttcatggccaatccgctcgcctgcgcggtggcagcggcggcgatggatctgtggcaaggccacgactggtcggccgaggcccgccggatcgaggcgcagctgacgcaggagctggcgcctgcacgcgggtttgcgggcgtggccgatgtgcgctgcctcggcggcatcggcgtgatcgagatgaaagcccccctgccgctggcgccgatccaccgcttttgcgcgcaaaccggcgtctggctgcgccccttcggccgggttctttacgcgatgccgccgctgacgatcgggccggacgatctgagccgcgtg

SEQ ID NO: 45520 - DNA, 777 bp, Rhodobacter capsulatus
ggttcgccgatgttttctttggaagggcaaaaggcgctcgtcgtcggaattgcgaacgaacagtcgatcgccttcggcattgcccgggccttgcgggcacagggcgccgatctggccgtcacctggctcaatgacagggccgagccgcatgtgcgcccgctggcggaagaccttgaggccgaaatcatgatgccgctcgatgtcgccgagcccgatcagcttgcggcggtgttcgaggcgatcgcggaccgctgggggcggctggacacgctggtccattccatcgccttcgcgccgcgggccgatctgcacgggcgggtcgtcgattgctcctccgagggtttcgcgctggccatggacacctcggtgcattccttcctgcggatgatccatctggccgaaccgctgatgacggcggggggcacctgtctttcggtgtccttcttcggctcgacccgggtggtgcggcattacaacctgatggggccggtgaaagccgcgctggaaagcgccgtgcgctatgccgcagccgaattgggcgaaaagggcatccgggtgcatgcgctctcgcccgggccgctggccacccgcgccgcaagcggcatcgatcatttcgacgagatgatggccgaggcggccgagcgcgcgcccacccatcagcttgcaacgatagaggatatcggcgcgatggccgcctttctggccgcgcccgaagcgaagaacctgaccggcgggatccacgagatcgacggcggctattccatcaccgcctgagga

SEQ ID NO: 45521 - DNA, 879 bp, Rhodobacter capsulatus
gaagcgatgacgggagggtgcgcaatggctttggacgatccgaaaacactggtttccaccgactggctcgaggcgcatctgcgcgacccggatttgcgggtgctcgatgcctcgtggttcctgccttcgatggaacgcgatgcgaaggcgggctatgcagccgcccatattccgggggcgcggttcttcgacatcgacgagatttccgacacgcggtccgagctgccgcatatggcgccgccggtcgagaaattcatgtcccggatgcgggcgatgggcgtgggcgacggccatcaggtggtgatctatgaccagatgggcatcttttccgcgccgcgggtctggtggctgttccggctgatgggcaagaccgatgtcgccgtgctggatggcggtttgccgaaatggctggccgagggccgcgagaccgaggacatggcgccgatcccgcgcgaccggcacatgacggtgcagcgccaggcgcatctgatcaaggatgtgacgcaggtcgcgcatgcctcgaagctgggcgatcacgagatcatcgacgcccgcccgcgcggccggttcctgggcaccgatcccgaaccgcggcccggcctgcggtccgggcatattccgggcgcgaagaacgtgccgtggaacagcgttctgaccgagacgaacacgatgaaatcgcccgaggacctgcgcgcggtcttcacggcggcgggcgtggaccttgcgaaaccggccattgccacctgcggctcggggatttccgccgccgtgctggtgctggcgctggaacggatcggccaccgcaatcacgccctttatgacggctcctgggccgaatggggcatgttcaacgacctgcgcgtcgcaaccggagaagca

SEQ ID NO: 45522 - DNA, 1181 bp, Rhodobacter capsulatus
atgttcaattccctcaaagctcaggcgcctgacaagatcttggcgctgatgggccagttccgcgccgatccgcggacggacaagatcgaccttggcgtcggggtctataaagacgccgaaggccggaccccggtgatgcgggcgatcaaatcggccgaaaagcagctttgggaaacggaaaccagcaagacctataccgcgctggcgggcgagccggccttccatgccgcgatggcggaaatggtgctgggcgcgggctatccggcggatcgtctgtcctgccttgcgaccgtgggcggcaccggcgcctgccgtcaggcgttcgagctggcgcggctggcgaacccgggctgcaccgtctgggtctcggacccgacctggccgaaccacctgtcgatccttgccttcatgaagcaggacaccaagctttatcgctatttcgacagcgccgcccgtgcggtggctttcgacgcgatgatggaagatctgcaggcgatcaaggcgggcgatgtcgtgctgctgcacggctgctgccacaacccgaccggcgcgaactgacgctggagcaatgggcggccgtggccgaccttttggaagccaagggcgccgtgccgatgatcgacctggcctatcagggcttcggcgacggtctagaagaggacgccgcgggcacccggctgatcgcctcgcgcctgcccgaggtgatgattgccgcgtcctgctcgaagaacttcggcatctaccgcgaacgcaccggctgcctgctggtcctgtccgatgcggcgtcgaaggacgtgacgcagggcacgctcgcctatctgaaccggcagaactactcgttctcgcccgatcacggcgcgcggctggtgacgatggtgctgaccgatccgaccctgcgggcggaatggatgaccgagcttgaggaagtccgcaagggcatgctgggcctgcgcgagcagctggcggcggagctgcggcagctgtcgaattcggaccgcttcgatttcgtcgcccgccatcgcggcatgttctcgcggctgggcgccagccccgagcaggtcgaaaagatgcgcgtcgacaatgcgatctacatggtcggcgattcgcggctgaacatcgccgggctgaacgccaagaccgtgccgatccttgcccgggcgatcatcgccgccggggtgtga

SEQ ID NO: 45523 - DNA, 1380 bp, Rhodobacter capsulatus
atgacttgccaggtcacccagaaggcgcgggaaggcacgatcaacccgatcttcacctgccagcccgccggggcgcaattcgcctcgatcgggatcaaggattgcatcggcatcgttcacggcggccagggctgcgtgatgttcgtgcgtctgctgatctcgcagcacatgaaggaaagcttcgagatcgcctcgtcgtcggtccatgaagatggcgcggtcttcggcgcgctcgaccgtgtcgaaaccgcggtcgaggtgcttttgacccgctaccccgatgtgaaggtggtgccgatcatcaccacctgctcgaccgagatcatcggcgacgacgtggacgggctgctttcgaaactcgaagacgagttgctgccgaccaaattccccggccgcgaagtgcatctgctcaccgtgcattgcccgagcttcgttggctcgatgatcaccggctatgacaaggcggtgcatgatttcgtgaagaaattcgcgacgaaggacgagcccagcgacaagatcaacctgatcaccggctgggtgaacccgggcgatgtgaaggagctgaaacaccttctggaggtgatggaggtcaaggcgaacgtgctctttgaagtcgaaagcttcgacagcccgctgatgcccgatctggaacaccattcgcacggctcgaccacgatcgaggatctgcgcgacacggccaatgcgaaaggcaccatcgcgctcaatcgctatgaaggcatgaaggccgccgattacctgaagaagaagttcaaggttcccgcggtgatcgggccgaccccggtcggcatccgcaacaccgatgccttcctgaaagcggtctccgagatgaccggccagccgatcccggcgcagctggtcaaggaacggggccttgcgctcgatgccatcgccgacatcggccacatgtttctggccgacaaaagggtggcgatctatgcgaaccccgatctggccatcggcctgaccgagttctgccttgacctcgaaatgaagccgaaactgctgcttctgggcgatgacaactcgggctatgtgaaagacccccgcgtgctggcgctgcaggaaaacgcgccggatctggaaatcgtgacgaacgccgatttctgggatctggaaagccgcatccagcaagggctcgaactcgatctgatcctcggccattccaagggccggttcatctcgatcgactacaaggtgccgatggtccgcgtgggcttcccgacctacgaccgggcagggatgtatcgccatccggtgctgggctacggcggggcgatgttccttgccgaaaccatggccaacacgcttttcgccgacatggaggcgaagaaaaacaaggaatggatcctcaacgtgtgg

SEQ ID NO: 45524 - DNA, 1587 bp, Rhodobacter capsulatus
atgccctaccatgagtttgaagtctcgaaatgcatccccgagcggcgcgagcacgcggtgatgaaggcggcgggcgaggatctgacctcttgcctgccgaaaggctacctgaacacgatccccggcacgatttccgaacgcggctgcgcctattgcggcgcaaaacacgtgatcggcacgccgatgaaggacgtgatccacatctcccacgggcccaatggctgcacctatgacacctggcagacgaagcgctacatctcggacaatgacaacttccagttgaaatacacctttgcgaccgacgtgaaggaaaagcacgtcgtcttcggcgccgaggggctgctgaagaaatcgatgcacgaggcctttgacgccttcccgaacatcaagcggatgacggtctatcagacctgcacgacggcgctgatcggcgatgacgtcgatgccatcgccaaggaagtgatggaagaacgcggcgatgtcgatgtgttcgtctgcaactcgcccgggttcgcggggcccagccaatcgggcggtcaccacaagatcaacatcgcctggctgaaccagaaagtcggcacggtcgagccggactacctaggcgaacacgtcatcaactacgtgggcgaatacaacatccagggcgaccaggaggtgatgatcgactatttcaaccgcatgggcattcaggtgctgtcgaccttcaccggcaacggcagctatgacagcctgcggatgatgcaccgcgcgcatctgaacgtgctcgaatgcgcgcggtctgccgaatacatctgcgacgaactccgcgcccgctacggcattccccggctggatatcgacggcttcggcttcgagccgctcgccaattcgctgcgcaaggtcgcgctcttcttcggcatcgaggacaaggccgaggcgatcatcgccgaggaatatgcgaagtggaagccgcagctggactggtacaaggaacggctgaagggcaagaaggtctgcctctggccgggcggatcgaagctctggcactgggcccatgcgatcgaagaggaaatgggcctcaaggtcgtgtcggtctataccaagttcggccatcagggcgacatggaaaagggcgtctcgcgttgcggcgagggggccttggcgatcgacgacccgaacgagctggaatcggtcgaagccatcgagatgctgaagcccgacatcatcttcaccggcaaacgccccggcgaattcgtcaagaaacacggcgtcccctatctgaacgcccatgcctatcacaacgggccttacaagggcttcgagggctgggtccgcttcgctcgcgacatctacaacgcgatctattcgccgatgcggcagctggcggcgctggatatttccgcccccgatgcggccatcacctcgggcttccgcaccgccaagatgaacgccgatctgaccgtttcggatgaggtcaagttcagcgaggtgctgcacgaatacaccggcaaatacgactcgattgccgagatccgcgcccgcaatcaggcctatgccgccgagcagaaagcgctccgcgacgccgttcaacctgccgccgaatgaggg

SEQ ID NO: 45525 - DNA, 1536 bp, Rhodobacter capsulatus
atgccccagtcggctgacaaggtgctcgaccactcgaaactgttcttcgagcctgaatacaaagagatgctcgccaacaagaaggcgaccttcgaatgcggccattccgccgaaaccctcgcccagatcggcgactggacggcgtcctgggaataccgcgaaaagaacctcgcccgcgaagccctgaccatcaacccggcgaaagcctgccagccggtcggcgccgtctttgccgcgcagggctatgaaggcaccctgcccttcgtgcatggctcgcaaggctgcgtggcctattaccggtcgcacctgtcgcgtcacttcaaggaaccttcggcggcggtgtcgtcctcgatgaccgaagatgccgcggtgttcggcggtctgaccaacatggtcgagggcctggccaacgcctatgcgctttacaagccgaagatgatcgccgtttcgaccacctgcatggccgaagtcatcggcgacgacctcagctcgttcatcatcaaggcgaaagaggccgaaagcgtgccggtcgatttcccggtgcccttcgcccacaccccggcctttgtcggctcgcatgtggacggctatgacaacacccagaaaggcatcctgtcgctgttctgggccggggccgagcgcgtggcgaatgacagcctgaacatcatcccgggcttcgacggttacgccgtggcgaacaaccgcgaaatcaagcgcctgctggatacgatgggcgtcagcttcaccttcctgtcggatgtgtcggaagtctatgacaccccctcggacgggcattaccgcatgtatgcgggcggcacgaaactcgaagacgcgaaagccgcggtgaacgccaaggcgacgctctcgatgcaggaatggtgcacgccgaagacgctcgaatatgtcgaaacgactggtcaggaaaccgccgtcttcaactatccgatgggcgtttccgccaccgacagcttcctgatgaaagtctcggaactgaccggcaaggcgatcccggacagcatcaagctggaacgcggccgtctggtcgacgcgatcgcggacagccaggcctatctgcacggcaagaccttctcgatcttcggcgacccggacttcgttctgggcatggcgaagttcatcatggagatgggcggcgagccggtgcattgcctcgccaccaacggctcgaagaaatgggccaagcagatggaagaagttctggccgcttcgcccttcggcaagcagggtcaggtctgggcgggcaaggatctgtggcacatgcgcagcttcctgatgaccgaaccgaccgatttcctgatcggctcgtcctacggcaaatatctggaacgcgacaccggcatcccgctgatccgtctgaccttcccgatcttcgaccgtcaccaccaccaccgcttcccgacctggggctatcagggcggcctgacggttctggtcaagatcctcgacgcgatcttcgtcaaagccgacgcccgcgccggtgactggggcaagaccgacatcagcttcgatctgacccgc

SEQ ID NO: 45526 - DNA, 612 bp, Rhodobacter capsulatus
atgcatacggaagcgattgcccgcagctacaagcgctgggcgccgatctacgacaagactttcggcaagatcacccatgccgggcgccatcatgccgtgcgcgaggtgaacgcgaccggcggcgcggtgctggaggtggggatcggcaccggccttgcgctggatctttatgaaccctcgaaggtggcggtgaccggcatcgacctgtcgcccgacatgctggccaaggcgcaggcccgggccgaggcgcaggggctgcgcaatgtcgccgggctgcatatcatggatgcgcgcgagctggcctttgacgacgaaagcttcgatcacgtcgtcgcgctgcacatcatgtcggtggtgcccgagccgcgccgggtgatggcggaaatggcgcgggtctgccgcgtcggcggcacggtgctgatcaccaaccatttcgcccgcgaaaagggcggctggggcgtcgccgcgaaactggccgcgccgatggccgatgcgctcggctggcattccgatttcgcccgcgccgaggtgatgtccgagccgcggctgaaactggtcgaggaaacccgcctgccgcccttcggcctgatgaccttcctgcgcttccgccgc

SEQ ID NO: 45527 - DNA, 1254 bp, Rhodobacter capsulatus
atgccggtctgcccgttcccaattcgccatcccgccggaccagaccagcgtgtcggccttgacccgtccggcccggatcagatcgcggatcaccaattcgtccaccgggccttcgctcttgcccgcccatgcgtaatgccacgccttcgccatgaaaccctcgcgcaaactttgcttgcgtggcaccttagcctgaggcaggacggggcgacaattgcggagacgaaaatgacccagaaaatcgccatcctcggggcttcgggctataccggcgccgagcttgcccgcatcattgcgacccatcccgagatggagatcacggcgctctcgggcgaccgaaaggccgggatgcgcatgggcgaggtctttccgcatctgcgtcacatcgggctgcccgatctggtgaagatcgaggagatcgacttttccggcatcgatctggccttttgcgcgctgccgcatgcgaccagccaggcggtcatcgccgaattgccgcgggatctgaaggtggtggatctctctgccgatttccggctgcgcgacgcggccgaatatgaaaaatggtatggcaagccgcatgcggcgatggatctgcaggccgaggcggtctatggcctgaccgaattctaccgcgaagagctgaaaacggcgcggctttgcgcgggcaccggctgcaatgccgcggcggggcaatatgcgatccgcccgctgatcgaggcgggtgtgatcgatctggatgaaatcgtcatcgacctgaaggcaggggtgtcgggggccggacgctcgctgaaggaaaaccttttgcatgcggaacttgcgggcggcaccatgccctattcggcgggcggcaagcatcggcatctgggcgaattcgatcaggaattctccaaggtggcggggcggccggtgcgggtgcagttcacgccgcatctgatgcccttcaaccgcgggattctggcgaccgtctatgtccgcggcacccccgaagacatccatgccgcgctggccagccgctatgaaaacgaggttttcctggaggtgctgccctttggtcagctggcctcgacgcgttcggtcgccgggtcgaacttcgtgcatctgggcgtgatcggcgaccggctgccgggccgcgcggtggtgaccgtggcgctcgacaacctcaccaagggctcttcggggcaggcgatccagaacgccaacctgatgctgggcctgcccgaaaccctggggctgatgctggccccggtcttcccg

SEQ ID NO: 45528 - DNA, 1338 bp, Rhodobacter capsulatus
catctgatcggcggggcgatgaccgcgcccgggccgcagcttgcggtgcataacccggccaccgacgagcccctggccgaagtcacccgggggagcgcggccgatgtgaccgccgccgtcgccgccgcaagggccgccgcccccggctggaccgcgctttcggggcatgagcgggcgaaatggctttatgcccttgcgcgcaacctgcagaaacgcgaagcatttcttagaattctggaagttctggataccggaaagccgatcagggaatgccgcgacatcgacctgccgctggcgatccgcgaggtctaccaccacgccggctgggccgaactctgcgccggggaattccccggtctggagccgctgggcgtcgtcggggcgatcctgccgtcaggctgcccgcttccgggactgctccggaccctcgccccggcgctggccgcgggcaataccgtggtggtgaaaccggccgaggaaacgccgctgtcggcccttgcccttgccgagatctgcctcgagatcggcctgcctgcgggcgttttgaacatcgtcaccggcgatggcgcgaccggcgccgccctggtcgcggccgaagtcgacaagatcgccttcaccggcgcgaccgacatcggccgtgcgatccgcaaggccacggcgggctcgggcaaggcgctggggctggagctgggcggccaatcccccgttctcgtctttgccgatgccgatctggacgcggcggtcgagggcgtcgtgaccgcggcctggaccggtcagggcgagagcagtgcgggcggggcgcggatccttgtcgccgaagcggtggccgagcgcttcaccgcccggctgaccgcccggatggagaagctgcggctgggcgatccgctcgacaagggcaccgacattggcgccctcgtctcggcggcgcagcgcgaccgcgtcctggcgctgctggcccgcggcgtcgcggccggggcacggctgctgcaatcgtccgcccccctgcccgcgcagggcaatttcgtcgcccccgggctgttgctggacgcgcaaccgaccaatccctgcgtgaccgaagacggccttggcccgattgcgacactggccagcttccgcacgcccgccgaagcgatcgcgctggccaatgccagtcggcagggacgtgccgcctcggtctggtcggaaaacatcacgctggcacaggatgttgcggcgaaactggcgaccgggacggtctggatcaacagccacggcaccgccgatgccgccgccccctcggatggcaagcgcgagagcggccttggccgcaccggcgggcgcgcggctctgcgcgccttc

SEQ ID NO: 45529 - DNA, 3330 bp, Rhodobacter capsulatus
atgccgaagagaaccgacatccagtccatcctcatcatcggcgccggtcccatcatcatcgggcaggcctgcgaattcgactattccggcgcgcaagcctgcaaggccctgcgggaagaaggctaccgggtcattctggtgaactcgaacccggcgacgatcatgaccgacccggaaatggccgatgcgacctatatcgagccgatcacccccgaggtcgtggcgaagatcatcgaaaaggaacgccccgacgcgcttttgccgacgatgggcgggcagaccggcctgaacacctcgcttgccttggccgacatgggcgtgctggagaaattcggggtcgagctgatcggcgccaaccgcgaggccatcgagatggccgaagaccgcaagcttttccgcgaggcgatggaccggatcgggctggaaaacccgaaagccacgatcatctcggcgccgaagctggaaaacggcaaatacgacatctcggccggcgtgcgtcaggcgctgatcgatctggaacatatcggcctgcccgcgatcatccgcccggcctttacccttggcggcaccggcggcggcgtcgcctataaccgcgacgattacgaggccatcgtgcgctcgggccttgatgcttcgcccgtggcgcaggtgctgatcgatgaatcgctgctgggctggaaagaatacgagatggaggttgtccgcgacaaagccgacaatgccatcatcgtctgctcgatcgaaaacgtcgatccgatgggcgtgcacaccggcgattccatcaccgtcgccccggcgctgacgctgaccgacaaggaatatcagatcatgcgcaacggctcgattgccgttctgcgcgaaatcggtgtcgaaaccggcggctcgaacgtgcaatgggcgatcaacccgaaagacgggcgcatggtggtgatcgagatgaacccgcgggtgtcgcggtcctcggcgctggcctcgaaagccacgggtttcccgattgcgaagatcgcggcgaaactggccgtcggctacacgctcgatgaacttgacaacgacatcaccaaggtcacgcccgcgtccttcgaacccaccatcgactatgtcgtgaccaagatcccgcgctttgcgttcgagaaattccccggttccaagcccgagctgaccaccgcgatgaaatcggtgggcgaggcgatggcgattggccggaccttccacgaatcggtgcaaaaggcgctggcctcgatggaaaccggcctgaccggctttgacgaaatcgccatcgagggcgcgcccgacaaggccgccgtgatcaaggcgatctcgcgtcagaccccggaccggatgcggctgattgcgcaggcgatgcgccacgggctgagcgacgaggaaatcgtcaccgccaccgcctttgatccgtggttcctcgcccgcatccgcgaaatcgtcgaggccgaggccgcgatccgcaagaacggcctgccgcttgatgaaaagggcctgcgcaagctgaagatgatgggcttcaccgatgcgcgtctggcgaaactgaccggccgcgacgagggtcaggtccgccgcgcgcggcgcaatctgggcgtcaccgccgtcttcaagcgcatcgacacctgcgccgccgaattcgaggcgcagaccccctacatgtattcgacctatgaagtcccggcgatgggcgatgtcgaatgcgaggcccggccctcggaccgcaagaaggtcgtcatcctgggcggtggcccgaaccggatcggtcaggggatcgaattcgattactgctgctgccatgcctgcttcgcgctgacgaaggcgggttatgaaaccatcatgatcaactgcaacccggaaacggtgtcgaccgactatgacacctcggaccggctctatttcgagccgctgacgctggaacatgtgctggaaatcctgcgcgtcgaacaggataacggcacgctgcacggcgtgatcgtgcaattcggcggccagacgccgctgaagctcgcgaatgcgctggaagccgaggggattccgatcctgggcaccacgccggacgccatcgacctcgccgaagaccgcgagcgcttccagcagctgctcaacgatctggagctgaagcagccggtcaacggcatcgcctcgaccgaggcgcaagcctttgaaattgcgggccgtgtcggctatccgctggtcattcgcccgtcctatgttctgggcggccgcgccatggaaatcgtccgcgacaccgagcatctgaaacgctacatcaccaccgccgtcaccgtctcgggcgacagcccggttctgctcgacagctatctttcgggcgcgatcgaggtggatgtggatgcgctctcggatggcaagaccgtccatgtcgcggggatcatgcagcatatcgaggaagcgggcgtccattcgggcgattccgcctgctcgctgccgccctattcgctctcgcgcgagaccgtggcggagctgaaagcccagaccgagaaaatggcgctggcgcttggcgtcgtcgggctgatgaacgtgcaattcgcgatcaaggacggggtgatctatgtgctggaggtgaacccgcgcgccagccgcaccgtgcccttcgtcgccaaggcgaccgacagcgccattgcctcgatcgcggcgcggctgatggcgggcgagccgatggcgaatttcccgctgcgcgccgcctatcccgaaggtgtcggcccggagacccccctgcccttcgccgatccgctgaccttggccgatccgaacacgccctggttctcggtcaaggaagcggtgctgccctttgcccgcttcccgggtgtcgatacgctgcttgggccggaaatgcgctcgaccggcgaggtgatgggctgggaccgcaacttcccgcgcgccttcctcaaggcgcagatgggcgcgggcacgcatctgccggaaagcggccgggtgttcctgtcgatcaaggatgccgacaagtcggacgatctggccaatgccgcccgcgatctgatcgcgatgggcttcacgctcgttgccacccgtggcaccggcgcctggctgaaggaaaagggcgtcgaggccgaggcggtgaacaaggtctacgagggccgtccgaacatcgtcgaccggctcaagaacggcgatatcgcgctggtcttcaacaccaccgatggcaaccagtcggtgtcggacagccgcgagatccgcgccgtcgcgctttacgacaagatcccctatttcaccaccgccgccgcctccatcgccgccgtcgccgcgatgaagagccgcgccgagggcgaaatctcggtccggccgctgcaggcg

SEQ ID NO: 45530 - DNA, 2121 bp, Rhodobacter capsulatus
gatggcgtggccgtcatcacctgggacgtgcccggcaagtcgatgaacgtgatgagccttgagggctttgcccagctcagcgcgcttgtcgacggctgtctggccgatcccgcctgcaagggcatcgtgctgaccagcggcaagaaggatttcgccggtggcatggatctgaacgtcattgccaagatgcgcgaaggcggggcggaggcgatctttgcaggcgtgatgcagatgcatgccgtgctgcgcaagatcgaacgcgccgggatggacccgaagacgctgaaagggggcaagccgatcgcctgcgtcctgccgggcacggcgctgggcatcgggcttgagctgccgctgtcgtgccaccgcatctttgccgccgagaatccgaaggcgaagatcggcctgccggaaatcatggtcggcatcttccccggcgcgggcggcacgacgcggctggtgcggaagatgggcgcgatgatggcggcgccgttcctcttggaaggcaagctctccgacccgaaagccgcgaaagcggcggggatcatcgacgaggtctccgccgatccgatggccgccgcgcgggactgggtcttgaacgcgaccgaggccgatctggtcaagccctgggatgccaagggctacaagatgcccggcggcgccccctatcaccccgcgggtttcatgacctatgtcggcgcttccgccatggtgtcggcgaagacgatgggggtctatccggccgccaaggcgctgctgagcgcggtctatgaaggggcgctcgtgccctttgatcaggcgctgcggatcgaggcgcgctggttcaccaaggtgctgatgaacccgtcctcgacggcgatgatccggtcgcttttcatcaacaaggaagcgctggaaaaaggcgcgaaccggcccaaggtcgccgatcagtcggtgaagaagctgggcgttctgggcgcgggcatgatgggggcgggcatcgcctatgtgtcggccaatgcgggcatcgaagtggtgctgatcgacgccagccaggaggcggccgagcggggcaaggcctatgcgaccggcatcctcgacaagggcatccaaaggcgcaaggtgaccgaggcgaaaaaggccgaggttctgggccgcatcaccgccaccaccgattacgcggcgctcgcgggctgcgatctggtcgtggaagccgtcttcgaagacccggccgtcaaggccgaggtgacggcgaaggccgaggcggtgatccccgagaccgcgatctttgccaccaacacctcgaccctgccgatttcgggtctggccaaggccagccaacgcccggcgcatttcatcggcatccatttcttcagcccggtcgacaagatgaaccttgtcgagatcatcaagggcaaggacaccggcgaggtcgccgtggcaaaggcgctcgatttcgtccgcgccatccgcaagacgcccatcgtcgtcaatgacgcccgcttcttctacgccaaccgctgcatcatcccctatatcaacgagggcatccgcatggtggccgagggggtgaacccggtcctgatcgagaatgcggcgaagctggtcggcatgccgctcggtccgctgcagctggtcgatgaaacctcgatcgatctcggcgtgaagatcgccaaggcgaccaaggccgcgatgggcgaggcctatcccgacggcgcggtcgatgcggtggtgttctggatggcggaacaggggcggcttggcaaaaaggccgatgcgggcttctacacctacgacgcgggcaagcgcggcggcatgtgggaggggcttgcggcgcagtatcctcgcgcggcggcgcaacccgagctgagccatgtgcagcatcggctgctgatggtgcaggtgctggaggccgtgcgcgcctttgaacagggcgtcctgaccgatatccgcgaaggcgatgtcggcgcgatcctgggctggggctttgcgccctggtcgggcggccccttcgcctggctcgacattctgggcgcggcccgggcggtcgagatctgcgacgcgctctcggcccgatacggcgcccgcttcgagaccccggcgctcttgcgcgacatcgccgccaagggcgacagtttccacgcc

SEQ ID NO: 45531 - DNA, 1206 bp, Rhodobacter capsulatus
accgaagcctatatctatgacgcctgccgcacgccgcggggcaaggggcgcgctgacggcagcctgcatgaagtgacctctgtcgcgctgtcggcgcggcttctggatgcggtggcggaacgcaatggcctgacgggtcctgcggtcgaggatgtgatctggggcaatgtcacccaggtgggcgagcagggcggctgtctggcccggtctgcggtgctgctttcggggctcgatgaatcgatccccggtctttcgatcaaccgcttttgcgccagcggcatggaggcggtgaacctggccgccaatcaggtcaaggcgggggcgggcgcggcctatatcgcgggcggggtcgagatgatgagccgcgttgccatgggctcggacggggcggcgatcgccgtcgatccgtcgcttgcgatgaagacctatttcgtgccgcaggggatttccgccgatatcatcgccaccgaatacgggtttacccgcgagatggccgatgcgctggcggtcgaaagccagcgccgcgccgccgaggcctgggccgaggggcgtttcgcgaaatccatcgtgccggtgaaggatcagaacgggctgacgattctggaccgcgacgaatatctgcgccccggcacgacgctggaggatctggccaagctcaagcccgccttcaaggacatgggcgaggtgatgccgggcttcgacaaggtggcgatgctgaaatatccgcatctggagcgcatcgagcatatccaccatgcggggaactcttcgggcatcgtcgatggggcggcggcggtgctgatcggctcgaaggagttcggcgaggcgcatgggttgaagccgcgcgcccgcatccgcgccaccgcgaagatcggcaccgatccgacgatcatgctgaccggcccggtgcccgtcaccgaaaagatcctgcgcgacagcggcatgagcattgccgacatcgaccttttcgaagtgaacgaggcctttgccgcagttgttctgcgcttcatgcaggcctttgacgtcggtcaggaccgggtcaacgtgaacggcggcgcgatggcgctgggtcatcccttgggcgcgacgggggcgatcatcatcggcacgctgctggacgagctggaacgccgcgatctgtccaccgggcttgcgacgctctgcatcgcttccggcatgggcgcggccacgatcatcgagagggtc

SEQ ID NO: 45532 - DNA, 1419 bp, Rhodobacter capsulatus
atgatcgagaaacgccacttctacatcgacgggacatgggtcggcccgcatcagccgcgcgaccatgccgtgatcgacccctccaccgaagagccctgcgcggtgatctcgctcggcgaccgggcggatacggatgcggcggtggccgccgccctgcgcgcggggcccggctgggccgcgacgccgcccgccgcgcgtctggcgacggtcgaacgcctgctggcgatctatcaatcccgcgccgaggagatggcgcaggcgatgagcctcgagatgggcgcaccgatcgatttcgcccgcgacagccaggtgggcgcaggcatctggcacatttcgaatttcatccgggcggcgaaagacttcgaatggctgcatccgctcggcgacggcacgccgggggcgatgatcgcctatgagcccgtcggcgtcgtcggtctgatcacgccctggaactggccgatgaatcaggtgacgctgaaggtcgttccggcgctgctcgccggttgcacgatggttctgaaaccatcggaagaggcgccgctctcctcgctgctctttgcggaattcgtgcacgcggcgggggtgcccgcgggcgtcttcaacctggtgaacggcgacggcgcgggcgtgggcacgcagctttcgacgcatccggatgtggaaatgatctccttcaccggctcgacccgggcgggcaaggcgatcagtcaagccgctgcagcgacgctgaaacgggtctgtctggaactgggcggcaagggggcgaatctggtctttgccgatgccgacgacaccgccatcgcccgcggcgtgcggcattgcatgaacaactccggccaaagctgcaacgcgccgacgcggatgctggtcgaacgcccgctttacgaccgcgccgtgcagatcgccgccgaggtcgccgccgcgatcaaggtcgccccggcgcaggcccccggccgccacatcggcccggtggtgaacgcggcgcaattcgacaagatccagtccctgatcgaaaccgggatcaaggaaggcgcccgtctggtcgcgggcggccttggccgccccgaggggctgaacaagggcttcttcatccgcccgacggtctttgccgatgtcacgcccgaaatgaccgtgatgcgcgaggaaatcttcggcccggtgctttcgatcatgcccttcgacaccgaggaagaggccgtcgccatcgccaatgccacgccctatggcctgaccaattacgtgcagtcgcaagacagcgcccggcgcaaccggctggcacggctgctgcgctcgggcatggtcgagatgaacggccaaagccgcggcgccggggcgcctttcgggggcgtccgcgcctcgggccgcgcccgcgagggcggccgctggggcatcgaggaattctgcgaggtgaaatcgatc

SEQ ID NO: 45533 - DNA, 789 bp, Rhodobacter capsulatus
atcgtgatcacggggatttcgggacggatgggacggatgttggcggcaaccgtcgccgcctcggacaaggcgcggcttgtcggcgcggtcgaacgcacgggccatgactggatcggccgcgatctgggcgaggcgctcggcggggcgaaaaatggcgtcatcgtcagtgatgatccgctggaagcctttgccaaggcgcaggcggtgatcgatttcaccgcgcctgcggcaacgctcgaattcgcccggctcgccgcgcaggcccgcgccgtgcatgtgatcggcaccacgggtttcgagaaagagcagatcgcggcgctggaacccgcctcgcggcattcggtgcagatccgcgcgggcaacatgagccttggcgtgaacctgctgacgaaactggccaagaccgttgccgcggcgctggatgccgattgggatatcgaagtggtcgaggcgcatcacaaccgcaaggtcgatgcgccctcgggcacggcgctgatgctgggccaggccgccgccgagggccgcggcatcgatctggacggcatgaccgaatcgggtcgccacggcatcaccggcgcccgcaaacacggcgcgatcggcttttcggcgatccgcggcggcgatatcgtgggcgaacatgacgtgatcttcgccgcggcgggcgagcgcatcgtgctgcgccacatcgccaccgaccgcgcgatcttcgcccgcggcgcgctcagggccgcgctttggggtcaaagccagaagcccggccaatacgacatgatcgacgtgctggggatc

SEQ ID NO: 45534 - DNA, 1209 bp, Rhodobacter capsulatus
atgacccagacccgcctgatcacccccgtccttgtgggcggcgccatcatcttgatgcttggcttcgccatccgcgcctcgttcggcgtgttccagatcccgatcgccactgaattcggctggccgcgggcggaattttcgctggccatcgcgattcagaacctggcctgggggatcgggcaaccgatcttcggcgcgattgccgagaaattcggcgaccgcaaggcgatcgttctgggtgcgctcatgtatgcgctggggctggtgctttccgcctttgccacccagccctggcagcatgacctgctggaaatcttcgtcggcttcggcatcgcgggcaccggctttggcgtgattctggccgtcgtcggccgcgcggcgtcggatgaaaaccgctcgctgacccttggcatcgccaccgccgcgggctcggcaggccaagtcttcggcgcgccggtggccgaggcgctgctgagccaattcccctggcagaccgttttcgtgatctttgccgtcaccatcctgctggcgcttctggccctgccgcttctgcgcagccccgcccgcacggcccatcacggtcaaaccgaaccgatgggcacggtcttgaaacgcgcgttgaaggacccgtccttcaccctgatctttctgggcttcttttcctgcggctatcagctggccttcatcaccgcccacttcccggcgatggtgaccgagatgtgcggcgccgttccccccggctcgctgctcgccgcggtggggatcgaaagcctctcgaccttgggcgccgtggcgatctcgctgatcggtctggccaatatcgcgggcacgatctttgccggctgggccgggcggcactattcgaagaaatatgcgctcgccatcatctacctgttgcgcaccatcgccgccgccgccttcatcctggcgccgatgacgcctgcgacggttctggtcttctcgctggtgatgggggcgctttggctggcgacggtgccgctgacctcggggctgatcgccgatctttacgggctgcgctacatgggcacgctttatggcgtcgtgttcttttcccaccagctcggcgcgttcctcggcgtctggctgggcgggcggctttatgacatcgcgggcgattacacgctggtctggtgggtcggcgtcggcatgggggcgttttcggcccttgtccatctgccggtgaaggac

SEQ ID NO: 45535 - DNA, 1911 bp, Rhodobacter capsulatus
atggccaaagtcatcgggatcgaccttgggacgaccaactcctgcgtcgccatcatggacggctcgcaaccccgcgtgatcgagaattcggaaggggcgcgcaccaccccctcgatcgtcgcctacaccgacaacgagcgtctggtcggccagcccgccaagcggcaagccgtgaccaaccccacgaacaccgtctttgcggtcaagcgcctgatcggccgccgcaccaccgatgccgaggtggaaaaggacaagaaactggttccctacaacatcgtcgacggcggcaacggtgacgcctgggtggaagtgcgcggcgagaaattcagcccggcgcaggtttcggccgtgatcctgcaaaagatgaaggaaaccgccgagagctatctgggcgagaccgtgacccaggccgtgatcaccgttccggcctatttcaacgacgcccagcgtcaggccaccaaggacgcgggcaagatcgcgggccttgaagtgctgcgcatcatcaacgaaccgacggcggcggcgctggcttacggcctcgacaagaaggacagcaagacgattgccgtctatgaccttggcggcggcaccttcgacatcacgatcctggaaatcgacgacggtctgttcgaggtgaaatcgaccaacggggacacgttcctgggcggcgaagacttcgacatgcggatcgtcaattaccttgccgacgagttcaagaaagaacacggcgtcgatctgaccaaggacaagatggcgctgcagcggctgaaggaagcggctgaaaaggcgaagatcgaactgtcctcggccagccagaccgaaatcaaccagccgttcatctcgatgaacgcggcgaccggcgtgccgctgcacatggtgatgaagctgacccgcgcgaagctggaaagcctggtcgatgacctgatcaaggcctcgctgaagccctgcgccgcggcgctgaaagatgcgggcgtcagcaaggacgagatcgacgaggtcgttctggtgggcggcatgacccggatgccgcgcgtcgtcgaggaagtgacgaagttcttcggaaaggaaccgcacaagggcgtgaacccggatgaagtcgtggcccttggcgccgcgattcaggcgggcgtgctgcagggcgacgtgaaggacgtggtgctgctcgacgtcacccccctcagcctcggcatcgagacgctgggcggtgtcttcacccgtctgatcgatcgcaacaccacgatcccgacgaagaagagccagatcttctcgaccgccgaggacaatcagaacgcggtgacgatccgcgtcttccagggcgagcgggaaatggccgccgacaacaagatgctgggcatgttcaacctcgagaacatccccccggcgccgcgcggcgtgccgcagatcgaagtcaccttcgacatcgacgcgaacggcatcgtttcggtcaaggccaaggacaagggcaccggcaaggaacagcagatcaccatccaagcctcgggcggtctgtcggacgacgacatcgaaaagatgatcaaggacgccgaagccaatgccgaagccgacaagaagcgcaaggagctggtcgaggcgaagaacaccggcgaaagcctgctgcattcgacccgcaaatcgctggaagagcatggcgacaaggtcgatggctcgaccgtcgagatgatcgaactggcctgcaacgcgctggaagaatcgctgaagtcggaagacccgggcaagatcaagggcgcggtgcagaacctgaccgatgccgcgatgaagctgggtgaggcgatctacaaggcgcaagcctccgaagccggcccggcctcggatgacgaagacggcccgcggtcggtcgatgatgacatcgtcgacgccgacttcgaggacatgggtgaaaacaagcgcaag

SEQ ID NO: 45536 - DNA, 1156 bp, Rhodobacter capsulatus
atggcgaagcgtgatttctacgaggttctgggggtgtccaagggcgcctcggccgaggagatcaagaaggcctatcgcagcaaggcgaaggaactgcaccccgaccgcaatcaggacaatccgcaggccgaggcccagttcaaggaagtgaacgaagcctatgacgtgctgaaggatggcgacaagaaggccgcctatgaccgctacggtcacgcggctttcgagggcggcatgggcggcggcggtccgcgcggaccctatggtcagggcgcggatttctcctcggctttctcggatgtgttcgaggatctgttcggcgatttcatgggcgggcgcggcggtccgggcggcggtggccgctcgcgggcgacgcgcggctcggacctgcgctacaacatgcgggtgacgctggaagaggcgttcaagggcgcgcaaaagacgatcaccgttcccggctcggccgcttgcggctcgtgcaacggcaccggggccgagggcggcgcggaaccgcaaacctgtccgacctgttcgggtctgggcaaggtgcgggcgcagaacggctttttcaccgtcgaacgcacctgccccacctgtggcgggcaggtcaggtggtgaaaaaccctgccgcgtctgtcatggttcgggccggatcgagaaggaacggacgctgtcggtgaacatccccgcgggggtggagaccggcacccggatccgtctggcgggcgagggcgaggccgggatgcgcggcgggccttcgggcgacctttatatcttcatcgaggtccgcgaacatgcgatcttccagcgcgacggggtgaacctgttctgccgggtgccggtcagcatggtctcggcggcccttggtggcgaggtcgaggtgccgacgatcgatggcggccggtccaaggtcaaggtgccggtgggcagccaatccggtcggcagatgcgtctgcgcggcaagggcatgcctgccctgcgcggtggcggcatcggcgacatggtgatcgaactggccgtcgaaaccccggtgaacctgaccgcgcggcaaaaggagctgctggatgaattccagcgcatccaggccgagaacaacccggaaggggcgtctttcttccagaaggtgaaaagcttctgggacgggatgaagggctgagtg

SEQ ID NO: 45537 - DNA, 1202 bp, Rhodobacter capsulatus
ctgccggtgatcgcgggcgtgtcctttgccgccgccgccgcgggggtgcgctatgcgggccggaccgatgtgatgctggcgcagatcgcgccgggggcgacgctcgcgggcgtcttcaccacctccaccacccgggccgcctgcgtgctcgattgccaggcgaaactggcgggcgccgccgatgaaagcactggcgccgcgatcgtggtgaactcgggcaatgccaatgcctttaccggcgccgccggtcaggcttcggtcgatgcggtgaccggcgccgtggccgaggcgctggatctgccgatcaaccgggtcttctcctcctcgaccggggtgatctgcgaaccgctgccgcatgaccgcatcgtcgccgccggtgcccggccttgttcgccgcgctggaacccggcgggcatggaggccgcccgcgggcgatcatgaccaccgacactttccccaagggcgcctgtgccgaggtgcagggcgacggcgggctgatccgcatcgcgggcatcgccaagggctcggggatgatcgcgccgaacatggcgacgatgctggtctatcttttcaccgatgcgaagatccccgcgaaactgctgcagaaaatgctgtcgcggcatgtcgatgacacgttcaacgcgatcaccgtggacagcgacacctcgacctcggatgcgttgatcctggccgccaccgggcgctcggccgcggcggaaatcaccgatctgcgctcgcgcgcggcaaaggatttcgaagcggcgctgcgcggggtgatgctggatctggcgcagcaggtggtccgagacggcgagggcgcgacgaaattcgtggaaatccgggtcagcggcgcggcgagtgccgatgatgcgcacaaggtcgcgatggcggtggcgaattcgccgctggtgaaaaccgcgatcgccggcgaggatgcgaactggggccgggtcgtcgccgccgtcggcaagtcgggcgccaaggccgaccgtgacaagctgcggatttcctttggcgacatggttctggccgagaatggttggcgcgtgccggattattccgaggaagcggcctctgcctatatgaaggggcaggagctggtgatcggcatcgatctggggctgggcaaggcggcgaaatccgtcttcacctgcgacctgacgcatcgctacatcgatatcaacgcggattaccgctcgtga

SEQ ID NO: 45538 - DNA, 1203 bp, Rhodobacter capsulatus
aagaaagtcgtgcttgcctattcgggcggccttgacacctcgatcatcctgaaatggctgcagaccgaatacggctgcgaggtcatcaccttcaccgccgatctggggcagggcgaggagctggaaccggcccgcgccaaggccgagctgatggggatcaaaaaggaaaacatccacatcgtcgacgtgcgcgaggaattcgtgcgcgacttcgtcttcccgatgttccgggcgaatgcgctgtacgaggggctttatctgctcggcacctcgattgcgcggccgctgatctcgaaacatctggtcgagatcgcgcagaagcacggcgccgatgcggtggcgcatggcgcgaccggcaagggcaacgatcaggtgcggttcgagctgtcggcggcggcgctcgacccgtcgatccgggtgatcgcgccgtggcggctgtgggatctgacctcgcgcacgaagcttctggaattcgccgaggcgaaccagatcccgatcgccaaggacaagcgcggcgaggcgcccttctcggtcgatgcgaaccttttgcacacctcgtccgaaggccgcgtgctggaagacccggcgcaggaattcccgaactacgtgctgcagcgcgtcgtgccggtcgaagaggcccccgacacgcccgagatggtcgagatcaccttcgagcgcggcgatgccgtcgcgatcaatggcgaggcgatgtcgcccgcgacgatccttgcgaaactgaacgagatcggcggcaagcatggcgtcggcgtgctcgatctggtggaaaaccgcttcgtcggcatgaaatcgcgcggcgtctatgagacccccggcggcacgatccttctggaagcccaccgcggcatcgagcagatcacgctcgacgcgggcgccggtcacctgaaggacagcatcatgccgcgctatgcggagctgatctacaacggcttctggttcagccccgaacgcgaggcgctgcaggcgctgatcgacaagacgcaggaacatgtctcgggcacggtgcgggtcaagctttacaagggcaaggcctcgaccgtcgcgcgctggtccgatcacagcctctattccgaaaagcacgtcaccttcgaggaagacgcgggcgcctacgatcaaaaggacgcggcgggcttcattcgtctgaacgcgctgcggctgcgcctcattgccacccgcaacgcgcgc

SEQ ID NO: 45539 - DNA, 1093 bp, Rhodobacter capsulatus
attccgacgcccttctatctgatcgacgagacggcgcttttgcagaacctgcaaaagatcgacctgttgcgcgaagcctcgggggccaaggcgctgctggcgctgaaatgtttcgccacctggtcggcctttgacatcatgcgcccgcatatggatggcaccacctccagctcgctttacgagctgcgtctggggcgcgagaaattcggcaaggagacgcacgcctattcggtggcctggtcggatcgcgagatcgacgaggcctgtgcctatgccgacaagatcatcttcaattcggtgggccagctgacccgttttgccgagccgtcgcagggcatccagcgcggcgtgcggctcaacccgcggttctcgacctctggttttgaccttgccgatccggcgcggccgttttcgcggctgggcgaatgggatgtgacgaagcttctgggcgttgccgatctgatttccggcgtgatgatccattacaactgcgagaaccgcgatttcgcgctgtttgatgaccagctgggccggatcgaacgggaatttgcgccgcttctggaaaagctcgactgggtcagcctgggcggcggcatccatttcaccggcgagggctatccgctggaagagcttgccaagcggctgaaaaccttctcggatcgcttcggcgtgcaggtctatctggaacccggcgaagcctcgatcaccaaatcgacgacgcttgaggtcacggttctcgacctgctcgacaatggcaagcaactggccatcgtcgacagctcgatcgaagcgcatatgcttgatctgctgatctaccgcgaaagcgcgaagctgccgcaggagggcgatcacgcctatcagatctgcggcaagtcctgccttgcgggcgacatcttcggggaagcgcggttcccccgcgccgctgaaggtcggtgaccgcatctcggttgcggatgcggcaggctacaccatggtgaagaagaactggttcaacggcgtcaacatgccgtcgatcgcgatcaaacgcgcttcgggccagatcgatctgatccgcgagttcacctacgaggattacctctcatccctgtcctga

SEQ ID NO: 45540 - DNA, 1057 bp, Rhodobacter capsulatus
atgacgattgccaaccgcatccttccgcacgcccccgccgaccatccgccggtgccggtgccgcgtgtcggcgtgcttttggccaatctcggcacgcccgacgccaccgactactggtcgatgcgccgctatctgaacgaattcctgtccgaccggcgggtgatcgactatccgatctggaaatggcagccgctgttgcagctgatcatcctgtcgaagcggcccttcacctcgggcaacaactatcgctcgatctggaacgaggagcgcgacgaaagccccttgatgacgatcacccgcgatcaggtgcgcaagctgcgcgccgcggtcgagacccgctatggcgcgggcaatgtggtggtcgatttctgcatgcgctacggcaacccctccacccgtgacgtgctcgatgacatgctggcgcagggctgcgaacgcatcctgttcctgccgctttatccgcaatatgcgggcgccacctcggccacggcgaacgaccagttcttccgcgcgctgatgcaggtgaaacgccagcccgccgcccgcaccgtgccggaatatttcgccaggccgagctatatcgaggcgctggccagctcggtcgagcgggtctatgcgacgctcgacacccggcccgacgtgctggtggcctcttatcacggcatgcccaaacgctatcaccgcggagggcgacccctatcattgccaatgccagaaaacctcgcggcttttgcgcgaacggctgggctgggggccggattcgatcgacaccacctttcaatccgtcttcggcaccgaggaatggctgcgcccctatacggtcgagcatgtggtgcagctggcggaagcgggcaagaagaacatcgcggtgatttcccccgccttttccgccgattgcatcgagacgctcgaggaaatcaacggcgagatccgcgaggcgtttgaacatgcgggcggcgaaagcttcacctatgtgccctgcctgaacgacgacgacctgcacatcgccgcgcttctggaagtggtcgaggaaaatctggcgggctggatcgactga

SEQ ID NO: 45541 - DNA, 1766 bp, Rhodobacter capsulatus
ccgccctcgcgactgatcccgtttctgcgctggtgcatcaacggcgcctggcccgccgtgtggattgccggggccgcctcggcgctggcgggctcgatggaggtgggggcggcctggcttctgggcctggtcatcgactctgtcgtcggcgccgatcccgcgacccatgccgggcagcatctgtggctgcttctggcctttgtcgtcttttatctgctgatccggcccggggcctttggcctctcgacctggacgatgaacatgctggtggcgccgaatgtgatgccgcaggtgctgtcgcggctgcaccgctggaccatgggccattcggtcaccttcttcgacaacgacttcgccggccgcatcgcgcaaaagcagatgcagaccgcccgcgccgtcaccgatgtcatcgccgaagtcatcggcacggtattcttcgcgctggcctcgatcatcggctcggtggtgcttttggccggaatagacacctggggggcgctggcgctggcgctgtggctggtgttctacctgcttctgatccgggccttcctgccgcatgtgcgggggcggtccaaggcgcgggcgtccgcccgggcgatggtgacggggcaggtcgtcgacacgatcaccaacatcaagacggtgaagcttttcgcccatgacgatcacgaagaccgcgtcgccctgggcgcgatggaaggctatcgcagcgccacgaaacggttcggcgtcaccaccacctggtatcggctgagccagatcaccttttcgggcctgttgccgatccttctggtcggcggcgcgatgctgatgtggcgcaagggcgccgcgacgccgggcgacatcgccgccgcgggggccgttgccatgcgcatcgcgcagatgtcgggctgggtgtcgcaatcgctgatggcgctctggtcgaacatcggcgaggtcgaggacggcatgcgcaccctgacccccgcccatgcgatcaccgatgccgaaggcgcgcaggtgctgggccgggtgcagggcgaggtccgcttcgatcaggtcagcttcgcctatggccgcgaaaagggcggcatcgacggcgtggatctgacgatcaaaccgggggaacgcatcggcatcgtcggcgcctcgggggcggggaaatcgaccctcgtggcgctgcttttgcggctttacgacaccgaaaaggccgggtgatgatcgacggcaccgacctgcgcgatgtcacgcaggaaagcctgcgccgcaatatcgggatggtcacgcaggaaaccgcgatgttcaaccgctccgcgcgggagaacattctttacggtcgccccgatgccacggaggaggagatgatcgccgccgcaaaggccgccgaggcgcatgacttcatcctcgggctggtcgatcacaccggcaagaccggctacgaggcggccctgggcgaacgcggggtcaagctttcgggcgggcagcggcagcgcatcgcgctggcgcgggcgtttctgaagaacgcccccatcctggtgctggacgaggcgacctcggccttggacagcgaggtcgaggcggcgattcagaaggcgcttggccgggtgatggagggcaagaccgtgctggccatcgcgcatcggctgtccacgatcgcggaaatggaccgcatcgtcgtgctggatcagggccggatcgtcgaagagggcagccatgccgagcttctggcgcagaacgggctttatgcgcgctactggaaccggcagtcgggcggcttccttggcacc

SEQ ID NO: 45542 - DNA, 867 bp, Rhodobacter capsulatus
atcttgaccgtgggtgtcgtgggcgccggacagatgggcaacggcatcgcccatgtctttgccctgtcgggctatgacgtgctgctcaacgacgtggcccccgaaagcctggaccgggcgctcgggatgatcggcaagaatctggaccggcagctgcaccggggcaagatctcggccgaggaacgcgcggcggcgctggggcggatccgcacgacgctgacgattgccgatctgggccagaccgacctgatcatcgaggcggcgacggaacgcgaaaccgtcaagcaggcgatcttcgacagcctgctgccgcatctgaagccggaaacgattctggcgaccaacacctcgtcgatctcgatcactcgtctggcctcgcgcacggaccggccggaaaaattcatcggcgtgcatttcatgaacccggtgccggtgatgcagctggtcgagctgatccgcggcatcgcgacgggcgaggaaacctaccgcacgcttctgggcgtgatcgaacggctgggcaagacccccgcctcggccgaggatttcccggccttcatcgtcaaccgcatcctgatcccgatgatcaacgaggcggtctatacgctttacgaaggcgtgggcaacgtgcagtcgatcgacatggcgatgaagctcggcgcgaaccatccgatggggccgctggaactggccgatttcatcgggctggacacctgtctggcgatcatgaacgtgctttatgacgggctggccgacacgaaataccggccctgcccgctgctgacgaaatatgtcgaggccggatggctcgggcgcaagaccggccggggcttttacgactatcgcggcgaaaccccggtgccgacgcgc

SEQ ID NO: 45543 - DNA, 858 bp, Rhodobacter capsulatus
atgaaacgcaaggtcacgaaagcgatttttccggtcgctggcctcggcacacgcttccttccggccaccaagtcgatcccgaaagagatcctgacgctggtcgaccgcccgctcattcaatatgcgatcgatgaagcccgggccgccgggatcaaggaattcatcttcgtcacctcgcggggcaaatccgcgctggaggattatttcgacgatgcgccggagctggaaacctcgctgcgcaagaagggcaagaccgatctgctcgaggcgctgaaagccacgaacatggattcgggcgccatcgcctatgtgcggcagaaccggccgatggggcttggccatgccgtctggtgtgcccgccgtctggtcggcaacgagccctttgccgtgatcctgaccgacgacgtcatcgccgcggaaaagccctgtctgcagcagatgatggaagcctataacgagaccggcggcaacgtcgtcgcggcgatggaagtgccgcatgagaaaacctcgtcctatggcgttctggacatcgccgaggacatgggctcgctggtcaaggtcaagggcatgatcgagaaacccgcccccgatgtggcgccctcgaacctcgccgtgatcgggcgctacatcctgacgccgcgggtgatgcagaacctgaacaagaagaaagagggcgcgggcggggaaatccagctcaccgacgccatcgccgaagagatcgaggccgggcagccggtttacggcttccgcttccgcggccagcgctatgactgcggctccaaggccgggttcctgcaggcgacggtggcctttggtctggcccgcgaggatctgcgcgacgaattcggcgatttcctc

SEQ ID NO: 45544 - DNA, 951 bp, Rhodobacter capsulatus
gttctggtgacggggggggccggctatatcggctctcacgcctgcaaggcgctggcccgggcgggctatgtgccggtgacctatgacagcctcgtcaccggctggcgcgatgcggtcaagtttggcccgctcgaggaaggcgatctttccgaccgggcgtggctggatgcggtcttcgcgcgctggcagccggtggcggtgatgcatttcgccgccctcagcctggtgggcgagtcgatgaagaaccccgggctttactggcgccacaacgtgctgtcctcgctgaccctgatcgaggcggcctgcgccgcgggctgccttgatttcgtcttctcctccacctgcgccacctatggcgatcaggacggggtggtgctggacgaaaccaccacccaggcgccgatcaacgcctatggcggctcgaaacaggcgatcgagatgatcctgcgcgatttcgaggcgtcgcatggtctgcgttccgtgatcttccgctatttcaacgtcgcgggcgccgatcccgagggagaggtgggcgagtttcaccgcccggaaacgcatctggtgcccctgatgctggatgcgatcgacggcaagcgtccggcgctgacggtttacggctcggattacccgaccaaggatggcacctgcattcgcgactacgtccatgtctccgatctggtcgatgcccatgtgctggggctgcaatggctgcaggcgggcaagggctcggaggtgttctgtctgggctccggcaccggcttttcggtgcgcgaggtgatcgcgcaatcgaaagccgtgaccaaccgcgcggtgccgatcgtcgagggcgcgcgtcgtccgggcgatgccgcggtgctggtctcgggctcgaccaaggcgatccgcgatctgggctgggcaccgaaacgcagcgatctgacgacgatgatcgccgatgcatggcgctggcat

SEQ ID NO: 45545 - DNA, 744 bp, Rhodobacter capsulatus
gcgaaaaggatcgatgccgaaagcctgaccgggctggatgtgaccagcctgcgcaagagctatcgcaagcggctggtgttgcgcgatgtgtccttgcggctggaacgcggcgaggtggtggcgctgctcggtccgaacgggtcgggcaagaccacctgcttttacgccatcgccgggctggtggcgcccgatgccgggcgggtcagcatcgacgggatcgacgcgaccgggctgccgatgtatcgccgtgcccggctgggcatcggctatctgccgcaggaggcctcgatctttcgcggcctgacggtggagcagaacatcatggcggtgctggaaatcgccgtcgccgatccgcaccaccgccgcgagcggctggaggaacttctgggcgatttcgccatcacccatctgcggcaggcgccggcgctggcgctctcgggcggcgagcggcggcgggtcgaaattgcccgctgtctggcggctgacccgaaatatctgcttctggatgaaccctttgcaggggtggacccgattgcggtggccgagatccgcgccctggtgtcgcatctgaaagaacgcggcatcggcgttctgatcaccgatcacaacgtccgggaaacgctggaaatcgtcgatcgggcttatatccttcacgatggcagggtgctgatgtcgggccgcaccgaagaggtggtgcaggacgaaaacgtccgtcgcgtctacctcggcgagaatttccgcatt

SEQ ID NO: 45546 - DNA, 741 bp, Rhodobacter capsulatus
ccaatgacgcgggctctcgggatcacctttgacaaggtcaacaagtggtatggccggatgcatgtcctgcgcgacgtgagcttctcggtcgcaccgggcgaaaagatcgtggtctgcggcccttcggggtcgggcaagtcgacgatgatccgctgcatcaaccgccttgaggaacatcagtccggcacgatcaccgtgaacggggtcgaggtgaacgaccagcgccgcaacgtcgatcaggtccgccgtcaggtcggcatggtgttccagaacttcaatctttatccgcatctgagcatcctggacaattgcaccgtcgcgccgcgctgggtgcgcaacatcccccgcgccgaggccgaggaacgggcgatgcactatctggagcgggtccgcatccccgatcaggcgcacaaatatcccagccagctctcgggcggtcagcaacagcgcgtcgccatcgcgcggtcgctgtgcatgcagcccgagatcatcctgtttgacgaaccgaccagcgcgctcgaccccgaactggtgcgcgaggtgctcgacacgatggtctcgctggccgaagacggcatgacgatgatctgcgtcacccacgagatgggctttgcccgtcaggtggccgaccgggtgatcttcatggaccgcggcgccatcgtcgaaagcgccgcccccgacgacttctttcgcaatccgcgcgaggaacgcacgcggctgttcctcagccagatcctgcac

SEQ ID NO: 45547 - DNA, 765 bp, Rhodobacter capsulatus
ctgatcgccgtgggcgacaactgccttgatgtctatctgaccaaggggcacatggccgtgggcggcaatgcgctgaacgtcgcggcgcaatggcggcgcaaggggcttgcggcgcggtatctgggcgtggtcggccccgatgccgagggcgcggtgatcctcgacgcgctggccggggtcgggcttgatccggccgatgtcgaacggcgcccgggcaataccgcggtgacgctgatccgcgatcatcatggcgaccggcgcttcctgctcgaagatctgggcgtcggcgatggctggcggcccgacgcggcgcatcaggccgcgctgcaagcggcacgctgggtgcatctgggcaccaatgccgatccggggctgctgcgctggctgctggaggcgggggtggggttcagcatcgatgtctccacccgccatgcggatctgccgcttgcgggcgtgcccctcgtcttcgcctcgggccccgaggatccggccgagccgatcgagccggtccttgcggcctttcgcgcccggggcgcgcggcgcacggtggtgacctgcggcagccgcggcgcctttttcgacgacggcggcacggtctgcagcgtcgcggcgcgcaagatcgcggtgcgcgacacctgcggggcgggcgacagtttcatcgcgacctttctggccgcgctgatcggcgcgcaccgcccggggccggaggccttgcagctggccactctggccgcggcggaaacctgtcagcacgagggcggtttt

SEQ ID NO: 45548 - DNA, 768 bp, Rhodobacter capsulatus
atgaaagccgtgatccttgcggggggacgtggaacgcggctttccgaagaaaccgggcggcggccgaaaccgatggtggacatcggcgggcagccgatcctgtggcacatcctgaagatctatgccgcgcatggggtgaacgagttcgtgctctgccttggctatcgcggctggcagatcaaggactacttcctgaactccgcgcggctctcgtcggatctgacggtcgatctcgcctcgggcgtcgtcgagatgctgcgcccggcgtccgagccgtggaagatccatctgatcgacactggcgaagacacccagaccggcgggcggctgaaacgggtggggcatcttctgcgtgacgacgatgccttttgcctgacctatggcgacggtctcggcgatgtccatatcaccgccgcgatcgcttttcaccgcgcccatggcaaggctgcgaccgtgacggcggtagtgccgccgggccgcttcggcgcgctcgaccggcaaggcgaccgggtttcggcctttgtcgaaaagcccgcaggcgatggcggcacgatcaacggcggctttttcgtgctgtcgccgtcggtacttgaccggatcgaaggcgatgcgacggtctttgaacaggagctgctcaagggccttgcgcgcgatggcgaattgcgcgcctttgaccatcgcggtttctggcaaccgatggacacgctgcgcgaccgcgaccatctgcaggcactttgggacgggggggcggcaccgtggaagatctgg

SEQ ID NO: 45549 - DNA, 759 bp, Rhodobacter capsulatus
aacctgcggggcaaacgcgccctgatcaccggcggcacccagggcgcaggcgcggccaccgtggcgctgtttcgcgatcttggcgcgcaggtgctgaccactgcccgcaaccgacccgagaccctgccggaggcgatgttcgtcgccgccgacctgagcacggttcagggctgcgagagggtcgccagggcggtgcaggaccgcatgggcggggtggatgttctggtccacatgctgggcgggtccaccgcgccgggcggcggctttgccgccctgggcgaggccgaatggcaggccgagctgaacctgaacctgatgcccgcggtgcggcttgaccgcgcgcttctgcccggcatggtggcgcagcgggcgggggtggtggtgcatgtcacctcgatccagcggctgatgccgctgcccgccgccaccaccgcctatgccgccgccaaggccgcgctgtcggtctacagcaagagcctgtcgaaggaggtggcgcccgcggggctgcgcgtgctgcgcgtggcgccgggctggattgccaccgcggcgtcgatccggctggccgggcggctggcggaggccgcgggcaccgaccttgagggcggcaagcggatgatcatggacagcctcggcggcatcccgctgggccgcccctcgaccccggaggagattgcaagcctgatcgccttcctcgcctcggaccgcgccagcagcatcaccgggacggaacatgtgatcgacgggggcacggtgccgacg

SEQ ID NO: 45550 - DNA, 255 bp, Rhodobacter capsulatus
caaaagcggctggccgagggggcgctgctcgtcgatgtgcgcgaggcggacgaggttgccgcctgcggctttgcgggctgcgcggtgatgacgattccgctgagccagttcgaggcccgctttgccgaaatcccgcgcgaccgcgaggtgatcctcgcctgtgccactggtgatcgcagcctcaaggccacctatttcctgatgtatcagggctatgcgaaggtgacgaacatgaagcacgggctggcccgctgg

SEQ ID NO: 45551 - DNA, 1005 bp, Rhodobacter capsulatus
atggcgagacttgcgatcaacggcttgggccggatgggaaaactgctcttgcggcggctcatcgatctggggcgcgggcccgagatcgtgcttttgaacgacgccatgggcgacgccgaaacccatgcgctgctgctcgagttcgacacggtgcatggccgctggccgaccccggttgccgccaccgaaaccgggcttcagatcgcggggcagcgcatccggctgacgcgggaaaagacccttgaagccctgcccctggccgagatcggggtcgatctggtgctcgattgcaccgggcagttcaagaccgcggccaaggtccagccctatttcgatgcaggcgtgcgcaaggtcgtcgtttcggccccggtcaaggatacgggcgcgctgaacctcgtctatggcgtgaaccacgtgctttacgatggcagccagcggctgatcacggcggcgtcctgcaccaccaactgcctggcccccatcgtgaaggtgatccacgaagcgcttggaatcaaacacggatccatcaccacactgcatgacgtgacgaacacgcaaacgatcgtcgaccgccccgcgaaagacctgcgccgggcgcggtcggcgctgatgaacctcattcccaccaccaccggctcggccacggcgatcacgctgatctatcccgagctgaaagggcggctcaatggccatgccgtccgggtgccgcttttgaatgcctcgctgaccgattgcgtcttcgaacttgaccgcccgaccacggtcgcagaggtgaacagccttctgcagaccgccgccgagggagggctgaacggcatcctcggtttcgagacgcggccgctggtgtcgtcggatttcaccaacgacccgcgctcggcggtgatcgacggcccctcgacgatggtggtcaatggcacgcagctcaagctttacgcctggtatgacaacgaatggggctatgtctgccggatggccgatatcgcccgaatggtggcggggtcgttg

SEQ ID NO: 45552 - DNA, 1692 bp, Rhodobacter capsulatus
atgctgcgcaagttcatcgcccattaccgcccgcaccggcgcctgttctggctcgatttcggctctgccgtcgcctcggggctgctggaactggcctttccgctggcgatcacctttttcatcgaccggcttttgccgctgggggactggtcgctgacgatcgccgccgccgctgcgctgctggcggtctatgcgctcaacaccgtgctgatggggatcgtgatctactggggccacatgctgggcatcgagatcgagaccgagatgcgccgccaggcctttgcgcatctgacgcggctgtcgtggcgctggtatgaccgcgcccgcaccggcaagctggtcgcccgcgtcacccgcgatctggaggatatcggcgagctggcccatcacggccccgaggatctgttcatcgcgatcatgacctttgtcggcgcctttgcgctgatggcggcgctgcatcccgtgctggcgctgatcaccgccgcgatcgtgccgctgacggtctggctggtcgcggtctatggcgggcggatgacccggacctggcaagagatctatggccgcgtcgggcagttcaacgtccggctggaggaagccgtgggcggcatccgtctggtgcaggcctttgccaacgagcgccacgaggaacggctgttcgaccgcgacaaccgcgcctatcgcgccacgaaactgcaggcctaccggctgatggcggtctcgagcgcgatccattacatggggctgcgcttcgtgcaggtggtggtgatggtggcgggcgcgggcttcgtgctggcgggcagcctgagcaccggcggcttcgtcggatttcttttgctggtgggggtgttcttccgcccgctggaaaagatcgccgcggtgatcgagacctatccgaagggcatcgcggggtttcgccgctatctggaacttctggaaaccgaaacagagatcgccgacgcccccgatgcccgcccggtgacagccctgcgcggggccatcaccttcgaccgcgtgcgcttcggctatgacgctgcccgcccggtgctgcaagacgtgtcgctgagcatcgccgcgggcgagacggtggcctttgtcggcccctcgggcgcgggaaaaaccacgcttctggcgctgctgccgcggttttacgaccccgacagcggcaccatccgcatcgacggcctgccgcttcatgcgatgacgcttgaaagcttgcgcaaccagatcggcatcgtcagtcaggacgtgttcctgttcggcaccagcttgcgcgaaaacatcgcctatgggcggctggacgccaccgaggccgagattcgggccgccgccgaaaaggcgcagctttccgcgctgatcgcggcgctgcccgaggggctggagacgctggtgggcgaacgcggcgtgatgctctcgggcgggcagaaacagcgcgtcgccatcgcccgggccttcctgcggaatccgccgatcctgatcctggacgaggcgacctcggcgcttgacagcgagaccgaacgcgagattcaggccgcgctcgaggcgctgtcgcggggccgcacgacgctggtgatcgcgcatcggctgggcacgatccgggcggcggatcgcatcgtggtgatggaagacggccgcgtgcaggagatcggatcgcatgcggcgctgctggcgcggggcgggctttatgcgcggctg

SEQ ID NO: 45553 - DNA, 1332 bp, Rhodobacter capsulatus
ttcgacgccgccgcgctggaacggatgtgcgcgctcaacgaggcgcatgccgtgatgctggccgaatgcggcctgatcccggccgagatcgcgcgcacgttgttgcgcggcatcgccacgatccgcgccgagggaccgggggcgatcgacctcgatccgcagttcgaagacagctatttcgccttcgaaaaccggctggggcaggtgatcggcaaggcgacggcgggctggctgcatatcgggcgcagccgcaacgacatcggcgcgacgcttgaccggatggccgcgcgcgaggtctgtcttgggctgctggcggaaatggccgcaacccgccgcgcctgtcttgcggcggcggcgcgccacaagatgacggtgatgccgggctacacccatctgcaaccggcgcagccgatcaccttcggctattatctggccaatgtcgcgcgcggcatggaacgggactacgaccggctggctgcggtctatgaccgggccgatgcctgcgcgttgggcatggcggcgctggcggggacctcgtttgcgatcgatcggccgcgggtggcgcagatgctcggcttttcggggctggcgacgccggggctcgatgccgtggcctcgcgcgatttcgtcaccgagatgctttgggcggtgaccagcgcgcaggtgctgttttcgcgcgtggcacaggatttctacgtcttcaccacctgggaattcggcgcgctcggctttcccgaccgggtggcgggcacttcctcgatcatgccgcaaaagaagaacatgctgccgcttgaatatttccgtgccgaggccgggcgcagcatcggggcgctggcgggggcgctttcggcggtgaaagggtcgaactattcgatcggcctcgacagcgtgcgcgagggcgtcaccgacgcctggccgactttcgagcggttccgcgccacgctgccgcttttgcggctgatcttcgagaccgcaacccccgatgccgaacgcctgctggcgcggtgttccgcgaatttctcgaccgcgaccgaccttgccgatggtctggtgcgcgacttcggcgtctcgttccgcgatgcccatcatgtcgtcgggcgggcggtgcagatggtgatcgccgcgggtggcgatgcgcgccagctcacggtgcaggtgctcaatgccgccgccgaggaagagatcgggcgcagcttcgatctggccgaggacaagctgcgccgctggatggacccggtgcaggcggtttcggcccgcaaggttccgggcggcaccgcccccgaagcggtcgaggcgatgctgcaggagatgcagggccggcttgatgccgac

SEQ ID NO: 45554 - DNA, 603 bp, Saccharomyces cerevisiae
atggaaatgactgattttgaactaactagtaattcgcaatcgaacttggctatccctaccaacttcaagtcgactctgcctccaaggaaaagagccaagacaaaagaggaaaaggaacagcgaaggatcgagcgtattttgagaaacagaagagctgctcaccagagcagagagaaaaaaagactacatctgcagtatctcgagagaaaatgttctcttttggaaaatttactgaacagcgtcaaccttgaaaaactggctgaccacgaagacgcgttgacttgcagccacgacgcttttgttgcttctcttgacgagtacagggatttccagagcacgaggggcgcttcactggacaccagggccagttcgcactcgtcgtctgatacgttcacaccttcacctctgaactgtacaatggagcctgcgactttgtcgcccaagagtatgcgcgattccgcgtcggaccaagagacttcatgggagctgcagatgtttaagacggaaaatgtaccagagtcgacgacgctacctgccgtagacaacaacaatttgtttgatgcggtggcctcgcgttggcagacccactctgcgacgatatag

SEQ ID NO: 45555 - DNA, 1107 bp, Saccharomyces cerevisiae
atgaaactggatagtatagacattacacactgtcagttggtcaaatctactagaactgctaggatttataggtcggatacatatgccattaaatgtctagcactagatttcgatatcccgccacataacgccaaattcgaagtatcgatattaaacaaactgggcaacaaatgtaagcacatcttacctcttctagagtctaaggctaccgataataatgacctattgttgttgtttccctttgaagagatgaacctttatgagttcatgcaaatgcactataaaagagatagaagaaaaaaaaatccctattacgatttgctaaatcccagtatcccaattgttgcggacccccccgttcagaaatatactaatcaattggacgtcaatcggtattctttgtcctttttccggcaaatggttgaagggattgcattcttacatgagaacaagatcattcaccgcgacatcaaaccgcaaaatatcatgctaacaaacaataccagcaccgtatccccaaagttgtacataattgattttggcatctcttatgacatggcaaataactcacaaacaagtgcggaacccatggatagcaaggtgacggatataagcacaggaatttacaaggccccagaagtgctttttggagtaaaatgctatgatggtggcgtggacgtgtggtcgttgttgataattatttctcagtggttccagagagaaacaagccgtatggggcacgttccggccatgattgatgacggcagcgacgacatgaactcagatggaagcgatttcagactgatttgctcaatattcgaaaagttgggcataccgtccattcagaaatgggaagaggttgcgcaacacggctcggttgatgcatttgttggtatgtttggtgcagatggcgatggcaagtatgtactggaccaggagaaagatgtacagattagcattgttgagaggaatatgcctcgactggacgagattgcggatgtcaaagtcaagcagaagttcattaattgtatcctggggatggtttcattttcaccaaacgaaagatggagctgtcaaagaatcttgcaagaattagaaaagccataa

SEQ ID NO: 45556 - DNA, 1296 bp, Saccharomyces cerevisiae
atgtctgatgcggctccttcattgagcaatctattttatgatccaacgtataatcctggtcaaagcaccattaactacacttccatatatgggaatggatctaccatcactttcgatgagttgcaaggtttagttaacagtactgttactcaggccattatgtttggtgtcagatgtggtgcagctgctttgactttgattgtcatgtggatgacatcgagaagcagaaaaacgccgattttcattatcaaccaagtttcattgtttttaatcattttgcattctgcactctattttaaatatttactgtctaattactcttcagtgacttacgctctcaccggatttcctcagttcatcagtagaggtgacgttcatgtttatggtgctacaaatataattcaagtccttcttgtggcttctattgagacttcactggtgtttcagataaaagttattttcacaggcgacaacttcaaaaggataggtttgatgctgacgtcgatatctttcactttagggattgctacagttaccatgtattttgtaagcgctgttaaaggtatgattgtgacttataatgatgttagtgccacccaagataaatacttcaatgcatccacaattttacttgcatcctcaataaactttatgtcatttgtcctggtagttaaattgattttagctattagatcaagaagattccttggtctcaagcagttcgatagtttccatattttactcataatgtcatgtcaatctttgttggttccatcgataatattcatcctcgcatacagtttggaaccaaaccagggaacagatgtcttgactactgttgcaacattacttgctgtattgtctttaccattatcatcaatgtgggccacggctgctaataatgcatccaaaacaaacacaattacttcagactttacaacatccacagataggttttatccaggcacgctgtctagctttcaaactgatagtatcaacaacgatgctaaaagcagtctcagaagtagattatatgacctatatcctagaaggaaggaaacaacatcggataaacattcggaaagaacttttgtttctgagactgcagatgatatagagaaaaatcagttttatcagttgcccacacctacgagttcaaaaaatactaggataggaccgtttgctgatgcaagttacaaagagggagaagttgaacccgtcgacatgtacactcccgatacggcagctgatgaggaagccagaaagttctggactgaagataataataatttatga

SEQ ID NO: 45557 - DNA, 1500 bp, Saccharomyces cerevisiae
atgttaagaatcagatcactcctaaataataagcgtgccttttcgtccacagtcaggacattgaccattaacaagtcacatgatgtagtcatcatcggtggtggccctgctggttacgtggctgctatcaaagctgctcaattgggatttaacactgcatgtgtagaaaaaagaggcaaattaggcggtacctgtcttaacgttggatgtatcccctccaaagcacttctaaataattctcatttattccaccaaatgcatacggaagcgcaaaagagaggtattgacgtcaacggtgatatcaaaattaacgtagcaaacttccaaaaggctaaggatgacgctgttaagcaattaactggaggtattgagcttctgttcaagaaaaataaggtcacctattataaaggtaatggttcattcgaagacgaaacgaagatcagagtaactcccgttgatgggttggaaggcactgtcaaggaagaccacatactagatgttaagaacatcatagtcgccacgggctctgaagttacacccttccccggtattgaaatagatgaggaaaaaattgtctcttcaacaggtgctctttcgttaaaggaaattcccaaaagattaaccatcattggtggaggaatcatcggattggaaatgggttcagtttactctagattaggctccaaggttactgtagtagaatttcaacctcaaattggtgcatctatggacggcgaggttgccaaagccacccaaaagttcttgaaaaagcaaggtttggacttcaaattaagcaccaaagttatttctgcaaagagaaacgacgacaagaacgtcgtcgaaattgttgtagaagatactaaaacgaataagcaagaaaatttggaagctgaagttttgctggttgctgttggtagaagaccttacattgctggcttaggggctgaaaagattggattagaagtagacaaaaggggacgcctagtcattgatgaccaatttaattccaagttcccacacattaaagtggtaggagatgttacatttggtccaatgctggctcacaaagccgaagaggaaggtattgcagctgtcgaaatgttgaaaactggtcacggtcatgtcaactataacaacattccttcggtcatgtattctcacccagaagtagcatgggttggtaaaaccgaagagcaattgaaagaagccggcattgactataaaattggtaagttcccctttgcggccaattcaagagccaagaccaaccaagacactgaaggtttcgtgaagattttgatcgattccaagaccgagcgtattttgggggctcacattatcggtccaaatgccggtgaaatgattgctgaagctggcttagccttagaatatggcgcttccgcagaagatgttgctagggtctgccatgctcatcctactttgtccgaagcatttaaggaagctaacatggctgcctatgataaagctattcattgttga

SEQ ID NO: 45558 - DNA, 1536 bp, Saccharomyces cerevisiae
atggctttccaacaaggtgtattgtcaaggtgttccggtgtctttagacaccatgtgggacattctcgccatatcaataatattctttatagacatgccatcgcgtttgcatccatcgctccacgaataccaaaatctagcttccatacttctgcaatcagaaacaacgaagcattcaaggacccgtacgatactttaggcttgaagaaatctgctacaggtgcggaaatcaaaaaagcatactacaaactggcaaagaagtaccacccggatatcaacaaggaaccggatgctgagaagaaattccacgatttacagaacgcttatgaaattctgtcagacgaaacgaagaggcagcagtacgatcaatttgggcccgctgccttcggcggcggcggtgccgctggaggtgccggtggtggtagtggctctccctttggttcccaatttcatgatttctcaggattcaccagtgcaggcggctcgccatttggcggtatcaattttgaagacctgtttggtgctgcatttggtggtggtggccgcggtagcggtggcgcaagcaggtcgtcatctatgttcagacaatataggggcgacccaatcgagattgtccataaagtgtctttcaaggacgcagtgtttgggtccaagaacgttcagttaagattctctgcgctggacccttgtagtacctgttcagggacgggaatgaaaccaaacacgcataaggtcagttgtagcacttgtcacggaacaggaaccactgttcacattaggggcggatttcagatgatgtcgacttgtcctacttgcaacggtgaaggtaccatgaaacggcctcaggacaattgtaccaagtgccatggtgagggtgttcaggtcaacagggcaaagacaattacggtggacttgccacatggattacaggacggcgacgtggtcaggatccctggccaaggctcataccctgacatcgctgtagaggcggacttgaaagattcagtcaagttatcaagaggtgatattttggtgagaattcgtgtcgacaaggatcccaacttttcgataaagaacaagtacgatatttggtacgacaaggagattcctataaccacagctgcacttggtggtactgtcactatccccactgtggagggacaaaagatcaggataaaggtcgctccagggactcaatacaatcaagtgatatccattcctaacatgggtgttcctaaaacatcaaccattcgcggtgatatgaaagtccagtacaagatcgttgttaagaaaccgcaatcgctggcagaaaaatgcttgtgggaggcactggcagatgtcaccaacgatgacatggccaagaaaaccatgcaaccgggcacagccgcgggtacagccattaatgaagagatactgaagaaacaaaaacaagaagaggaaaaacacgcaaaaaaggatgacgacaacactttgaagagactagaaaatttcattaccaacacattcaggaagatcaaaggtgacaaaaaaaattaa

SEQ ID NO: 45559 - DNA, 330 bp, Saccharomyces cerevisiae
atgtctgacgcaggtagaaaaggattcggtgaaaaagcttctgaagctttgaagccagactctcaaaagtcatacgctgaacaaggtaaggaatacatcactgacaaggccgacaaggtcgctggtaaggttcaaccagaagacaacaagggtgtcttccaaggtgtccacgactctgccgaaaaaggcaaggataacgctgaaggtcaaggtgaatctttggcagaccaagctagagattacatgggagccgccaagtccaagttgaacgatgccgtcgaatatgtttccggtcgtgtccacggtgaagaagacccaaccaagaagtaa

SEQ ID NO: 45560 - DNA, 1641 bp, Saccharomyces cerevisiae
atggttagttcaagtgtttccattttggggactagcgccaaggcatccacttctctaagtagaaaggatgaaattaaactaacccctgaaacaagggaagctagcttggacattccatacaaacccattattgcatactggacggtgatgggtctctgtctgatgattgcctttggtggattcatttttggttgggatacaggaaccatttcagggtttattaaccaaacagatttcaagagaaggtttggtgagttacaaagggacggcagttttcaactatcagatgtcaggacagggctaattgtcggtatcttcaacataggttgtgctttaggtggcctaacgctgggacgcctgggcgatatttatgggcgtaaaatcggcttaatgtgtgttatactggtgtatgttgttggtatcgtgatccagattgcttcctctgacaaatggtatcaatattttattggtagaattgtttctggaatgggtgttggaggtgttgctgtgctgtcgccaactttgatctcagaaatttccccaaagcacctaagaggcacttgtgtctctttttaccagctaatgattacccttggaattttcttgggctactgtaccaattatggtacaaagaaatattcaaattcaatacagtggcgggttcccttgggtttgtgttttgcgtgggcaatctttatggtgattggaatggttatggttccggaatcgcccagatatttagtagaaaaaggtaagtatgaagaagctagaaggtctttggccaaatcaaacaaggtcacagttactgatccaggcgttgtttttgagtttgatactatagttgcaaatatggaattagaaagggctgttggaaatgccagttggcacgaactcttctcaaataaaggagcaattctaccaagggtaataatgggaatcgttatccagtcactgcaacagcttactggctgtaattattttttctactacggcacgaccattttcaatgctgttggaatgcaagactctttcgagacttccattgtccttggggctgttaattttgcttctacatttgttgcactatacattgtggataaatttgggcgtcgaaaatgtttattgtgggggtctgcctcgatggcaatttgtttcgtcatattcgccaccgttggcgtcactagattatggccacaagggaaagaccaaccttcttcgcaaagtgctggtaatgttatgatcgtttttacttgtttcttcattttctcttttgccattacttgggctcctatcgcctatgtcattgtggcagaaacttatccattaagagttaaaaatcgtgccatggccattgcggttggtgcgaactggatgtggggtttcttgattggatttttcacaccctttatcactagatccataggattttcttatggctatgttttcatgggttgcttaatcttttcgtacttctacgttttcttctttgtttgcgaaacaaagggattaactctggaggaagttaatgaaatgtacgaagaaagaataaagccatggaagtccggaggttggattcccagttctagaagaacaccacaaccaacaagcagtacaccattagttattgttgatagtaaataa

SEQ ID NO: 45561 - DNA, 2340 bp, Saccharomyces cerevisiae
atggggtcgtttcccttagctgagtttccattacgtgatatccctgttccttatagctaccgtgtgtctggcggtatagcttcctcaggtagtgttactgcgcttgttactgccgctggcactcatcgaaactcgtccacggctaagacagttgagacagaagacggcgaagaagatatcgatgagtatcagaggaaaagagcagctggttctggcgaatccactcctgaacgcagtgatttcaaaagggtaaaacatgataatcacaaaaccctccatccagttaacttacagaacaccggtgcagcgtctgtggataatgacggtctgcacaatttaacagatatatccaacgatgcagaaaaacttttgatgtctgtggatgatggttctgccgcaccttctacattgagtgtaaacatgggagtggcatctcataatgttgctgctcccactaccgtcaatgcggcaacaataactggcagtgatgttagtaacaatgttaatagtgctactattaacaatcctatggaggaaggagcgctgccgttatcacccactgcttcctctccaggtaccacaactcctttagctaaaactacgaaaactatcaacaacaataataatatcgccgatttgatagaatccaaagattctataatctcccctgaatacctttctgatgagattttcagcgcaataaacaataatctccctcacgcatacttcaaaaatttattatttagattagttgccaacatggataggagtgaactatccgacttggggactttaatcaaggataatttaaagagggacctaataacgtctttgccttttgaaataagtttgaaaattttcaattatttgcaattcgaggatattataaattcccttggggtctcccaaaattggaacaaaataattagaaaatctacatcgttgtggaaaaaacttctgatatcggaaaattttgtgagcccaaagggttttaattctctcaatctcaaactctcccaaaaatacccaaaactctcacaacaagatcgccttagattatcttttctggagaatatattcattttaaaaaattggtacaatcccaagtttgtaccacaaaggaccacgttaagaggccatatgacgagtgttattacgtgcttgcaatttgaagataattatgtcattacgggggctgatgacaaaatgatcagagtttatgattcgataaacaagaaatttcttctacaactatcaggtcatgatggtggggtttgggcattgaagtatgcccatggcggtattttagtcagcggttctacagacagaacggtgcgagtttgggatattaagaaaggttgttgtacccatgtgtttaaaggtcataactctacggtgaggtgcctagatatagtagaatataaaaatatcaagtacattgttactggttcgagagataacactttgcacgtttggaaattgcccaaggagtcctccgttcctgatcatggggaagaacatgattatccattagtctttcatacccctgaggagaacccatattttgttggtgttttaagaggacatatggcatctgtaagaactgtctcaggccacggtaatattgtcgttagtggctcctatgataatacactgattgtgtgggatgttgcgcaaatgaaatgtttgtatattttaagtggacatacggatcgtatttattcgacaatctacgatcatgaaagaaaaaggtgcatctctgccagtatggataccactattagaatttgggatttggaaaatatatggaataatggagaatgttcctacgcaacaaattcagcatcgccatgcgccaaaatacttggtgctatgtacactttgcagggtcatacagctttggtcggtttattaagattatccgacaaatttttggtcagtgccgctgcagacggttcaataaggggttgggacgcaaacgactactctagaaaattttcctaccatcataccaatttgagtgcaattaccacattttatgtatcggataatattttggtgagtggatcggaaaatcagttcaacatctataatctacggagtgggaaattggtccacgcaaatattctaaaagatgctgatcagatttggtcggttaattttaagggcaaaacacttgttgcagcagttgaaaaagatggacagagctttttagaaattctggatttcagcaaagcttcaaaaattaactacgttagcaatcccgtaaactcctcgtcgtcgtctttggaatccatttctacttctttgggtctaacgaggacaactataataccatga

SEQ ID NO: 45562 - DNA, 3678 bp, Saccharomyces cerevisiae
atgggacgtttagttggcttagaactaagtaatttcaagtcctatagaggcgttaccaaggtaggattcggcgagtcgaatttcacaagtattatcggtcctaacggatctggtaaatcgaatatgatggatgctatctcattcgtactcggtgtgcggagtaatcatttgaggtcaaacatcttgaaagatttaatctatagaggtgttctaaacgatgagaatagtgacgattatgataacgagggcgctgcctcttcgaacccacaatccgcatacgtgaaggcattttatcaaaaaggtaacaaactggtggagctgatgaggataatttccagaaacggtgacactagttataaaattgatggaaaaactgtctcctataaggactattctatatttcttgagaacgaaaatattcttatcaaagccaaaaattttctagtgttccagggtgatgttgagcaaattgcagcacaatctcccgtagaattatcaagaatgtttgaagaagtatcaggttctatccaatacaaaaaggagtatgaagagttgaaggaaaagattgagaaattaagcaaatctgcaaccgaatctataaaaaataggagaaggatccatggagaattgaagacatataaagaaggtatcaataagaacgaggagtataggaaacaattggacaaaaaaaatgaattacagaagttccaggctctatggcagttatatcatttagagcaacaaaaagaggagctaacggacaagctgtccgcattaaactctgaaatatcgtctttaaagggaaaaataaataacgagatgaaatcattacaacgctcaaaatcttcctttgttaaagaaagcgcagtaatttctaagcaaaaaagtaaattagattatatcttcaaggataaggaaaaattagtctcggatttacggctcataaaggttcctcaacaggcagcagggaagcgaatttcccatatagaaaaaagaatcgaaagtttacagaaagatcttcaaagacagaagacttatgtggagagatttgaaacacaactaaaagtggtgaccagatcaaaggaagcttttgaagaggaaatcaaacaatctgctagaaactatgacaaattcaagctaaatgaaaatgatttaaagacatataattgcttacatgaaaaatatctgactgaaggtgggtcaatcctagaagaaaaaattgccgttttgaacaacgataagcgagaaatccaagaggaattggagagattcaacaaaagggcagatatttctaaaagaaggataacggaggagctttctataacaggagaaaaattggacacgcaattaaacgatttaagagtttctttgaatgagaaaaacgcccttcatactgaacgtttgcacgagctgaaaaaattacaatctgatattgaatctgctaataatcaagaatacgacttaaatttcaagttgagggaaacgttggttaagatcgatgacttgagtgctaatcaaagagaaacaatgaaagaaagaaaactaagagaaaatatagcaatgttgaaaagattcttccccggagtaaaaggtcttgttcatgatctttgtcacccaaaaaaggagaaatatggcttggcagtgtctaccatcttaggtaagaactttgattccgtcattgtagaaaatttaaccgtagctcaagaatgcattgcatttttgaagaagcaacgtgcgggcactgcatctttcataccactagacacaattgagacagagttacctacattatcattgcctgactcacaagactatattttatcaattaatgctattgactacgagccggaatatgaaaaagcgatgcaatatgtgtgtggcgattccatcatatgtaatacgttgaatattgctaaagatctgaaatggaaaaagggcataagaggcaaattggttacaattgaaggtgctttgatccacaaggccggtttgatgacaggtggtatatcaggagatgccaataataggtgggataaagaagaatatcaaagcttaatgtctttaaaagacaaattactaatccaaatcgatgaactttccaacggtcaacgctctaattcaatcagagcaagagaagttgaaaatagtgtttcactattgaactcggacatagcaaatttgagaactcaagtaacacaacaaaaacgctccttggatgaaaatcgtttagagattaagtaccataatgacttgatagagaaagaaattcaaccgaagataactgaactaaagaagaagctagatgatttagaaaatactaaagataatttagtgaaagagaaggaggctttacaaaataatattttcaaagaattcactagtaaaattggctttacaatcaaagaatatgaaaatcattccggtgaattgatgagacaacaatctaaagaattacagcagttacaaaaacaaattttgaccgttgaaaataagttgcagtttgagacagacagactaagtactactcaaagaagatatgaaaaggcgcaaaaggatttagagaatgctcaagttgaaatgaagtctttggaagaacaggaatatgcaatagaaatgaaaatcggatcaatagagtctaaattggaagaacacaaaaatcacttagatgagttacagaagaaatttgtaacgaagcaaagtgaattaaattccagcgaagatattctagaggacatgaacagcaacttacaagtcttaaaaagggaaagagacggtataaaggaagatattgaaaagtttgatttagagagagtaacagcgttaaagaattgtaaaatttctaatataaatatacctatatcatctgaaacaacgatagatgatttaccaatatcttccactgataatgaagcaattacaatttccaacagtatcgatataaactataaaggactacctaaaaaatacaaagaaaacaataccgattcggcaaggaaggagctggagcagaagattcatgaagtggaggaaatattgaacgagttgcagcccaatgcaagagctttggagagatacgacgaggcggaaggaaggtttgaagtgattaataacgaaacagaacaactaaaggccgaagaaaagaaaatattaaaccagttcctaaaaattaagaaaaaaagaaaggaactgttcgaaaagacatttgattatgtgagcgaccatttagacgcaatctacagggaacttactaaaaatcccaactccaatgtggaattggccggtggtaacgcttctttaaccatagaagacgaagatgaaccgttcaatgcgggaatcaaatatcatgccactccgcctcttaaaagattcaaagacatggaatatctttctggtggtgaaaaaaccgtagctgcattagctctattatttgctattaattcctaccagcctagtcccttcttcgtgctggacgaagtggacgcagccctagacattactaacgtccagagaattgctgcctatataagaaggcaccgtaatccagatctccaattcattgtcatttcattgaagaacaccatgtttgaaaaatctgacgctctcgttggggtttacagacagcaacaagaaaactcgtcgaagatcataactttggacttgagcaattacgcagaataa

SEQ ID NO: 45563 - DNA, 648 bp, Saccharomyces cerevisiae
atgtcaggcttgagaactgtttctgcttcatccggtaatggaaagagctatgactctattatgaaaattttattgattggtgattctggtgttgggaaatcatgtttattggttcgttttgttgaagacaaatttaacccgtcatttatcaccaccattggtattgatttcaaaataaagactgtcgatatcaacggtaagaaggtaaagctgcaactttgggataccgctggtcaagaacgtttccggacaatcaccacagcgtattatcgtggtgctatgggtatcattcttgtatatgatgtgacagacgagagaacatttactaatatcaagcaatggtttaaaaccgttaatgagcatgcgaacgatgaagcacagctactgttggttggtaacaagagcgatatggagacgagagtggtaacagctgatcaaggtgaagccttggctaaggagctgggtataccattcatcgagtccagtgctaagaacgatgacaatgtcaacgagatttttttcaccttggcgaagttaatccaagaaaaaatcgacagtaacaagcttgttggcgtcggtaacggtaaagagggcaatattagcatcaatagtgggagcggaaacagttctaaatcaaattgctgttga

SEQ ID NO: 45564 - DNA, 2637 bp, Saccharomyces cerevisiae
atgagtgaatctaatctatctagttttatcagtacaaattatttcaatttaaggtcggcggctaattcttcaaactctatttcgaagccaagtacgaaaaagagtatcaggaaccaaaaatcgccaactaacataagtagttgggctctcaaaaagaaaacgctacaaatagcagagacaacatgggaaaacaatgaaaaagattcaacacatagccattacttaatgactggatcaatggcctctaggaccgcaacctccttaagtcgatacagcaccaacgcttcactcctcggtcctagtattgactgtgttctttgttgcatatacgaagtgccaagagacataagtacgcggattgggttatgtattatcaactgtaacacgggacagatgtatctttcagatttcatggattcacaaatttacattcgtgtagttcataaactccaaatttaccaacctacggaaatactgattccaagcagttctctagctccaacagtatcaaaattagcgacaatgataaaatttaatgtggccgagacagttaaaattgaagagggttcacgaaagtgcttcaatagccaagatggactggcggcgattacaaagtatttaatggatgatacaaaaaaggacttgaaaatcgaggagattatagataaaacgtttgctctttgtgctgcatctgctgcgataagctacatggaagagattatatccaaaagcagccgaaatttgaatgcgtttcgaaaactacgtatacagtttgaaggaacagaaaatacaatgctgattgattctaaaaccgtcagaggtttagaacttgtagaaaataaattggataagaatggcatatcactatggaagttcttggataccacgtccactaaaatgggacaaagatcacttcggaacagtatactgcagccattaactgataggggcagtatcgaaatgagactagaggccctagaagaattgaaagccaatgatgaccttctacaaaaattaaggctagaaatgaaatcattgcctgatctagataagttattttcaaggttattatgcattaatcattctgcaataaaacctgaccaaagaattaattacgttttgttgctaaaggaaactttacaaagcgtgaagtcattgaaagacgcacttaatgatcagttaattcaaagccgtttaattagcgagaccaaaaaaatattcaataatgacgcaattatggaaattgaaaaattaattaatagttgtataaatgaagactgtgtctgggcatcctcagctatacaactacttaaccaacgttcatatgctgtgaaaagtgattccaatgggcttttggatgtttctagacaaatctacaaagaggtaaaagaggaattttttcgtgaggtagaagatcttaccgctaaaaacaaaatcaatttagatcataattacgattctgcacgaggcttttatctcagaataaaaagacaggaatttaccgatgacgtcgctacacttccagacgtattcatttcaagaacaataaaaaaaaattatattgaatgtacaaccctaaatataataaaaaaaaatgcgaggttgaaggaagttatggaagagattttacttttaagtgaagagacagttgatgaactgctcgataaaattgcaacccatatttctgaactatttatgattgcagaagcagtggctatcctggatttggtttgttcattcacatataatttgaaagaaaataattacacaataccgatttttacaaacaatctactaattcgagattcaagacacccactacttgaaaaggtactaaaaaattttgtccctaacaccatatcaagtacaaaacatagctccagcttacaaatcataaccggatgcaacatgagtggaaaatctgtttatttaaaacaagttgcccttatttgcataatggcccaaatgggatcaggtataccggcactttatgggtcttttcctgtctttaaacgtctacatgcaagagtctgcaatgacagtatggaattaacctcatcaaattttggttttgaaatgaaagaaatggcttactttttagatgacataaatacagaaacactgttaattttagatgaacttggtcgtggttcaagcatcgctgatgggttttgtgtgtctttggcagtaactgaacatttacttcgaacggaggcaacggtatttctttctacacacttccaggacattcctaaaataatgtctaagaagccagcagtttcccatcttcatatggatgcagtccttctcaatgacaattctgtcaaaatgaattatcagttgacccagaaatctgtcgcaatagagaatagtggaataagggtggtaaaaaaaatattcaacccggatattattgcagaagcgtacaatatccattcgcttttgaaaattgcaaaagcaaggactgaaaacgaagattcaaatggcgttgttgatcaaaagaccataaaccaaatgaagagaatacacaatcttgtagcgatattgaaagaatgtgcaggaaatgaaaaagagcccttgactttagggaaattaaaagaaataaactccgacttcatcgaaaattttgaagaataa

SEQ ID NO: 45565 - DNA, 1821 bp, Saccharomyces cerevisiae
atgtcaaagtcattggaatgggataatctcgggttttctttacttccctggataaggacaggactcgatgttatgggttttgagaccatgactccagtccaagcatcgacaattcccatgcttgctggcaacaaggatgtagtagttgattctgtaacaggctcaggtaagaccgctgcgtttgttatacctgtactagaaaaagttgtaaaggaagaagcgaatacatcaaaattcaagaaagcacacttccactcgttaattattgctccaacaagagaattgtcacgccaaattgagtctgtcgttctatcatttctggaacattatccttccgacttgttccctattaaatgtcagctcctggttggtactaatgaagccacagttagagatgatgtaagtaattttctgcggaatagaccgcagattctgattggaacacctggtagagttttggactttttacaaatgccagcagtaaagacgtcagcatgcagtatggtagttatggatgaagcagacagattgttggatatgagttttattaaggataccgaaaaaattctgaggctattgcctaaacaaagaaggacgggtctattttctgcaactatgcgtagcgccggatcagatatctttaagacagggcttagaaatcctgtcaggattaccgttaactctaagaaccaggcgccctcctctttgaaattaaattactgtgtcgtaaatcctgccgaaaaactacaacttttggttagcattttgaataactacaaattcaagaaatgtattgtatattttccaacatgtgtgtcagtctcctacttctactcatttatccagtatttgggaaagaggaatattctcgtgaatgaagtagaaatattttccttgcatggaaaacttcaaacatcggcaaggacaaaaactctaacagcttttactgattcgctaagtaattctgttttattcacaacagatgtggctgctagaggtattgacatacccgacgttgatctcgtcatccagcttgatccccctaccaatactgatatgttcatgcatagatgtggtagaactggtagagcaaatagagtgggtaaagcaattacgtttcttaatgaaggcagagaagaggattttattcctttcatgcaagttaaaaatgtggaacttgaagaacttgatttggaagtaaagggcataacaacaaacttttacgaggactttagaaattggatactagaagatagggatagatttgataaaggtgttaaagcatatgttgcctttattaaatactactcaaatcattccgcaacttcaatttttaggcttcaatctttagattatgttggtattgcgaaattgtatggtcttttccgcctgcctagaatgcctgagataacaaagtacttagccaccgaaaaacaagaagggattttcccagggaattggttggtcgatcccccagttaatatggatgaatataaatacaaggacaaaaaacgtgaaaaggagagacaagaaacattaaaaaatataagcctgattaatgataaaaagaagctgaaaagtgagttgaagaagaagaatttagcgtggtcagataaaacattgacgaaagaacggaaactcgagagaaaggaaaagatgagtttaaaaaggaaggctatagaggaagaattgaaagcagaagagctcgatgaaaatgctgaagaagagcgtattaaagaggattggaaagaaatcgttttacagaataaacggaagaaagtttccagcaaagctatccaaggcaattttgacgacttataa

SEQ ID NO: 45566 - DNA, 921 bp, Saccharomyces cerevisiae
atggaacgactacagagattgatgatgaatagtaaggtggggtccgcggacaccggccgtgacgatacgaaagaaactgtttatatttcttcgattgcgcttttaaagatgctaaagcatggtagagctggtgttcccatggaagtcatggggttgatgttaggtgagtttgtcgatgattatacggttaacgttgtggacgtgtttgcgatgcctcaatcgggtaccggagtttctgttgaggctgtcgatgatgttttccaagcgaagatgatggacatgttaaaacaaacgggcagagaccaaatggtcgttggctggtaccactctcatccagggtttggctgttggctatcttctgttgatgttaatactcaaaaatcttttgaacaactaaacagcagagctgttgctgtcgttgttgaccctattcaatccgttaagggaaaagttgtcatcgatgcttttagattgattgacacgggcgcattgataaataacttagagcctagacaaacaacctccaacacaggcttattgaacaaggccaacattcaagccttaattcacggtctgaataggcattactattctttaaatattgattatcataaaaccgcgaaggaaaccaagatgttaatgaacttacataaagaacagtggcaatcaggtcttaagatgtacgattatgaagaaaaagaagaatcaaatttggctgctacaaagagtatggttaagatagccgaacagtactctaagagaatagaagaggaaaaggaattaaccgaagaagaacttaagacaagatacgttggtaggcaagatccaaagaagcacctttccgaaacagcagatgagacactagagaacaatattgtttctgtgctgacggcgggtgttaattcagtggcaattaaataa

SEQ ID NO: 45567 - DNA, 1608 bp, Saccharomyces cerevisiae
atgtgccttgaaccaatctctcttgttgttttcggatccctggtgtttttctttggcttggtgaagtatttcaaacgtggagaacggcaaagaacaagaggaattttacagccagagtacaaagataagtattattacagtaaagaaaaaggggaagaaatgggcgaggtagcaaacgtaaatgaaattccggtcaagataagaaatcataagtatcctgcgaaagaacataacttgagggttaaagatttgttgttaaatcgcaatccgaagctatcaaagatatccacagcattttttattgctggtgaagaattagagggaaacaagtattgtgacaccaacaaagattttagacagaatagatatttttatcatttgtcaggtgttgatatacctgcttcggcgatattgtttaactgtagcacagataagctgacattgtttttgccaaacatcgatgaagaagatgtcatatggagcggtatgcctttgagtttggatgaggcaatgagagtgtttgacattgatgaggccttgtacatatctgatctggggaaaaaatttaaagaattgcaagacttcgctatctttacaaccgatttggacaatgttcatgacgagaatattgcaagatcactaattccttcagaccctaacttcttttatgctatggatgaaactagagcaattaaggattggtatgaaattgaaagcatcagaaaagcttgtcagatttcagacaagagccatttggccgttatgtccgcgttgcccatcgaactgaacgagttacaaatacaagctgaatttgaataccatgcaacccgtcaaggtggtcgttctttgggctatgaccccatttgttgttctggaccggcatgtggcactttacattacgtcaagaattcagaagatatcaaaggtaaacattccatcttaattgatgcaggtgcagaatggagacaatatacaagtgatatcaccagatgtttcccaacttcaggcaagtttactgcggaacatcgtgaagtttacgaaaccgttcttgacatgcaaaaccaagcaatggaaaggattaaacctggtgctaaatgggacgatttacatgcactgacacacaaggttcttattaaacatttcttaagtatgggtattttcaagaaagagttttctgaggacgaaatctttaaaagaagagcttcttgcgctttttatccccatggactagggcatatgttggggcttgatgtacacgacgttggtggtaatccaaactatgacgacccagatccaatgtttagatatttaagaatccgccgtcctttgaaagaaaatatggttatcactaatgaaccaggttgctactttaatcaatttttgatcaaagaatttttggaaaagcaccccgaaagattggaagttgtcgatatgagcgtattgaaaagatacatgtatgtcggtggtgttagaattgaagatgatatccttgttaccaaagatggttacgagaacttaactggtattacttctgaccctgatgaaattgaaaaaatcgttcaaaaaggtttgaagaaaccccgttcaggtttccacgtaatcgtttag

SEQ ID NO: 45568 - DNA, 1500 bp, Saccharomyces cerevisiae
atgagcggagaaacgtttgagttcaatattagacattctggtaaagtttacccaataacactttccactgatgctacttcagcagatttgaaaagcaaagcagaggaattgacccaagtcccaagtgcccgccaaaaatacatggttaaaggtggcttgtctggcgaagagtccattaaaatatatcccttaatcaagccaggatcgacagtaatgctattggggactccagatgctaacctgatttctaaaccagccaaaaagaataatttcattgaagaccttgcgcctgagcaacaagtccaacaatttgctcaattgcctgttggtttcaagaatatgggcaacacctgttatctgaatgctaccctacaggctttatacagagtgaacgatttaagggatatgattcttaattataacccttctcaaggtgtgtctaacagtggtgcacaagatgaagagattcacaaacaaatcgttattgaaatgaagcgttgttttgaaaatttacagaataaaagtttcaagagtgttttgccaattgtgttattaaacacgctaagaaagtgttatccacaatttgctgaacgtgattcacaaggtgggttctataaacagcaagacgctgaggagttgtttacacaactattccatagtatgagtattgtttttggtgacaaattttccgaagatttcaggattcaatttaaaactaccatcaaagacacagctaatgataacgatattactgttaaagaaaatgaaagcgattctaaattacaatgtcatatttctggtactacaaatttcatgagaaatgggctcctggaaggtttgaatgagaaaattgaaaaaagatcagacttgactggcgccaattccatctatagcgtcgaaaagaaaatatcaagattaccaaagtttttaactgttcagtacgttagatttttctggaaaaggtcaaccaacaaaaaatctaaaatattgcgtaaggtcgttttcccatttcaattagatgttgcagacatgcttaccccagaatacgcagcagagaaggtaaaagttcgtgacgaactgagaaaagttgaaaaggagaaaaatgaaaaggaaagagagatcaaaaggcgtaaatttgacccatcatccagtgaaaatgtcatgacaccaagagaacaatatgagacacaagtggctcttaacgaaagtgaaaaagatcaatggctcgaagagtataagaaacattttcctccaaacttggaaaaaggtgaaaacccatcttgtgtttataacttgatcggtgtcattacacatcaaggtgccaattctgagtctggacactatcaagctttcataagggacgaactggacgaaaataaatggtacaaatttaatgatgataaagttagcgttgttgaaaaggaaaaaattgaatctttagccggtgggggcgaaagtgatagtgcactgatcttaatgtataaaggatttggtctgtaa

SEQ ID NO: 45569 - DNA, 1341 bp, Saccharomyces cerevisiae
atggacgacaaagtttcagaaaaggagagctccccaaaacaaacagaggaggattctgaaggtaaaatggcacatgtgcagcctgcttcgtacgtgaataaaaaaaaatatgtttttgggaagacattaggtgctggtacatttggtgtggtgagacaagccaaaaacactgaaacaggggaggacgtggccgttaaaatcctgatcaagaaagcactaaagggaaacaaggttcagctagaggctttatacgacgagttagacattttacaaagactgcatcatccaaatatagtggcatttaaggattggtttgaatcaaaagacaagttctacattatcacgcaattagccaaagggggtgaattgttcgataggattttgaagaagggtaagttcactgaggaagatgcagtgagaattttggttgaaatattgagcgcagtcaaatatatgcattctcagaatattgttcatagggacttgaaaccggaaaatttactgtatatagataaaagtgacgaatctccactggtagttgctgattttggtatcgcaaagagattgaaaagtgatgaggaactcctctataagccggcaggctcactgggttacgtggctccagaggtacttactcaggacggtcatggtaaaccttgcgacatttggtcgataggtgtcattacgtatactttgctttgcggttattcggcgtttagagccgaaagggttcaagatttccttgacgaatgcacaactggtgagtatccagtgaagtttcataggccttattgggattccgtttccaataaggcaaaacaattcatcttgaaggctcttaatttggatccttcaaagagaccgaccgccgcagaactcttggaagatccatggattatttgtaccgaattgaagacgcacaatttattgcctgggttaaaggaaggattggatgctcgtcaaaagttccgtaattctgttgagagagtcagattaaacatgaagatccagaaattaagagatctgtatcttgaacagacagagagtgattcagattttgacgaaggaagtcaagcaaacggttcagttcctccattgaaagcaacggataccagtcaactatccaagaagctatcagaagaagaacagtctaagttgaagtccgagttaaccagcaaagcttttgcacaattagttaacacagtgcttgccgaaaaggaaaaatttttaaatattaacagagtctgtagttctgatagcgatcttcctgggagtgatataaagtctttggatgaggcgaaggagaaaccagaggggaaggataccaaaacagaagaatga

SEQ ID NO: 45570 - DNA, 2127 bp, Saccharomyces cerevisiae
atggctcgtgacttacaaaatcatctactgttcgaagtagcaacagaagtaactaacagggttggtggtatttactctgtcttgaagtccaaggctccagtcactgtggcacaatacggagacaactatacgctgcttggacctttgaacaaggcgacttatgaaagtgaggttgaaaaacttgactgggaagatgaaagtatctttcctgaagagctgttaccgatccaaaaaactttgatgtccatgcgggaaaagggtgtgaactttgtctacggtaactggttgattgagggagcaccacgtgtcattttatttgagctggattctgtaagacactttttgaacgaatggaaggctgacctatggtctctcgtcggaattccatcaccagagcatgatcacgaaacaaacgatgccatattgttgggttatgttgttgtgtggtttttgggagaagtttcaaaactggacagtagccatgccatcattggccatttccatgaatggctagctggtgtagccctgccattgtgtagaaagaaaagaattgatgttgtaacgattttcaccacgcacgcaactttattgggtagatacttgtgtgccgctggtgatgtagatttttataacaatctacagtattttgatgtggaccaagaagctggtaagagaggcatatatcataggtactgcattgagcgcgctgcggctcatactgccgatgtttttacgactgtgtcgcaaatcactgcattagaagcggagcatttgttgaagaggaaaccggatggcattttgcccaatggtttgaacgttgttaagtttcaagcagtacatgaatttcaaaatctgcatgccctgaaaaaggacaaaattaatgatttcgtcagaggccatttccatggttgttttgatttcgatctagacaacacagtttatttctttatcgctggtagatatgaatacaaaaacaaaggtgctgacatgttcattgaatcattggctcgtctcaattacagattgaaggtttctggatccaagaagacggtggtagcgtttttgatcatgcctgccaaaaccaattccttcactgtggaggcactgaaaagccaagccattgtaaaatctttggaaaatactgttaatgaggtcaccgcatccattgggaagagaattttcgagcatacgatgagataccctcataatggcctagaatcagagttgcccactaatttagatgagctgttgaagagttctgaaaaggttttgctgaagaaaagggtattggcgctgagaagaccttacggggaattgcctccggtagtcacacataacatgtgcgatgatgctaacgatccaattttaaaccaaattagacatgttagattattcaatgattcgagtgatcgtgtaaaagtgattttccatcctgaattcttaaacgccaataaccctatccttggtttggattatgacgagtttgttcgcggctgtcacttgggtgtttttccatcctattacgaaccatgggggtacacgccagcagaatgtaccgtcatgggtgtcccatctatcacaacaaacgtttctgggttcggtgcctacatggaagacttgattgaaacagaccaagcgaaagactatggtatttatattgtagaccgtcgtttcaagagccctgatgaatctgtcgagcaattagcagactacatggaagagtttgtaaacaagaccagaagacaaagaatcaaccaaagaaacagaaccgaaagactatcagacttgttagattggaagagaatggggttggaatacgttaaggctagacagttgggtcttcgtagggcctatccagagcagttcaagcaactggtgggtgaaacaattagtgacgccaatatgaatactcttgccggtggcaagaaattcaagattgccaggcctttgagtgtacccggatcccccaaagtaaggtccaatagtactgtttacatgactccgggcgatttaggtacccttcaagatgctaataatgcagatgactattttaatttgagcacgaatggagccatcgacaatgacgatgatgacaacgatacgtctgcatactacgaggataattaa

SEQ ID NO: 45571 - DNA, 1008 bp, Saccharomyces cerevisiae
atgcactcacaccattcacactccggtgactatagtgcccacggtacggaccctttggattccgtggtcgatcaagtggtcaacctcaactttcacacgtactgtttgacagagcacataccaagaattgaggccaagtttatataccccgaagagcagtcattgggcaagaatcctgaggaagtcataaccaagctagaaacatcgttcaagaatttcatgagtcatgcgcaagaaatcaagactcgttatgctgatagacccgatgtgcggactaaattcattataggaatggagatcgaaagttgtgacatggctcatatcgaatatgcaaagcgactcatgaaggagaataatgatattttgaagttttgtgtgggttcggtccatcacgtcaacgggatccctattgatttcgaccaacaacaatggtacaattcattgcattccttcaatgataatttgaaacattttctcctgtcttacttccaatcacagtacgaaatgctgatcaatattaaaccgttggtcgtgggtcacttcgacctttacaaattatttttgcccaatgacatgctagtaaaccagaaatcgggcaactgcaacgaagaaaccggagttcctgtagcttcactggacgtcatcagtgaatggccagaaatatacgatgcagttgtaagaaatttacaatttatagactcctatggcggcgcaattgaaatcaatacgtccgcattaagaaagcgcctcgaggagccgtaccccagcaaaaccttatgtaatctggtcaagaagcactgtggatccagatttgttctaagtgatgacgcacacggcgtggcgcaagtgggtgtgtgctatgacaaggtaaagaaatacatagtagacgtgctacaattagagtatatttgctaccttgaggaaagccaatcaccagagaatctgttaactgtaaagagattacccatttcgcaattcgttaatgatcccttttgggccaatatataa

SEQ ID NO: 45572 - DNA, 1656 bp, Saccharomyces cerevisiae
atgcgtaggagtgtatacctcgacaacacgatcgagttcctgcgaggcagagtatatctcggtgcatatgattacacgccggaagatactgatgagctggtgttttttaccgtggaggacgcaatcttttacaacagtttccatttggatttcggtcccatgaacattggacatctatatcgttttgccgttattttccatgaaatcttgaatgacccagaaaatgccaataaagccgttgttttctattcatctgcatcgaccagacaacgtgctaacgccgcatgtatgctttgctgttatatgatcctcgttcaggcatggactccgcatcaagtgcttcagccgttggcgcaagtagaccctcccttcatgccatttagagatgccggttattctaatgcggatttcgaaatcacaattcaagatgtggtttatggcgtttggagggctaaggaaaaaggccttattgatttgcattccttcaatttggagagttacgagaaatacgaacacgtggagtttggagacttcaatgtactcaccccagattttattgcatttgcgtcaccacaagaggaccatccaaagggctatctcgctaccaaatcttcacatttgaaccagccgtttaagtcagttctgaattttttcgccaacaataacgtccaattagtggtaaggttgaattctcatttatataataaaaagcattttgaagacattggcattcaacatttggatctaattttcgaagatggtacatgtcctgatctttccattgtaaaaaactttgttggtgctgctgaaacgataattaaaaggggaggtaaaattgctgtgcactgtaaggctgggctaggtagaactggttgtttaattggtgctcacttaatatacacgtatggatttaccgctaacgagtgtattggcttcttaaggtttataaggccgggaatggtcgttggccctcaacagcattggttatatttacaccagaatgattttagagaatggaagtacacaaccagaatttctttgaagcctagtgaggccattggcggcttatatcccttaataagtttagaagaataccgcttacaaaaaaagaaacttaaagacgacaagagggttgcgcaaaataacattgaaggtgaattaagagatttaaccatgacgccgccatccaacggtcatggggcgcttagtgccagaaattcgagccaaccttctacggcgaataatggaagtaattcattcaagagctcagccgtcccacagacttcgcctggtcagccgagaaagggccaaaacggttctaatactatagaagatatcaacaataatcgtaatccaacttcccatgcgaataggaaggtagtaatagaaagcaacaactcagatgacgaatccatgcaggataccaacggcacaagtaatcattatcccaaagtttcgcgcaagaaaaatgatatctcctctgcttcatcgtcccgaatggaagataacgaacccagcgcaacgaacatcaataatgccgcagatgataccatactaagacaactattgcccaagaataggagagtaacgtcagggagaaggactacaagcgccgccggtggtataagaaaaataagtggctccatcaagaaataa

SEQ ID NO: 45573 - DNA, 3108 bp, Saccharomyces cerevisiae
atgccagttgagtttgctaccaatccttttggcgaggccaaaaatgcaacttcactgccaaaatatggtacacccgtaactgccatttcatctgtgctgttcaataacgtggactccatttttgcttacaagtccttttctcaacccgatttgctacaccaagatctaaaaaaatggtctgaaaagcgtggtaacgaatcacgtgggaagccatttttccaagagctggatatcagatctggcgctggtttggctcctttagggttttctcatggattgaagaacactacagcaattgttgctccagggttttcgctgccatacttcattaactctttgaaaaccgtctctcatgatggtaagtttcttttgaatgttggtgctttaaactacgacaatgctaccggctctgtcaccaacgattatgtaaccgcattggatgctgcttccaagctgaagtatggtgtcgtgactccgatttccgctaacgaggtacaaagtgtcgccttactggcattggcgattgccactttcagtaataactccggagctatcaatttatttgacggattaaactactcgaaaaccgtcttgccgttggtcgaatctgttcctgaggcatctattttggcaaaactatccaaagttattgcaccagatgctgcctttgatgatgtcttggataagtttaatgaattgactggattgagactacataatttccaatactttggtgctcaggatgctgaaactgtgtttatcacttatgggtctttagaatccgaattgttcaactctgcgattagtggtaataattccaaaatcgggttaatcaacgtcagagtgccattaccttttaacgttgctaagtttgtcactcacgttccatccactaccaaacaaattgttgttataggccaaactttggatggttcttcgccttctttcttgagatctcaagtttcagccgccttattttaccacggccgcacctcaattagcgtttctgagtacatctatcaaccagatttcatttggtccccaaaagctgtcaaatcaattgtatcgtcattcatccctgaattcacttacaatgccgattcatctttcggcgaaggattcatttattgggcctctgataagagtatcaatattgatgttgcctccaaacttgtgaaagctctgtctttggaagatgggaaatttgtgtctttgagaacgaaatttgataacttggctaatgctggtaccttccaagctcaatttgtgacctcgaaagaacagatacctgtttcaaacatcgattctacgaaattatcagtcgttgaagatgtcagtttattgaagcatttagacgtagctgctaccgtcgcagaacaaggttcaattgcgttggtttcccaaaaggcagttaaagatttggatttaaattctgtagaaagttacgtcaagaatttgggaattcctgaatcattcctaatatctattgcgaagaaaaacatcaaattgtttatcatcgatggtgagaccactaacgacgagtccaaattgtccttgtttatccaagccgttttctggaaattggccttcggtctagatgtcgcagaatgtaccaaccgtatctggaaaagcattgattcaggtgcagacatttcagcagcctcgatttctgaatttctcactggtgcattcaaaaacttcctcagtgaggttccgctagcgctgtacactaaattttctgaaataaacattgaaaagaaagaggatgaggaagagcctgcagctttaccaattttcgttaatgaaacatctttcctcccaaataacagtaccattgaagaaataccattacctgagacctctgagatctctgatattgccaagaagttgtccttcaaagaggcatatgaagttgagaataaactaagacccgatttacccgtcaagaacttcgtcgtgaaagttaaagaaaatagacgtgttacgcctgctgattatgatagatatattttccatattgaattcgatatttctggtactggaatgacttatgacatcggtgaagccctcggtattcatgccagaaacaatgaatctttggtcaaagaattcttaaccttctatggtctaaatgaatccgatgttgtcttagtccccaacaaggacaaccaccatttgttagaaacaagaaccgtcttacaagcatttgtggaaaatttggatattttcggtaaaccaccaaaaagattttacgaatcattgattccatatgcctctaacgaagaggagaagaaaaaattagaggatttggttactcctgccggtgcagtagatttgaagagatttcaagatgtggagtattatacatatgctgacatttttgaattgttcccatctgttcgcccatctcttgaggaacttgttactatcattgaaccattgaagagaagagaatactcaattgcctcctctcagaaagttcatccaaatgaagttcatttattgatcgttgttgttgattgggtggataataaaggaagaaaaaggtacggtcaagcttctaagtatatctcagaccttgctgtcggttcagaattggtcgttagcgttaaaccatctgttatgaaattaccaccatctccaaagcaaccagttattatgagtggtttaggtactggtttggcaccattcaaggccattgttgaagagaaattatggcaaaagcagcaaggttatgagattggtgaagtcttcctatatctaggttcaagacacaaaagagaagaatatttatatggtgagttatgggaggcttacaaagatgcaggtattatcacacacatcggcgctgctttctcaagagaccaacctcaaaaaatttacattcaagatcgtatcaaagagaatttggatgaattaaaaactgcaatgattgataataaaggttcattttacttgtgtggccctacttggccagttccagatattactcaagctttgcaagacattctggctaaagacgccgaggaaagaggcatcaaagtcgacttggatgccgcaattgaagaattaaaggaagcatcaagatacattttagaagtctactaa

SEQ ID NO: 45574 - DNA, 3513 bp, Saccharomyces cerevisiae
atgaaggtagaggaattgattattgatggtttcaaatcatacgctacaagaacagtcattactgattgggaccctcaattcaatgctattacaggtctaaatgggtccggtaagtcgaacattttggacgccatttgcttcgtgctcggtatagcatcaatgagcactgtgcgagcatctagcctgcaagatttgatctataagcgtggtcaagcaggtgttaccaaggcaagcgtaaccattgtttttgataataccgataaatcaaattctcccattgggttcactaactctcctcaaatctctgttacaaggcaagtcgtgcttggtggaacttctaaatatctgataaatgggcatagggcacctcaacagtcggttttgcaactatttcaatccgtgcagttaaatatcaataatcctaattttttaatcatgcaaggtaaaattaccaaggttttgaatatgaaaccctcagagatcttatcactgattgaagaggcagcagggacaaaaatgttcgaggatcgtagggaaaaggcagaaagaacaatgtctaagaaagaaactaaattacaggagaacaggactctgttaactgaagagatcgaacctaaactggaaaaacttcgaaacgaaaagagaatgttcctagaatttcagtctactcagactgatttggaaaaaactgaacgaattgttgtatcttatgaatactataacattaaacataaacatacatcaataagagaaactctggagaacggtgagactcgtatgaaaatgttaaatgaatttgttaagaaaacttccgaagaaatagacagtttgaatgaggatgtcgaggaaatcaaacttcagaaagaaaaagaactacacaaagaaggcacaatctccaagttggaaaataaggagaacggtcttttaaatgaaatttctcgtttgaaaacttcactgtcgataaaagtagaaaatttgaatgatactactgaaaaatcaaaggctctggagtcagaaattgcaagttcctctgcaaagctaatcgaaaaaaaatcggcatacgctaacactgaaaaggattataaaatggtgcaggaacaactcagtaaacaaagggatctttataaacgaaaagaagaattagtttccactttaaccacaggtatttcctcgaccggtgccgcagacggtggttataacgcacagttggccaaggcaaagactgagctgaatgaagtctccttggcgataaaaaaatcaagcatgaaaatggagttgttgaagaaagagctattgacaattgaacctaaattaaaggaggccacgaaagataacgagttaaatgtgaagcatgttaaacaatgccaagaaacgtgcgataaactacgagcccgactagtcgaatatgggtttgatccatcacgaattaaagacctgaagcaaagagaggataaattgaagagccattattatcaaacatgtaagaactctgaatatttaaaaagacgcgtaacaaatctggaatttaactatacgaaaccttatcctaattttgaagccagctttgtccatggggtggtgggtcaacttttccagatagataatgataatattcgctatgctactgctttgcaaacttgtgccggaggtaggctattcaatgttgttgttcaagattctcagacggccactcagctattagaaagaggaagattacgcaagcgtgttaccatcatacctcttgataagatatatacgaggccaataagttctcaagtgcttgatttagccaagaaaattgctcctgggaaagttgaattggcaataaatttaataaggtttgatgaatctatcactaaagcgatggaatttatttttggaaatagtttaatctgtgaagatccggaaacagcaaagaaaattaccttccatccaaagatccgcgctagaagtatcacccttcaaggtgatgtatacgacccagagggtacattgtctggtggtagtagaaatacctctgaatcgttattagttgatattcaaaaatacaatcaaattcaaaaacaaattgagaccattcaggctgatctcaaccatgtaacggaagagctacagacgcaatatgctacatcgcaaaaaacaaagaccattcaaagtgatttaaatctctcgttgcataaattggatttggctaagcgtaatctcgacgcgaatccatcttcccaaataattgctaggaatgaagaaattttgagggacattggagagtgtgagaatgaaatcaaaaccaagcaaatgagcttaaagaaatgtcaagaagaagtttcgaccattgaaaaagacatgaaggagtacgatagcgataaaggatccaagttaaatgaattaaagaaggaattgaaactattggcgaaagagctggaggagcaggaatcggagtcagaacgtaaatatgacttgtttcaaaacttggaattagaaacagagcaattgagctcagaactagattctaataagacgctattgcataaccatttgaaatctattgaaagtttgaaattggaaaattctgatttggagggaaagatacgaggtgttgaagacgaccttgtaacagtccagacagaactgaacgaagaaaagaaaaggttgatggacattgatgatgaactaaatgaattagaaacattgataaagaaaaaacaggacgagaaaaaaagcagtgaattagaactacaaaaattggtccatgacttgaacaaatataagtctaatacgaacaacatggaaaagataattgaagatctgcgacagaaacacgaatttcttgaggattttgatctggtgagaaatatcgtcaaacaaaatgagggtatcgatttggatacttacagagaaaggagtaaacaattgaacgagaagtttcaagagctcagaaaaaaagttaatccaaatattatgaatatgatagaaaatgttgagaaaaaggaggcagcattaaaaacaatgattaaaacgattgaaaaagataagatgaaaatccaagagactatatcgaagttgaacgaatataaaagagaaactttagtcaaaacatgggagaaagtgacacttgattttggtaatatttttgcagaccttttaccaaattcatttgcaaaattggttccatgcgaaggtaaggacgtaacgcagggtttagaggttaaagtaaagcttggtaatatatggaaggaaagtttgattgaattgtccggtgggcaaaggtcgttgattgctttgtcattgattatggcattgttgcaatttcgaccagcgcctatgtatattttggatgaagttgatgctgctcttgatttaagtcatacgcaaaatataggtcatttgattaaaacaaggtttaaaggatctcagttcattgtagtctcgcttaaagaaggtatgtttgccaatgctaatagggtcttcaggacgagatttcaagatggtacctccgtagttagtataatgtga

SEQ ID NO: 45575 - DNA, 375 bp, Saccharomyces cerevisiae
atgatcagaagggcccctaccaccttgcagctcagtcacgacgacgtaacctctctgatcgatgacctgaacgagcagaaactcaagcagcagctgaatatcgagaagacaaaatacttccaaggaaaaaatggcggatcgctgcactccaatacagactttcaggacacatcgcagaatatcgaagacaacaataacgataacgataacgatatcgatgaagatgacgacatgtcatcttacaacgacaaagcagcctcggtagcgcacaccagagtcctcaattccttgcatctgtccaccgacagcaataccgcccacgagacgtccaatgcaaacgacaaccacaaccccttctacatccgcgaggaataa

SEQ ID NO: 45576 - DNA, 2337 bp, Saccharomyces cerevisiae
atgagcagatgctcaaacgcggcgctgatgactgttgttgaggatgctgttggggccagggtggctgcaaggacgagaaacatgagcaatggcgtcaattaccgggagaaggaagtcaatgacctaacggctgacatttcagattcagattcagatttggattcagaggacaataaacatggcaaaggcgacaatgacactgcccccatatggttacaagatgatgtgcattcagacgaagatattcagctggactcagaggacgattccgatacagaagctgttcaagcccaagtggtggataaattggcaaaagacacgaaatcagagcaaaaatccttggatgatgagctctccgagatggataccaagacggtttctttaaaacttaagaaactaaacgagtttgtgaggcagagtcaggtatattccagtataatcgccgatactttactacatcgatctaatgaagtggctaacgctaatacaaaagataacagcaactctgatgatgaagaacattcttcaaaaaaacgtaaaacaaaaaaaaaatcaataacagatttcttcaaaaaacagaaaaagaacgaagatacaaccacccaaaacggcgcaccagacgatgcagcaataaagcaacctcgcctattgaaaaactgtattttaaaaccttaccaactagaaggtcttaactggctgatcactctttatgaaaatggcctgaacggaattcttgccgatgaaatgggtcttggtaagactgttcaaagtattgctcttttggcgttcatatatgaaatggacacaaagggtccttttctagtgactgcaccattaagcaccctagataattggatgaacgaatttgcaaaattcgctcctgatctaccagttctaaaatattatgggaccaatggttataaggaacgttctgccaagttgaaaaatttctttaaacaacacggcggcacggggatcgtcatcacatcatatgaaattattttaagagataccgacttaatcatgagtcaaaattggaaatttttaattgttgatgaaggccaccgtctgaaaaatataaactgtagattgattaaagagttaaaaaaaatcaatacttccaatagactgctactaacagggacgcctttacaaaataacctagctgaattatggtcacttttgaatttcataatgcccgatatctttgccgatttcgagatattcaataaatggtttgacttcgacagcttaaatttaggctccggttccaactctgaagcattgaataagttaatcaacgatgaactacagaaaaatttgatttccaatttacacacaattctgaaaccattccttttgagaagattgaaaaaagttgttttggctaatattctgccgccaaagagagaatatatcataaattgtccgatgacgtctgcacaggaaaaattctataaggctggattgaatggaaagttgaaaaaaaccatgttcaaagaattaatcaaggattttttcacattgaacgatgaatacatcggccacgtttctaatcggtccatacgagatttcatcaattataaactatctggtaatgaaacttcaaatacagacaataaaatcaatccaaccttgttgcaaatggacaaactatataagaagaacctgcaaatggaaatttcaaataagaaattgcaaaatatgatgatgcaattgagacaaatcattgactcaacttttttgttttatttcccatatttacacccagaagacttgactttggaaactcttttaaagacgtctgggaaattacaaatcttacaaaaattaatccccccattaatatctgaggggcacaaagtgcttatttattctcagtttgttaacatgctcgatttgatcgaagattggtgtgatttaaattcgttcgcgacatttcgaattgatggttcagtaaacaatgaaacaagaaaggatcaactcgagaagtttaatagctcgaaagataagcataacattttcctattgtccacaagggcggcaggactgggtattaatctagtcggggcagatacagttgtcttgtttgatagtgattggaatccacaggtggatttacaagccatggacaggtgtcaccgtattggccaagaatcaccggttatagtatataggttgtgttgtgataacaccattgaacatgttatattgaccagagcggccaataagcgaaatttggaaagaatggttatccagatgggaaaattcaataacctgaaaaaattggcgttaaatgaagggttcttttttgaaggcaaacaaagcgggtgttaa

SEQ ID NO: 45577 - DNA, 2718 bp, Saccharomyces cerevisiae
atgaactctagcgaatcttccactacatctttttcttctgggtcaacttctaaaactgatttagatgaggaggatatcagcaatgctactgctcccatgatggtcaccacaaagaatttggataactcttttattgaaagaatgcttgtagagacagagctactgaacgaattatcgagacaaaacaagacgctacttgacttcatttgctttggatttttctttgataagaaaactaataagaaagtgaataatatggaatatctggtcgaccaactgatggaatgtatctcgaagattaaaaccgccaccacagtggatttgaataacctgatagattatcaagaacagcaacagcttgatgatagctcacaagaggacgtttatgtggaatctgatacggagcaagaagaggagaaagaggacgataataacagcaataacaagaagagacgaaaacgcggaagctcctcgtttggtaacgatgatatcaacaacaatgacgacgacgacgatgcgaatgaggacgatgaatctgcttatttgacaaaggccaccataatatctgaaatcttttccttagacatatggttgattagcgagtcattagttaaaaaccaatcatacttaaacaagatttggtctatcatcaaccagccaaatttcaattctgaaaactctcccttggtacccatattcttaaagattaaccaaaatctgttgttaaccaggcaggatcaatatttaaattttattcgaacggagagaagctttgttgatgatatgttaaagcatgttgatatttccctattgatggattttttcttgaaaataatatccacagataagattgaatcacccacgggaataattgaattagtatatgatcaaaacttgatcagcaaatgcttaagctttctaaataacaaagagtccccagctgacatccaagcatgcgtgggtgatttcttaaaggctctgattgccatttctgctaatgcacccttggatgatatttccattggtccaaactccttgacgagacagctagcatctcccgaatccattgcaaagctagtcgatatcatgatcaaccaaagaggtgccgcattaaataccacagtttcgattgtcattgagctgataaggaaaaacaattcagactacgatcaagttaatcttttaaccactactataaagactcatccaccttcaaatagagatccaatatatttaggctatctacttcggaaattttcaaaccatttgtccgattttttccaaatcattctagatattgaaaatgacgccaacatcccattacatgaaaatcagttgcacgaaaaatttaaacctttaggatttgaaagattcaaagtggtggaattaatcgccgagttactgcattgctctaatatgggattaatgaattccaaaagggcagaaagaatagccagaagaagagataaagtaaggagccagttatcccatcatttacaagatgcattaaacgatctgagtatcgaagaaaaggagcaacttaaaacgaagcactctccaacacgtgacactgatcacgacctaaaaaataacaacggtaaaatagataacgacaataatgataatgatgatgaaagtgactatggcgacgaaatagacgagagcttcgaaattccatacatcaatatgaagcaaaccataaaacttaggaccgaccccacggtcggggacctattcaaaatcaaactatatgatacgcgaattgtttccaaaataatggaactattcttaacacatccttggaacaatttttggcataatgttatattcgacataattcagcaaatcttcaatggaagaatggatttttcctataattccttccttgttttgtctctgtttaacttaaagagctcctatcaatttatgactgatatcgtcatatcagatgaaaaaggaacggatgtttcccgattttctcccgttattagagacccaaattttgatttcaaaataactacagacttcatattaaggggctaccaggattcatataaattttatgagctaaggaaaatgaatttgggatatatgggccatattgtcttgattgccgaagaagtggtcaaattttctaaattgtacaaagtggaactaatatctcccgatattcaagtaattttacaaaccgaagaatggcaatactactccgaagaagtcttaaacgaaacaagaatgatgtactctaaaattcttggcggtggaagttatattgatgatggaaatggtaacatcattccgcagctgcctgacaatactactgtattaactccaaatggtgatgcaagtaataataatgaaatccttgattcagataccgggagtagtaatggaacaagtggtggcggccaattaatcaatgttgagtctctagaagaacagttgtccttatctacagaatctgatttacacaacaagttaagggaaatgttaatcaatagggctcaagaagacgttgataataagaacacggaaaatggggttttcatactggggccgccggaggacaagaacagtaatagtaacattaacaataccaaccataatagtaataatagtaataacaacgataataacgataataatgataatgacaatgataatactcgtaattataatgaagatgctgataatgataatgattatgatcatgaatga

SEQ ID NO: 45578 - DNA, 537 bp, Saccharomyces cerevisiae
atgatcgatcataaaaaattagagaagaatcaacctgtagttaacgcaaaggcaacctttcacaaggtggcgactaaatctactcctgtggctcgtatcgagaaactacttccagcggtaaaacacatgtatcaaacaagaggccctgctgcgttcgtccagggaacaacagccaccatatttaggcagatagctaacacctctattcaatttactgcatacacagcatttaaacggttgttacaagcaagaaacgacaaggcatcctcagtaataacggggttagccacatcttttacactcgtggcaatgactcagcccattgacgtcgtaaaaacaaggatgatgagtcaaaatgccaaaactgaatataaaaataccttaaattgcatgtatagaatatttgttcaagaaggcatggccacattctggaagggctccatctttaggtttatgaaagtcggtatttcaggaggcttaacgttcactgtttatgaacaggttagtttgttactaggcttctcttccaggtcttga

SEQ ID NO: 45579 - DNA, 801 bp, Saccharomyces cerevisiae
atgaatcacgatcctttcagttggggcaggcccgcagactctacttatggtgcttacaatacacaaattgcgaacgcaggcgcctctcccatggttaatacacagcaaccaatagtaacaggtacttccgtcatatcaatgaaatatgataatggggttatcattgcagcagataatttaggttcatatggctctcttctaagattcaatggcgtggagaggcttattcccgtgggtgataacaccgttgtgggcatttcaggtgatatttctgatatgcaacacattgagagattattgaaagatctagtcactgaaaatgcgtatgacaatcctctagcggatgctgaagaagcgctcgaacccagctatatttttgaatatctagctaccgtcatgtaccagcgaagatcaaagatgaatccactttggaatgccatcattgttgctggtgtacagtctaatggtgatcaattcctaagatacgtaaatcttctaggtgttacgtattcgtctcccaccttggccacaggttttggggcacacatggcaaacccactgttaaggaaagttgtagatcgagaatctgatattccaaagaccactgtacaggttgctgaagaggcgatcgtaaatgcaatgagagttctttattatagagatgcccgttcttctagaaacttctcactggccataattgataagaacacaggtttaactttcaagaaaaacttgcaagttgaaaacatgaaatgggacttcgccaaggatattaaaggctacggtactcaaaaaatttag

SEQ ID NO: 45580 - DNA, 1458 bp, Saccharomyces cerevisiae
atggttcatttaggtccaaagaaaccacaggctagaaagggttccatggctgatgtgcccaaggaattgatggatgaaattcatcagttggaagatatgtttacagttgacagcgagaccttgagaaaggttgttaagcactttatcgacgaattgaataaaggtttgacaaagaagggaggtaacattccaatgattcccggttgggtcatggaattcccaacaggtaaagaatctggtaactatttggccattgatttgggtggtactaacttaagagtcgtgttggtcaagttgagcggtaaccatacctttgacaccactcaatccaagtataaactaccacatgacatgagaaccactaagcaccaagaggagttatggtcctttattgccgactctttgaaggactttatggtcgagcaagaattgctaaacaccaaggacaccttaccattaggtttcaccttctcgtacccagcttcccaaaacaagattaacgaaggtattttgcaaagatggaccaagggtttcgatattccaaatgtcgaaggccacgatgtcgtcccattgctacaaaacgaaatttccaagagagagttgcctattgaaattgtagcattgattaatgatactgttggtactttaattgcctcatactacactgacccagagactaagatgggtgtgattttcggtactggtgtcaacggtgctttctatgatgttgtttccgatatcgaaaagttggagggcaaattagcagacgatattccaagtaactctccaatggctatcaattgtgaatatggttccttcgataatgaacatttggtcttgccaagaaccaagtacgatgttgctgtcgacgaacaatctccaagacctggtcaacaagcttttgaaaagatgacctccggttactacttgggtgaattgttgcgtctagtgttacttgaattaaacgagaagggcttgatgttgaaggatcaagatctaagcaagttgaaacaaccatacatcatggatacctcctacccagcaagaatcgaggatgatccatttgaaaacttggaagatactgatgacatcttccaaaaggactttggtgtcaagaccactctgccagaacgtaagttgattagaagactttgtgaattgatcggtaccagagctgctagattagctgtttgtggtattgccgctatttgccaaaagagaggttacaagactggtcacattgccgctgacggttctgtctataacaaatacccaggtttcaaggaagccgccgctaagggtttgagagatatctatggatggactggtgacgcaagcaaagatccaattacgattgttccagctgaggatggttcaggtgcaggtgctgctgttattgctgcattgtccgaaaaaagaattgccgaaggtaagtctcttggtatcattggcgcttaa

SEQ ID NO: 45581 - DNA, 498 bp, Saccharomyces cerevisiae
atgcaattgttttccatcctctctttgttgtcatcattgatgtgttcattgaccgttttagggtcttccgcaagttcctatgttaagtttcctgttcaaaagtttgctgatattataaatataggcacacaggatgtttctaccgtcttcaaaagaaatgaggttcttaacaccacagtgataaatggaataggagtgtatgttgtcaagatggaaatcggaacgcctccacaaacggtgtacctacagttagatactggctcttcagatatgattgtgaataatgctgacattgcctattgcaaatcgatgtctgacggatctgactacgcttcaactgataattacgaactcacggcaacattcactgggcctcgttctactaccacctcaccagagcttataacactgtccgctcttataggggtaaattcaatgcaagaaactcatctacttttaagaataacgcgactttcttcaatgacatatacgtattag

SEQ ID NO: 45582 - DNA, 1398 bp, Saccharomyces cerevisiae
atgcttgggatcacgtatgccgttaactctacaaagcaattgatattttgctgcctcaaatatctcacactactaggatatattcttttatcaaacaggaaaaaagggcagcgtaccaacatgtataaaagggttattagcatttctggtttattaaagactggagtcaaacgtttttcttctgtctattgcaaaacaaccatcaacaacaagtttacatttgcaacaactaatagtcaaataagaaaaatgtcttccgttactgggttttacattccaccaatctctttctttggtgaaggtgctttagaagaaaccgctgattacatcaaaaacaaggattacaaaaaggctttgatcgttactgatcctggtattgcagctattggtctctccggtagagtccaaaagatgttggaagaacgtgacttaaacgttgctatctatgacaaaactcaaccaaacccaaatattgccaatgtcacagctggtttgaaggttttgaaggaacaaaactctgaaattgttgtttccattggtggtggttctgctcacgacaatgctaaggccattgctttattggctactaacggtggggaaatcggagactatgaaggtgtcaatcaatctaagaaggctgctttaccactatttgccatcaacactactgctggtactgcttccgaaatgaccagattcactattatctctaatgaagaaaagaaaatcaagatggctatcattgacaacaacgtcactccagctgttgctgtcaacgatccatctaccatgtttggtttgccacctgctttgactgctgctactggtctagatgctttgactcactgtatcgaagcttatgtttccaccgcctctaacccaatcaccgatgcctgtgctttgaagggtattgatttgatcaatgaaagcttagtcgctgcatacaaagacggtaaagacaagaaggccagaactgacatgtgttacgctgaatacttggcaggtatggctttcaacaatgcttctctaggttatgttcatgcccttgctcatcaacttggtggtttctaccacttgcctcatggtgtttgtaacgctgtcttgttgcctcatgttcaagaggccaacatgcaatgtccaaaggccaagaagagattaggtgaaattgctttgcatttcggtgcttctcaagaagatccagaagaaaccatcaaggctttgcacgttttaaacagaaccatgaacattccaagaaacttgaaagaattaggtgttaaaaccgaagattttgaaattttggctgaacacgccatgcatgatgcctgccatttgactaacccagttcaattcaccaaagaacaagtggttgccattatcaagaaagcctatgaatattaa

SEQ ID NO: 45583 - DNA, 1461 bp, Saccharomyces cerevisiae
atggttcatttaggtccaaaaaaaccacaagccagaaagggttccatggccgatgtgccaaaggaattgatgcaacaaattgagaattttgaaaaaattttcactgttccaactgaaactttacaagccgttaccaagcacttcatttccgaattggaaaagggtttgtccaagaagggtggtaacattccaatgattccaggttgggttatggatttcccaactggtaaggaatccggtgatttcttggccattgatttgggtggtaccaacttgagagttgtcttagtcaagttgggcggtgaccgtacctttgacaccactcaatctaagtacagattaccagatgctatgagaactactcaaaatccagacgaattgtgggaatttattgccgactctttgaaagcttttattgatgagcaattcccacaaggtatctctgagccaattccattgggtttcaccttttctttcccagcttctcaaaacaaaatcaatgaaggtatcttgcaaagatggactaaaggttttgatattccaaacattgaaaaccacgatgttgttccaatgttgcaaaagcaaatcactaagaggaatatcccaattgaagttgttgctttgataaacgacactaccggtactttggttgcttcttactacactgacccagaaactaagatgggtgttatcttcggtactggtgtcaatggtgcttactacgatgtttgttccgatatcgaaaagctacaaggaaaactatctgatgacattccaccatctgctccaatggccatcaactgtgaatacggttccttcgataatgaacatgtcgttttgccaagaactaaatacgatatcaccattgatgaagaatctccaagaccaggccaacaaacctttgaaaaaatgtcttctggttactacttaggtgaaattttgcgtttggccttgatggacatgtacaaacaaggtttcatcttcaagaaccaagacttgtctaagttcgacaagcctttcgtcatggacacttcttacccagccagaatcgaggaagatccattcgagaacctagaagataccgatgacttgttccaaaatgagttcggtatcaacactactgttcaagaacgtaaattgatcagacgtttatctgaattgattggtgctagagctgctagattgtccgtttgtggtattgctgctatctgtcaaaagagaggttacaagaccggtcacatcgctgcagacggttccgtttacaacagatacccaggtttcaaagaaaaggctgccaatgctttgaaggacatttacggctggactcaaacctcactagacgactacccaatcaagattgttcctgctgaagatggttccggtgctggtgccgctgttattgctgctttggcccaaaaaagaattgctgaaggtaagtccgttggtatcatcggtgcttaa

SEQ ID NO: 45584 - DNA, 2175 bp, Saccharomyces cerevisiae
atgacgaaactattttcaaaggttaaggaaagcatagaagggatcaagatgccatctaccttgactattaatggaaaagccccaattgtggcttatgctgaactaattgctgctcgtattgtgaatgcgttagctcctaactccatagctattaagttggtggacgataagaaagcacctgctgccaagctcgatgatgctactgaagatgtcttcaacaagataactagcaaattcgccgccatcttcgataatggtgataaagagcaagttgctaaatgggttaatctggcccaaaaggaattagttatcaagaactttgctaaattatcacaatcattggaaacactagattctcaattgaacctaagaacctttattcttggcggcttgaagtattctgccgctgatgtagcatgttggggtgctttaagatccaatggtatgtgcggttccatcatcaagaacaaggttgatgttaacgtttctcgttggtacactttgttagaaatggatcccatcttcggcgaagctcacgatttcttgagcaaatctttactagaattaaagaaaagtgctaatgtgggtaagaagaaggaaactcacaaggctaactttgaaattgatttgccagatgccaaaatgggtgaagtcgtcactcgtttcccacctgaaccttctggatacttacatattggacatgccaaagctgccttgttgaaccaatattttgctcaagcttacaagggtaagttgattattagattcgatgacaccaacccatcgaaggaaaaggaagaattccaagactctattttggaagatttggatttattaggaatcaagggtgatagaataacctactcatctgactacttccaagaaatgtacgactactgtgttcaaatgatcaaggatggtaaagcttactgtgacgacactccaactgaaaagatgagagaagaacgtatggatggtgttgcttctgccagaagagatcgttctgttgaagagaacttaagaatttttaccgaagaaatgaaaaacggtactgaagaaggtttgaagaactgtgttcgtgccaagatcgattacaaggctttgaacaagactctaagagatcctgtcatttacagatgtaatctaacccctcaccacagaaccggatcaacttggaagatctacccaacttatgatttctgtgtcccaattgttgatgctattgaaggtgttacccacgctttacgtaccattgaatatagagaccgtaacgctcaatatgattggatgttacaagctttgcgtttgagaaaagtccatatttgggatttcgctcgtatcaatttcgttagaaccttgttgtctaagagaaagttacaatggatggttgacaaggacttggtcggaaattgggacgatccaaggttcccaactgtcaggggtgtgagaagaagaggtatgactgtcgaaggtttgaggaacttcgtcttatcccaaggtccatccagaaatgtcattaacttggaatggaacttgatctgggctttcaacaagaaggtcattgatccaattgctccaagacacactgctatcgtcaacccagttaaaatccacttggaaggctccgaagctccacaagaaccaaagattgaaatgaaaccaaaacacaagaaaaacccagctgtgggcgaaaagaaagtcatttactacaaagacattgttgtcgacaaagatgatgctgacgtcatcaatgttgatgaagaagtcactttaatggactggggtaatgtcattattactaaaaagaatgacgatggttctatggttgccaaattgaatttggaaggtgatttcaaaaagaccaagcacaagttgacttggttagctgatactaaagatgtcgtccctgttgatttagttgacttcgaccatttgattaccaaggacagattggaagaagacgaaagtttcgaagatttcttgactcctcaaacagaattccacacggatgccattgctgacttgaatgttaaggatatgaagattggtgatatcatccaattcgaaagaaagggctactacagattggatgctttacccaaggatggtaagccatatgtcttttttaccatcccagatggtaaatctgtcaacaagtatggtgcaaagaaataa

SEQ ID NO: 45585 - DNA, 3015 bp, Saccharomyces cerevisiae
atggatattaatgaattgataataggtgctcaatcagctgataaacacactagagaagttgcggaaacgcaattgttacagtggtgtgattccgatgcatctcaagtgtttaaagcgctggcaaacgttgccttacagcacgaagcttctctagaatcgagacagtttgctttattgtcgttaagaaaattgatcaccatgtattggagtccaggatttgaatcataccgttctacatcgaacgtcgaaatagatgttaaagattttatccgagaagtgctactgaaattatgcttaaatgacaatgaaaataccaaaataaaaaatggtgcatcttactgtattgttcagatatctgcggttgattttcctgatcaatggccgcagcttttaacagttatttatgatgctatctctcatcagcattcattaaatgcgatgtctttattgaatgaaatttacgatgatgtcgtatctgaagaaatgttctttgaaggcggaattggcttggcgacaatggagatcgttttcaaagtactcaatacagaaacttctactttgatagccaaaattgctgctttgaagctacttaaagcatgtcttctacaaatgagctcccataatgagtatgatgaggcgtcacgaaaaagttttgtctcccaatgtttagctacttctttacagatattgggacaattgttgactttgaattttggaaacgtagatgttatttctcagttgaaatttaaatccattatatacgagaatttggtttttattaaaaatgatttctctagaaagcatttctcaagtgaattacaaaaacagttcaaaataatggcaatccaagatctggaaaacgttacccatataaatgcaaatgtcgaaactactgaaagtgaaccccttttagaaacagttcatgattgttctatttatattgtagaatttttgactagtgtttgcactttgcaatttagtgttgaagagatgaacaaaattataacatctttaaccattctttgtcagctaagttctgagacaagagagatatggacaagcgatttcaatacatttgtatcgaaggaaacaggcctagcagcatcatataatgttagagatcaagccaatgaattttttacttcattacccaatcctcaactttccctaattttcaaagttgtttccaacgatatagaacacagcacgtgtaattattcaactttagaatctttactatatctcttacagtgtattttgcttaatgatgatgagataactggtgaaaatatcgatcaatctttgcaaattttaataaaaacgttagaaaatatcttagtatcacaagaaataccagaattaatattggcgcgtgcaattttgactattcccagagtactagacaaatttatagatgcattacctgatatcaaacccttgacatctgcattcttggcaaaaagtcttaatttggcgctaaaatctgataaagagctcattaaatccgcaacattaatagcatttacgtactattgttattttgccgaactagattcagtccttggaccagaggtctgctcagaaacccaggaaaaagtaattcgaataatcaaccaggttagtagtgatgccgaagaggacactaatggggctttaatggaagtattaagtcaagtcattagctacaatccgaaagaacctcattcaagaaaggaaattttacaggctgaatttcatcttgtgttcacgatctcatccgaggatccagcaaatgtacaggtcgttgtacaaagtcaagaatgcttggagaaactattggataatatcaatatggataattacaaaaattacattgaattatgtctcccatcatttattaatgtgctagattccaacaatgcaaacaattatagatactcacccctgctatcattagtcttggaattcatcacagtttttttgaagaaaaaacccaacgatggatttttaccagatgaaataaatcaatacctatttgaaccattagcaaaagtattagcgttctctactgaagatgagaccctacagttagccacggaggcattcagctacctgattttcaacacagatacacgagccatggagccaaggttaatggatatcatgaaggttctagaaaggctgctgtctttggaggtatcggattcagccgctatgaacgtcggtccattggtagttgccatattcacaaggttttcaaaggaaatccaaccgttaataggaagaattttggaagccgttgtggtaaggttaattaagacacaaaacatttctactgagcaaaaccttctttctgtattatgcttcttaacgtgtaatgatcctaaacaaacggtggattttttgtctagtttccaaattgacaatactgatgctttgacattggtgatgcgaaaatggatagaagcctttgaagtcattagaggtgaaaaaagaatcaaagaaaatatcgttgctttgagcaaccttttcttcctgaacgacaaaaggctacagaaagtggttgtcaatggtaacttgataccatacgaaggggacctgatcattacaagatcaatggctaagaaaatgccagacaggtatgtacaagttccactttataccaagatcattaaattgtttgtttctgagttaagcttccaaagtaaacaaccgaatccagaacaattgatcacaagcgatattaagcaagaagtggtaaatgctaataaagatgacgacaatgatgattgggaagatgtagatgatgtactcgattacgataagttgaaagaatatattgatgatgatgtcgatgaagaagcagacgacgattcagacgatataacgggactcatggacgtgaaggaatctgttgttcagctactggtaagattctttaaagaggttgcaagcaaagatgtgagtggcttccattgtatttacgagactctatccgacagtgaacgtaaagttctttcagaagcccttttgtag

SEQ ID NO: 45586 - DNA, 852 bp, Saccharomyces cerevisiae
atgcggcaaaataagcgccgtctatataaaagaaagaaagtgttaaataaactgaccacagaaggtggcaaaaataatacgagatttagaagtcagataatggacccgattggaataaacaaagtcttggaccatttagcaccctcagagcttatcaaacctgttaagagttgccataataaaccttcagtgttggtgttggatgacaggattgtggatgcggcaaccaaagatctctacgtgaatgggttccaagaagagattcagtatcagaatcctacaccggagaacttgcaacatatgttccaccaaggtattgaaatattggattcggcaaggatgatcaacgtgacacatttagcgctttggaagccttcttcttttaagttggggaatcctgtggactttgctctagatgataactacgatacgttttggcagagcgatggagggcaaccacaccaattggacattatgtttagtaagagaatggacatctgtgtcatggcaatattcttttcgatgattgcggacgagtcctatgctccaagcttagtgaaagtttacgcggggcatagtccttctgatgcgaggttttataagatgcttgaagtgagaaatgtgaatggctgggtggcactaaggtttctagataatagggaggacgaccagctgctgaaatgtcaattcatcaggcttttgtttccagtcaaccatgaaaacggaaaagatacacatctgagaggcataaggctatatgttccatctaatgagccacatcaagatacccatgagtgggcacagaccctcccagaaactaacaatgtcttccaggatgctatattacgttaa

SEQ ID NO: 45587 - DNA, 2409 bp, Saccharomyces cerevisiae
atgctcaacattctcgttttaggaaacggtgcaagagaacacgttcttgtcaccaagctggctcagtcacccaccgtgggtaagatctatgtcgctccaggtaatggagggaccgcaaccatggatccttcgcgtgtgataaactgggatattacgccagatgtcgccaattttgctcgtttgcagtcgatggctgtggaacataagatcaacttggtcgttcctggtccagaattacctctagtcaacggcatcacctccgtgttccatagcgttggtattcccgtttttggaccttccgtcaaagccgctcagttggaagcttccaaggctttctccaagagatttatgtcaaaacacaatattccaaccgcgtcttatgatgtcttcactaatccagaagaagccatttcattcttgcaagctcatactgacaaagcttttgtcatcaaggccgacgggatcgctgctgggaaaggtgttattatcccatctagcatcgacgagtccgtccaagctatcaaggacataatggtcaccaagcaattcggtgaagaagcgggcaagcaggttgtgatagaacaattcttggaaggtgatgaaatctctctactcaccattgttgacgggtactctcacttcaatctccccgtcgcacaagatcacaagaggatctttgatggcgacaagggcttgaacaccggtgggatgggtgcctatgcccccgctcctgtggccacaccatctttgttgaagaccatagattcacagattgtgaagcctacgattgatgggatgagacgtgatggtatgccctttgttggtgtgctgttcaccgggatgattttggtgaaggattctaagacaaatcaacttgttcccgaagtgttagaatataatgtcagattcggtgacccagagacacaggctgttttgagtttacttgatgatcaaaccgatttggcgcaagtgtttttggctgctgctgaacatcgtttggattccgtaaacataggaatcgatgacacaagatctgccgttactgtcgtagtggctgcaggtggttatcctgaatcatacgccaaaggtgacaaaattaccttggataccgataaattacctccacatacacaaatcttccaagcaggtaccaaatacgattccgccaccgattctttattgaccaatggtggtagagttctttctgtgacctccactgctcaggacttgagaacagcagtagatacagtatatgaagccgtcaaatgcgtccatttccaaaattcttactacagaaaggacatcgcataccgtgcgttccaaaactcagaatcatcaaaagttgccatcacatacgcagactcaggtgtctctgttgataatggtaacaatctcgtacaaactatcaaagaaatggtcagatccacaagaaggccaggtgcagactctgatattggtggttttggtggtttattcgatttggctcaagcaggtttccgtcaaaacgaagataccttactagtaggtgctacagatggtgtcggtactaaattaatcattgcccaagagaccgggattcataatactgtcggtattgacctggtggccatgaatgttaacgatttggtggtacaaggtgctgagcctctattctttttggactactttgccactggtgctcttgacattcaagttgcctctgattttgtgtccggtgttgctaatggttgtattcaaagtggttgtgctcttgtgggtggtgaaacttcggaaatgcccggtatgtatccacccggccactacgatactaatggtaccgctgttggtgctgtattaagacaagatatcttgcccaagataaatgaaatggccgcaggagatgttcttctgggtctcgcctctagcggtgttcattctaatggtttctctttggttagaaaaattattcaacatgtagcattaccatgggacgctccatgtccatgggatgaatctaagacgttaggtgaaggtattcttgaaccaacaaaaatttacgtcaagcaattattgccatcaattagacaaagactactactaggtttagctcatataacaggtggtggtttagtagagaatatcccaagagctattccagaccacctacaggcccgcgttgatatgtcaacctgggaagtaccccgtgtcttcaaatggtttggtcaagcaggtaatgttccacacgatgacattttaagaaccttcaacatgggtgttggtatggttttgattgtcaagagagaaaacgtcaaggctgtttgtgattcattgactgaagaaggtgaaattatttgggagcttggttctttgcaagaaagaccaaaggatgctcccggttgtgtgattgaaaacggaactaagctttactaa

SEQ ID NO: 45588 - DNA, 2733 bp, Saccharomyces cerevisiae
atggaccaagaaggccagccattgctttcaaaagattttcagcaggttttactggctactgcatccggaaacaattcatcgtggacagaaagggctgttctcaacaatgaaagtacagatgcagtgaaacacgaacctgcgctgggccaaaatgatgtgtttgatttagatcctttatcctttgataagtgggtaccttttttaagaagggctcttgataaaaatcaattggaccccgtaattgatgaattggaaaattcaattgaggataactttcaaggtctggaattgcaattattacaagattcccaaatgaatgataagctggaaacatctatagacgaaattgcaaacatccaaggtatggtgcaagacactttatccagtgaaatttccaaatttcaaataagattgagtgaatcagctaatgaactaattgtcaagaaacaaatgtatgttaataacaaaaaaatttcactaaaaatttcagaagcaacaattttaatcactaaggttgttagaatcttggaattatccagcaaatgtcaagaattgatcaccgaaagaaagtttttcaaagttttacaaaacttggatagtctggagaaattgtatctacaagaatttaagaattataatttccaatttttaattgaaatttacaattctataccatttttacagaaagtcaccaaggatgagtgtataaatttgataaggaattctctaaatttaaatttagggaagaacttgataaaagtggggcaagaattcgtggcaatttatgagaatgaattacttccgcaatggctcgaaacgagatctaaaatgaagttgacaaatttcaaatttaattcgcctatagagatctccatgagagatgaatcctttctagcaaagctaaacttgggtgaatttttccagttagatgactttcacgattctataatgatttttcaaaacttaaatgagttgagcgtcctctctggagagtttaacaaagaatatgaactgagaaagacaaaactaatgtatccattgatatggaagaagaataaaacagctgcatatcaaatggattcgttattacggggtacaggtactactcctggatcaaccgcgcatgacgtttccacagatgatcctttcacacaaagtctaagtttacactttttgcaggattactttttgaaaattctcggcttcttattatatgatattaatttgaataaagctacagaatttatcctcgttgataataactataattctacaaatgaattttgggatggactcatggacaggttgtcaccatatttgagttatttcatagatgagaagctgaaaacagaagaagacatgattaaattgaaagattttctttgtatttatgttgccattttagaaaatttcaaactgaacatcgaacctttatataaaattttggtttcaattttcgagaaattctgctctgtttccttgagagcttttgacgatgaatttcaaatcttgttaaacgatgatgattttatgcctttatccattaatgacaagacattatatgagaaagttttgaagatttgctggatgaaggagggcgaacacctttccctgccagatccaaccaacggagagccatttgctgtgactttgcctttttctccattatacccaatgacgtgtacacttgctaagaaaacatattctaaaataaccgcatttctttccatattttatcgtcatgagctacacactttgaataatattttggtcaaaacaatggacgatatatttaatgatatcgtcaataaaaaaattcgttctaaacttgaaagtacgtcgagagaagaaattgcacaaatcttagtcaatttagattattttatcatagcagcaaaagaatttagtaacttcatgacaagagagaatattttacaaaacccggatatggaaatacggttatcctcgataaaatatcttgcggaaagcagaaaattggcagaaacaaagttaattgaattaatcgattctaagatatcagatattcttgaaactattgaaattgactggcaaataacggaggtaaggcaagacccggatatctccatcattgatctggcacaatttttagaaatgatgtttgccagcacgctacaaaatttaccatacagcgtccaaacattattgattttccgtgaatttgactccttgacgagacaattcatgggtctattattgcatgacacaccaagtacaattacacatgaaagcataatgaattttgaagttgatgtcaattatttagagagcattattcccagaattttcccctctacaccaggtactatagatagtaatggataccagtcgccaatgaccccttcgacgcctacatttccaaatgccaacggtgttgacgcaccaacattatttgaaaataatatcaaatcgctagaagctacatttatggagttgaagcagtgtatagagttattaaagactcagggaaaagattataatgaaccagaaataagattaagaaaatattcaagaattagacaggaagatgcggctcttttgttgagcaagattcagcacttcgtctcatctgtagaaggagctaacggcgatgacactagcgtaatggatagtagcagcatattcaactctgaatcagcgagtgtcattgactctaatacgagtaggatagccaaattttttaatagacgttaa

SEQ ID NO: 45589 - DNA, 2457 bp, Saccharomyces cerevisiae
atgtcactatggccctttggagagacgctgagtcattccggaattgattcgatacttgaagagtactatctaatttttcgtagtttggagggaaatgagacctcttcaactgacgacaagaagaatgagccttctatggagtcagagtccgaatttggtaccgagtctcgggataggagtgaccttaaccagtcatttattgataggatcttgttggaaacagctttgctggatgaactgaatggagcagccaacgacagactcgtcgacttcatttgcttgggatatttctatgacgaccgttcccagcaggtccgccacatggactacctagtggacatgttgatggcttacctgaaggacatagaccgcactggttatagaaccccatttcttttagagaattcattccatcaaacaggtgaatatgaagatcaggacgatgaagacccaatgctgtatgtcaacattatttccagtattttttgttcgaaaagtgcgcccatagtggaggcactcgtgcaaaataccccatttttgtcctctctgttcgaggttttccagtttgaaaatattgaggcagaaaattgtcctatcttggctgttttccttaagattaacgaaactcttctgtttgaacagacatctagctatttggaatttttcaaatcgcaaccgaacattgtggacaagttcttatatcatattgaagtctcacccttggttgaatttctcattaaaatcatgctgactgatcaagttgaatcacctacgaacattattgacttcttgtatcaccaggatctgatacctaagtgtttgaatctcttggaaaatagcaaatactcacctggtattcaaaacagtagcggagagcttctaaaagcactgatcagcatttccaccaattttaaactggatactttgtggatcggacctaaccgattgacaagacagcttgcctctccgcaatatgtcgaccaacttattaatataatcttatttcaaagaggccatgcaatgggagttgccgtatctattataattgagttgatcaggaagaataattccgactatgacgaagtagatttgttaagtaccaccatagtagacaatccgccttctcaaagagatccagtctatttgggccatttgttatatgagctcactatgcatatggaagatttttatgcattactaattaaacttgaaaatgatgatgacgatgatcatgacactgcttcaaaagctcttccatctgttaagcatcacctactagaaaaccaattgcatgaatcattcaggcctttgggctttgaaagagtcaagattacagaattgatatcggaaatgttacactgttcaaatatgggattgatgaattcaaaaagaggcgaaaaaatagcacgtaccagagataaatgcagggacactcttgatcaaaactcactagagaaagccatgaaaaatttaaatataaatgataatactattacttccaatacattagaagataaatgtaataataatgatagtaatgacagtaatgacaaccaaaaacaaaaaaaaaatattaaaaaaaagtttcatgataatgaattgtattctacttttgatacatctgatgacaatattgatgatgatgatgatatgagttttgaaattccttacgtcagtgaaacgcaaaatttgaaaatacgtaaaaaccctaccattggagatttattcaaaattaaacttcatgaccttgggttttttccaaagtttctacaattattcttaagatatccttggaataacttttggcacaacattgtatttgatattattcagcagatattcaatggtcgaatggatttttcttataactcatttttggtctattctttgtttgatttcaaaaagtctacaagatttatcccaaaacctttgtacggcagcaaccaaaagttacctgttaaagacttccatattatctctgatttcattttacaaggccacaaggattcgtttgaattttacgaaaaagagaaaacaaatttaggttatatgggtcaattagtattaattgccgaagaaattgcgaagtattccaaaatttataagaccgatctaattgctccagatatatatgccttcttacaagatgaagtttggatgtcatattctagtgacatcttgaacgaaacaaggacaatgtgttcaataattcttggtggaggccagttctgtgccgaaagcgatgaaaatactaaccaggactttttggaaaaagctgatatgagtaaaccagctcatccatccacaatggatgagaatgaaattgttcacgaggaggatgttaagttgcatgataaagttgccgagctcatagatgaattgggtcaattaaccgaattagatattcatgataaaattaaagatgttattgttgatcatcattccgacttaaattga

SEQ ID NO: 45590 - DNA, 2418 bp, Saccharomyces cerevisiae
atgaacgtgcctgaaacaagacaatcctccatagtcgtagctataagagtaaggccctttacgtcaatggaaaaaacaagattggtcaatgaagctagtggtgcagaagctaactttcccggtttgggggattcgtcgttaatattacccatgagtaataactccgactccgatatagacatagacgctgaagaaggttctacgcggagcaaaagaaatagcttgctgaggagaaaagtaattagaccggagggtatacgtaaaattgtggattgtgtggatgatagaatgctcatattcgacccagctgatagaaacccattgaacaaagtgagtgatcaggtcctgaactcgatgcgtgcaagggccactaaggccactgcgtcctctatcaataacagcaatgctacgaacaaattttcttcgcaacgtcgaaggcacggtggcgaaatcaagtttgtatttgataaattgtttgatgaaacctcttcccaagcccgtgtatacaaagagaccaccagcccgctcctagattctgttttagatggattcaacagtaccgtatttgcttacggtgctactggttgtggcaagacatatactgtgagtggcacaccttcacagccggggatcatatttctagccatggaggaactattcaataaaattacagacctgaaggacgaaaaagacttcgagatttcactgtcttacttggaaatatacaatgaaagaatcagagaccttttgaaaccagagacaccatctaaaagattggtcattagagaagatacgcagaaccacatcaaagtggcgaatttgtcgtatcaccacccaaatacggtagaagatgtgatggacttagttgtccagggaaacataaacaggactacgtcaccgacggaagcaaacgaagtatcttcacgatctcatgcagtgctgcaaatacacatcatgcagacaaataagcttgtagacttgacctcgcaacatacatttgctacactttcaataatcgatctagctgggagcgaaagagccgccgcaacaagaaaccgtggtataagattacacgaaggtgcgaatataaatagatccctactagcactgggcaattgcattaacgcgttgtgcttgaatgatggcagcagaagctgtcatattccatacagggattccaagttaactaggctgttgaaattttcactgggtggcaattgcaaaacagtcatgattgtttgcatatcgcccagcagttcacattatgatgagacattgaatactttgaaatatgcaaatcgtgctaaagaaataaagaccaaaataatcagaaatcagcagtctttgagtagacacgttggatcttatttgaaaatgattacggaacaaaagcgacaaatcgaagagttacgcgaacgtgaagagaagatgatttctttgaagctaacgaaatacaaactaaacaaagaaaagatccagttagccattaacgagtgcgtcaatcgtgttcagcaaacgtatgcaggagtggaaacgtatcaagtagccaagaccttgaaatcattaatactttgtaaaaggcggtttttgcaaatggtcaagctagaagtggataatttgatactattatttgaacgggaggaaagtacagccgccgagatgcagccggtgattagtaattgccgaatgatcagtggtcagctttataacaaaatacacgagttagaaatgaaatttgatgaaaccgacactctgagttccgtcattcatcaggtacattccattgacttgaacaagttaagagagatggaggactgggatgaaacttacgacctggtgtacttggagtcgtgtttaaatcaaatatcagaattacaaagaaacgaaatcttggttaattcctccataatgacagaaaaattaatgtcagatccgggtttgaactcccgatttaaatttctatcaaagtggctgatgaataggacacctaacattgaatccataattcaagacctggttcatatcgacgaggagtttgaatcttttgccagaacttttatcgccaatcccgatagcaattttacaaacacaaatataaatataataaacacgacggcagctgacttggctgttcccgctgagaccctacaacggcaaaatttttcccaaaaaaaagtaaagtggacgagtcccgaccttagtcccagccctatgattgaaccacaaccggagctagaaccagaactacaccaagatcaagacgccattgcaagtgaagtggacgtaagtatgcaagataccacattcaatgagcaggggccctcgaccccctccgctccgactacagcggttccaagaaggaagatgcgctcctcccttcttactcatcaaagtctactggccactgccaggaaataa

SEQ ID NO: 45591 - DNA, 1359 bp, Saccharomyces cerevisiae
atggctaatactttcaagtattatcctgaaacgatgggtaattctagtggttatccaattagtttgccttttccgaaaggttcggctacttctgctgttaatgttgctaggcaactgcctaaatatttaggtcatgttccctcgcaatcagttcatactcagttgccatccatggcttctttaggttacttcaatcagccaagttctacttactatgctcctcctgcaccacttcaacagcaccagcaaccacctatccttccccctccgggcctaatgtacactagtaacaataacagcaacgttattcctcctcctgttcaaatgattcgggatggacaacaacaaccacaacaatctaaccaagtaaatgggggcgtcagtgagaacttggactacgatatttctataatgtcaaaatttatcatggaaaatgcctttgttgccttcaacgcgaactatagtactgatgaccagaccactgatctttttttcaagggcatatcttctgtgttgaatgccacgagattgccttcagctactatttttttggctatagattatcttttcaagtatatcaataaattatctaatgggatacattcaattggtggcaattcgatcaatatcatttatcaaaatactatgattgcgttcatattagcaaacaagttcaacgatgacaaaactttcaccaataactcatggtcacaggcaacaggaatactgataaatgttatcaatgatttcgagagacaatggttgagaatatttaactgggaattgtatgatagtgcttttctttattttgagttcgtcaagaattttgagattttcaagcaaaatcaactcaaacctgctgtagcggttcctacgttattatctccaattgtcaacgttggtgatacgagaaacgtaaatttcaacttgaagcctacttccacaaacaacctattatctccagtttccaattatgaaacccccatgctgatgccgcataacatgttttcatcaccatcttatcagagtaactcaaggtctgaattttctagtatgaatggttattataactattacaactataatcagccaagattgaattactatcaacaattccccaatatatattcttcaccaatttcggaaactcagtttgattacgacttctacaatttcagtagtcaacaacaacagcaacaacaaaaacaacactcacttttacctgccgctccacaattacctccccctcacgtccataatcagtcttacggtcatcatcttggctggaagtcaatggatgacacaataaatcattcaagatttgagcgaaactactttccgtattcggcagtgtattag

SEQ ID NO: 45592 - DNA, 669 bp, Saccharomyces cerevisiae
atgagcaacgaagattacggatacgactacgattatttatttaagatagttcttatcggcgactccggtgtgggtaaatctaatctgttgtcgagatttacaaccgatgaattcaacattgaatccaaatccacgattggcgtggaattcgctacaagaaccattgaagttgaaaacaagaagataaaagcacagatttgggacacggcaggtcaagaacgttacagggccatcacgtctgcgtactaccgtggtgctgtaggtgcacttatagtgtatgatataagcaaatcaagttcatacgaaaattgcaaccactggcttaccgaactgagagagaacgcagatgacaacgtggctgttgggttgatagggaacaaatcagatctggctcatttaagagcagtaccaaccgatgaagcgaaaaatttcgcaatggaaaaccaaatgttatttactgagacaagtgctttaaatagtgataatgtagataaagcatttagagaactgatcgtagccatcttccaaatggtaagcaaacatcaagtagacttaagcgggtcgggtaccaacaacatgggctctaatggcgctccaaagggtcctaccatcagcttaacaccggcaccaaaggaagacaagaagaaaaaatccagcaactgttgttaa

SEQ ID NO: 45593 - DNA, 804 bp, Saccharomyces cerevisiae
atgatacaccaaccaataccgcaagtcctaccagcaaatatggccataaatgttcaggcagtaaatggaggtaacattatacacgctcccaatgcggtgcacccaatggtgataccaatcatggcccaaccagcccccattcatgcctccgctgcatctttccagcctgcaacttctcctatgccaatttctacatacactccagttccatcgcaatcattcacctctttccagagctctattggctccatacagtcaaatagtgatgtttcatctatcttctcgaacatgaatgttcgcgtaaacactccacgctctgtgccaaactctccgaatgatggatatttacaccagcaacatatcccacagcagtatcagcatcaaactgccagcccttctgttgccaagcagcagaaaacttttgcacattctcttgcatctgcattatctaccttacaaaaaagaacgcctgtaagtgccccttccaccactatagaatcaccatcctcaccaagtgattccagtcatacctctgcatccagcagcgctatctctttgcctttcagcaatgctccttctcagctcgccgtggccaaagaacttgagtccgtctatttagattccaatagatacaccaccaagactaggagggaaagagcaaaattcgaaattcctgaagaacaagaagaagataccaataacagcagcagtggtagtaatgaggaggagcacgagtcgctagatcatgaatctagcaaaagccgaaagaaattgtcagggcgtaaaattgccgcctgtacgtaa

SEQ ID NO: 45594 - DNA, 3108 bp, Saccharomyces cerevisiae
atggaagagctgaatattgattttgacgtatttaagaaaaggattgaattgttgtattccaagtacaatgagtttgaaggttctccaaattcgctgctgtttgttttaggttcgtccaacgctgaaaacccgtaccagaagacgaccatattgcataattggttgctaagttacgaatttcccgctactttgattgcattagttcccggaaaggttattataattactagttctgccaaggccaagcatttacaaaaggcaattgatctatttaaagaccctgaaagcaaaattacgctggaattgtggcaaagaaacaataaagaaccagaactcaataaaaagttatttgatgacgttattgccttaatcaatagcgctggtaaaacagtgggtatccctgaaaaggactcttaccaaggtaaatttatgactgagtggaacccagtatgggaagcggctgtgaaggagaacgaattcaatgtcattgatatttcgctgggtctttctaaagtttgggaagtgaaggatgttaacgaacaagccttcctgtccgtttcaagtaaggggtcggacaaatttatggaccttttatccaatgaaatggttcgggcagttgacgaggagttgaaaatcaccaatgccaagttatcagacaaaattgaaaataaaattgatgatgtgaaatttttgaagcaattgagtcccgatttaagcgcattatgcccaccaaactacaaattcaactttgatttattggattggacctattctccaatcattcagtccgggaaaaagtttgatcttagggtttctgcccgttctaccaatgatcagttgtacggcaacggttgtattttagcttcatgtggtattcgttacaataattattgttctaatattactaggacctttttgatcgatccatctgaagaaatggccaacaactacgattttctattaactttgcaaaaagaaattgtaactaacattctgaagcccggccgtacaccaaaagaagtttatgaatcagtaatagaatacatcgaaaaaaccaaacctgaactagtgcccaatttcaccaaaaacattggttcattgattggtctcgaatttagagattctaactttatattaaatgttaagaatgattaccgtaaaatccaacgcggtgactgctttaatatttcgtttggtttcaataatctgaaagattctcaaagtgctaacaactacgctttacaattagctgatacggttcaaattcctctcgatgaaacagagcctccacgcttcttaacaaattacaccaaagccaaatcccagatatcattttatttcaataatgaagaagaagacaataataaaaagaaatcttcacctgccaccaaagtccctagtaaaccagacagaaattccaaaattttaagaacaaagttacgtggcgaagcccgtggtggtgccgaagacgctcaaaaggagcaaattcgtaaagaaaaccaaaagaagctacacgaaaaattggaaaagaatggattactcagatttagtgctgctgatgccaatggcccagatagtgaacctcgtcaatacttcaaaaaatatgaatcttatgttcgggattcacaactaccaaccaatattcgtgatctaagaattcatgtcgactggaaaagccaaacaattattctacccatttacggtaggccagtcccatttcatataaattcatataagaatggttctaaaaacgaagaaggcgaatatacgtatttacgtttgaactttaattcaccgggatcttctggtggtatttctaaaaaagtggaggaattgccgtatgaggaatcagcagacaatcaatttgtacgttcgattacactaagatccaaagatggtgaccgcatgagtgaaacctttaaacaaattgcagatttgaaaaaagaagccacaaagagagagcaagaacgtaaggcgcttgctgatgttgttcaacaggacaaattgattgaaaataaaactggaagaacgaaaagactggatcaaatttttgtgaggccaaatccagatacaaaacgtgtacctagtactgtctttatccatgaaaatggtatcagatttcaatccccactaaggactgatagcagaatagacatattattctcaaacattaagaatctaatttttcaatcttgtaaaggtgaattaattgtcgtcattcatattcatttgaagaatccaattttaatgggtaaaaagaaaatacaagacgtccaattctatcgtgaagcttctgatatgtccgtcgatgaaactggaggtggaagacgaggtcaatccagattcagaagatatggtgatgaggatgagctggaacaagaacaagaagaaagaagaaaacgagctgcgcttgataaagaatttaagtattttgcagacgcaatcgcagaagcatcaaacggtttattgacggtggagaatacatttagagatttgggcttccaaggtgtcccaaatagatcggcagttttctgtatgccaactacagattgtttagttcaattgattgaaccaccatttttggtgattaacctagaggaagtcgaaatctgtattttagaaagagttcaatttggtttgaaaaacttcgacatggtttttgtttataaagatttcaataaacccgtcactcatatcaatacagttccgatcgaatctttagatttcttgaagcagtggttaacagatatggatattccttacactgtctcaacaatcaatttgaattgggcaactattatgaagtcattacaagatgatccatatcagtttttcttagatggtggttggaattttctggctactggttcagatgatgaagcatctgatgaaagtgaagaagaagttagtgaatatgaggcttcagaagacgacgtaagtgatgaaagcgcattttctgaagatgaagaaggatcagaggtggatgacgatattagtggtgatgaaagtgaggactatactggcgacgagagtgaggaaggtgaagactgggatgaattagagaaaaaggctgctagggctgataggggtgcaaactttagagattag

SEQ ID NO: 45595 - DNA, 2247 bp, Saccharomyces cerevisiae
atgacgagacgtactactattaatcccgattcggtggttctgaatcctcaaaaatttatccagaaagaaagggcggattcgaaaatcaaagttgaccaagttaacacatttttagagtcatccccggagaggagaactctgacgcacgccttaatagaccaaatagtgaatgatcctatattgaaaactgatacggactattacgatgctaaaaaaatgcaagagagagaaattactgccaaaaaaatagctaggcttgctagttatatggagcacgatatcaaaacagtgcgcaaacactttcgcgacactgacctgatgaaagagttgcaagcaaatgatccagacaaagcttcgcctttaacaaacaaagacctttttatattcgataagagattgtcacttgtagcaaatattgatcctcaattgggtacgcgcgtgggtgtacacttggggctatttggtaattgtatcaagggcaatggtactgatgagcaaatccggtattggttgcaggagagaggtgccactttgatgaaaggtatatatggctgttttgcaatgactgagttaggacatggttccaatgttgcccagctgcagactagggctgtgtacgataagcaaaatgatacttttgtaattgatacacctgatctaactgccaccaaatggtggattggtggggctgcccattctgccacgcacgctgccgtgtacgccagattgatcgttgaaggtaaagactacggtgtaaaaacattcgttgttcctctgagagacccttcgactttccaactgttagctggtgtttccataggggatattggagcgaagatgggtcgtgacggtattgataatggctggatccagttcagaaacgtagttatccctagagaatttatgctaagtagatttaccaaagttgtccgttctccagatggttcagtcaccgtcaaaactgagccacaattggatcaaatttctggttatagtgcattgttaagtggtagagttaacatggtcatggattcatttaggtttggctccaaatttgctactattgctgtacgttacgcggttggtcgtcagcaattcgcacctagaaagggattgtctgaaacacaattaatcgactatccccttcaccaatatcgtgttttaccacaattgtgtgttccatatttggtgtcacctgtagcttttaagttaatggacaactattattccactttggacgagttatacaacgcttcctcatctgcatacaaagctgctctggttaccgtgagtaaaaagttgaagaatttatttattgatagcgccagcttgaaagccaccaatacttggttaattgctacactgattgatgagttgagacagacttgcggaggacatgggtattcacagtataacggatttggtaaaggctatgacgactgggtggttcagtgcacatgggagggtgataataatgttttatctttaacttcagcaaaatcaatattgaaaaaatttatcgattcagccacaaagggtagatttgacaacacactggatgtggactcattctcttacttaaaacctcagtacataggatctgtggtttctggagaaataaagagtggtttaaaggagttgggtgattatactgaaatttggtctatcaccttaatcaaattactggcacatattggtactttagttgaaaaatcaagaagtattgatagcgtttctaagcttttagtcttagtatccaaatttcatgccttgcgctgcatgttgaaaacctattacgacaagttaaactctcgtgattcacatatttccgatgaaattacaaaggaatctatgtggaatgtttataagttattttccttgtattttattgacaagcattccggagaattccaacaattcaagatcttcactcctgatcagatctctaaagttgtgcagccacaactattggctcttttgccaattgtgaggaaagactgtataggtctgacagactcctttgaattacctgacgcgatgttaaattctcctataggttactttgatggcgatatctatcacaattacttcaatgaagtttgccgcaataatccagtggaggcagatggggcagggaagccttcttatcatgcgctgttgagcagcatgctcggtagaggtttcgaatttgaccaaaagttaggtggtgcagctaatgcggaaattttatcgaaaataaacaagtga

SEQ ID NO: 45596 - DNA, 2190 bp, Saccharomyces cerevisiae
atgttttacaataggtggctcggaacgtggctagccatgtctgctttaataaggatctcagtatcccttccgtcatctgaggagtacaaagtggcatatgagctgttgccagggttatctgaagtgccagacccttcaaatattccacagatgcatgctggccatattcctttacgttccgaagatgcggatgaacaggatagctctgacttggagtactttttttggaagtttaccaataacgactctaatggcaatgtcgaccgtcccttaattatatggttaaatggtggacccggttgctcttccatggatggtgccttggtcgaatccggcccttttagggtgaattcagacggtaaactttatctaaatgaagggtcctggatatccaaaggcgatcttttatttatcgaccaacctactggtactgggttttctgtcgaacaaaataaagacgaaggtaaaatcgacaaaaacaaatttgacgaagacctagaagatgtgaccaagcattttatggattttctggagaactatttcaagatttttccagaagacctcactaggaaaatcatactatcgggtgaaagttacgctggccaatacataccattctttgccaatgcaattttgaaccataacaaattttcaaagatcgacggggatacatacgacttgaaggcgctattgattggtaacggttggattgaccccaatacacagtccctatcgtaccttccgtttgctatggagaagaaactgattgatgaaagcaaccccaatttcaaacacttaacgaacgcacacgagaattgccagaatctgataaactctgccagtacagatgaggcagcccatttttcgtatcaggaatgtgagaatattttaaaccttctattgtcttataccagggaatcttcgcaaaagggaacagcggattgcttgaacatgtataacttcaatttaaaagatagttatccatcttgtggtatgaattggccgaaagatatttcctttgtcagtaaattcttcagcacacctggtgttattgattcgttgcatcttgattctgataaaattgatcattggaaggaatgcactaatagcgttggaactaaattgtctaatcctatttcaaagccatctatccatttattacctggtctacttgaaagtggaatagagattgtcttgttcaatggtgacaaagacttgatttgtaataacaagggcgtattagatactatagacaatctaaaatggggtggaataaagggatttagcgacgatgctgtttcgttcgattggatccataaatcgaagagtacagacgacagcgaagaatttagcggatacgtgaagtatgatagaaatttgacgtttgttagcgtttataatgcttctcacatggtacccttcgataaaagtttagtgagtagaggcattgtcgatatttactcgaacgatgttatgatcattgacaacaatgggaaaaatgttatgattactactgacgacgatagtgatcaagatgctactactgaaagcggtgataagccaaaagaaaacctcgaagaggaagaacaggaagcgcagaatgaggaaggaaaggaaaaagaaggcaataaagataaagatggcgatgatgataacgacaatgatgacgacgatgaagacgatcacaactccgagggcgacgacgatgatgacgatgacgatgatgaagacgataataatgaaaaacaaagtaatcaaggcctcgaggatagtagacataaatcttcagaatatgaacaagaagaggaagaggtagaagaatttgcagaagagatttcaatgtataaacacaaagcggtagtagttaccatcgttacatttttgatagtggttttaggagtttatgcgtatgatagaagagtgaggagaaaagcgcgtcacacaattttagttgatccaaataatagacaacatgacagtcccaataagacagtttcatgggcagatgatctggaaagcggactcggggcagaagatgatttagaacaagatgagcagttagaaggcggagcacccataagtagcacttctaacaaagcaggatctaaattgaaaactaagaaaaagaagaagtatactagccttccgaacactgaaatcgatgaatcttttgagatgactgatttttaa

SEQ ID NO: 45597 - DNA, 3054 bp, Saccharomyces cerevisiae
atgtcatccccttttccagctgacacaccaagcagtaatagaccttccaactcctctccgccaccatcgtcgataggtgctggcttcggaagcagtagcggactcgattcgcaaataggctctaggttacatttcccaagttcttctcaaccgcatgtcagtaattcacaaacaggcccttttgttaacgattccactcagtttagttctcaaaggttgcaaaccgatggttccgcgactaatgatatggagggaaatgaacctgccagaagcttcaaaagtagagctttgaatcacgttaagaaagttgatgacgttactggtgaaaaagtccgtgaagcgttcgagcagtttttggaagacttttccgttcaatccactgatactggtgaagttgaaaaagtttatagagctcaaattgaatttatgaaaatatatgacctaaacaccatttatatagattatcagcatttatccatgagagaaaatggtgctctagctatggctatctcagaacaatattacagatttttggcttttttacaaaagggtttaagaagagtagtaagaaagtatgcacctgaattgttaaacacaagtgactcattgaagagatccgaaggtgacgaaggtcaagcggatgaagatgagcaacaggacgatgatatgaatgggtcgagtctaccaagagattctggatcatcagccgcaccagggaatgggacatctgccatggcaacgaggtcaataacaacttctacgtcacctgaacagacggaacgtgtttttcaaatcagtttcttcaatctaccaacagttcacagaattcgtgatataagatctgaaaagattggttcactattgagtatatcagggacagtgacaagaacatctgaggtccgtccagaattatacaaggcaagctttacgtgtgatatgtgccgtgctatcgtagataacgtagaacagtccttcaagtacactgaaccgacattttgcccgaacccatcatgcgaaaatagagccttttggacattaaatgttacaagatccaggtttcttgattggcaaaaagtcagaattcaagaaaatgctaacgaaatacctacaggctccatgccgcgtacgctggacgtcattcttcgaggtgatagtgtcgaaagagccaagccaggtgaccgttgcaaatttacgggtgtggaaattgtagtacctgatgttacacaattggggctaccaggtgtgaagccaagttcaacattagatactagaggtatttcgaagactactgaaggtttgaatagtggtgttactggtttacgctctcttggtgttcgtgatttgacatacaagattagctttctggcatgccatgttatcagtattggatcaaacattggtgcaagtagccctgatgcaaattctaacaaccgagaaactgaactacagatggctgctaatttacaagctaataatgtataccaagataatgaaagagatcaagaagtattcttgaacagtttgagttcagatgaaataaatgagctgaaggaaatggtaaaggatgaacatatttatgataaattggtcagatctattgctccagctgtgtttggccatgaagccgtaaagaagggtatcttgcttcagatgctcggtggtgttcataagagtactgtagaaggtattaagttaagaggagatatcaacatctgtgttgttggtgatccctctacttctaagtctcaatttttaaaatacgtagtgggatttgcaccaagatcagtttacacttccggtaaggcctcgtcggctgctggtttaacagctgcggttgtgagagatgaggaaggaggtgattatacaattgaagcaggtgctttaatgcttgctgataacggtatttgttgtatcgatgaatttgataaaatggatatttcagatcaagttgccattcatgaagctatggaacaacagaccatctctattgctaaagctggtattcacgctactttaaatgcaagaacatcaattctagcggctgccaacccggtaggtggaagatacaataggaaactatcactgaggggtaatttaaatatgaccgcaccgatcatgtccagatttgatttattttttgttattcttgatgactgtaacgaaaaaattgataccgaattggcatctcatatcgttgacttacacatgaaaagagacgaagccattgagccgccatttagtgcagaacaactacgtcgttatatcaaatatgcacgtacttttaaaccaatattaacgaaagaagcccgttcctatttagtcgagaagtataaggaactgagaaaggatgatgcccagggatttagtagatcgagttatagaatcacagttaggcaacttgaaagtatgattagattatcagaagctattgcgagggctaattgtgtcgatgaaattactccatcattcattgcagaagcttacgatcttttaaggcaaagtattattcgtgttgatgtggatgatgtggaaatggatgaagaatttgataacatagagagtcaaagtcacgccgcttctggaaacaatgatgacaatgatgatgggactgggtcaggtgtaattacgagtgagccaccagcagatatagaagaaggacaaagcgaagctacagctcgtccaggtacaagcgagaagaagaaaacaacggtgacgtatgataaatatgtgtccatgatgaacatgatcgttagaaagattgctgaagtagatagggagggtgcagaagaactaacagctgtggatatagttgattggtatttattacagaaggaaaatgatttgggttcgttagcagaatattgggaagagagaagattagcgttcaaagtcataaaaaggttggtcaaagataggattttaatggagattcatggtaccagacacaatttaagagatcttgagaatgaggaaaatgaaaataataaaactgtttatgttattcatccaaactgtgaggttttggatcaattggaaccacaggattccagctaa

SEQ ID NO: 45598 - DNA, 1359 bp, Saccharomyces cerevisiae
atgtctggaacatttagttatgatgtgaaaacaaaggagaacgaaccattatttgagtttaattctgcttattctcccagggtatcgtatcattttaactccaaagtttcacattaccattatggtgttaagcatccaatgaagccgtttcggttaatgctaacggatcacctagtttcctcttatggattgcacaagattatggacctttatgaaacaagaagcgctaccagagacgaattactacaatttcactcggaagactacgtgaattttctctcgaaggtttcaccagaaaatgcaaacaaactgcccagaggcacacttgaaaattttaacattggagacgactgtcctatttttcaaaatttatatgattatacaacactatacactggtgcgagccttgacgccaccaggaaactaatcaacaatcaatcggacatagcgataaattggtctggtggtcttcatcatgcaaaaaagaatagtccatctgggttttgctatgtaaatgatattgtgctttctattttgaacttattacgatatcacccaagaatcctttatatcgatatcgacttacatcacggcgatggtgtccaggaggcattttacaccacagatagggtcttcacgttgtcttttcataaatataatggcgaatttttcccaggaactggtgatctgacagaaattggttgcgacaaaggaaaacatttcgcattaaatgtacccctagaagatggcatagatgacgactcatatataaaccttttcaagtcaattgtagatcctctaataatgactttcaaaccaacacttattgtccaacaatgcggtgcggattccttaggtcatgatcgcttaggatgcttcaatttaaatataaaggcacatggagaatgcgtaaaatttgtcaaatcatttggtctaccaatgctagtagtgggcggtggaggttatacacctagaaatgtatcacggctttggacctacgagacaggaattttaaatgatgtcttgctaccagaagacatccccgaagatatcccattccgggactcattcgggccggattattcactttatcctatgttagatgacttatacgaaaacaaaaacagtaaaaaactactggaagacattagaatacgatgtctagaaaatatcagatacttgcaaggagcaccaagtgtcagaatggatgctgaatgcataccgacacaagatataagtgccctgacagaagaagaggataaaatcattcaagaaatgaatgaagaaacagaagcagacagttcaaataggctagaagaaatggaaaaagaaaacagtggattgattgccttttcatag

SEQ ID NO: 45599 - DNA, 1581 bp, Saccharomyces cerevisiae
atggcacaaaacaattttgattttaaattcagccaatgttttggtgataaagcagatattgtggtgacagaggcggatctaattacagctgtagaatttgactatactggaaattatctggccactggtgataaaggtggccgtgtggtactttttgaaagaagtaatagtagacattgcgaatataagtttttaacagagtttcaaagtcatgacgcagaatttgattatttaaaatccttagaaattgaagagaagataaatgaaatcaaatggttacgaccaactcaaagatcacactttcttttgagcacaaatgataaaactataaaactttggaaagtttatgagaaaaatataaaattggtaagccagaacaacttaacagaaggggttacgtttgcgaaaaaaggcaagcccgataaccataacagtagaggaggctccgtgagggctgtattatctttacaatcgctgaaactgcctcaattatcacagcatgacaaaatcattgctgccaccccaaagcgtatatatagtaatgcacatacctatcacattaattcgatatcgttgaattctgatcaggaaacatttttaagtgctgacgacttgagaatcaatttatggaatctggacataccagatcagagcttcaacatcgtagatatcaagccaaccaatatggaagaacttaccgaagtgatcacaagcgctgaatttcatccgcaagaatgtaatttattcatgtactcttcttccaaaggtacaataaagttgtgtgatatgagacaaaattccctatgtgacaataaaaccaaaacatttgaagaatatttggatccaatcaatcataatttttttacagaaatcacgtcgtcaatttccgacataaaatttagtccaaatggtaggtatattgcatccagagattatttaactgtcaaaatttgggacgtaaatatggataataagcctttgaaaaccataaacatacatgagcaattgaaggaaagattgagtgatacctatgaaaacgatgcgattttcgataaatttgaagttaattttagtggtgatagttcaagtgtaatgactggttcttacaataacaatttcatgatctatcctaatgtagtaacttctggtgataatgataatggcatagtcaaaacttttgatgaacacaacgcacctaatagcaacagcaataaaaatatccacaacagcatacaaaataaagattctagtagtagtggcaacagccacaagcgtaggagtaacggacgcaacacaggcatggtgggaagtagtaatagctctagaagcagtatagcgggaggagaaggagcaaattcggaggactcgggaaccgaaatgaatgaaatcgtgttacaagctgacaaaacagcgttcaggaacaaaagatacggttcgctagcgcaaaggtctgcaagaaataaggattggggtgacgatattgatttcaagaagaatattttacatttctcatggcatccaagagaaaatagtattgctgttgcagcaactaataatttattcattttttccgcattataa

SEQ ID NO: 45600 - DNA, 1140 bp, Saccharomyces cerevisiae
atgtgcgattctcctgcaacgactggaaagcctactattcttttcatcgcagatccgtgcgaaacatcagccacacttaattccaaggcattcaaagagaagttcaggatcttgcgctatcagctggacaccaaagaagcatttcttaactttttagaaaggcatgaacaagacaaaatatgtgccatttatgctgggtttccggcattcaaaaaaatcggtgggatgactcgaagtatcatcgaacacaagtcatttccaaggaaaaatttaaaatgtatcgtgctttgctcaagaggttacgacggatgggatctggatacattacgcaagcatgaaattcgattatacaactaccaagacgatgaaaatgaaaaattgatagacgatttaaagcttcatcaagtcggtaatgatgtggcagattgtgccttgtggcacattctggagggctttagaaagttctcctattaccaaaaacttagtagagaaactggaaatacattaactgcaagggcgaaagctgcagaaaagagcggatttgcttttggccatgaactggggaatatgtttgctgaatcaccaagaggaaagaaatgcttaattcttggtttaggaagtattggaaagcaagtagcctacaagttgcaatacgggctaggaatggaaatacattattgcaaaagaagcgaagattgcacaatgagtcaaaacgaaagctggaaatttcatttgctagatgaaacaatatatgcaaaactataccagtttcatgcaatcgtggtcacattgccgggaactccacaaacagaacatttaatcaacaggaaatttttggaacactgcaatccaggcctaattttagtcaacttgggaagaggtaaaattttggacttgcgggctgtttctgacgccttggtaacgggacgaatcaaccatctcggtttagacgtctttaataaagaaccagaaatagatgaaaaaatcagatcttctgatagacttacttcaattactccgcatttgggtagtgcgacaaaggatgtttttgagcaaagttgtgaactggcattgacaagaatcttacgggtagtgtctggggaagccgcaagcgatgagcatttctcccgtgtagtttga

SEQ ID NO: 45601 - DNA, 1398 bp, Saccharomyces cerevisiae
atgccgatcaagagattagatacagttgtggtaaataccggctctcaaaatgaccaacattcagcctccgtgccaccggtgtatttgtcgactaccttcaaagtggacttgaataatgaagatgcacagaactacgattattccagatcgggaaacccgaccagaagtgtccttcaacaccagattggtaagctttatcgtgtcccacaggaaaacgtattagctgtgagcagtggtatgacggcgctagacgtcatcctgcgtgggctcgtcttacttaacggcactgacaaccatacgccaacaataatagccggcgatgatctttatggaggcacccaaaggctgctgaattttttcaagcaacagagtcatgcagtctctgttcatgtggacacttccgattttgaaaagttcaaaaccgttttccagtctttagataaagttgattgtgttcttctagagtctccgaccaatccgctttgcaaggttgtagatatccctagaatattacgttttgtgaaatgcatatctcccgacactacagttgtcgttgataatactatgatgagtggactcaattgtaatcctcttcaactgaatccaggctgcgatgtcgtatacgaatctgctaccaagtacttgaatggtcatcacgatttgatggggggtgttattatcagcaaaacaccagaaatagcctcgaagctttactttgtcattaattctacaggagctggattatccccaatggattcttggctacttgtgaggggcctaaaaactctaggagttagattatatcaacagcagagaaatgctatgatattggctcattggctagaaaattcatgcggattcaaacctaccagaacaaacaaggctacgaaaactagatttgttggattacgctccaacccggatttcaagctgcataaatcgttcaataatggcccaggtgccgtgttatccttcgaaacggggtccttcgaacattcaaagagactggtcagttccaaaaaactgagtatatgggctgtgacggtatctttcgggtgtgtaaattcgcttctatctatgccttgcaaaatgtcccatgcttccattgatcccgaattaaggaaagagagagattttcctgaagatttggttcgtctttgctgcggtatcgaaaatatagtagatttgaagaaagatttattagcggcgatggttgacgctgatattatagaagtaagagaaaatggcaaatatcttttcaacaaattgaataagaacctagctgtgaacactaccatcgatgacctgcataagcctttaagtatttacgaagaattttacaatcaagatctcatcagaaaggactcagaattgaatattaagagttcgaaattgtaa

SEQ ID NO: 45602 - DNA, 1191 bp, Saccharomyces cerevisiae
atgaggtttaggagttcttcccatagcttaaaacatgttgacagagaattaaaggagttgattaattcgtccgagaatgccaataaatgcggtgaatgtggtaatttctacccaacttggtgctcagttaatttgggggttttcctttgtggtaggtgtgcctctgttcatagaaaagttttcggtagcagagacgacgatgccttttctaacgttaaatcactatcaatggatagatggacaagagaggatatcgatgaattagtgagtcttggaggcaataaggggaatgctcggttctggaatcctaaaaatgtcccttttccttttgatggagatgatgacaaagccatcgtggagcattacattagagacaagtatattttgggtaaattcaggtatgatgaaataaagcctgaagactttggatccagaatggatgattttgatggggaatcggacaggtttgatgaaagaaatagaagtaggagcaggagcagatctcattctttctataaagggggccataataggtctgactacggcggttccagggactcattccaaagcagtggaagcagatattctaggcaactggcagaactcaaggacatgggtttcggtgatacaaacaaaaatttagatgcattatcgtccgctcacggaaatatcaatagagcaatcgattatctagaaaaaagttcaagttcaagaaatagtgtatcggcagcagcgacaacatcaactccgcccctgcccaggagacgtgcgacaacaagtggcccacagccagctatttttgatggtacaaatgtaatcacgccagattttacttcaaattcagcatcttttgtacaagcaaagccagcagttttcgatggtacccttcaacagtattacgatcctgctaccggaatgatatatgtagatcagcagcaatacgccatggctatgcaacagcagcaacagcaacagcaacagcttgctgtcgcacaggctcaggctcaggcacaggcacaggcacaggctcaagttcaggctcaggctcaggctcaggcccaggctcaggctcaagcacagcagatccagatgcaacagcttcagatgcagcaacagcaacaggcgccattatcttttcagcaaatgtcgcaaggaggaaacctgccacaaggttatttctacacacaataa

SEQ ID NO: 45603 - DNA, 1683 bp, Saccharomyces cerevisiae
atggtactacttaaagaacctgttcagccgctgcctcgatcatctctgttatataataatgcgagcaatagtagtagtcgtataaaagagacaagaaaagtcaaactattatataatcccttaactaagagacaaatccttaacaactttgaaattttagccactttgggtaatggacagtacggcaaagtgaaattagcaagagatctcgggacaggtgcgttggttgcaataaaaattcttaatagattcgaaaaaagaagcgggtattctcttcaattgaaagtagaaaatccaagggttaatcaagaaattgaagtaatgaaaagatgtcatcatgaaaacgttgtggaattgtatgaaattttgaatgaccctgagagcacaaaggtttatcttgtattagaatattgctcaaggggacccgttaaatggtgtccagaaaacaaaatggagataaaagcagtgggaccatcaatactcactttccaacagtcgaggaaggtagtgttggatgtagtatcgggtctggagtatttacattcccaagggataacgcatcgagatatcaaaccatcgaacctgttaatttcatcaaacggaacggtgaaaatatccgattttggcgttgctatgtcaactgccaccggaagtactaatatacaatcatcgcatgaacaacttttaaaatctagagccttagggacccctgctttttttgcacctgagctttgctccactgaaaaagagtattcctgctcatctgccatcgatatctggtcattgggggtcactatatactgcttgttgtttggaaagttgcctttcaacgccaattcaggattagaacttttcgacagtattatcaataaacccttagaatttccatcttatgaggaaatgttgaatggtgccacttcgggaatcacaatggaagaatacactgatgccaaagatttattgaagaagctgttacaaaaagatcctgacaaacggataaaactagcagacatcaaggtacatccgtttatgtgccattatggtaaaagcgatgcagcatccgtattgaccaatttggagacgtttcatgagttgaaagtttcaccgccctcttcatgcaaaagggtagaattggtcagcctaccagtgaattcatcattcgcctctttagatagcgtttatatggaaaattttgaccacaataaccttaggactggtgctgacagaaattcaacatattctccatcaatatacgacgcaaataccttatcaccctcagcatatcacaacatcggttctagagagtcatcctattcgtccttttcctctttcacatcatccaccgcttttgcatctcagatcagtattcaggatgccccagcaatcggtgatcaacaatgcttgataggtgagagtggaagttcattaagagtgaattcttgtgagtttccacaatatacaactatgtctcctgtaggagaatatccctttgagagtacggaagcaagtttgagctctactcttacgcctgtcggtaatgtacctcaacgtataaaagcccacctggtagaagggaaatctaacagcaaggatgaccttagaatagaagcagacgcatcacttgtatttgaggctagcgacgcccagcgcacgagaagaagaatgtctctttataagctttag

SEQ ID NO: 45604 - DNA, 1695 bp, Saccharomyces cerevisiae
atggatatttttagagtattaactagaggagcttccgtgaagaaagagtcaggcccaaaggctaaggcagcagattacagcgttataaatggaaatgatgagaatcataaggaagataataatgaaagccagatcgtgaaagaacttgatttctttcgaaacaagagaatcattagcaaggtagaggatgatagagagaagacaaccgaaaacgattctccaaacaaagaggagaagagcggcaatgatgatggtctgataaaaccagtgattaccaataccgttgaggcatccgcgttgagaaaatcatataagggaaacgtgtcgggtatagatataccacttccaataggttcgtttgaagatttaatttcaaggttttcattcgataagcgtttactgaataacttgattgaaaacgggtttactgagcctaccccaattcaatgtgaatgtattcctgttgctttgaataatagagacgttttggcatgtggtcccacagggtctggtaagacgttagcattcttaattccgctggttcagcagattattgatgacaagcaaactgcagggttgaaagggttaatcatttcgcctacaaaggaattagcgaaccaaatttttattgaatgttttaagctatcttacaagatatttttggagaaaaaaaggcctctgcaagttgcactcttatctaaatctttaggcgctaaattgaaaaacaaggtagttagtgataagaaatatgatataatcatttctaccccattaagactaatcgatgttgtgaaaaacgaagctctcgatctctccaaagttaagcatttgatatttgatgaagctgataaattgtttgacaaaacattcgttgaacagagtgacgatattttgagcgcctgtagagagccatcgttgcgtaaagcgatgttttctgcgaccattccatccaatgtagaagagattgcacaaagtataatgatggatcctgttagagttattattggccacaaggaagcagcaaatacaaatattgaacaaaaattaatattttgtggtaatgaagagggtaaactaattgctattagacaactcgttcaagagggtgagttcaagccaccgatcataatatttttagagtctattacaagagcaaaagcgttatatcatgaattgatgtacgataggattaacgtagatgtgattcatgcagaaagaacagccttacaaagagacaggattattgaacgatttaaaactggtgaattatggtgtttgatctgtaccgacgttttagctcgtggtattgacttcaaaggtgtcaatctggtcatcaattatgacgttccaggatcgtctcaggcttatgttcacagaattggtagaacaggtagaggtgggcggtcaggtaaagctatcacattctatactaaacaagactcagtagctattaaaccaataataaatgtcatgaaacaaagtggttgtgaagtatctgagtggatggataaaatggctaaaatgaccagaaaggagaaagaaagtataaaaaacggtaaagcgcataaagaaagaaagcagattactactgtgcctaagatggataaggccaaaagaagacgtcaacaagaaatgattgcagcatccaaaagaagaaaaaatgaagaactttcaaaaaaacatttctcgaaataa

SEQ ID NO: 45605 - DNA, 2853 bp, Saccharomyces cerevisiae
atgagtgacaatccatttaatgcgagtcttcttgacgaggactcaaaccgtgagagagaaatactagatgccacagcagaggccctttcgaaaccaagcccttctttagagtattgtactttatccgtggacgaagctctagaaaaactggacactgacaaaaacggtggtttacgatcatctaacgaggccaacaataggagatcactttatggccccaatgaaataaccgtagaagatgatgaaagtcttttcaagaagttcttgtcaaatttcattgaggatcgaatgattctacttttaataggatccgcagtggtctctctttttatgggtaacattgatgatgctgttagtatcacactggccattttcatagttgtcactgtcggttttgtccaagaatataggtctgaaaaatctctagaagcgttgaataaattggttcctgctgaatgtcacttaatgagatgtggtcaagagagtcatgtactggcttccaccttggttcctggtgatttagtgcacttcagaataggtgacagaatccccgcagacattagaattattgaagcaatcgatttatccatcgatgaaagtaatttaactggtgaaaatgaaccggtacataaaacctcacaaacgatcgaaaaatcttcctttaacgatcagcctaattcaattgtaccgatttctgagagatcttgtatagcttatatgggtacattagtcaaggaaggtcatggtaagggtatcgtcgtaggaacaggtacaaacacatcctttggtgccgtttttgaaatgatgaataatattgaaaaaccgaagactccattgcagttaacaatggacaaattgggaaaggacttgtcactggttagcttcatagttattggtatgatttgtttagttggtatcatacaaggtagatcttggttagaaatgttccaaatatcggtatccttagcggttgctgctattccagaagggttaccaattattgtcactgttactttggcattgggtgttctgagaatggccaagcgtaaagccatcgtgagaaggttaccaagtgtcgaaactttaggctctgtcaacgttatctgctccgacaaaacaggtacactaacctcaaaccacatgaccgtatctaaactttggtgcttggacagtatgtccaataagctaaacgtcctctcattagacaaaaataagaagactaaaaattctaatggaaatttgaaaaactatttgactgaagacgttagggaaactctaactatcggtaatctctgtaataatgcatctttctctcaagaacatgccatatttctgggaaatcctactgatgtagctcttttagagcaattggcaaactttgaaatgcctgatatcagaaacaccgttcaaaaagttcaggaacttccatttaactcgaaaagaaaattaatggcaaccaagattctcaaccctgtcgacaataagtgtacagtttatgttaaaggtgcatttgaaagaattcttgagtactccacaagttatttgaaatcaaagggtaaaaaaactgaaaagttgactgaagcccaaaaagctacgataaatgagtgcgcaaattctatggcatctgaaggtttgcgtgtctttggatttgctaaactaactttgtctgattcatcaactcctctaaccgaagacctaatcaaagatttaacctttactggtttaatcggtatgaatgacccaccaagaccgaacgttaaatttgccatcgaacaattactacaaggtggtgtccatattattatgatcactggtgattctgagaataccgcagtaaacattgcaaaacaaattggtattccagttattgatccaaagctttccgttttatccggtgataaattagatgaaatgtcagatgatcaactggccaatgtcatcgaccacgttaatatttttgctcgtgctacgcctgagcataagttaaacattgttcgtgcattaagaaagaggggtgatgtggtagcaatgactggtgatggtgttaacgacgctcctgcgttgaaactttcagatattggtgtttctatgggtagaattggtacagatgtagccaaagaagcctcagatatggtcttaactgatgatgacttcagtactattttaactgccattgaagagggtaaaggtatctttaataatattcagaatttcctgacttttcaattgtctacttctgttgccgcactatcattagttgcactatctacagcgtttaaactacccaatccactgaacgcaatgcaaattctttggataaatattttaatggatgggccaccagctcaatccttaggtgtggaacctgttgatcatgaagttatgaaaaaacctccaagaaaacgtaccgataaaattttgacccatgatgtaatgaaacgtttactaaccaccgcggcctgtatcatcgttgggacagtttacatttttgttaaagagatggccgaagatggtaaagtaactgctagagatactactatgacatttacttgttttgttttttttgatatgtttaatgctttggcctgcagacataacacaaagtcaatcttcgaaatcggctttttcacgaacaaaatgttcaactacgccgttggactgtctctgttaggtcaaatgtgcgctatatatataccatttttccaaagtatctttaaaactgagaaacttggtatctctgatatactattgttattgctcatcagcagtagcgttttcatcgttgatgaattgagaaaattgtggacgaggaaaaagaatgaagaagactcaacgtatttctcaaatgtttga

SEQ ID NO: 45606 - DNA, 1539 bp, Saccharomyces cerevisiae
atgtcagtaaacccagaatttatagccgatggcatcgatttttatccaacaacgcccgatgccgcgtatttcaatgccgctgatggtaaaaataaagttaacaggataaatggtaactcagaaaatttacaccactcctttgcatcgggttgccgtagatcatctctttcagtcgactttaatgttacctcgtccgattcagaaaaaagtgaacagagctgcttggaaaacaactctcaagaagacgaatatttttgtgacattttttccactgaattaaaattagatgaaacttctaacaagtcaaccgattattccagttcaaatcaccagtatcctgaacaactggagttgcacaattataaactgctcaataaaattggtgaaggggcattttccagagtatttaaagcagtaggcatcaacacggatgaccaagctcctgttgccatcaaagcaatcataaagaaaggcatttcgagcgatgccatcttaaaagggaatgatagaatccaaggttccagcagaaagaaagtcttaaacgaagttgccatccacaaactggtttcgaaaaataatccgcattgtacaaaatttatcgcattccaggaatcggcgaactactattacttagtgacggagttagtcacaggtggggaaatatttgataggatcgtccaactaacatgctttagtgaagacttagctcgtcatgtcattactcaggtagcaattgcaattaaacatatgcactacatgggtattgtgcatcgtgatgtcaaaccagaaaacctactatttgaacctatcccattttatggccttgatggggacatgcaaaaagaagacgagtttacattaggtgtcggcggaggcggtattggtttagtgaagctaatggacttcggactagccaagaaacttcggaacaataccgcaaaaactccctgcggaacgatagaatacgtcgcatcagaagtattcacctccaaacgatattccatgaaagttgatatgtggagtattggctgcgtactattcacgttattgtgtggatatcctccgttttacgaaaagaacgaaaaaacattattgaagaaaatatcgagaggagattacgaattcttggcgccatggtgggacaacataagttctggcgctaagaacgcagttacccatcttttggaggttgacccaaacaagagatacgatatcgatgacttcctaaatgatccttggttaaattcgtacgattgtttgaaggattcaaactcaaattcttatgccagcgtgcaaagcatactaaatgattcattcgatgagagagcagagaccctacattgtgcattaagctgccaatctgaaaaacaagatgacaccgagttttccagaagtgaaagctcggaatacatatttatgacggaagaagacagaaacctacggggcagttggatcggtgagccaaaagagtgttttaccttagaccttgcaacatcttctatataccgaagaaggaagaacaagatattcttctggtaa

SEQ ID NO: 45607 - DNA, 3252 bp, Saccharomyces cerevisiae
atgtcatctgaggatatcatttatgatcctcagttcaaacctgttcagggaatctacgagaatagattaagacaatttattgatactggtggggattaccatgacttaaatttacccaagttttatgataagaagcgcatttcattagatcatgatcacgttaaggtttggtggtaccaggtttcttttgaacgtggatcttcccctgtttcccctgataagaggccatcttggaaatctattattgaacgtgacaagaagggtgaattggagtttagagaagcgaacataaatcagccctttggacccagttggtctaccacttggttcaaggtgaaaatctctttgcctgaagattgggttaaatcaaacgagcaactacttttccaatgggattgttctaacgaaggaattgtcatagacccaaagactctaatccctgtgactgctttttcaggtggtgaaaggactgaatatgttttaccgaaaacatcggatgggaaacatttcttttacatcgaagctggtaataatggtatgtttggctgcggtgcaggatccactataaatccaccagatgataatagattttttcatttgagaaaagctgatatcgtttggcccgatctagatgctcgtgcattgtatatcgatttttggatgctaggggatgctgcaagagagctacctggagactcctggcaaaaacaccaggcaagacaactaggcaatgcagttatgaatctttttgacccgaatgatcgttcaagtgttcgtaaatgtcgtgaattactacaaagggaatactttgactcctttttagaaagcagtaaggtttacgaacaaggtgaatctcaagttttaacaaatgtttatggtatcggcaactgtcatatagatacagcttggctatggccattcgcagaaacaagaaggaaaattgtgagatcttggtcttcccaatgtactttaatggatcgcttcccagagtataaatttgttgcttcacaagcccaacaatttaaatggttattagaagatcatcccgaatttttcaataaagtgttaattccaaaaattcagcaatctcagttttttgctgttggtggtacatgggttgagaatgataccaatattccctcaggggaatcgctggcaaggcaattcttttttggtcaaaggtttttcttgaagcattttggtctcaagtcaaagatattttggttacctgacacctttggttattcttcgcaaatgccacaactttgccgcttatctggtattgataaatttttgactcaaaagctttcctggaataacatcaacagttttccgcatagcacgtttaactgggcagggattgacggttctcaattattgactcacatgcctcctggtaatacgtatacagcagattcacacttcggtgatgttttgcgtactgccaagcagaataagacaccagaatattacggctccggtttaatgttgtacggaaagggtgatggtggtggaggaccaactgaggaaatgctgcaaaaaatgaggcgtattagatccatgaataacagaaatggtaatgttattccaaagttacaagttggtataacggttgatgaattttatgatgacattttgaaaaggactaaccaaggccatgatttacccacatggagtggtgaattgtatttcgaatttcatagggggacatacaccagtcaagctcagaccaaaaaattaatgaggttgtccgaaattaaactacatgatttggaatggatagctgccaaaacatcagttttatatcccgattcgtataaatacccttccaaacagattaacgaactttgggagaatgttttgttatgtcaatttcacgatgttctaccaggatcatgtattgaaatggtatataagtatgaggctgtccctatgttgcacaacgttgtgaaagaatgtacttccttaatagacaaaaccgttcaatttcttcagagtcagagtaaggcagatttggttgagatgagaacattaacttggtcaaaaccagaaaaggtttctgaggagtgctcgttgaacggtagttacacgtcctctgtaaccgggtacgatgactatatagtccttgccaatgggaagttgaaagttatcatttgcaaaaagactggggtgatcacaagcattacggatgaaactttgggggtagaatacctggacacggaacatggcagaaacaaattgggcgccaaccagtttgttatttatgatgataaacctttgggctggcaggcttgggatactgaactttattccgtcaaccaatacaagtatgtaacaaagccgaagaaagttcaagtttcctgcaacacaaaagagaaatgtgctgttgaggtcatttttcaaatttccgaaaaatgcaaaatcaaatcagtgatatcactcaatgcaactgcggtcactgatgctaaattaagtaaagtagacatttctacgacggtagaaaactgggatgctagaaacaaatttttaaaagttgaatttcccgttaatattcggaacgattttgcttcgtatgaaactcaattcgggattaccaaaagaccaacacattataatacctcatgggacgtcgctaaatttgaggtttgccatcacaaatttgctgattattctgaatacagcaagggtgtttcaattttgaacgattgcaaatatgggttttccacacacggtaacttgatgagattatcattattaaggtcaccaaaggctccggatgcgcatgctgatatgggtactcatgagataaaatatgctatctatccacatagaggagcactatcaagcgacactgttaagctcgctcacgaattcaattattgcttcaaatacaaactccccaaagatattggcatgaattttgatgacatcataagcatttccggagatgagaatgtcattttgtctaacataaaaagaggcgaagatgatagtgctgtcaagtccaactattcattaaatccaagggatgaacaaagtattgtggtaagggtttacgaatctcttggcggggaatcttttgcttcactaaataccacactaaatttgaagcgtattgagaaggtcgataacttggagatgaaagtttataagagtttgacagcaacgcgagacgaatcaaatcatgcaataaacagaattcccattaaattgagaccttttgagattgcctcattcaggttgtatttctga

SEQ ID NO: 45608 - DNA, 1131 bp, Saccharomyces cerevisiae
atgtgtcaagctaccaatggcccgagtagagttgtgactaaaaagcataggaaatttttcgaaagacatctacagttgcttccctcttcacatcagggacatgacgtgaacagaatggcgataatattctactcaatctcaggactctctatatttgatgttaacgtttctgcgaagtacggcgatcatcttggctggatgcgcaaacattatatcaaaacagtgctggatgatacagaaaatactgtgatatctggatttgttggaagcttagtcatgaatatccctcacgcaacaacgattaatctaccaaatactctctttgcattgttgtccatgattatgctgagagattacgagtattttgagactatactagacaaaagaagcctggcgagatttgtttctaagtgccaacgacctgaccgtggctcgtttgtatcttgtttagactataagacaaattgtggatcttcggttgattcagacgatttaaggttttgctacatcgcagttgccattctgtacatatgcggatgccgatccaaagaagactttgatgaatacattgatactgagaagttgcttggctatataatgtcgcaacaatgctacaacggagctttcggtgcccacaatgaaccacactcagggtacacatcttgtgcgctgtctaccttagctttactctctagtttggaaaagctatcagacaagtttaaagaagacaccataacctggctattacataggcaagtatcaagccatggatgtatgaaatttgaaagcgaattgaatgccagctatgatcaatctgatgatggcggtttccagggaagggagaacaagttcgctgatacgtgttacgcattttggtgcttaaattcactacacttactaacaaaggattggaaaatgctatgccaaactgaactagtcacaaattatttgcttgatcgaacgcaaaaaacattaactggaggctttagtaaaaatgacgaagaagatgctgatttatatcacagctgtctagggagcgctgcgttagcattaattgaggggaaatttaatggagaattatgcatacctcaagaaatatttaatgattttagtaaaaggtgctgtttttga

SEQ ID NO: 45609 - DNA, 1131 bp, Saccharomyces cerevisiae
atgtcaacgtttgggaaactgttccgcgtcaccacatatggtgaatcgcattgtaagtctgtcggttgcattgtcgacggtgttcctccaggaatgtcattaaccgaagctgacattcagccacaattgaccagaagaagaccgggtcaatctaagctatcgacccctagagacgaaaaggatagagtggaaatccagtccggtaccgagttcggcaagactctaggtacacccatcgccatgatgatcaaaaacgaggaccaaagacctcacgactactccgacatggacaagttccctagaccttcccatgcggacttcacgtactcggaaaagtacggtatcaaggcctcctctggtggtggcagagcttctgctagagaaacgattggccgtgtcgcttcaggtgccattgctgagaagttcttagctcagaactctaatgtcgagatcgtagcctttgtgacacaaatcggggaaatcaagatgaacagagactctttcgatcctgaatttcagcatctgttgaacaccatcaccagggaaaaagtggactcaatgggtcctatcagatgtccagacgcctccgttgctggtttgatggtcaaggaaatcgaaaagtacagaggcaacaaggactctatcggtggtgtcgtcacttgtgtcgtgagaaacttgcctaccggtctcggtgagccatgctttgacaagttggaagccatgttggctcatgctatgttgtccattccagcatccaagggtttcgaaattggctcaggttttcagggtgtctctgttccagggtccaagcacaatgacccattttactttgaaaaagaaacaaacagattaagaacaaagaccaacaattcaggtggtgtacaaggtggtatctctaatggtgagaacatctatttctctgtcccattcaagtcagtggccactatctctcaagaacaaaaaaccgccacttacgatggtgaagaaggtatcttagccgctaagggtagacatgaccctgctgtcactccaagagctattcctattgtggaagccatgaccgctctggtgttggctgacgcgcttttgatccaaaaggcaagagatttctccagatccgtggttcattaa

SEQ ID NO: 45610 - DNA, 2409 bp, Saccharomyces cerevisiae
atgagatttcttcaggtttataaatcatcggcattaattggactaataatattgttagccagtaaagtaaatcttgcagaggcaaaaaggaagctggtagccacatcattggtcacatgtatggaaaactcgcagctgtcagcaaatagttttgacgttgttttcaatccagacgacaggtcattacattatgatcttgatatgtcaactcaaattgattcatatatttttgctgatattgatgtctacgcatatggtttcaagatcattactaaaaatgtcgatctttgttcaatcaactggaaacagttttgcccggttcacccaggtaatattcagatcgactctattgaatacatctccagtgagtacgtaaatgaaattcctggtattgcataccaagtccccgatatcgacgcatatgccagggtcaagatcaccaacaatgtgagcgagtacctagcatgtatccaaatatacttctcaaacggtaaaacagtttctcagattggtgtaaaatgggcaactgcagtggtagcgggaattggtcttttactatctgccatcttatccacttttgggaactctaccgcagcctcacatatttctgccaacacaatgtcacttttcttatacttccaatctgttgtcgtggttgccatgcaacatgttcatcgagttccgcctattgcagccgcctgggcggaaaacttggtttggtcaatggggttaattagaatctcattcatgcaaaggattttccggtggtatgtgcaatccactggtggtacgcctagcttatatctgacttcaacatctatgtctgttttggctcaaagaagttggcaatatttgatggagctcccattaatcaaaagagctaccaatgttttgtatggtaatgcaaatacattaatttttagaggaatcaaaaggctaggctataaaatgggaatcgaaaatacgtccatcgtttgtaccggttttactttcttcgtcttatgtggatatgtgttggctggatttatcatagtattcaaatgctgtgtggagttagccacccggttaggatggatccaaaaggcaaggttttgggaattcaggaaacaatggagaatgatcttaaaaggtgctcttttaagatatatttacatcggtttcgttcagttaacaattctcagtttttgggaatttactgaaagagattcacctgctgttatcgtcatcgcatgcctttttattcttttgtcatgtgggttaatgctttgggctgcatggaggactgtttttttcgcaagaagatctgttgcattgtacaacaacccagcagccttattgtatggagatgaatatgtcttacacaaatacggatttttctatacaatgttcaatgccaatcattactggtggaacattgttcttttatcctacatttttgtaaaatcattattggttggatttgctcaggcttctggtcaaacacaagttcttttcatgttcatattggatttgttttacttcgttgctattatctactataagccctatctggaccgtccaacaaacataatgaatattttaattgctactgttactgtagttaattcctttctattcatgtttttttcggacttgtttaaccaaagctacaaagtggctgctattatgggatggatatttttcattatgaacgctgcattttcgttcattttactaatgatgatattggcattcgctggtatgatgcttttctcaaagaaccccgatctaagatttaaacctgctaaggacgatagaacttctttccaaaggaacactatgaaaccagaaggtactgttaatagatcagtagcgaacgagttgcttgcgttgggcaatgtggcaaaagaccatgacgacaattcagattacgaatcaaatgatactggtgtgaatgatgagctaaagcaagcacaggatgaaaccactcccacaaccgtaacatcaagtgatgataacaagcctacgttttcagagaaaatattaagtaaattctctaggcctaagaatgaaaacgcaagcacagatgctctgagagttgaagctccaaaacaacaaacgtttcctcacaacttaacgaatctttcacgagaaaacctatcaacattaggctctaaaccttatccaggacacacaagatcacagtctgatgcgcataatggactgatcaattcctttgaagaggaagatacaagttcaaataccgatccatttcacgactccactgaaggagaccttttagatacctcaagttcggacggaggatttaggtcgcaaaactatgttcgagatgacagcataaatagtttgggaaacaataaacaaccactgaggaaaccccctggattcttcgatgaaggatttatgtga

SEQ ID NO: 45611 - DNA, 1302 bp, Saccharomyces cerevisiae
atggacatgactaaaaaccacaccactgacacagaggagtttgatgatggtgatatacgtccagtcagtttgggaattgtggacgattataacgcttcgttcgaattacctttgaaaccaaagtttttacagagtgagaatttctcagatttaacaagtgaatgggaccagtctagatcaaatacgcctggtcttgcagaaggcaagactgagaaagcacagccatgcggtacaacagatagttcaaaaaatagaatacatgtagagcaactgttggaatccgctaatgaaatgaataattatttggcgcagaatatagagaacataaacaattttcaggtggggctattgaatggagggaaaggattatatagttccatgggtgatgattcgagcgcgtgtattaatggcactaattttagctcaacgtccaattttgaactaagtgatgatgagctagaggataccacgggttgcacaagttctatttttgataaagatcttttccatcaacaaaacgggctaagcatacctcgccgtagatcaccactcttcaaatctccaactgccagtttcgaaattggcgatgctacggatgtggaggagcaagatattgatgactccattttttctgaatgtagcagcattacaagctttgatatgggagggttgcatatcagtctaccacacgatgaagaagaagatcaagaaaaaactaagtccgaaagtgaaaacccgttgctacatggcataccggttgatgtagaagtgccccacatatcggttgatgaagctctggcgaatttcaaggaaaccatagaactactactaaaacttagtggcaatagaaagtgtaccggtttcaatactagagtggagaaaaaagaatactcgaatttctacatgaaaagtaaacccaccttatcatcagcagattttctcaagagaatccaagacaaatgtgagtaccagccaactgtttaccttgtggcaacatttttaattgacacgttgtttttaacaagggatggcaataacattttgcagttgaagttaaacttacaggaaaaggaggtccatcgaatgataatagcagcggttagattgagcacgaaattattggaagatttcgttcactcacatgaatattttagtaaagtatgcggtatttcgaaacggcttttgactaaattagaagtcagtctattgatctgtgtgtgcaatactaaattaatggtcagtaacaggaaattagccgcctccaaattacttttgaatgaactacggtccttctgtgtatag

SEQ ID NO: 45612 - DNA, 1800 bp, Saccharomyces cerevisiae
atgaagatcacagaaaaattagagcaacatagacagacctctggcaagcccacttactcattcgagtacttcgtcccgaagactacacaaggtgtacagaacctgtatgaccggatggaccggatgtacgaggcttctttgccccaatttattgacatcacctggaatgcaggcggtggacggttgtcacatctgtccacggacttggttgcgacagcgcagtctgtgcttggtttggaaacgtgcatgcaccttacctgcaccaatatgcccatttcgatgattgacgacgctttagaaaacgcttatcactccggttgccagaacatcctagcgctgagaggagatcctcctagggacgcagaaaactggactcccgttgaaggtggcttccagtatgccaaggacttgattaagtatatcaagtccaagtacggtgaccatttcgctatcggcgttgccggctacccggagtgccatccggagttgcctaacaaagacgtgaagcttgatctcgagtatttgagcagaagatcgaccggcggcgacttcatcatcactcagatgttttacgatgttgataatttactcaactggtgttcccaagttagagctgcgggcatggacgtgcccattattcccgggatcatgccgatcactacctacgcggccttcttgagaaggatccaatggggccaaatctccatccctcaacatttctcgtcccgattggatcctatcaaggacgatgacgagttggtccgtgatatcggaactaacttgatcgtggaaatgtgtcaaaaattgctcgacagtggttacgtttctcacttgcacatctacaccatgaacttggaaaaagcgcctctcatgattctggaaagattgaacattctacctacggaatcagagttcaatgcacatccattggccgtgttgccatggagaaaatctttgaatccaaagcgtaaaaacgaggaagtcagacctatcttctggaagagaagaccttactcctatgtcgcaagaacctctcaatgggccgtggacgaattccccaacggtagattcggtgattcgtcttctcctgcgttcggtgacttggatctgtgtggttcagacttgatcaggcaatcagcgaacaaatgtctcgaattatggtccacccctacttccatcaacgacgtcgccttcttggtcatcaactacttgaatggaaacttgaagtgtttaccttggagtgatatccccatcaatgatgaaataaatccaatcaaagcacacttgattgagctgaaccagcattctatcatcactataaactctcaacctcaagtcaacggcattaggtccaatgacaaaattcatggttggggacccaaggatggttacgtttaccagaagcaatatttggaatttatgttgcccaagactaagttgcccaagttgattgacaccttgaaaaacaatgagttcttgacctacttcgccatcgactctcaaggtgacctgctaagtaatcatccagacaactccaagtccaacgctgtgacttggggtattttccccggcagagaaattcttcaacctaccattgtcgagaaaatttcgttcttagcgtggaaggaggagttctatcatatcttgaatgaatggaaactaaacatgaataaatacgataaaccgcatagtgcccaattcattcagtccttgattgacgattactgcttggtcaatattgttgacaatgactacatttctccagatgatcaaatccattccatcctactaagcctataa

SEQ ID NO: 45613 - DNA, 2304 bp, Saccharomyces cerevisiae
atgggttccaaaagaagattctcgtccgaacacccggatccagttgagacctctattcctgagcaggccgccgagattgcggaagaattatccaaacagcatcctcttccatccgaagagccacttgtccatcatgatgctggtgaattcaagggcttgcaacgtcaccatacttcagcagaagaggcccaaaaacttgaagatggaaaaataaatccatttaccggtagggagtttacaccaaaatatgttgatatcctgaaaattagaagagaattgccagtacatgcccagagagatgagtttttaaaactttatcaaaataaccagattatggtttttgttggtgaaacaggttccggtaaaacgacacaaattcctcaattcgttttattcgatgagatgccacacttagagaacactcaagttgcatgtactcaacctcgtcgtgtcgcagcaatgtctgttgcacagagagttgctgaggaaatggatgtcaagttgggcgaagaagttggttattctatcagattcgaaaataaaacttctaataaaacgatattgaagtatatgactgatggtatgttgttgagagaggcaatggaagaccatgacttgtcgcgttattcatgtatcattctggatgaagcgcacgaacgtacactagctactgatattttgatgggtcttttgaagcaagtagtcaagaggagacctgatttgaagataattattatgtctgctactctggatgcagagaagttccaacgctacttcaacgatgctccattacttgccgttccgggcagaacatatccagttgagctatactatacaccggaatttcaaagggactatttagattctgccattcgtactgttttgcaaattcatgccactgaagaggctggcgatattttgttatttttaactggtgaagatgaaattgaagacgctgtcagaaagatttccttagaaggtgatcaattggttagagaagagggatgcggacctttatccgtatacccactgtatggttcattaccaccgcatcaacaacaaagaatattcgagcctgctccagagtcacataatggtagaccaggcaggaaagttgttatctccacgaacatcgctgaaacttctttaacaattgatggtattgtctacgtcgttgacccaggattttcaaagcaaaaagtttacaatccaagaattagagttgagtctttacttgtttcccctatctccaaggcttctgcccaacaaagagctggtcgtgctggtcgtacaaggcctggtaaatgtttcagattatacactgaagaggcattccaaaaggaactgatagagcaaagttacccagaaattttacgttccaatttatcctccaccgttctagaactaaaaaaattaggtattgatgacttggtccatttcgattttatggatccaccggctccggaaacaatgatgagagcccttgaagaactaaattatttggcatgtctggacgacgaaggtaacttaacacccctaggtagattggcatcccagtttcccttggatcctatgctagcggtgatgttaattgggtcctttgagttccaatgttctcaagaaatactaactatagtggccatgctatcggttccaaacgtgtttattcgcccaacaaaggacaagaagcgagcagatgatgccaagaatatctttgctcatccagacggtgatcatatcaccttactaaatgtatatcatgcgttcaaatcggatgaagcttatgaatatggtatccataagtggtgccgtgaccactatctaaattacaggtccctttccgctgctgataatatccgctcccaattagaaagattaatgaaccgttacaacctagaattaaacactacagactatgaaagccctaaatactttgacaacatcagaaaggctcttgcgtctgggtttttcatgcaagtagcaaaaaaaagatcgggagctaaaggatacatcacagttaaagataaccaagatgttctgatccatcctagtacggttcttggccacgacgcagaatgggtcatttacaatgaatttgtgctcacatcgaagaactacataagaactgtgacctcggtcaggcccgaatggctgattgaaatagcgcctgcatactacgacttaagcaatttccaaaaaggtgatgtcaaattatctttggaaaggatcaaggaaaaagttgatagattaaacgagttgaaacaaggtaaaaacaaaaagaagagtaagcactccaagaaatag

SEQ ID NO: 45614 - DNA, 1833 bp, Saccharomyces cerevisiae
atgccagaaagctctagagataagggaaatgcagcaattagcggtaaccgttctgtactttctattgcgtccccaacaaagctaaacatactatcttccgattggtccagaaaccaaggtaaagtttctaaaaattcgctaaagagatcaagttcactgaacattagaaactccaaacgtcccagtttacaagcctctgccaattctatttattcaagacctaagattacaattggggcaccaccgttaataagacgagattcttcatttttcaaagatgaatttgacgctaaaaaagacaaagcaacgttttcggcatactcttctcgttcatatccaacaattggatctgagagcgtagtttcccaaacatctttatcgcaaccgacaacatctagagaagttgatgagcaatttacagtagctgcggatagatatattccaattctacagggagcttcgcaaaacaaggtcgatcctgaaaccttacacgaggcattacctccgccaaacgcgtcgccaatttcacacttaagggcccagactaagattgtcttcaaacaaaatgtagctgaagcgtgtgggttagatatgaataaaagaatactacaatacatgccggaaccaccaaaatgctcttccttgagacaaaaaagctatatcatgaagaaaagaacacattatagttatcagcaggaacaaaaaattcctgatttaattaaattaaggaaaatcaataccaatccggaaagaattcttgatgcacctggtttccaagacgacttttatttaaacttgttaagttggtccaaaaaaaatgtcttagctatagcactagacactgcattatatctgtggaatgccaccactggggatgtttccctgttaacggatttcgaaaacaccacaatatgcagcgttacgtggtctgatgatgattgtcatatctctatcggtaaagaggatgggaacaccgaaatttgggacgttgagaccatgtcattaattagaactatgagatcaggcttaggtgtccgtatcggttcattgtcttggttagatactttgatagctacaggcagtcgtagtggagaaattcaaatcaatgatgtcaggatcaaacagcatattgtatctacatgggcagagcacacaggcgaagtctgcggtttgagctataaaagtgacggattgcaacttgcatctggtggtaatgataacactgtaatgatttgggataccagaacgtccttgcctcaattttccaagaagacgcatactgctgctgtaaaagcactaagctggtgtccatattcgccaaatattctagcctctggaggcggacaaacagataaacacatccatttttggaacagtatcacaggtgcacgagttggctcaatcaataccggatcccaggtgagctctttacattggggccaaagtcatacgtcaaccaatggtggtatgatgaataaagagattgttgccacaggaggtaatccagagaatgcaatctctgtttataattatgaaacaaaattcaaagttgcagaagtagttcatgctcatgaagcaagaatatgctgttctcaattgtcccctgacggaaccacattggccacagtgggaggagatgaaaacttaaaattttataagatatttgatccaagatgtacaggaagatcgagagaagacggattgatggatggtatgctaggacttattggcaaggaaggttgtcgaacaaatgataaggagaatcgttccaaaaattcgagtgagattcatacaaggaggccctctagtaccagccaatatttgatcaggtga

SEQ ID NO: 45615 - DNA, 1551 bp, Saccharomyces cerevisiae
atgtctacacagcagcaatcttacacaatttggtctccacaagatactgttaaagatgtcgctgagtcgcttgggttggaaaatatcaacgatgacgtgttgaaagcacttgctatggacgttgaataccgtattctagagattattgaacaggcagtcaagtttaaaagacactctaaaagagatgttttaactacagacgatgtatcgaaggccctgcgtgttctgaatgtggaacctttatatggatattatgatggctctgaagttaataaagctgtatcatttagtaaggttaacacaagtggaggacagtcggtttactacctggatgaggaagaagtagattttgatagattaataaatgagccattaccgcaagtgcctcgtctaccaacttttactacacattggctagcagttgaaggggttcaacctgccataatccaaaatccaaatttgaatgatataagggtatcccaaccaccatttattagaggtgctattgtcactgctttgaatgataacagcctccaaacacctgtaacgtcgacgacagcaagtgcttctgtgacggatacaggcgcctctcaacacctgtctaatgttaaaccaggacagaatactgaagtcaaacctttagtgaaacacgttttatccaaagaattacagatttatttcaataaggtcatttcaaccttgacagcgaagagtcaagctgatgaagctgcacagcatatgaaacaagcagctttgacttcactacgaactgatagtggcctgcaccaactggttccatattttattcaatttattgccgaacaaatcacacaaaatctttccgatttacaattgctaacaacaattttggaaatgatttactctttactaagcaatacttctattttcctggacccttatattcattcgttaatgccttccattttaaccttgctattagcaaaaaaacttggtggatcaccaaaagatgattcgccgcaagaaattcatgaatttttagaaagaacgaatgcactacgtgattttgccgcatctttgttggactatgtattgaaaaaatttcctcaagcatacaaatccctgaagccaagagtaactaggacactgctaaagacatttttggacataaaccgtgtttttgggacttactatgggtgcttaaagggtgtatcggtactagaaggtgaatccatcagattcttcttaggaaacctaaataattgggcgcgcttggtattcaatgaaagcggaataactctagacaatatagaggaacatttgaacgatgactccaatccaactaggaccaaatttactaaagaagaaactcaaatcttggttgatactgtaattagtgcattgttagttctaaaaaaggatttaccagatttgtacgagggtaaaggtgaaaaagttacggatgaggataaggaaaaattgctagagaggtgtggtgtcactattggatttcacattttgaaaagagacgacgcaaaagaattaattagtgcgatattttttggcgaatag

SEQ ID NO: 45616 - DNA, 450 bp, Saccharomyces cerevisiae
atgtcagccaccagagccaataaagatattttcacactattcgacaagaagggtcaaggcgccattgccaaggattccttgggagattacctgagggcaattggctacaaccccaccaaccagctcgtacaggacatcataaacgcggattcgagcttgagagacgcctctagcttgacgctggaccagattacaggcctaattgaagtcaacgaaaaggaattggatgcaactaccaaggcaaagacagaagacttcgtcaaggcattccaggtcttcgacaaggaaagtacaggcaaggtatccgttggtgacttaaggtacatgctaactggcttgggtgaaaagttaaccgacgctgaagtagacgagctgttgaagggtgttgaagtggacagcaacggagaaattgactacaagaagttcatcgaagatgttttgagacaatga

SEQ ID NO: 45617 - DNA, 1461 bp, Saccharomyces cerevisiae
atgaataggattctatctagtgcatcgttgctatccaatgttagcatgccaaggcaaaacaagcataaaattacaaaggcgttatgttatgcaattatagtagcctcaatcggttcaatacaatttggttaccacttgtcggaattaaatgcacctcagcaggtgctttcgtgctcagaatttgacattcccatggagggctatccctatgacagaacatggctgggaaaaagaggatataagcaatgtataccattgaatgatgaacagattggaatcgtgacctccgttttttgcattggaggcattttgggctcttattttgccaccagtctggccaatatttatggaaggaagttctcaagtttaattaactgcacattgaatatcgtcggttcgctgataatcttcaattcgaatagttataggggcttaatcattggtagaattctagtgggtatttcgtgtggctctttgatcgtgattataccccttttcattaaggaagttgctccaagcggttgggaaggtttactgggttcgatgacacaaatctgtatcaggttaggggtcttgttgacacaaggaatagccctcccactgactgattcataccgttggaggtggattttgtttggtagcttccttatcgcggtattgaattttttcatgtggtttatagtcgatgaatctccaaaatggttgttagcacatggaagagtcaccgatgctaagttatctctatgtaagctacgtggcgtgacttttgatgaagccgcacaagagatacaggattggcaactgcaaatagaatctggggatccgttgattgaaccaaccaccacgaactctattagcggttctaattcattatggaaatacttgagggacagaacaaatgtcaagtctcgccatgttatcactgtattgttatttggccaacaattctgcggtataaactccattgtactatatggtaccaagataattagtcaactgtatcctcagcacgcaattaggataaactttttcattagtatggtgaatgtattagtcaccatactagtttctctgctaattcatagtttgccacgtaaaccgcttctgatgacgtccaccgtcttagtttctgttaccgccttcattatgggaatagcaatgaaccataataaaatgaaccttttgattgtgttttcatttatatatatgggcgttttcacgatggggttaaatccgttgccatttataataatgagagaagtatcaaaaccacaggatatggtccttgcgcaaagatatggtaccatttgcaattgggtaggaacttttatcattgcatatactttccctattattcatgatgttttgtcaggttatgttttcatcatttttgctatcatagcatgctcaataagcgcctttatctggaagaaggttccggagaccaagaggagcggctaa

SEQ ID NO: 45618 - DNA, 1449 bp, Saccharomyces cerevisiae
atggtcaaaagaacagtcgccaccaatggagacgcgtctggcgctcatagagcaaagaaaatgtctaaaactcatgcttctcatatcataaacgctcaagaagactacaagcatatgtacttaagtgtccaaccattggatatattttgctggggtactggttctatgtgtgagcttgggttgggtccactagccaaaaataaggaagttaaaagaccaaggttaaacccatttttacctcgcgatgaggccaagatcatttcttttgcagtcggtggtatgcacaccttagcccttgatgaagaaagcaatgtatggtcctggggttgcaatgacgtgggtgcgttgggcagagatacttccaacgccaaggaacaactcaaggacatggacgccgatgactcaagtgatgacgaagatggtgatttgaacgaattggaatctacgcccgctaaaatcccaagagagtcatttcctcccttagcggagggacacaaggtcgtgcaattggcagctacagacaatatgagttgcgccctgttcagcaatggcgaggtatacgcatggggtactttccgttgcaatgaaggtatcctagggttttaccaagataaaattaaaattcaaaaaactccatggaaagtgcctacattctctaagtacaatattgtccaattagctcccggtaaggatcacatacttttcttagatgaagagggtatggtgttcgcctggggtaacggtcagcaaaaccaattaggaagaaaagttatggaaaggttccgtttaaagactttggatcccagaccatttgggttaagacatgtaaaatacatcgcatctggcgaaaaccattgctttgctttaacaaaagacaacaagttagtaagctgggggttgaatcagtttggtcaatgtggtgtttcagaggatgtggaagacggtgcgcttgttacaaagccaaaaagactagcgctacctgataacgttgttatcagaagcattgctgctggtgaacatcactcattgatcctatcccaagatggcgatttgtattcgtgtggtagactagacatgtttgaagttggtatcccaaaagacaatttacccgaatatacttacaaagatgttcatggaaaagcacgtgccgtgccacttccaactaagttgaataatgttccgaagttcaaaagcgttgcggcggggtctcaccattcagtcgcggtagctcaaaatggcattgcctattcttggggttttggtgaaacctacgccgttggattaggcccttttgaggacgacactgaagttccaaccagaatcaagaatactgctacacaggatcataacatcattttagtcgggtgtggaggccaattttccgtgtctggtggtgttaagctgtctgatgaggacgcagaaaagagagcggatgaaatggatgattaa

SEQ ID NO: 45619 - DNA, 499 bp, Saccharomyces cerevisiae
atgtcaaaagtgtatgttattataagttttgaaagggatttcaacatatactaacaaattcttgaaatgtaccctcactgtcctattgtaaatcagaccaagaaattttaggttgttagaagaattagaaaagggtgaaaaagggtttggtccagaatcatgtagttatggtttagctgatagcgacgatattaccatgaccaaatggaacggcactattttagggccccctcatagtaatcatgaaaacagaatctattccctttctatagattgtggcccaaactatccagattctcccccaaaggtcactttcatttccaagataaatctaccatgcgtcaatccaactacgggggaggtccaaactgacttccacaccttacgtgactggaaaagagcctacaccatggaaactttattacttgatcttagaaaggaaatggcaaccccagcgaacaagaaattgcgtcaaccgaaggaaggagaaaccttttag

SEQ ID NO: 45620 - DNA, 2250 bp, Saccharomyces cerevisiae
atggatgtgagagcggcattgcaatgtttcttcagtgcattgagtggacgattcactggaaaaaaattgggactagagatctattctatccagtacaaaatgagcaatagtggtgggtcctctcctttcttggaaagccctggaggttcgcccgacgtaggcagtacaaatggacaaagtaatcgtcagattcaggcgttacaattcaagctcaatactctacaaaatgagtatgagattgaaaaattgcagctacaaaaacagacgaatatcttagaaaagaaatataaggccacgattgacgaattagagaaagcattgaatgatacaaaatatctttatgaaagcaatgataaattggagcaagagttaaagagtttgaaagaaagatcagctaattcgatgaatgataaagacaaatgcatagaggaattgcgaacaaccctccaaaacaaagatttagaaatggagactttaaggcagcagtatgattcgaagttatcaaaggtcactaaccaatgtgaccatttcaagttggaagcagagagctctcattcgctactgatgaaatatgagaaagaaataaagaggcaaagtgtggatatcaaagatttgcagcatcaagtgatggaaaaggatgatgaattatcttcggtaaaagcatctaagatgataaactcacatccaaactactccaccgaagagttcaacgagctcactgaaatgaacaaaatgatccaagaccaagttcagtatactaaagaattggaactagcgaacatgcaacaagccaatgaattgaaaaaacttaaacaatcccaggacacttctactttttggaaattagaaaatgaaaaactacaaaacaaattaagtcaattacacgtactcgaaagtcaatatgaaaatcttcaattggaaaacatagatctaaaatcgaaattaaccaaatgggaaatttataatgatagtgacgatgatgatgataacaatgttaacaacaatgataataataataataataaaaatgataataataatgataataataatgatacaagtaataacaacaatattaataataacaacagaaccaaaaataacataagaaataaccctgaagagattatccgggactggaaacttaccaaaaaggaatgtttaattttgacagatatgaatgataagttaagattggacaataacaatttaaagctactgaatgatgaaatggctttagagagaaaccaaatactagatttgaacaagaattatgaaaacaacatagtaaatttgaaaagattaaatcacgagttagaacaacagaagagtttatctttcgaagaatgtcgattactgcgcgaacaattagatggcctatattccgcacaaaataatgctttactagaggtcgaaaatagtgaaacacatgcgtcaaacaagaacgtaaacgaagatatgaataatttgatcgatacttataaaaataagacagaagatttaacaaacgaactaaagaagctaaacgatcagttattatcaaattccaatgatgtagaaacacaaagaaaaaagaggaagttgacaagtgaccaaattggtttaaattattcacagaggctcaacgaattgcaactggaaaatgtaagtgtctcgagggagttgagtaaagcacaaactacaattcagctactacaagaaaaattagaaaagttaactaaactaaaggagaaaaaaatacgtatactgcaattacgtgacggccccttcataaaagatcaatttatcaagaaaaacaaattacttcttctagaaaaggaaaatgcagatttacttaacgaattgaaaaagaataatccagcagtggaaacagtacccatttctgtttatgattcactaaatttcgagttgaaacagttcgaacaggaagtttttaagtcaaataaaagattttccagactaaagcaagttttcaataataaatctttggagtttattgacgttgtaaactcattattaggttttaaattggaatttcaacaagatagtcgtgtgaaaatattttcctgtttcaaacctgaaaaatatttgattgctgatctaaatgaaaacactttgaaatctaaccttgatgcagatatagaaggatgggatgatctcatgaatctatgggtggaagatagaggtcaacttccgtgctttttggcaacaataacattgcgtctgtgggaacagcgacaagccaaataa

SEQ ID NO: 45621 - DNA, 1572 bp, Saccharomyces cerevisiae
atgacaaaggaagaaatcgcagacaagaagagaaaggttgtagatgaggaggtaattgaaaaaaagaagagtaagaaacacaaaaaggataagaaagacaagaaggaaaagaaggataaaaagcataaaaagcataagaaggagaagaagggtgagaaggaagtggaagtaccagagaaagaatctgaaaagaaacctgaacctacttctgcagtggctagtgagttttatgttcagagtgaagcactaaccagtcttccacaatctgatattgacgaatatttcaaggaaaatgaaattgctgttgaggattctctggatctagccctacgtccgctattatcatttgattatctttctttagactcttccattcaagcagaaatttccaaatttccaaaaccaacgcctattcaagccgtagcctggccatatttgttatctggtaaagatgttgttggtgttgctgagaccggttctggtaaaacatttgctttcggtgttccagctatcagccatttaatgaacgatcaaaagaaaaggggcatacaggttctagtcatttccccaactagagaacttgcttcccaaatttatgataatctgattgtattaactgacaaggttggtatgcagtgttgttgtgtttatggtggtgttccaaaggatgagcaaagaattcagttaaaaaagtcacaagtggtggttgctacacctggtagattattagacctattgcaggaaggatctgttgacttatctcaagttaattacttagtattagacgaggcagacagaatgttggaaaaaggttttgaagaagacatcaagaatattatcagagaaactgatgcgtccaaaagacaaactctaatgtttaccgctacctggccaaaggaagtccgtgaattagcttccacgttcatgaacaacccaatcaaagtatctattggtaacacggaccaactaactgctaacaaaagaattacacagattgttgaagtggtggacccacgtggaaaagaaagaaagttattggaactgttgaaaaagtaccactctggtccaaaaaagaatgaaaaggtcttgatttttgctctttataagaaggaagctgctcgtgttgaaaggaatttgaaatataacgggtataacgtcgcagctatccatggtgatttgtcccagcaacaaagaacgcaagcattgaatgagttcaaaagcgggaagtctaacttgttactggccaccgacgttgcagcaagaggtttagatataccaaatgttaagacagttattaatttaactttcccattgactgtggaggattatgtccatagaatcggtagaactggtagagctggtcaaacaggcacagcacacactctgttcactgaacaagaaaagcatttggctggtggactggttaacgttttgaatggtgccaatcaacctgttcctgaagatttgataaagttcggtactcacactaagaagaaggaacatagcgcttatggttcattctttaaggacgtcgatttgactaagaaaccaaaaaaaattactttcgattag

SEQ ID NO: 45622 - DNA, 1164 bp, Saccharomyces cerevisiae
atgagtaacggtgcgtttgatgctatttttgagtacgcatggggccaaattgacaaacccatcagtggagactttatatatggtaaagatttgccaaagctaatcgagataattgagaatatctttcaaaaggcacagaaaagtggttcctatgagcttcgattgccattgttttcagaaatcaataaagatttgtttcgcacgttttctaatacaaaaaccttctttaaaatacacaaagaagaatttgacgatatcttcttcaatttggttaatcaccccctcagggaaatcttagaaaacgcgttcattggtgtagattctattccaagtgattttatcgtaagcatgaatttgaattcaccttccaaatttctggttgagaacaagaacaagaatacagagggggctggaatttcgacacctaggaagaagcttactgaatcacctatcaagctgttaagcaggaataatataggaaaggccttagaggtgcaggtggaggaattgaaaagagaactaactgcgaaacaaagcctccttcaggaaaatgaacgacaagtaagcgaattgaaaataaggctcgaaacttatcaagaaaagtatgcttccatacaacagcggttcagcgacttacagaaagctagacaagtggaagataatcaaaatagctccagaacatctgacccaggatcacctctggtaacgggaatcgatcaaaaagccattctggaagagtttagaagaagattacagagacaaacagacaccatatctttcctaaaggatcaaatacggcgagaaagggggctcaattgcagtaacgataaggtatcacattcaaaacgaaaacatgcaaccactgatggtgatgggactttcaagaattttatttccgcggttccctccaacatatgggtaaaagcaacaataagaattatagtctgtttcgctttactggcaggtgtcctaccatacattagaaaatacgtatatgctcatgacacaccatcccaaaactcaaggttacaattatcatggtgggaaaatagtggcatattaagcaagattgtatggttctttgaagatcagacagatttagaaactgaataccgttcaaatgccaatgtggatgacgcatatagtagagtattcggcatttaa

SEQ ID NO: 45623 - DNA, 2502 bp, Saccharomyces cerevisiae
atgaataatgctgcaaatacagggacgaccaatgagtcaaacgtgagcgatgctccccgtattgagcctttaccaagcttgaatgatgatgacattgaaaaaatcttacaaccgaacgatatctttacgaccgatcgtaccgatgcaagtactacatcttccacagccattgaagatattattaacccctcattggatccgcagtcagcagcatcgccggttccttcttcctcttttttccatgactcaaggaaaccttccaccagtacacatttagtaaggagaggtactccattgggaatttaccaaaccaatctatacggtcacaatagcagagaaaatactaatcctaatagtacattattatcttctaagttactcgcgcatccaccagttccttatgggcaaaatcccgatttactacaacatgctgtgtacagggcacagccgtcaagtggaaccactaacgcgcaaccgcgccaaaccacaagaagatatcaatcccataaatcacggcctgcatttgttaataaactatggagcatgttaaacgatgattctaatacgaaacttatacagtgggcggaggatggaaaatcttttattgtcacgaatagggaggaatttgtgcaccaaattttaccaaaatattttaaacattccaatttcgcttcctttgtaagacaattgaacatgtatggatggcataaagttcaagatgtcaagtcaggatcaattcaaagtagttcagatgataagtggcaatttgaaaatgaaaacttcattagaggtagagaagatttgctggaaaaaataatcaggcagaaaggttcctccaataaccataatagccctagtggtaacggtaatccagcgaatggtagcaacatccctctggacaatgccgcaggaagtaataatagcaataataacatcagtagtagtaattcattttttaacaatggtcatttattgcagggtaaaacactaagattaatgaacgaagcgaatcttggagataagaatgatgtcaccgcgattttgggggaattagagcaaataaaatataaccagattgcaatttccaaagatttactaagaataaacaaagataatgagttattatggcaagagaatatgatggccagggaaagacatagaacccaacagcaagccttggaaaaaatgttcagattcttgacatctatagtcccacacttagatcccaaaatgattatggacgggctgggagatccgaaagttaataatgaaaagctaaacagtgcgaataacattgggttaaatcgcgacaacacaggcactatagatgaactaaaatccaacgattctttcataaacgatgatcgtaattctttcaccaatgctacaaccaacgcccgtaataacatgagtcccaacaatgatgacaatagtattgacaccgctagcactaataccaccaacagaaagaaaaatatagatgaaaacatcaaaaataacaacgacataattaatgacattatatttaataccaaccttgccaacaatctcagcaattacaattccaacaataatgctggctcgccaataaggccctataaacaaagatatcttttgaaaaatagagccaattcctcgacatcgagtgagaatccaagcctaacgccctttgatatcgaatctaataatgaccgcaaaatttcagaaattccttttgatgacgaagaagaagaagaaacggattttaggccttttacctcgcgagatcctaataaccaaacgagtgaaaacacttttgatccaaacagatttacgatgctctctgatgatgatttaaaaaaagattctcataccaatgacaataaacacaacgaaagtgatcttttttgggacaacgtacatagaaatatagacgaacaagatgcaagactccagaacttggaaaatatggttcacatactttctcctggatatcctaataagtcgttcaacaacaaaacttcctcgacaaacactaattccaatatggaaagtgctgtcaacgttaatagccctggtttcaacttacaggattatttaactggagagtctaattcccccaattctgttcattctgttccctccaatggcagcggctccacaccgttgcccatgccaaatgataatgacaccgagcacgcaagtacaagtgtcaatcaaggcgaaaatggaagcggattaacgcccttcctcacggtagatgatcacacactaaacgacaataacactagtgagggaagtacaagggtgtcccccgatataaagttcagcgccactgaaaacactaaagtgagtgataacctgccaagctttaatgaccacagttattccacccaggccgacacggcgcccgagaacgctaagaaaagatttgtggaggaaataccggaaccggctatagtcgaaatacaggacccgacagagtacaacgatcaccgcctgcccaaacgagctaagaaatag

SEQ ID NO: 45624 - DNA, 369 bp, Saccharomyces cerevisiae
atgactacgtttagattttgtcgtgactgcaacaatatgttgtaccctcgtgaggataaagaaaataaccggttgttatttgaatgcagaacatgctcgtatgtagaagaagcgggcagtccattggtctacaggcatgaattgattaccaacattggtgaaactgcgggagtggtgcaagatattggttccgatcccactcttccgagatctgatagagaatgtcccaaatgtcactctcgggaaaatgtgttttttcaatcacaacaaagaagaaaggatacttcgatggttttattctttgtgtgcttatcttgctcacacatatttacttcagatcaaaaaaacaaaaggacgcagttttcatga

SEQ ID NO: 45625 - DNA, 1686 bp, Saccharomyces cerevisiae
atgtcgctttttttcaagccagtaatttcaccacagtggtctttccccgtgcttctcaagataggagtgcgttcttatgcgggaggcccaagaacaaagcataaaggaaactctccattagcttcagtgcctacaggcagtagtaataaaaaccgaaaacagaaggccaaaggcaaaaaaggtaacaaaaagaatgaccctgaccaagcattcaactttggagagtatggtggattgaaaaaagacgtcgagatgaatatggacagtacgaataaactcattcaaaaaatatcgaatttcgaccaattgcttatacttccacctgtcagagacgctgtgaaagaaatcatttccaaagagtccctgaagctacaagatagtaggaaaaaaaccagtgaaaatataataccgagtcccattcaaacagtggccattaagagaatatccaaaaatttaatggatccaaagttacaaatacatgcgattgccgctgagacaggttcaggtaagaccatggcctacttgatacctttaatagactatttgaaaagacaggagttggaaactcccgaattatgggaaacattaagaaaaaacgttctgattcggtccatcatactggtgcctacgcatgaattggttgaccaagtatacgaaactgtttccaagacgaaaaccttgttaggcttaaactctttcaagtgggacaaggccacatcatatcgtgatttattagagaacattaaaaatagaatagatattttagtcactactccgggaaaactactgaacctgttctccataagaatgataactagacctgataaagtcttgtccaaagtgggtttcgtagtactagatgaagctgacacacttctagataggtcatggcttgaagaaacgcactccgcaataaagagaattcctaacattaatcaccttattttctgttccgctactattcctcaagagtttaataaaacaatgcaaagactatttcctacagtggttcctataatgacacccagactgcataagttaccattcgctttggactttaaagttataaattctgccttaagtcctttcaagggatccaagatcaaagcattggcacaaactttatatgctatttcaaatgatgacacggaaccagggttcgagaaaagatgcattatctttgttaacgaaaaaaagaatgttcctgaaattgttaacctattgaataagaaattcggtcataatgccatcggtttaactggtgaagatacatttgaagaaagatccgagaaaattatgccctttttatcaccaccgcgaccactttcggaggtggttgctcagagtacttcacctcccacttccttgaagaaatttgaaattcctgattccaacatcgtcatcggcaaattgaaaaacacaaattctaatggtaccgcacccagtaacaagtctttgcatgtactcgtaaccaccgacctcatggcaagagggctcaatttcaaaggtgtacggaatgttgttctctacgatgtacccaaaacgtcaatagacctgatacaccgagtgggcagaactgctagaatgaaacagggcggccgcgtatttatgctaactgacagtaaaacaaaatcttgggctaaagctcttccaaagatcatcaaaaagcaccagagattatcatga

SEQ ID NO: 45626 - DNA, 3537 bp, Saccharomyces cerevisiae
atgtcgcaaagaaaattcgccggcttgagagataacttcaatctcttgggtgaaaagaacaaaatattggtggctaatagaggagaaattccaatcagaatttttcgtaccgctcatgaactgtctatgcagacggtagctatatattctcatgaagatcgtctttcaacgcacaaacaaaaggctgacgaagcatacgtcataggtgaagtaggccaatatacccccgtcggcgcttatttggccattgacgaaatcatttccattgcccaaaaacaccaggtagatttcatccatccaggttatgggttcttgtctgaaaattcggaatttgccgacaaagtagtgaaggccggtatcacttggattggccctccagctgaagttattgactccgtgggtgataaggtctcagctagaaacctggcagcaaaagctaatgtgcccaccgttcctggtacaccaggtcctatagaaactgtagaggaagcacttgacttcgtcaatgaatacggctacccggtgatcattaaggccgcctttggtggtggtggtagaggtatgagagtcgttagagaaggtgacgacgtggcagatgcctttcaacgtgctacctccgaagcccgtactgccttcggtaatggtacctgctttgtggaaagattcttggacaagccaaagcatattgaagttcaattgttggccgataaccacggaaacgtggttcatcttttcgaaagagactgttccgtgcagagaagacaccaaaaggttgtcgaagtggccccagcaaagactttaccccgtgaagtccgtgacgccattttgacagatgcagttaaattggccaaagagtgtggctacagaaatgcgggtactgctgaattcttggttgataaccaaaatagacactatttcattgaaattaatccaagaatccaagtggaacataccatcacagaagaaattaccggtatagatattgtggcggctcagatccaaattgcggcaggtgcctctctaccccagctgggcctattccaggacaaaattacgactcgtggctttgccattcagtgccgtattaccacggaagaccctgctaagaacttccaaccagataccggtagaatagaagtgtaccgttctgcaggtggtaatggtgttagactggatggtggtaacgcctatgcaggaacaataatctcacctcattacgactcaatgctggtcaaatgctcatgctccggttccacctacgaaatcgttcgtagaaaaatgattcgtgcattaatcgagttcagaattagaggtgtcaagaccaacattcccttcctattgactcttttgaccaatccagtatttattgagggtacatactggacgacttttattgacgacaccccacaactgttccaaatggtttcatcacaaaacagagcccaaaaacttttacattacctcgccgacgtggcagtcaatggttcatctatcaagggtcaaattggcttgccaaaattaaaatcaaatccaagtgtcccccatttgcacgatgctcagggcaatgtcatcaacgttacaaagtctgcaccaccatccggatggaggcaagtgctactagaaaaggggccagctgaatttgccagacaagttagacagttcaatggtactttattgatggacaccacctggagagacgctcatcaatctctacttgcaacaagagtcagaacccacgatttggctacaatcgctccaacaaccgcacatgcccttgcaggtcgtttcgccttagaatgttggggtggtgccacattcgatgttgcaatgagatttttgcatgaggatccatgggaacgtttgagaaaattaagatctctggtgcctaatattccattccaaatgttattgcgtggtgccaatggtgtggcttattcttcattgcctgacaatgctattgaccatttcgtcaagcaagccaaggataatggtgttgatatatttagagtctttgatgccttaaatgacttggaacaattgaaggtcggtgtagatgctgtgaagaaggcaggtggtgttgtagaagccactgtttgtttctctggggatatgcttcagccaggcaagaaatacaatttggattactacttggaaattgctgaaaaaattgtccaaatgggcactcatatcctgggtatcaaagatatggcaggtaccatgaagccagcagctgccaaactactgattggatctttgagggctaagtaccctgatctcccaatacatgttcacactcacgattctgcaggtactgctgttgcatcaatgactgcgtgtgctctggcgggcgccgatgtcgttgatgttgccatcaactcaatgtctggtttaacttcacaaccatcaatcaatgctctgttggcttcattagaaggtaatattgacactggtattaacgttgagcatgtccgtgaactagatgcatattgggcagagatgagattgttatactcttgtttcgaggctgacttgaagggcccagatccagaagtttatcaacatgaaatcccaggtggtcaattgacaaacttgttgtttcaagcccaacaattgggtcttggagaacaatgggccgaaacaaaaagagcttacagagaagccaattatttattgggtgatattgtcaaagttaccccaacttcgaaggtcgttggtgatctggcacaatttatggtctccaataaattaacttccgatgatgtgagacgcctggctaattctttggatttccctgactctgttatggatttcttcgaaggcttaatcggccaaccatatggtgggttcccagaaccatttagatcagacgttttaaggaacaagagaagaaagttgacttgtcgtccaggcctggaactagagccatttgatctcgaaaaaattagagaagacttgcagaatagatttggtgatgttgatgagtgcgacgttgcttcttataacatgtacccaagagtttatgaagacttccaaaagatgagagaaacgtatggtgatttatctgtattgccaacaagaagctttttgtctccactagagactgacgaagaaattgaagttgtaatcgaacaaggtaaaacgctaattatcaagctacaggctgtgggtgatttgaacaaaaagaccggtgaaagagaagtttactttgatttgaatggtgaaatgagaaaaattcgtgttgctgacagatcacaaaaagtggaaactgttactaaatccaaagcagacatgcatgatccattacacattggtgcaccaatggcaggtgtcattgttgaagttaaagttcataaaggatcactaataaagaagggccaacctgtagccgtattaagcgccatgaaaatggaaatgattatatcttctccatccgatggacaagttaaagaagtgtttgtctctgatggtgaaaatgtggactcttctgatttattagttctattagaagaccaagttcctgttgaaactaaggcatga

SEQ ID NO: 45627 - DNA, 519 bp, Saccharomyces cerevisiae
atgtccacaccagctagaagaaggttgatgagagattttaaacgtatgaaggaagatgccccaccgggtgtatctgcttcaccattacctgataacgtcatggtatggaacgccatgattatcgggccagccgatactccatatgaagacggaacttttaggttattgttggagtttgatgaagaatatcccaataagccaccgcatgtcaaatttttgagtgaaatgtttcatcccaatgtctatgcaaatggtgaaatttgtttggatattttgcagaacagatggactccaacatatgatgtcgcatccatattgacatccattcaaagtttattcaacgatccaaatccagcttcgccagcaaacgttgaagctgcaacattattcaaagatcataaatcacagtacgtcaaaagagttaaggagacggtagagaaatcttgggaggatgatatggacgatatggacgatgatgatgatgatgatgacgacgacgacgacgacgaagcagactga

SEQ ID NO: 45628 - DNA, 1533 bp, Saccharomyces cerevisiae
atgccaacttctggaactactattgaattgattgacgaccaatttccaaaggatgactctgccagcagtggcattgtcgacgaagtcgacttaacggaagctaatattttggctactggtttgaataagaaagcaccaagaattgtcaacggttttggttctttaatgggctccaaggaaatggtttccgtggaattcgacaagaagggaaacgaaaagaagtccaatttggatcgtctgctagaaaaggacaaccaagaaaaagaagaagctaaaactaaaattcacatctccgaacaaccatggactttgaataactggcaccaacatttgaactggttgaacatggttcttgtttgtggtatgccaatgattggttggtactttgctctctctggtaaagtgcctttgcatttaaacgttttccttttctccgttttctactacgctgtcggtggtgtttctattactgccggttaccatagattatggtctcacagatcttactccgctcactggccattgagattattctacgctatcttcggttgtgcttccgttgaagggtccgctaaatggtggggccactctcacagaattcaccatcgttacactgataccttgagagatccttatgacgctcgtagaggtctatggtactcccacatgggatggatgcttttgaagccaaatccaaaatacaaggctagagctgatattaccgatatgactgatgattggaccattagattccaacacagacactacatcttgttgatgttgttaaccgctttcgtcattccaactcttatctgtggttactttttcaacgactatatgggtggtttgatctatgccggttttattcgtgtctttgtcattcaacaagctaccttttgcattaactccttggctcattacatcggtacccaaccattcgatgacagaagaacccctcgtgacaactggattactgccattgttactttcggtgaaggttaccataacttccaccacgaattcccaactgattacagaaacgctattaagtggtaccaatacgacccaactaaggttatcatctatttgacttctttagttggtctagcatacgacttgaagaaattctctcaaaatgctattgaagaagccttgattcaacaagaacaaaagaagatcaataaaaagaaggctaagattaactggggtccagttttgactgatttgccaatgtgggacaaacaaaccttcttggctaagtctaaggaaaacaagggtttggttatcatttctggtattgttcacgacgtatctggttatatctctgaacatccaggtggtgaaactttaattaaaactgcattaggtaaggacgctaccaaggctttcagtggtggtgtctaccgtcactcaaatgccgctcaaaatgtcttggctgatatgagagtggctgttatcaaggaaagtaagaactctgctattagaatggctagtaagagaggtgaaatctacgaaactggtaagttcttttaa

SEQ ID NO: 45629 - DNA, 417 bp, Saccharomyces cerevisiae
atgggtgcttggttatttatccttgctgttgttgtcaactgtatcaatttgtttggccaagtgcatttcacaatactatacgctgatttagaagctgactatatcaatccaattgaattatgttctaaagttaacaagttaattacccctgaagccgccttgcatggtgctttgtcattactattcttactgaacggttactggtttgtatttttattgaacttaccagttctagcttacaatctaaacaagatctacaataaagttcaacttttggatgctaccgaaatattcagaactttaggcaaacataaaagggagagtttcctaaagttaggtttccacttattgatgttcttcttctacttgtacagaatgatcatggctttgattgctgaaagtggtgatgacttctaa

SEQ ID NO: 45630 - DNA, 1218 bp, Saccharomyces cerevisiae
atgacagctgctgtaacatcctccaatatagtattagaaacccacgaaagtggtatcaaaccatattttgaacagaagatccaagaaacagaattaaagatccgctccaaaacagaaaatgttcgcagactggaagctcaaaggaatgcattgaatgacaaagtacgttttatcaaggacgaactgcgtctattacaggaacctggatcttatgtgggtgaagttataaagatcgtgtctgacaaaaaagttctcgttaaagtgcaacctgagggaaaatacatcgtggatgttgcaaaagatataaacgtgaaggacttaaaggcatctcaaagagtttgtctaaggagtgactcttatatgttgcataaagttcttgagaataaggctgacccactagtttcgttgatgatggtggaaaaagttcctgattccacatacgatatggttggtggtttgacaaagcaaataaaggagattaaagaagttattgaattgcccgtaaaacatcctgaactttttgaaagtttgggtattgcgcaaccaaagggtgtcatcttatatggcccccctggtacagggaaaaccttattggcaagagctgtcgcacatcacactgattgtaaattcatcagggtcagtggtgcggaactggtacaaaagtatatcggcgaaggttcccgtatggtccgtgagctgtttgtgatggctagagaacatgctccctcaattatctttatggatgaaatcgattccattggctctactcgtgtagaaggttctggtggtggtgattcagaagttcaaagaacaatgttagaactactaaaccaattggacgggtttgaaacttctaaaaatatcaagatcataatggccacgaatagactagatattctagatccagcacttttgagacccggtagaatagataggaagattgaatttccacctccaagtgtcgcagctagagctgaaattttaagaatccattccagaaaaatgaatctaactcgtggtatcaacttgagaaaggttgctgaaaagatgaacggttgttctggtgccgatgtcaaaggtgtctgtacagaagctggtatgtatgctttaagagaaagaagaatacacgttactcaagaagacttcgaactcgctgtgggtaaggttatgaacaagaaccaagaaacggccatttctgtcgccaagctgttcaagtga

SEQ ID NO: 45631 - DNA, 930 bp, Saccharomyces cerevisiae
atggatagtaaggaagtactggtacatgttaagaatctagaaaagaacaaaagtaatgatgctgcagttctagaaatcttacatgtcttggataaagaattcgtccccactgaaaagttactgagagaaacaaaagttggtgtggaagtcaacaagtttaaaaaatccactaatgtagagatcagcaaactcgtgaagaaaatgattagctcttggaaagacgcaattaataaaaataagcgttccaggcaagcacagcagcatcatcaagatcatgcgccaggcaatgcagaggacaagacaactgtaggtgagtccgtgaatggtgttcaacagccggcctcctcccagtcagatgccatgaaacaagacaagtacgtcagcactaaaccaagaaatagtaagaacgatggtgtggatacagctatataccaccacaaattacgtgatcaggtactaaaagcactctacgacgttttggccaaggaaagtgagcatccacctcaatctattttgcatactgcaaaggccatagaaagtgaaatgaataaagttaacaactgtgacaccaacgaagccgcttacaaagccaggtatcgtataatttattcaaacgtcatatcaaagaataacccagatctcaaacataaaattgccaacggtgatataacacctgaattcttagctacatgcgatgccaaggatctggcaccagcgcccttaaagcaaaagatagaagaaattgccaagcaaaacttatacaacgcacagggtgccaccatagaaaggtcagtcaccgatagatttacatgtggtaaatgtaaagagaagaaggtatcttactatcaattgcaaacaagatctgcggatgaaccattgaccactttctgtacatgtgaagcatgtggtaacagatggaaattctcttag

SEQ ID NO: 45632 - DNA, 1029 bp, Saccharomyces cerevisiae
atgcatacagctgaatttttggaaacagaaccaacagaaatctcatctgttctagcaggtggttataatcacccactgctgagacagtggcaaagtgagcgtcaactgactaagaacatgttgatttttccgctattcatctccgataatccagatgactttactgaaattgactctctacctaatatcaatagaatcggtgtaaataggctaaaagactacttaaagccattagtggccaagggtttgcgttctgtgatcttgtttggtgtgcctctcatccctggtaccaaggatccagtgggtacagcggctgacgatcctgcagggccagtcattcaaggtattaaattcattcgtgagtatttccctgaactgtatattatttgcgatgtctgtctctgtgaatacacttctcatggccattgcggggttctatacgatgatggtactattaatagagaacgtagtgtctctagattagcagctgtggcagttaactacgctaaagctggtgcgcactgtgtggctcccagtgatatgatcgatggtaggatcagagatattaaacgaggcttaataaatgcaaacttggctcacaagaccttcgtgttatcctatgcagctaagtttagcggtaatctatatgggccattccgtgatgctgcttgttcagctccttcgaatggtgataggaaatgttaccaattacctcctgccggtcgtggcctggcacgtagggcgttggaaagggatatgagtgaaggtgccgacggtattattgttaagccttccactttctacttagatataatgagggatgcaagtgaaatttgtaaagacttaccaatctgcgcatatcacgtgtcgggcgaatacgcaatgttacatgctgcagctgaaaaaggtgttgttgatttgaagacaattgcctttgaatctcatcaaggtttcttgagggcgggtgccagattaatcatcacttatttggctcctgagttcctagactggttagatgaagaaaactaa

SEQ ID NO: 45633 - DNA, 1443 bp, Saccharomyces cerevisiae
atgtctaggaagttgtcccacctgatcgctacaaggaaatcaaaaacaatagtcgtaaccgtacttcttatttattctttgttgacatttcacttgtcaaacaaaaggctgctttctcagttttaccctagcaaagatgatttcaagcaaactcttctccctacgacttctcattcacaagatataaatttgaagaaacaaattacagttaacaagaaaaaaaatcaattgcataatttacgtgatcaattatcgtttgcgtttccctacgactctcaggcccccatcccgcaaagggtgtggcagacctggaaagtcggcgcagatgataagaattttccctcttcgttcagaacctatcaaaaaacatggtctggttcgtattcaccggattaccaatattctctgatttcggatgattctattatcccttttttggagaatctttacgcacccgttccgatagtcatccaagcgtttaaattgatgcctggaaatatcctaaaggcagattttttaaggtacctattattatttgcaagaggtggtatttactcagatatggatactatgcttttgaagccaattgattcatggccttctcagaataagtcatggctaaacaacataatagatttgaataaacctattccttataagaactcaaagccctcacttctctcaagtgatgagatatcacaccagccaggtttggtcatcggcattgaggcagatccggacagagatgattggagtgaatggtatgctcgtaggatccagttttgtcaatggactatccaagccaaaccaggtcacccaattctaagagaattgatcttaaatattactgcaacgactttggcgagcgtacaaaacccaggagttcctgtcagtgaaatgattgatccaagatttgaagaagactacaacgtaaactataggcacaaaagacgtcatgatgagacctacaaacactccgaattgaaaaataacaaaaatgttgatggctcagatataatgaattggacgggtccaggtattttctccgacattattttcgaatacatgaacaatgtgctccgatacaatagcgatatcttgttaatcaacccaaacctaaacaagaacgacgaagaaggtagtgagagtgccaccacaccagcaaaagatgttgataacgatacgctgtccaaatcaacaagaaaattttataagaaaatatcagagtctttgcaatcgtcaaattcaatgccctgggaattcttctcttttttgaaagaaccagttatcgttgatgatgtgatggttctaccaataacaagtttttcaccagatgtggggcagatgggcgcccagtctagtgacgacaaaatggcttttgtaaagcacatgtttagcgggagctggaaagaagatgctgataaaaatgcaggtcataaataa

SEQ ID NO: 45634 - DNA, 1515 bp, Saccharomyces cerevisiae
atgcaaagcccatatccaatgacacaagtgtctaacgttgatgatgggtcactattgaaggagagtaaaagcaagtccaaagtagctgcgaagtcagaggcgccaagaccacatgcttgtcctatctgtcatagagcttttcacagactggaacatcagacgagacacatgagaattcatacaggtgagaagcctcacgcgtgtgacttccccggatgtgtgaaaaggttcagtagaagcgatgaactgacgagacacagaagaattcatacaaactcccaccctcgaggtaaaagaggcagaaagaagaaggttgtgggctctccaataaatagtgctagttctagtgctaccagtataccagatttaaatacggcaaatttttcaccgccattaccacagcaacacctatcgcctttaattcctattgctattgctccgaaagaaaattcaagtcgatcttctacaagaaaaggtagaaaaaccaaattcgaaatcggcgaaagtggtgggaatgacccatatatggtttcttctcccaaaacgatggctaagattcccgtctcggtgaagcctccaccttctttagcactgaataatatgaactaccaaacttcatccgcttccactgctttgtcttcgttgagcaatagccatagtggcagtagactgaaactgaacgcgttatcgtccctacaaatgatgacgcccattgctagcagtgcgccaaggactgttttcatagacggtcctgaacagaaacaactacaacaacaacaaaattctctttcaccacgttattccaacactgttatattaccaaggccgcgatctttaacggattttcaaggattgaacaatgcaaatccaaacaacaatggaagtctcagagcacaaactcagagttccgtacagttgaagagaccaagttcagttttaagtttgaacgacttgttggttggccaaagaaataccaacgaatctgactctgattttactactggtggtgaggatgaagaagacggactaaaggacccgtctaactctagtatcgataaccttgagcaagactatttgcaagagcaatcaagaaagaaatctaagacttccacgcccacgacaatgctaagtagatccactagtggtacgaatttgcacactttggggtatgtaatgaaccaaaatcacttgcatttctcctcatcatctcctgatttccaaaaggagttgaacaacagattactgaacgttcaacaacagcagcaagagcaacataccctactgcaatcacaaaatacgtcaaaccaaagtcaaaatcaaaatcaaaatcaaatgatggcttccagtagttcgttaagtacaaccccgttattattgtcaccaagggtgaatatgattaatactgctatatccacccaacaaacccccatttctcagtcggattcacaagttcaagaactggaaacattaccacccataagaagtttaccgttgcccttcccacacatggactga

SEQ ID NO: 45635 - DNA, 264 bp, Saccharomyces cerevisiae
atgcagttacttcgctgtttttcaatattttctgttattgcttcagttttagcacaggaactgacaactatatgcgagcaaatcccctcaccaactttagaatcgacgccgtactctttgtcaacgactactattttggccaacgggaaggcaatgcaaggagtttttgaatattacaaatcagtaacgtttgtcagtaattgcggttctcacccctcaacaactagcaaaggcagccccataaacacacagtatgttttttga

SEQ ID NO: 45636 - DNA, 837 bp, Saccharomyces cerevisiae
atgtcgcaagagtttgtggaagactattcacgtacagggtcctcagacgacgaggatagtggagcttatgacgagtggattccatcgttctgttccagatttggtcacgagtacttctgccaagtcccgacagagtttatcgaggatgatttcaatatgacctcgttatcccaagaggtaccccactaccggaaagctctggatttgatattggatttggaggctatgagtgatgaagaagaggacgaagacgacgtggtggaagaagacgaagtggatcaagagatgcagagtaatgacggtcatgatgaaggcaaaaggagaaacaagtcgccagtggtgaacaagagtattatcgagcacgcagcagaacagttatacggattgatacatgcaagatttattctgaccaagccaggcctgcaagcaatggctgaaaaattcgaccacaaggaatttggaacgtgcccccgttactattgtaatggcatgcagttgctgccttgtgggttgagcgatacagttgggaaacacaccgtaaggttgtactgtcccagttgtcaggacttgtatcttccccaatcatctagattcctgtgcttagaaggtgcattttgggggacaagcttccctggtgtgttcttgaaacatttcaaagaattggaagagtatgtggaaaggaaaagtaaagagtcctacgagttgaaagtttttgggttcaggataaatgatgaggcagtatctggtcctagaatgaagtggttgagacaatatccatccacggaggaggactgggaagaatttgccaaatgcgagttcgagacaccggcggtttaa

SEQ ID NO: 45637 - DNA, 1422 bp, Saccharomyces cerevisiae
atggcaaaggataatagtgagaagctgcaggtgcagggagaggagaaaaagtccaagcaaccggttaatttcctgcctcagggtaaatggctgaagccaaatgaaatcgaatatgagtttggtgggactactggtgttattggtatgctgatcgggtttccactgctaatgtactatatgtggatttgtgcggaattttatcacggtaaggttgccctacccaaggctggtgaatcgtggatgcactttatcaagcacctataccagttagtcttggagaacggtatcccagaaaagtatgactggactattttcttaacattttgggtgtttcagatcattttctactatacgttgcccgggatttggacaaaaggtcaaccattgtctcatttgaagggaaaacaattgccttacttttgtaatgccatgtggaccttgtatgtaactaccactttggtcttggttttgcactttaccaatctttttagattgtatgtcattattgaccgttttgggaggatcatgacatgtgccattatttcagggtttgccttctccatcatattgtacttatggactttatttatctcacatgactatcatagaatgacaggaaaccatctatatgatttcttcatgggagctccactaaaccctaggtgggggattttggacttgaagatgtttttcgaggttagattaccttggttcaccctttactttatcactttgggtgcctgtttgaagcagtgggagacttacggctatgtgacaccacaattgggggttgtcatgttagctcattggttgtacgcgaacgcatgtgctaaaggtgaagaattgattgttccaacctgggacatggcttacgaaaagtttggatttatgctgatcttctggaatattgccggtgtcccatacacttactgtcattgtacgttgtatttgtactaccatgacccatctgaatatcactggtctacactgtacaatgtttcgctgtacgttgttctattatgcgcctactacttctttgacacggcaaatgctcagaaaaatgccttcagaaagcaaatgtctggtgacaagacaggtaggaagactttcccatttttgccataccaaattttgaagaatccaaagtatatggttacctccaatggatcgtacctattgattgatggttggtacactttggctagaaaaattcactacactgccgattggactcaatctctcgtttgggccttgtcttgcgggttcaactcggtgttcccatggtttttcccagtattcttccttgttgtcctgattcacagagccttcagagaccaagcaaaatgtaagagaaagtacggaaaagattgggatgagtattgtaaacattgcccttacgtctttattccttatgttttctag

SEQ ID NO: 45638 - DNA, 759 bp, Saccharomyces cerevisiae
atgtcgggtgctgctgctgcatctgctgctggttatgacaggcacatcactatcttttcccccgagggtcgtttatatcaagtagaatatgcctttaaagcgactaatcaaactaacataaactcactagcggtcagaggtaaagattgtacagtggtgataagtcagaaaaaggtccctgataaactgttggatccaactactgtttcgtatattttttgtatttcaagaacaattggtatggtagtgaacggaccaataccggatgcaagaaatgcggccctaagagccaaggctgaggctgcagaattccgttataaatatggttatgatatgccatgcgatgtattggctaagagaatggctaacctttcccaaatctatactcaaagagcatatatgagaccattaggtgttatactcacatttgtttcggtagatgaagaattgggtccctccatttacaaaactgaccctgcaggttattacgttggctacaaagctactgcgacaggaccaaaacaacaggagatcacaacaaacttagaaaaccatttcaaaaagagtaaaatcgaccatattaatgaagaatcatgggagaaggtggtagaatttgctattactcatatgattgacgcactgggtaccgaattttcaaagaatgacttggaagtcggtgtcgctacaaaggacaaattctttaccttgagtgctgagaacatcgaagaaaggctagtagcaattgctgaacaagattaa

SEQ ID NO: 45639 - DNA, 2340 bp, Saccharomyces cerevisiae
atggtttacactccatccaagggtccaagaactctttacgataaggtttttgatgcacatgttgtccatcaagatgaaaatggttcctttttgttgtatatcgacagacacttggttcatgaagtcacctctccacaagctttcgaaggcctagaaaatgccggcagaaaggtcagaagagttgattgtactctagctactgtagatcataatattccaactgaatcaagaaagaatttcaaatcactagacacatttatcaagcaaactgattcgcgtttacaagtcaaaactttagagaataatgttaaacagttcggcgttccatatttcggtatgagtgatgccagacaaggtatcgtccacaccatcggtcccgaagaaggtttcactttaccaggtaccactgttgtttgtggtgactctcatacctctactcacggtgcctttggttcgctggcctttggtattggtacttctgaagttgaacacgtcttggccactcaaacaattatccaagctaaatcgaaaaacatgagaattactgttaatggtaagctatcacctggtatcacatctaaagatttgattttgtatattattggtctgataggtactgcaggtggtactggttgcgttattgaattcgcaggtgaagccattgaagctctttctatggaagcacgtatgtccatgtgtaacatggccatcgaagctggtgcaagagcaggtatgattaaaccagacgaaactactttccaatacaccaaaggcagacctttggctccaaaaggtgccgaatgggaaaaggctgttgcctactggaaaactttgaaaacagacgaaggtgccaaatttgaccacgaaatcaacattgaagctgtcgacgtgattccaactattacatggggtacttctcctcaagatgccttaccaattactggttccgtaccagatccaaaaaatgttacagacccaataaagaaatctggtatggaaagagccttagcctatatgggtttggaacctaacacaccgctaaagagcatcaaagtagataaagtctttattggatcttgtaccaatggccgtattgaagatttaagaagtgctgcagctgtagttaggggtcaaaaattggctagtaacatcaaattagctatggttgttccgggatctggtttggtcaaaaaacaagccgaagcagaaggtttggacaagattttccaagaagctggttttgaatggagagaagctggttgttcaatatgtttaggtatgaaccctgatattttggatgcctatgaacgttgtgcttctacttccaacagaaatttcgaaggtcgtcaaggtgccttgtctcgtacacatctaatgtccccagccatggcggctgctgcaggtatcgcaggtcacttcgtagatattagagaattcgaatataaggatcaagaccaaagtagtccaaaggttgaggtcacttccgaagatgaaaaagagcttgaaagtgctgcttacgatcacgctgaacctgtccaacccgaagacgctccccaagatattgccaatgatgaattaaaagatattccagtgaagtcagatgatacacctgctaaacctagctcttccggcatgaagccatttttgactttggaaggtattagcgcaccattagataaggccaatgttgatacagacgctattatcccaaagcaatttttaaagacaattaagagaacgggtttgaaaaaagggttgttttatgaatggcgtttccgtaaagacgatcaaggtaaggatcaagaaaccgattttgtattaaatgttgaaccttggagggaagctgaaatattggttgttactggtgacaatttcggatgtggttcttccagagaacacgcaccatgggctctaaaagactttggtataaaatccatcattgcaccttcttacggtgatattttctacaacaactctttcaagaacggcttattacctattagattggatcaacaaataatcattgacaaattgatccctattgctaataagggtggtaagctctgcgtcgatttaccaaatcaaaaaattttggattccgatggcaatgtgctcgttgatcattttgaaatagaacctttcagaaagcactgcctagttaacggtcttgatgatattggtattacattgcaaaaggaagaatacatttccagatacgaagctttgagaagagagaaatactcattcttggaaggtggatcaaaattattaaaatttgacaacgttccaaaaagaaaagctgttacaactactttcgataaagtccaccaggattggtag

SEQ ID NO: 45640 - DNA, 2757 bp, Saccharomyces cerevisiae
atgactgatacatcatcctcttcatcatcctcttcagcatcttctgtttcagctcatcagccaactcaagaaaagcctgctaagacttacgatgacgctgcatctgaatcttctgacgatgacgatatcgatgctttaatcgaagaactacaatctaatcacggtgtcgacgacgaagacagtgataacgatggtccagttgccgccggtgaagctagaccagttccagaagaatatttacaaactgacccatcttacggtttaacttccgatgaagttttgaaaagaagaaagaagtacggtttgaatcaaatggctgacgaaaaagaatctttagtcgttaagttcgttatgtttttcgtcggtccaattcaattcgttatggaagccgctgctattttggctgccggtttgtccgattgggtcgatttcggtgttatctgtggtttgttaatgttaaacgctggtgttggtttcgttcaagaattccaagctggttctattgtcgatgaattgaaaaagactttggctaacactgctgttgttatcagagacggtcaattggttgaaattccagccaacgaagtcgtcccaggtgatattttgcaattggaagatggtactgttatcccaactgatggtcgtattgtcactgaagactgtttcttgcaaatcgatcaatctgctattactggtgaatctttggctgtcgacaaacattacggtgaccaaactttctcttcttccactgttaagagaggtgaaggtttcatggttgttaccgctaccggtgacaacactttcgttggtagagctgctgctttggttaacaaagccgctggtggtcaaggtcatttcactgaagttttgaacggtattggtattatcttattggttttggtcattgccactttgttgttggtctggactgcttgtttctacagaaccaacggtattgttagaatcttgagatacactctaggtattactattattggtgtcccagtcggtttgccagctgtcgttaccaccactatggccgtcggtgctgcttacttggctaagaaacaagccattgttcaaaagttgtctgctattgaatccttggctggtgtcgaaatcttgtgttccgacaaaaccggtactttgaccaagaacaagttgtccttgcacgaaccatacactgttgaaggtgtttctccagacgacttgatgttgactgcttgtttggctgcttccagaaagaagaagggtttggatgctattgataaggctttcttgaagtctttgaagcaatatccaaaggctaaggacgctttgaccaagtacaaggttttggaattccatccatttgaccctgtctccaagaaggttactgccgttgtcgaatctccagaaggtgaaagaattgtttgtgttaagggtgctccattattcgtcttgaagactgtcgaagaagatcacccaatcccagaagatgtccatgaaaactacgaaaacaaggttgctgaattggcttctagagggttccgtgctttaggtgttgctagaaagagaggtgaaggtcactgggaaatcttgggtgttatgccatgtatggatccaccaagagacgatactgctcaaactgttagcgaagctagacacttgggtctaagagttaagatgttaactggtgatgctgttggtattgctaaggaaacttgtagacaattgggtttgggtaccaacatttacaacgctgaaagattaggtctaggtggcggtggtgacatgccaggttctgaattagctgattttgttgaaaatgccgatggtttcgctgaagttttcccacaacataaatacagagttgttgaaatcttgcaaaacagaggttacttggttgctatgactggtgatggtgttaacgatgctccatctttgaagaaggctgatactggtattgctgtcgaaggtgctactgatgctgccagatctgctgctgatattgttttcttggctcctggtctatctgctattattgatgctttgaagacctccagacaaatttttcacagaatgtactcttacgttgtttaccgtattgctttgtctctacatttggaaatcttcttgggtctatggattgctattttggataactctttggacattgatttgattgttttcatcgctattttcgctgatgttgctactttggctattgcttacgataatgctccttactctccaaagcccgttaaatggaacctaccaagattatggggtatgtctattattttgggcatagttttagctataggttcttggattaccttgactactatgttcttaccaaagggtggtattatccaaaacttcggtgctatgaacggtattatgttcttgcaaatttccttgactgaaaactggttgattttcattaccagagctgctggtccattctggtcttctatcccatcctggcaattggctggtgccgtcttcgctgtcgacatcatcgctaccatgtttaccttattcggttggtggtctgaaaactggactgatattgttactgtcgtccgtgtctggatctggtctatcggtatcttctgtgttttgggtggtttctactacgaaatgtccacttctgaagcctttgacagattgatgaacggtaagccaatgaaggaaaagaagtctaccagaagtgtcgaagacttcatggctgctatgcaaagagtctctactcaacacgaaaaggaaacctaa

SEQ ID NO: 45641 - DNA, 3522 bp, Saccharomyces cerevisiae
atgtctagacaagacgaaaattctgctttactagcgaataatgaaaataacaaaccatcgtatacgggaaatgagaacggagtctacgataatttcaaattatcaaaaagtcaactttcggatcttcataaccctaaatcaataagatcatttgtcagattatttggatatgagtctaacagcctcttcaaatacttgaaaacagataaaaatgcaggcatttctcttccagaaatatcaaattatcgaaagacaaaccggtataaaaattatggcgataattcacttcctgaaagaataccaaagtcttttttacaattagtatgggctgcttttaatgacaaaacaatgcaattactgacagtcgccgctgttgtttcctttgttttaggtctatacgaactatggatgcaacctccacagtatgatcctgaaggaaataaaattaagcaagttgactggattgaaggggttgctatcatgattgcggtctttgtggtagttctagtgagtgccgctaacgattaccagaaggagttgcaatttgcaaagctaaataaaaagaaggaaaaccgtaaaattatagtcataagaaatgatcaggaaatattaatttccattcaccacgttttagtcggtgatgtcatttcattacaaaccggtgatgttgtccccgctgattgtgttatgatatcagggaagtgtgaggcagatgaatcatccatcactggtgaatctaacacaatacagaaatttccggtggataactcattaagagatttcaaaaaatttaattctatcgatagtcataaccatagcaaaccattagatataggtgacgttaacgaagacggtaacaagattgctgattgtatgttgatttcaggttccagaattctctctggcttgggcaggggtgtcatcacgtccgtgggtataaactcagtttacggtcaaaccatgacttcattaaatgccgaacctgaaagtactccattacagttacatttgagccaattggctgataatatatccgtttacggttgcgtgtctgctataattcttttcttggtccttttcactaggtacttattttacataatacctgaggatggcaggttccatgatctagatcccgctcaaaagggttctaaatttatgaacatttttatcacatctatcacggttattgtggtggctgttccggaaggtttaccattagctgtaactttggccttagcgtttgcaacaacaagaatgacaaaagacggtaatttagtacgggttttaagaagctgtgaaacgatgggatctgctactgcagtgtgctctgataagactggcactttgacagaaaatgtcatgactgtcgttcgtggcttcccgggcaattctaaatttgatgatagtaaatcgttgcccgttagcgaacaaaggaagctgaattctaagaaagtttttgaagaaaattgttcgtcatccttgagaaatgatttattagccaatattgtcctgaattctaccgccttcgaaaacagagattataagaaaaacgataaaaatacaaatggtagtaaaaatatgtcaaaaaatttgagttttttagataagtgtaaatctagattatcgttttttaaaaaaggcaacagggaagatgacgaggatcaattattcaaaaatgtcaacaagggtaggcaagaaccctttattggctctaaaacggaaacagccttactcagtttggcaagattatcattaggattacaaccgggagaattgcaatatttgagagatcaaccgatggaaaagtttaatatcgaaaaagttgttcaaacaattccgtttgaaagttctcgtaaatgggccggcttagtggtaaagtacaaagaaggcaaaaataaaaaaccattttacaggtttttcattaaaggtgcagcagaaattgtttccaagaattgttcgtacaagaggaattcagatgatactttggaagaaatcaatgaggacaataaaaaagaaactgatgatgaaatcaaaaatcttgcgtccgatgctctcagagccataagtgttgcccacaaagatttctgcgaatgtgatagctggccccctgaacagctgcgtgataaagactcaccaaatatagctgctcttgacttgctatttaacagtcaaaagggcttaattctagatggtttacttgggattcaagaccctttacgtgcaggcgttagggagtcagtacaacagtgccaacgtgctggtgtaactgtgcgtatggttactggtgacaatatattaacagcaaaagcaatcgcgaggaattgtgcgattctttctactgatattagttcagaggcttattctgcaatggaaggcactgaattcagaaagttaacgaaaaacgaacgtataagaatcctgccaaatttaagggtcttagcaaggtcttcgcctgaggataaaaggttattagtagaaacattgaaggggatgggagatgttgttgcggtcactggcgatggtacgaacgatgctccagctttaaagctagctgatgttggtttctcaatgggtatttccggtacggaggttgccagagaggcttctgacattattttgatgactgatgatttctcagctattgtcaacgctattaagtggggaagatgtgtttcagtctccataaaaaagttcatacagtttcaattaattgttaatatcaccgcagtgattttaacgttcgtttcatccgttgcatctagtgatgaaacatcagtactgacggcggtccaactgttatggatcaatctaatcatggatactctagcagctttagctttagccactgataaacccgatccaaatatcatggacagaaaacctaggggccgctcaacttctttgatttctgtgtcaacttggaaaatgattctatcacaagctacattgcagttgatagttactttcattttgcatttttacgggccagagttattcttcaagaaacatgaagatgaaataacaagtcaccaacagcagcaactgaatgccatgacattcaacacttttgtttggttgcaattttttaccatgttagtatcgagaaaattagatgaaggtgatggtatatcaaactggagaggcaggatttctgccgccaatttgaatttcttccaagacttgggtagaaactattattttctcacgatcatggcgatcattggcagctgtcaagttttaatcatgttttttggtggcgcaccattttctattgccagacaaaccaaatcaatgtggataaccgcggtactgtgtggtatgttgtctctaatcatgggggtgctagtgagaatctgccccgatgaagtagcagtgaaggtatttccggctgctttcgttcaaagattcaagtacgtatttggactcgagttcctcagaaaaaaccatactggaaaacacgacgatgaagaagcgctgttggaggaatctgatagtccagagtccaccgccttttattaa

SEQ ID NO: 45642 - DNA, 1701 bp, Saccharomyces cerevisiae
atgtccacaaacctgaacccattcatgaataatacgccttcctcctccccactcaagggttctgaaagtaagagggtatcgaaaaggccaatatctagttcttcgtccgcctcactattatcatctccctccaggcgatcgaggccgtctacagtatatggtgataggtatattccttcccgaacagatatagatttcaattccatcgtttccatcagtagtatggcaagcgttccagcccttaatccatcgagtacggaagatcaagtagaataccaaaaggaaagacaggcacatgaaacttataatactttgctgaagaatgagctttttggcgagatgctaagcaaggatacggtaggctcagagagcagtatagatcgcattaagaatacgagaccatctactagaggcaatgtgcacgcagaaaatacaactagacatggttatgaactggaacgagtatcaactccacctcctgaagctgctggtttagaggaattttcgccacattccacgccagtcactcctcgacgtctttttacatcacagcaagatgaaatcacgagaccctcaagcaactcagttaggggcgccagcctgttgacttatcaacaacgtaaaggtagaagactatctgcggcctctttgttacaatctcaattttttgattccatgtcgccagttaggccggattccaaacagctcctattatcaccggggaagcaatttagacaaatagctaaagttccctatagagttttagatgccccatcattagcagacgatttttactacagcttgatagattggtcaagtactgatgttttggcagttgctcttggaaaatcgatttttttaaccgataataacactggcgacgttgttcacttatgcgacacggaaaacgaatacacaagcttaagctggattggagcaggctctcatctggcagtaggtcaagcaaatggacttgtagaaatttatgacgtaatgaaaagaaaatgtattaggacgttgtcgggacatattgacagagtagcgtgtttatcttggaataatcatgttttgacgtctgggagtagagatcatcgaatactgcatagggatgttaggatgccagatcccttttttgaaactatagaatcgcacactcaggaagtctgtggcctaaagtggaatgtagcggacaacaaacttgcctcaggtggtaacgataacgtcgtccatgtttacgaaggaacgtcgaaatctccaatcttgacgtttgacgaacataaggctgctgttaaggcaatggcctggtctcctcataaacgaggtgtgctagctaccggtggtggtacagcagatagaagactaaaaatctggaacgttaatacgtcaataaagatgagtgatatagatagcggctctcaaatatgtaatatggtatggtcaaagaatactaacgagcttgtgacatcacatggttactcaaaatataacttaaccttgtgggactgtaactctatggatccaattgcaattctgaaaggtcatagtttcagggttctgcatttaacgttatccaatgatggaaccacggtggtttctggggctggagatgaaacattgcgatattggaaactttttgataaaccaaaagcgaaggtacagccaaattcgttaatatttgacgcatttaatcaaatacgttag

SEQ ID NO: 45643 - DNA, 1050 bp, Saccharomyces cerevisiae
atgtcaaagatagattcagttttaattatcggtggttctggttttcttggattgcacttaattcagcaattttttgatattaatcctaagccagacatccacatttttgatgttagagatctccctgaaaaactttcaaaacagtttacttttaatgtagacgacataaaatttcataagggtgatttaacatcacctgatgatatggaaaacgcaattaacgaaagtaaagcaaatgttgttgttcattgtgcttctccaatgcatggtcaaaatccagatatttatgacatagtgaatgttaagggaacccgtaacgtgatagatatgtgcaagaaatgtggcgttaatatacttgtatatacttcctctgctggtgttatttttaatgggcaagatgtgcacaatgcagacgaaacctggccaatcccagaagttcctatggatgcgtacaatgagactaaagctatcgccgaagatatggtcttgaaggcgaatgatccaagcagtgatttctatactgttgctcttcgtccagctggtatttttggcccaggtgataggcaattagtacctggtctaagacaggttgcgaaattggggcagtcgaagttccaaattggtgataataacaatctatttgattggacttatgctggaaatgttgctgacgcgcatgtgttagctgcacagaaacttctcgatccaaaaacaagaactgctgtctcgggtgaaacttttttcattaccaatgatacccccacctatttttgggccttggcccgtactgtgtggaaggcagatggtcatattgataaacatgttattgttttgaaaaggccagttgcaatttgtgcaggttatctttcagaatgggtatccaagatgctgggtaaagagccaggtttgactccattcagagtcaagattgtgtgtgcataccgttatcacaacattgctaaggccaaaaagttgctaggctacacaccaagagttggtattgaagaaggaattaacaaaacgttggcctggatggacgaaggtttgtaa

SEQ ID NO: 45644 - DNA, 2235 bp, Saccharomyces cerevisiae
atgataactaataagaaaataaagataagtgtcccagaaaaactcggtttgtcagaagaatcttttgaggaatcctgggaaacagttaaatatgccattgatcatatatacagcgatgacatggccgacctttccttcgaacaagtgtacaagaccatttatactatcgttttaaataaaaaggggccaatactttataacagattgaaagattatttaatccaaaaattagcgcttttgagggaaacgatagtcaaggacaatactcatgattatgagtttcttggaactatggcacggttatgggaggtgcaatgccattgttttaaaataacgggagacttaatgatgtatatggacaaagtttattgcaaaccaaatagatgcatggaggtatacgacatgtgcctcgatcttttccgaatcgaaatattgcaaaaatgctcatcttctctcatctcagcactgatatctgatatagaaaggattcgtaatttaggatctgtcgactccgaacatactagtttgtggaaagtactaataggaatgatggagacattacatgacaatagagatagttttttcttaaccgattttgagccggttttgattagcgcgacagaagaatactacaataaagctattgatattgaattattaacgccaattgagagcctggaaaagattaggaagttaaggcagtttgaaagtatgctagactcctcttttctaaatgtggattctcataataagttgaagactgtattagaaaatgtccttatatggggaaagttgagtgatattattgaagatctaacgcacgaagcaatggtaatttcaaatggaaagctactccaagaaatttatgacttgtcaagcgaggaaaaatatcgcgttactgtcattgaatctattaaatcttacatcaataaaaatgccataaatattccttttaatgaaggtaaccgcaaaaaagggcagaatgcgattacttggtcttcggaaattgtagagctatatcgcagtcaacactcgtttttggaaagtattgattttggttctgttcgtcttaataatttgaccggggatgtatctaatgcaatacttggcgatgttttctcaatgtatttctctaaagaaggagcattaccatctgagtatctttctacctacgtggaccattgtatgaaacgaaccaaggaaaaagatgctgaaatagtgaagatcaagcaagatttgcttgatagtaccaaattaatcggactcctaactgagaaggatatatttgaaaagatttacaaaaaacaactctccagaagattactgcagcagaggtctttagtggaaattgaaaaatggatggtgcaaatgataaagaaggttctaggaactttttttacctcaaaattggagataatgctgcgagatatatctttatcctctgaaatgtatcaagcattccaacactcaacaatcaacagcatagaatatttgagttttgcaccacaagttttgacgagaacgagctggccctttcagagtactaatccaattgatgaaggtatttcactacctcctagaatgtcacaaattttagctggctttgagggctattacagcttaaaatacaaagaaagagtgctaaagtgggctcatcatctaagtgtaattgaaattggctgccaatttaatagcggttactacgaaataagtttttctgtttacgctggagtgattttccttctatttgaagattatgaagaattaacgttgggggaaatatatgaactaactcatattcccatagatgacgttaagtctcttgtaatgtcaatgtcgacaatacccagatgtaagattttgaaaaaatcatccagttcaggaaatatgaaattttcagttaattatttcttttcttctccaaacaggaaagtgaaagtgccggttattgcatgccctctaccatctcagaaatcagataatttggcaaccgcaagttccgtggacacttatgataatgaaattgttatggagcttagtgctattattgttcgtatcatgaaaacagaaggtaagctaagccatcagcaattacttgaaagaactacgaaacggacacagtctcggctcagtcttacaccgagcattttgaaacgaagcattcagcttttaatagagaaagaatacatccagagaaacgcagatgacccctcttattaccattacctttcctaa

SEQ ID NO: 45645 - DNA, 972 bp, Saccharomyces cerevisiae
atgacggtaaacttagatccggataaagtttggatagacggctgctttgatttcacacatcatgggcatgcgggagccattttgcaggctcgtcgaacagtttcaaaagaaaatggtaaactattctgtggtgtgcataccgatgaagatattcagcataacaaaggaacaccagtaatgaactcttcagaaagatatgagcatactagatcaaataggtggtgttcggaagtggttgaagcggcgccatatgttacagatcccaattggatggataaatatcagtgccaatatgttgttcatggtgatgatatcaccatagatgctaatggagaagactgctataagttggtgaaagagatggggcgcttcaaggtagttaaaagaacatatggcgtaagtactaccgagattatacatagaatattgacgaaaaaatctttgccaccgactcatcctgattattatcccaccacccaggaattgagtttctattctgtcgcccaagatgccgtttcaaaacattgttatgtctttcagagggatttggacaatgtcttggtcaatggtggatacaaattcgatgcagaagattgtgtttatgttgacggggattttgacttattccatatgggggatattgatcagttaagaaagctgaaaatggatcttcaccccgataagaaattgattgttggtattaccacaagcgattactcgagtaccattatgacgatgaaggaacgcgtcttgagcgttttaagttgtaaatatgttgatgccgttattatcgatgctgacgccacctcaatgtctcagtataactgcgagaagtatcatattggcacggctgtcctcactgctgccggaaaattcagtgaatacttgactaaagagcttattgtgaagagggtggaatcgcaaagggaggtttacattgcgaggaaccaaaaaaagggaatgtccatataa

SEQ ID NO: 45646 - DNA, 1416 bp, Saccharomyces cerevisiae
atgtctatttgtgaacaatactacccagaagagccaaccaaaccaactgttaagaccgagtccattcctggtcctgaatcccagaagcagttaaaggaactgggtgaagtttttgacacaagaccagcatattttttggctgattatgagaaatctttaggtaactatatcactgatgtggatgggaacacatatttggatttgtatgcccaaatctcttcaattgcacttggttataacaaccctgctttgatcaaggcagcacaatcaccagaaatgatccgtgctttggtcgaccgtcctgccttaggtaacttcccatctaaggatttagacaagatattgaagcaaatattgaaatctgcgccaaagggtcaagatcacgtctggtcagggctttccggtgcagatgccaatgaattagcgttcaaggctgcctttatttattaccgtgccaaacaaaggggctatgatgccgatttttctgaaaaggaaaacttgtctgtcatggacaatgacgcccctggcgcccctcatcttgccgtactatcgttcaagagagcgttccacggtagattgtttgcctccggttccacaacttgttctaaaccaattcacaagttggatttcccagccttccactggcctcatgctgagtatccatcttaccaatacccattagatgaaaattctgatgcaaaccgtaaagaggatgaccattgcttggccattgttgaagaattaatcaaaacctggtctattccagttgctgccttaatcatcgaaccaattcaatctgagggaggtgataaccacgcttctaagtatttcttacaaaagctaagagacattaccttgaagtataacgttgtctacatcatagatgaagtgcaaacaggtgtcggagccaccggtaagctatggtgtcatgagtacgccgatattcaaccacctgtggatttagtgaccttttccaagaaattccaaagtgcaggatatttcttccacgaccctaaattcattccaaacaaaccatacagacaattcaacacatggtgtggtgaacctgcaagaatgatcattgcaggtgccattggacaggaaatctccgacaagaagttgactgaacaatgttcaagagtaggtgattatttgttcaagaaattggagggtttgcagaagaaataccctgaaaactttcaaaacttgagaggtaaaggaagaggcacattcattgcctgggatttgcctactggtgagaagagagacttactattgaagaaattgaagttgaatggttgcaacgttggtggatgtgcagtccatgcagtgagattaagaccttcattaacattcgaggagaagcatgctgatatctttattgaagcattagccaaatcagttaatgaattatga

SEQ ID NO: 45647 - DNA, 357 bp, Saccharomyces cerevisiae
atggctgagaaacgtactcttatagctgtgatagctgacgaagatactacaactggtttattgttagccgggattggacaaatcactcctgaaacccaagaaaagaacttttttgtttaccaagaaggtaagactactaaggaggaaatcactgacaagtttaatcactttactgaagagagagacgatattgccatccttctaatcaaccaacatatcgcggaaaacataagagctagagtggactccttcaccaatgcgttccctgctattttagaaattccatctaaagatcatccctacgaccctgaaaaggactctgtattgaagagagtcagaaagttgttcggtgagtaa

SEQ ID NO: 45648 - DNA, 1089 bp, Saccharomyces cerevisiae
atgtctcgcaaatttgatttaaaaacgattactgatctttccgtcctagttgggactggcatatcattatactacctggtcagtcggctactcaacgatgttgaatcaggaccgttatcaggtaaatcaagggaatcaaaggccaaacagtccttgcaatgggaaaagctggtgaaaagatcaccggcattggcagaagtaacattagatgcatatgaaaggactatattatcttctatcgttacgccagatgaaataaatattacattccaggatattggtggcttagacccgcttatttcagatctacatgaaagtgtcatatatcccttgatgatgccagaagtatattctaatagccctttacttcaagcacctagcggtgtcttgctatatgggccaccaggatgtggtaaaaccatgttggcgaaggccctagccaaggaaagtggtgctaattttatctcaataagaatgtcatctataatggataaatggtatggtgaatctaacaaaatagtcgatgcaatgttttcattggcgaacaagttacaaccttgtataatattcattgacgaaattgattcattccttagagaacggtcttctacagatcatgaagttacggcaaccttaaaagctgaattcatgactttatgggatggcttattgaataatggaagggttatgattatcggtgctactaatcggataaatgacatagatgatgcgtttttgaggaggttaccaaaaaggtttcttgtttcattgcctggttctgatcaacgttacaaaatattaagtgttttattaaaagacactaaactagacgaagacgaattcgacttgcaactgattgcagacaataccaaaggattttctgggtcggacctgaaagagctttgcagagaagcggccttagatgcagcaaaggaatacataaaacagaagaggcagctcattgatagtggtacaatcgatgttaatgatacttcttccttgaagataagaccattaaagacaaaagattttacaaaaaaattaagaatggatgctacaagtacgttgtcatctcaacctcttgattaa

SEQ ID NO: 45649 - DNA, 5688 bp, Saccharomyces cerevisiae
atgtcctacaacgatccaaacttgaatggacagtattacagtaacggtgatgggactggtgacggtaattaccctacgtaccaagtgacacaggatcaaagtgcgtacgatgagtacggtcagccaatctatacacaaaaccaactggatgatggttattatgatccaaacgaacaatacgttgacggtacacaatttcctcagggacaagatccttcacaagaccaaggtccttataataacgatgctagttactataaccaaccccccaatatgatgaacccgtcttctcaagatggagagaacttctcagattttagcagctatggtcccccatccggcacttatcctaacgatcaatatactccttctcaaatgagttatcctgatcaagatggttcttcaggggcctcaaccccctatggaaatggtgtcgttaatggtaatggccagtactacgaccctaatgctattgaaatggctttaccaaatgatccatatcccgcatggaccgcagatccccagtctcccctgcccatcgaacaaatcgaagatatcttcatagatttaacaaataaattcggttttcagagagattccatgagaaatatgtttgaccattttatgacccttttggactctagatcttctaggatgtctccagaacaggcccttttatcattacatgcagactacataggtggagatacggccaactacaaaaaatggtactttgccgctcaacttgatatggatgatgaaattggtttcaggaatatgaagttgggtaagctatcaagaaaggcaagaaaggctaagaagaaaaataaaaaagccatgcaagaggctagtcctgaagacactgaggagactttaaatcaaattgagggtgataactcattagaagctgcggattttagatggaagtcaaagatgaatcaactttctccatttgaaatggttcgtcaaattgccttgtttttattatgttggggcgaggcaaatcaagtcagatttaccccggagtgtctttgtttcatttataaatgcgcctctgattacttagattctgcacaatgtcaacaacgtcctgatcccttgcctgaaggtgattttttgaatagagttattactcctctttatcgttttattaggagccaggtttacgaaatcgtggatggtcgatacgtgaagagtgaaaaagatcataacaaagttattgggtatgatgatgtcaatcaattattctggtatccagaaggtatagcaaaaattgtcatggaagatggaaccaggttgattgatttgccagcagaggagcgttatttgaaattgggagaaattccctgggatgatgtcttctttaaaacttacaaagaaacacgttcctggttacatttagttaccaacttcaatcgtatttggatcatgcacatctcagtatattggatgtattgtgcttacaatgctccaactttttatactcacaactatcaacaattggtcgacaatcagcctttggcagcttataaatgggccactgcagcattaggtggtactgtggcaagtttgattcaagttgccgctactttgtgcgagtggtcattcgttcctagaaaatgggcgggtgctcaacatttgtcccgtagattctggttcttgtgtgtcattatgggtattaatttggggcctgtgatatttgttttcgcttatgataaggacacagtatattctactgccgctcatgtcgttggagcagttatgttttttgttgctgtggcaacacttgttttcttttccgtaatgccattgggtggattatttacatcgtatatgaaaaagtccacaagaagttatgttgcctcacagaccttcaccgcatcttttgctccattgcatggtttagacaggtggatgtcttatttggtttgggtaaccgtttttgctgctaaatatgcagagtcatatttttttctaatactgtcactaagagatccaattaggattttatctactacatcaatgagatgtactggtgaatactggtggggtaataagatttgtaaggtccagccaaagattgttttaggtttaatgattgcgactgacttcattttgttctttttggatacctacttgtggtatatcgttgttaacactgttttctcggtcggaaaatcgttctatttgggtatttctatcttaactccatggagaaatattttcactagattgccaaaaagaatttattctaagatcttggctactactgatatggaaataaaatataaaccgaaagtactaatttctcagatttggaatgctatcattatctccatgtacagagaacatttattagccatagaccatgtacaaaaattgttatatcatcaggttccgtccgaaattgaaggtaagaggactttgagagcaccaactttctttgtttcccaagatgacaataattttgagactgaatttttccctagagattcagaagctgagcgccgtatttcattttttgcccaatctctatccactccaattccagaaccactaccagttgacaacatgccaacatttactgtattaactccccattacgccgagaggattctattatcattgagagaaattattcgtgaagatgatcaattttcaagagttactcttttggaatacctgaagcaattacacccggtagaatgggactgttttgttaaggatacgaaaattcttgctgaagaaacggccgcatatgaaaacaatgaagatgaacctgaaaaggaagacgctctgaaatctcaaattgatgatttacctttctattgtattggtttcaaatctgctgcaccagaatacaccttacgtacgagaatctgggcctctttaaggtcgcaaactttgtatcgcacaatctcggggtttatgaattattcgagggccataaaattactttatcgtgtggaaaatccagaaatcgttcaaatgttcggtggtaatgctgatggattagaaagagaactggaaaaaatggcaaggcgaaaattcaaattcttggtttcgatgcaaagattggccaagtttaaaccacatgaactagaaaatgctgagttcctgttgagagcttatccggacttgcaaattgcctacctggatgaagaacctcccttaaacgaaggcgaagagccaagaatttactcggccttaattgatggtcattgtgagattttagagaatggtcgtagacgtcccaaatttagagttcaactatccggtaatccaattcttggtgatggtaaatcagataatcaaaatcatgctttgattttttacagaggtgagtatattcaattgattgatgctaatcaagacaattacttggaagagtgtttgaaaatcaggtctgtcttagcagaatttgaagaattgggaattgagcaaattcatccttatactcctggtttaaaatatgaggaccaatccacaaatcatcctgttgcaattgtcggcgctagagaatatattttctcagaaaactctggtgttcttggtgatgtagcggctggtaaagaacaaacttttggtacattatttgcccgtactttggcacagattggtggtaaattgcattatggtcatccagattttattaatgcgacattcatgactactaggggtggtgtttccaaagcacaaaagggtctacatttaaatgaagatatttatgccggtatgaatgccgtacttcggggtggtcgtatcaagcattgcgaatattatcagtgtggtaaaggtagagatttaggttttggtacaattttgaatttcactactaagatcggtgctggtatgggtgaacaaatgttatctcgtgaatactattatttgggtacgcaattacctattgaccgttttttaacattttattatgcgcatccagggtttcacttgaataacttatttattcaattgtctctgcagatgttcatgttaactttagtgaacttgcatgctttggctcatgaatccattctgtgtgtttacgatagggataagccaattactgatgttttgtatccaattggttgttacaactttcatcctgcgattgattgggtgagacgttatacactctctattttcatcgtcttttggattgcttttgtccctattgtcgttcaggaattaatcgagcgtggtctgtggaaggcgacacaaagatttttccgtcacattttatctctatctccaatgtttgaagtctttgctggccaaatctattcttcagcactgttaagtgatatcgctgtgggtggtgctcgttatatttcaacaggtcgtggctttgctacatctcgtatacctttctctattctttattcaagatttgcgggttcagccatttatatgggatcaagatcaatgttgatgttattatttggtaccgtggcacattggcaagctccactattatggttttgggcatcattatcagccttaatctttgcaccattcattttcaatccacatcaatttgcttgggaagattttttcctagactacagagattatatcagatggctgtcaagaggtaataataagtaccacaggaactcatggattggttatgtaagaatgtcgaggtctcgtgttactggtttcaagcgcaaactggtgggtgatgagtctgaaaaatctgcaggcgatgcaagcagggctcatagaaccaatttaattatggctgaaattataccgtgtgcgatttacgcagcaggttgttttattgccttcacgtttattaatgcacaaactggtgtcaagactactgatgaagatagagtaaattccaccttacgtatcatcatttgcaccttggcgcctattgttatcgatattggtgttttattcttctgtatgggtttgtcatgctgctctggccctttgttgggcatgtgctgcaagaaaactggttctgttatggcagggatcgctcacggtatcgctgttgttgtccatattgtctttttcattgtcatgtgggttttagagggttttagttttgttaggatgttgattggcgttgttacatgtatacaatgtcaaaggttgatttttcactgtatgactgtactgttgctgacccgtgagttcaagaatgatcacgctaatactgccttttggacaggcaaatggtacagcaccggtttaggatatatggcatggactcaaccgacaagggaattgactgcaaaagtcattgagctttccgagtttgcagcggattttgttttggggcatgtaattttgatcttccaactaccagtcatttgtattccaaagatagataagtttcactccatcatgttattttggttaaaaccatcccgtcaaatccgtcctcctatttactctttgaaacaagcacgcctacgtaaacgtatggttaggaggtattgcagcttgtactttttggtactgatcatattcgcgggatgcatcgttggccctgccgttgcttcagcacatgttccaaaagaccttggatctgggttgacgggtactttccataacttggttcaaccaaggaacgtatctaacaatgatacagggtcccagatgtctacttataagagtcattattacactcatacgccatccttaaagacctggtctacgatcaaatga

SEQ ID NO: 45650 - DNA, 264 bp, Saccharomyces cerevisiae
atggtttcccaattattcgaagaaaaagctaaagccgtcaacgagctaccaacgaagccctccactgatgaattattagaattgtatgctctgtacaagcaagccactgtaggtgacaacgacaaggaaaagcctggtattttcaacatgaaggaccgctacaagtgggaagcctgggaaaacttaaaaggtaaatcccaggaagatgccgaaaaggaatacattgcccttgttgatcaactgattgccaagtactcctcttag

SEQ ID NO: 45651 - DNA, 1107 bp, Saccharomyces cerevisiae
atggctagaaccataacttttgatatcccttcccaatataaactcgtagatttaataggtgagggagcgtacggaacagtatgttcagcaattcataagccttccggcataaaggtagctatcaagaaaatacaaccgtttagcaaaaaattgtttgttacaagaactatacgtgagatcaagcttttacggtatttccatgaacacgaaaacataataagtatattggataaagtaaggccagtatccatagacaaactaaacgctgtttatttagtcgaagagttgatggaaaccgatttacaaaaagtaattaataatcagaatagcgggttttccactttaagtgatgaccatgttcaatactttacataccaaatcctcagagccttaaagtctattcacagtgcacaagttatccatagagacataaagccatcaaacctgttactaaattccaattgtgatctcaaagtctgcgattttggactagcgaggtgtttagctagcagtagcgattcaagagaaacattggtaggattcatgacggagtacgtcgcaacgcgatggtacagggcacccgagataatgctaacttttcaagagtacacaactgcgatggatatatggtcatgcggatgcattttggctgaaatggtctccgggaagcctttgttcccaggcagagactatcatcatcaattatggctaattctagaagtcttgggaactccatctttcgaagactttaatcagatcaaatccaagagggctaaagagtatatagcaaacttacctatgaggccacccttgccatgggagaccgtctggtcaaagaccgatctgaatccagatatgatagatttactagacaaaatgcttcaattcaatcctgacaaaagaataagcgcagcagaagctttaagacacccttacctggcaatgtaccatgacccaagtgatgagccggaatatcctccacttaatttggatgatgaattttggaaactggataacaagataatgcgtccggaagaggaggaagaagtgcccatagaaatgctcaaagacatgctttacgatgaactaatgaagaccatggaatag

SEQ ID NO: 45652 - DNA, 1644 bp, Saccharomyces cerevisiae
atgacgaaaataaccagagatgtttcgataacgacagaaaattcaaaatccacatctggatcggcaacggcttcatccgcatctttacctgagaacgaccacccaatattccatcaaccgcgagcaagaataagatctggttcgctgttcatcgaaggatctgattcatttccatcatcagaagtgaagtcatacaatgtttatattgatgatagcaagtatagtgaaatcctcaaaggagatacaaattcaagtagtactgatggtaaacaagtctttgaagatgctagagatgacaatttccatcaggaatcacatagagatctagaggattcaattttagatttagtacgacgagatccagaagtagcagcattccctttacctccgccaaattcaaatgagaggaacagaaattcctcaaacgggtcttccgctgaaactaacctaaatggacacagcagcagcggtaccatctctacttcggtgctgttgaatatgggttcggcagaaaagcacgctgggacgaccagaggagatcatatggaatcatcttcaatgaaatccttcgagaaactgggaaccagaccttcttctttattctatccaccacccgaaggaactgcgccgtaccagggaccaagggctaccgtctccggaaataagtctacaaggcaaacacaaggtacatactcatttccttctatgcggtatggtgtagatcttgtttctcctgtggaaggggctgttgatgtagcaaaaagcagagttcctaacagcacgctaaatggtacttttcccgataaagcgtttatcccacatgaatttcaaattcctaaaaaggcctggaacagaataccagcgaataagtccactagcctcaaaaccccaagaaaccattccctattaattgacatattaaagccttttgaagcagctgaccttgctaatgaccagcgaagttcttccgctgttttaaaaaatacagtgcattctaatgggcagtataatccaactaatgaaacctctggaactcgaatgcaagatcaaaggcagaagaataccaacgaaattgatttagagaaaattcctaatcctcaagtccctcttggtatcgcaatggacaccatgcgtagtccaaaccaactacacgaaaaggaatacgaaagtaatatagaagctggtttagcttctggggtcggaaaaggtgacaatagtattaagcaacatcaatataaaaaaattcctcaagaaattgatcgagatcagcaattaagttttcaaatggaaacaatgcccattcaaagaatagattcctcctccatacgttcatttgattcccgaatatatggcttctccgagatttatagtattccaagggttataactacactgtgcatctgcctttttgttccgcccttattctttttcttttcaatcaatggaaataatggcgtttcaaattatagattaatgagaatgataatgaattatgaacatagaatcggcctcctcaaagggtttgaatgggacattgacgtacaatggttcaggacattgtgctttgtattaggatgtatagagatgttagctatctttgctagcataggaataggatttggtgtgggaataataagagagtaa

SEQ ID NO: 45653 - DNA, 1002 bp, Saccharomyces cerevisiae
atgtcagaaccttcagagaaaaaacaaaaagttgctacctcatctttagaacaattaaaaaaggccgggacccatgtggttgctgattcgggtgattttgaggctatttcgaagtatgaaccacaggattcaacaactaacccttctctgatattggctgcttcaaagttggagaaatatgcgaggtttatcgacgctgccgttgaatatggtagaaagcatggcaaaactgatcatgagaaaatcgagaacgccatggataagattttggtggaattcggcacccagattttgaaggtagtcccaggaagggtttccactgaagtagacgcaaggttatcttttgataagaaggcgacggtgaagaaggctctccacatcatcaaactatataaagatgcgggagtacctaaagaaagagtcttgatcaagatagcttctacgtgggagggtatccaagctgctagagaattggaagtaaagcatggtattcattgtaatatgacattactgttttcctttacgcaagcagtagcctgtgcggaggcaaatgtcacattgatctccccatttgttggaaggattatggacttttacaaggccctttcaggcaaagactatactgcagaaactgatcccggtgttctttctgttaagaagatatacagttactataagaggcatggttatgcaactgaggtaatggcggcttctttcaggaatttagatgaattgaaggcgttagccggtattgataatatgactctcccactgaaccttctagaacagttatatgaatcaacagatcctattgaaaacaaattgaattctgagagtgctaaggaagaaggcgtcgaaaaagtctcttttatcaacgacgagcctcatttcagatatgttttaaacgaagatcaaatggctacagaaaaactatcagatggtatcagaaaattctccgcagacattgaagcactgtacaaactggttgaagaaaaaatgtga

SEQ ID NO: 45654 - DNA, 903 bp, Saccharomyces cerevisiae
atgtcaccgtgttatggacaaaacagtgccatcgccaaggggtcttggaacagagaggttttacaagaggtgcaaccgatttatcattggcacgatttcgggcaaaacatgaaagaatattcggcatcacccttagagggggattccagcctgccttccagcctgccttccagcactgaggactgtttactactatcattagaaaacacaatcacagttatagccggaaatcagagacaggcttatgactctacgtcgtctactgaggaaggtacagcacctcaattacggccggatgaaatagcggacagtacacactgtatcacgtcattagttgatccggagttcagagatcttattaattatggacgtcaaaaaggagcaaatcctgtatttattgagagcaatacaacagaacaatcccattcacagtgtattctaggctatccccaaaaatcgcacgtggcacagctatatcacgaccccaaagtactcagcacaatttccgaagggcaaacaaaaagaggaagttaccactgttctcattgttctgaaaagttcgcaacgttagttgagtttgccgcgcacttagacgaattcaaccttgaaagaccgtgtaagtgtcccatagagcaatgtccctggaaaatattgggtttccaacaagcaactggtctgagaagacattgtgcttcccaacatataggagagcttgatatagagatggagaaatcattaaatctaaaagtagaaaaatatccaggactgaattgcccatttcctatctgtcagaaaacgtttaggcgcaaagacgcctataagagacatgtggccatggtgcataacaacgctgattcaagatttaacaagcgtttgaagaaaattttgaacaataccaaatag

SEQ ID NO: 45655 - DNA, 1725 bp, Saccharomyces cerevisiae
atgtcggaaggaagaacgtttctgtcacagttgaatgtcttcaacaaggagaactatcaattttcttcttctactacaaaaaaggaagtaagtaactcgacagtggatgctgacaacggtgcctccgattttgaggcaggccagcaatttgctacagaattggaccaaggtgaaaagcagttaggtattttgtcgtgtattgggcttatctgtaatagaatgcttggtaccggtgttttcgccgtttcctcgaccatttacacactatgtgggtctgtggggcttgcattaattatgtgggcagttggcgccattattgccatttctgggttatatgtatacatggaattcggtacggctataccgaaaaatggtggtgaaaaaaactacctggaggctattttcaggaaaccaaaattcttcattacctgtatgtatgctgcgtatattttcttcctaggttgggctgctggtaattccatcaatacagctattatgtttttaactgctgctgatactgaagtgaccaaatggaatcaaagaggtattggtgtggccgtcgttttttttgcattcctaattaattctctgaatgtcaagattggtctatatttgcaaaacattttaggtattttcaagattggtattgtcctcttcatttctattaccggttgggttgcccttggcggtggtctcaaagatggttatcaatctcacaactttcgtaatgcttttgaaggtactgaaaccgccactgcttatggtattgttaacgccttatatagtgttatttggtcgtttgtcggttactccaatgttaactatgcacttggtgaagttaagaaccctgtgagaactttgaagattgctggtcctacatcgatggtcttcttggctataatctacatttttgtgaacattgcttacttcgctgtggttccaaaagataagttaatttcttcaaaattgattttagctgctgacttcttcgatattgtgtttggcggccaagccaagagagcagcagccgcactggtcgggttgagtgccttaggaaatgttctttctgtcattttttctcagggtagaattattcaacaactaggacgtgaaggtgtgttgcccttttctaatttctttgcctcttctaagccattcaactccccaatggttggtttgtttcaacattttattgtttgtacagtaaccattttagccccacctccaggtgatgcatatttgctagtccaaaatttaatttcctacccaatgaatattattaattttgccattagcgcgggtttgctttggatatactggcaacgtagacaaggtaaaattgaatggaacccaccaattaaggccggtgtttttgttacgggatttttcacattatccaatttatacctgattattgctccttacgttccaccttcaaatggcgagtcggtgtattcaagcatgccatactggatccactgtgtaattgcttggggtattttcttctttggtggtgtttactacgttgtttgggcccaattattgccaagatggggccactacaaattggtttccaaggatgtgcttggtgaagatgggttctggagagtcaaaattgccaaagtttatgatgacactattggcgatgtcgatacacaagaagacggcgttattgaaacgaatataatcgaacattacaaaagtgaacaagaaaaatcgctgtaa

SEQ ID NO: 45656 - DNA, 1539 bp, Saccharomyces cerevisiae
atgaagtcaaaagggagtcggttgtcaacagactgtcctgtcgaatttcccaagatagtctctggattcgctgaggaagtgaaaatacgtagacaaagttcccaaggacagtacgccgtcgattcacatcctccgaaaagccctgaactgaaacacagaagacagaggtcatcctcttttgttaacggtaaatgcaggaacagggaccttccattgttagataacaagaaagcacaagaaataaacaccaattcacacggccaagacatcggtatcaaaaacttaccacgtcaacgtgagttgttgaatgccaaaaatggaattgattttacgctgatggtggcgggtcaaagtggattgggtaaaaccacgtttatcaattccttattttctacttctttaattgatgatgacatcaaagaaaacaaacctattattcgttataaaagcattgtagaaggagatggaacacaccttaatttcaacgtcatcgatacacctggttttggtaacaatatggataatgcatttacgtggaggacaatggttaactatattgatgaagaaataagatcgtacattttccaagaagaacaacctgataggacaaaaatggttgataatagagtccattgttgtttgtactttctgagaccttcaaataagggaattgatactttagacgtcgtaacaatgaaaaaattagcgaagagagtgaatttaatcccggttattgctaaatcagatttgctaacgaaagaggaattgaaaaacttcaaaacacaagttagagaaataataagagtacaagatatccctgtatgtttctttttcggcgatgaagttttgaatgcaacacaagatatttttcaaaaatatccattcagtataattgcatctaatgagtacatttttaatgaaaagggcgaaaaagttaaaggaagacaatacaaatggggcgctgttgacattgaaaatgaaaagtactgtgacttcaaaatcttgcaaaagacgatttttgattggaatttaattgatcttgtagaaagtaccgaggattattatgaaaaatgcagatctgaaatgctaagaactaggctattaaaggccagagattgcttaacaacgaaaagtgttgacataacggaagaacaaaggaaatttttggaggaagaaatgaacttcgatgaaatcgaggaaaacaaactcaaaaattacaagtgctatgaaataattaataaaacggtcatggataaggtggctacagaatgggatcctgaatttataactagacaattagaagctaagaaaaaattcaacgagctgtccaacagagaaatttcaaaatttcgagactggaaaaagagcctattcatggaacaagagaattttaaccaagagattgaacaattgaatcacaagttggaaaacttacaactggaatgtcaggacttggaatacaagctgttaatcggaaaaagttccaacagccattccacagatagtgctactttagtaaacgttcacatcaaaaggtag

SEQ ID NO: 45657 - DNA, 1782 bp, Saccharomyces cerevisiae
atgacaatttcgaataaatcgtggaggagctacttcccacatttgagaaaactacccgaagatgatcagtacttatactcagacgatactaactccagtatcatagctgaagaggagctacatcatagcgtagataagtcctcgaagacagacgttacggcagaaactacagctgtagaacctcatcctcacaatttaaggcatgacttgccatatgaagtgagagatgaagctgggcgtaaatggtggaaatattttgatgaattcgagtatcgtgttaataaggaatacaagaaatcacgtaagtggtacgagtttttgtatcctaatcatactactcaaaccaaggctgaaagacggcttctttacaagctagacattattattgctttatacttttttatgttatgttggtccaagtcagtggatttgaataactacactaacgcatatgtttccaatatgaaggaagatttaaacatgaaaggtaatgattacgtttacacttctactattgctaatgttggtgccattgtcttccaattaccatttatgtatttgttaccaagatttccctctcatattattttgcctgtaatggacttgggctggacttggttcacatttgcatgttatagggcaaactcactagccgaactaagggcttacagatttattttaagtgcctttggcgctgcttactacccagtgtcccaatatatactaggttgttggtatgccccagatgaaattaattcaagagtctgtttattcttttgtgggcaacaattgggttccgtgacttcaggacttctgcaaagtcgcatattcaaaagtttgaacggcgtccatggtctagcaggctggagatggatgtttctgatcgatgccattgcaatttctcttcccacggctattattggtttttttgttattcccggtgtaccatctaagtgttactctttatttctgactgacgaagaaatacgaattgcaagggccagaaataagaggaaccaaatcaaagatggtgttgataaaagtaagctagccccattatggagcagaaaactttggaagaaagtattttgtactccagcattctgggtacttgttgtttttgatacatgttcgtggaataacatgactgcgtatagtggttcatatactttgtggttaaagtctaatacaaagtactccattgcccaagtgaacaacctgagtgttatacccgcatgtttaggatttgcgtatgtgattttttgtgcctttggtgccgatttatttagatgtaagtggatattcatggtttttgctgctataatgaataccgtttcttgtgccttacttatcaagtgggatattccttcgaaagctaaatggtacgctttcttcaccacgtatttcagtgtggccgcatcgccttgtctatggtcgtttattaatgacttcttaaggtttgatcctcaggtgaaggctattacatggatcgccatttattccttctctcaatccacttacgcctggattcctaccttggcgtggcctaccgtggagtcaccacgttttaagactggttacaccgtgagcttaatttttggtgctatttacggtttatggacgtttgttgtactttttttttacaagagaaacgaaaagaaacatgctctaggtaatggtatcatcttgtatgatagtaataagggtgaagagcttccagaatttgtaaagaaaaatatggaggaaagagatggttactactatttaaagcggtcctcgtag

SEQ ID NO: 45658 - DNA, 3468 bp, Saccharomyces cerevisiae
atgaatagtaatgaactggatctaagaaataaatatttttatgagatattcggtaagaaaagaaaatcagatacttcaacccctactcagttgttctccggctccaaagttcagacaaacatcaatgaaatttctatcactaacgatgaggatgaagatagtactgaagatgaaaataaggcttcattgaaggattatacactagggcacgacaccggtgcacggtataggatagcaccggactgttcttcccaccaattaaaggcatctcctgtcctacatatttcaacaaaccttaattcaagtccacaatccttcacaggcgatcagatttcacctactaataaaaaaatttcaataaatgattcgaccagacaagataaaggtaacagttgcactaccacttcatcaccttctcaaaaaagatcgaatgttttgcttcctcacgtaagaaaacattcatctccttcactattatcattttccaaaaacagtggcagtcatatgggggatccaaaccagctatctacgcctccaactcccaaaagtgcaggtcacacgatggagttacacagttcattcaatggaaaacatagttcttctagcacctcttctttatttgcattagagtcactgaaaacccaaaatagacgctcatcaaactcttccaatcattctagtcaatatcgacgccatactaatcaacaccaacgtcatcattcaaggtccaaatcaagtcctgtctctctgacggaaatatccatgatcaaaggcacgcctttggtttatcctgcacttttatcactaatagcaattaaattcaaacagaccatcaaattgagcacgcataaaaagatggggttactttacagagattcctttacaggaaaacaagcaattgatactttatgcttgatcataggaagcttagatcgtaatttgggcatgttgatcggaaaatcgctggaagctcaaaaattgttccatgacgtactttatgaccatggcgtaagagattctgtactggagatttacgagttatcttcagaatcaatttttatggcacatcagtcgcagagttctacttcaattgccaacacattttcttcatcatcttcttcagttaattcgctccgtactaaaactgaaatatatggtgtttttgtcccattgacacattgttattcctctacatgctctctggaaaaactttgctactctatttcttgccccaatcgtttgcaacaacaggctaatttacatttaaaattaggtggtggtcttaagagaaatatttcgttagcactcgataaggaggatgatgaacgaatttcctggacaaattctgtaccaaagagcgtatgggaatcattatccaaacaacaaatcaaaaggcaggaggcaatatatgagttgtttactacagaaaagaagtttgtaaaatctttggaaatcatccgagatactttcatgaagaaattattagaaacgaatattattccatctgatgtaaggataaattttgtaaagcacgttttcgcacatatcaatgaaatatattctgtcaatagagaatttttgaaggctttagcacaaaggcaatcattaagcccaatttgtcctggaattgcagatatatttttgcagtatcttcctttctttgatccttttctgtcatacatagcatcaagaccatacgcaaagtatctaattgaaacccaaagatcagttaatcccaattttgctcgttttgacgatgaagtgtctaattcttccctgaggcatgggatcgattcattcctatctcagggtgtttcaagacctggtagatattcactgttggtaagagaaataatacacttctcggacccagtaacagacaaagatgatctacaaatgctaatgaaagtccaagatcttttaaaggatctaatgaaaaggattgatagagcaagcggtgcagcacaagatcgttatgacgttaaagtgttaaagcagaaaattctattcaaaaatgaatacgttaatctgggtttgaataacgaaaaaaggaaaatcaagcatgaaggtttactctcaaggaaggacgtgaacaaaacagatgcgtccttttcaggagacattcaattttacctactcgacaatatgctattattcttgaaatcaaaagctgtaaacaagtggcaccaacacactgtatttcagagaccaattccactccctttactgtttatttgtccggctgaggatatgccacccataaaaagatatgtgacagaaaacccaaattgctcagcgggtgtgctcttaccccaatatcaaacgagcaatcccaagaatgctattgtattcgcctattacggtacgaaacaacaatatcaagttactttgtacgcgccgcagccggccggattacagacattaatagaaaaggtgaaacaagagcaaaaaaggctccttgatgaaactaaacatattacttttaagcaaatggtaggtcaattctttcactcatacataaatactaatcgcgtcaacgatgtcctaatctgtcatgctggtaaaattttattggttgcaacaaatatgggactctttgttcttaattatgctacatcgatcaatcaaaaaccagtgcaccttctgcacaaaatatcaatttcacagatctctgtattggaagaatataaagttatgattcttctaattgacaaaaaactgtacggctgtcctttagacgtaatcgacgatgcagaaaatgcagattttcttttcagaaaaaattctaaagtgttatttaaatatgttgcaatgttcaaagacggtttctgtaatggtaaaagaatcattatgattgcacatcattttttgcacgccgcacaattattgattgttaatcctttgatatttgattttaatagcggtaattttaaaaaaaacctaaaggcaggcttggtagattttagcgttgattctgaacctctgtccttttcttttttggagaataagatctgcattggttgtaaaaaaaatatcaaaatattaaacgtaccggaagtgtgtgataaaaatggatttaaaatgagggagcttttaaatctacatgataacaaagttttagcgaacatgtataaagagacgttcaaagtagtttccatgtttccgataaaaaattcaacttttgcatgttttccagaactctgcttttttctcaataagcaagggaagagggaggagacaaagggatgttttcattgggagggggaaccagaacagttcgcgtgttcctacccttatattgtggcaattaatagtaactttattgaaattagacatatagaaaatggagaacttgtccgctgtgtacttggaaacaagatacgtatgttaaaatcatatgccaagaagatcttatattgttatgaggatcctcaaggatttgaaattatcgaactgttaaatttttga

SEQ ID NO: 45659 - DNA, 1692 bp, Saccharomyces cerevisiae
atgtctgaaattactcttggaaaatacttatttgaaagattgaagcaagttaatgttaacaccatttttgggctaccaggcgacttcaacttgtccctattggacaagatttacgaggtagatggattgagatgggctggtaatgcaaatgagctgaacgccgcctatgccgccgatggttacgcacgcatcaagggtttatctgtgctggtaactacttttggcgtaggtgaattatccgccttgaatggtattgcaggatcgtatgcagaacacgtcggtgtactgcatgttgttggtgtcccctctatctccgctcaggctaagcaattgttgttgcatcataccttgggtaacggtgattttaccgtttttcacagaatgtccgccaatatctcagaaactacatcaatgattacagacattgctacagccccttcagaaatcgataggttgatcaggacaacatttataacacaaaggcctagctacttggggttgccagcgaatttggtagatctaaaggttcctggttctcttttggaaaaaccgattgatctatcattaaaacctaacgatcccgaagctgaaaaggaagttattgataccgtactagaattgatccagaattcgaaaaaccctgttatactatcggatgcctgtgcttctaggcacaacgttaaaaaagaaacccagaagttaattgatttgacgcaattcccagcttttgtgacacctctaggtaaagggtcaatagatgaacagcatcccagatatggcggtgtttatgtgggaacgctgtccaaacaagacgtgaaacaggccgttgagtcggctgatttgatcctttcggtcggtgctttgctctctgattttaacacaggttcgttttcctactcctacaagactaaaaatgtagtggagtttcattccgattacgtaaaggtgaagaacgctacgttcctcggtgtacaaatgaaatttgcactacaaaacttactgaaggttattcccgatgttgttaagggctacaagagcgttcccgtaccaaccaaaactcccgcaaacaaaggtgtacctgctagcacgcccttgaaacaagagtggttgtggaacgaattgtccaaattcttgcaagaaggtgatgttatcatttccgagaccggcacgtctgccttcggtatcaatcaaactatctttcctaaggacgcctacggtatctcgcaggtgttgtgggggtccatcggttttacaacaggagcaactttaggtgctgcctttgccgctgaggagattgaccccaacaagagagtcatcttattcataggtgacgggtctttgcagttaaccgtccaagaaatctccaccatgatcagatgggggttaaagccgtatctttttgtccttaacaacgacggctacactatcgaaaagctgattcatgggcctcacgcagagtacaacgaaatccagacctgggatcacctcgccctgttgcccgcatttggtgcgaaaaagtacgaaaatcacaagatcgccactacgggtgagtgggatgccttaaccactgattcagagttccagaaaaactcggtgatcagactaattgaactgaaactgcccgtctttgatgctccggaaagtttgatcaaacaagcgcaattgactgccgctacaaatgccaaacaataa

SEQ ID NO: 45660 - DNA, 1722 bp, Saccharomyces cerevisiae
atgccaataagatcaatcagctcagcttcacaaatgaacgtgttcggtaaaaaagaagaaaagcaagaaaaagtttactctctacaaaacggttttccgtactctcatcacccatacgcttctcaatactcaagaccagacggccctatcttactgcaagacttccatctgctggaaaatattgcaagtttcgatagagaaagagttccggagcgtgtagtccatgccaaaggtggtggttgtagactggagttcgaactaacagattctttgagtgatattacatacgccgctccataccagaatgtgggttacaaatgtcctggtcttgttcgtttttccaccgttggtggtgaaagtggtacaccagacactgcaagagacccaagaggtgtttcttttaaattctataccgagtgggggaaccatgactgggtcttcaacaatactcccgtcttcttcctcagagacgctattaagtttcccgtatttattcattcgcaaaagagagaccctcagtctcatctgaatcagtttcaggacactaccatatactgggattatctaacattgaatccggaatcaatccatcaaataacttacatgtttggtgatagaggtactcctgcttcgtgggctagtatgaacgcgtactctggtcattccttcatcatggtcaacaaagaaggtaaggacacatatgtgcaattccacgtcttgtcggatactggttttgaaaccttgactggagataaggctgctgaactgtcaggctcccaccctgattataatcaggcaaagctgttcactcaattgcaaaatggcgaaaagccaaaatttaactgttatgtgcaaacaatgacacccgaacaagcaactaagttcaggtattcggtaaatgacctaacgaaaatatggccacacaaggaattccctttgagaaaatttggtaccatcaccctaacggagaatgttgacaattatttccaagaaattgaacaagttgcattcagtccaacgaacacttgtatcccaggtattaagccttctaatgattccgttctacaagccagacttttctcctatccagacactcaacgtcatagattgggagccaactatcagcaattgcccgtcaacagaccaagaaacttgggatgtccatactccaaaggtgattcccaatacactgccgaacagtgtccatttaaagcagtgaacttccaaagggacggcccaatgagttactacaatttcggtcctgagccaaattatatttccagtttaccaaatcaaactctgaaattcaaaaatgaagacaacgacgaagtatctgataagttcaaagggatagttcttgacgaagtaacagaagtttctgtgagaaaacaggaacaagaccaaatcagaaacgagcatattgttgatgccaaaattaatcaatattactacgtttatggtattagtccactagacttcgaacagccaagagctctatatgaaaaggtatacaacgatgaacagaagaaattattcgttcataacgttgtttgccacgcttgtaagatcaaagatcctaaagtcaaaaagagagttacgcaatactttggtttgctaaacgaagatttgggtaaagtcattgcagaatgcttgggagttccttgggaacctgttgaccttgaaggttatgccaagacttggtccattgcaagtgccaattaa

SEQ ID NO: 45661 - DNA, 1719 bp, Saccharomyces cerevisiae
atgctatcaaaatcagaaaaaaatgtcgacctcttggcaggcaatatgagcaatttgagtttcgatgggcatgggactcctgggggcactggactatttcctaaccaaaatataacaaagaggaggacaaggcctgcgggtatcaatgattcaccttcgccggtaaaaccatccttttttccttacgaagatacttccaacatggacatagacgaagtatctcaacctgatatggatgtctcgaactctcccaagaagcttccaccaaagttttacgaaagagcaacttcaaataaaacacagagagttgttagtgtttgcaaaatgtactttctagaacattactgtgatatgtttgactatgtaattagtagaagacaacgcacgaagcaagttctagaatacctgcaacagcaaagccaacttccgaattctgaccagattaaactcaacgaagagtggtcctcttacttacaaagggaacatcaggttttgagaaaaagaaggttgaaaccaaaaaatagggattttgaaatgatcacacaagtaggtcaaggtggttatgggcaagtttatttagccagaaagaaagacacaaaagaggtgtgtgctttgaaaattttgaacaaaaaactattgtttaagctcaacgagacaaaacacgttttaactgaaagagatatcctaaccacgacaaggtctgaatggttagtaaaacttctgtatgcattccaagacctacaaagtttatacctggctatggaatttgtaccaggcggtgattttcgtacattattaataaatactagatgcttgaaaagtggccatgcgagattttacatcagtgaaatgttttgcgctgttaatgcgttacatgatttaggctatacacatagagatttaaagccggaaaacttcttaatcgatgccaagggacatataaaattaacagattttggtttggctgctggtacgatttctaatgaaagaattgaaagtatgaagataaggttagaaaaaatcaaggacctggaatttccagcgtttacagagaaatctatagaagatagaagaaaaatgtacaaccagttgagggagaaggaaattaattatgcgaactccatggttgggtctccggattatatggctttggaggttttagaaggaaagaaatatgactttactgtggattactggtcgttgggttgtatgctgttcgaaagtttagttggttatacaccatttagtggatcatcgactaatgagacctatgacaacttaaggcgctggaaacaaactttaagaagaccgagacaatctgatgggagggcagcattctccgatagaacttgggatttaataacaagattgattgccgatccaatcaatcgattaagatccttcgaacatgttaaacgcatgtcttattttgcagatataaactttagtactttgaggtcaatgatcccgccttttacaccccaactagacagcgaaactgatgccggttattttgatgacttcaccagtgaggctgacatggccaaatatgctgatgttttcaaaagacaagacaaattaacggctatggtagatgactcggcagtatcatcaaaacttgttgggttcactttccgacatagaaatggtaaacagggttccagtggcatcttattcaacggactggaacactcagaccccttttcaaccttttactag

SEQ ID NO: 45662 - DNA, 945 bp, Saccharomyces cerevisiae
atgttcaaagaggaggactcgttaagaaaagggcaaaatgtggccgcgtggaaaactttgttggctggcgccgtatccgggctgcttgcccgtagcataactgctcccatggataccattaagatcagattgcaattgacccctgcaaatgggctgaagcccttcggaagtcaggtcatggaggtggccagaagcatgataaagaacgaaggcatccggtccttttggaagggtaacatacccggttctttgctgtacgttacctatggctcagcgcagtttagttcatactccctttttaatagatatttaactccatttggactagaggcgcgcttacatagtcttgttgtcggagcctttgctggcataaccagttccatcgtttcctacccgttcgatgttttacggacccgactagttgccaacaaccagatgcactcaatgagcatcacgagagaagtgcgtgatatctggaaactagaaggtctccccggatttttcaagggctccatcgcgtcaatgacaaccataactctaaccgcatctataatgttcggaacatacgaaacaatcaggatatactgtgacgaaaacgaaaaaacgaccgccgcgcataaaaaatgggaactggctactttaaatcacagcgctggtaccattggcggcgtcattgctaagatcattactttccccctcgaaacgatccgtaggcgaatgcagttcatgaattcgaagcatctggaaaagttctcccgtcattcgtctgtatacggttcttataaagggtacggattcgcaagaatcggtttacagattttgaaacaagaaggtgtgagttcgctttacagaggtattctggtggccctttccaagacaatacccaccacttttgtgagtttctgggggtatgaaactgccatccattatttgcggatgtactaa

SEQ ID NO: 45663 - DNA, 450 bp, Saccharomyces cerevisiae
atggtgttatccaattatttagtaagcttcgcttgtactcagtcattttttttttttgcatccaattttattgaaagtccgcccgctctgttaaaaaaggcgtttcttccaaatttgaataggacacgatcgagattccctccgattaattatgtgctactggctcctctttcgtcgtattgcaagtggacttttcaacgaggctatgcatgcccagtgtcattcttgaagcaggcacacacagacgcgcttcaattagttttctttactagatgcatcatttgggcggtttttcactaccgttttcgagtaggggctctcacaaaacgggcacgaccttttgtttacaaccgcccaaagaggaaaaacatcaacaatcaagaagcggacacaaaatatagaagcaccataaaactcacgtcaacggtaactttaaatttgttgtattaa

SEQ ID NO: 45664 - DNA, 1416 bp, Saccharomyces cerevisiae
atgtcacgatcccttttggtagagaatagtagaaccattaatagtaatgaagagaagggggtaaacgaaagtcaatatatcttacaaaagagaaacgtcccaaggaccattctcggtaatgtcacaaataatgcaaatatcctgcaagagatttctatgaacagaaaaattgggatgaagaacttctcaaaattgaacaacttctttcctttaaaggatgatgtttcgagagccgatgacttcacctcctcttttaatgacagtagacagggggtgaaacaagaagtactaaacaataaggaaaatattcctgaatatggatattccgagcaagaaaagcagcagtgctcaaatgatgactcttttcatacgaattcgactgccttgagctgtaatcggttgatatactctgagaacaagtctatttccactcaaatggaatggcagaaaaaaataatgagagaagattccaaaaaaaaaaggccaatatcaactcttgtagagcaggatgaccagaaaaagttcaaactccatgaattgactacagaagaagaggttctggaggagtacgaatgggatgacctagatgaagaagattgtgatgatcccttaatggtgagcgaagaggttaatgatatcttcgattatttgcatcacttggaaataatcacattgccaaataaggcgaatctctataagcataaaaatattaagcaaaacagagacattttggtgaactggataatcaagattcataataagtttggccttctgccggaaactctatatttggccataaacataatggatagatttctttgtgaagaggtggttcagttaaatagattgcaactggttggtacatcatgcctgttcatcgcatctaagtatgaggaaatatactcccctagcataaaacattttgcgtacgagacagacggtgcatgctctgtggaagatattaaagagggtgaaagatttatattggaaaaactcgattttcaaattagtttcgctaacccaatgaatttcttaaggagaatatcaaaagcggatgactatgatatccagtctaggacgttagcgaagttcctaatggaaatatctatagtggacttcaagttcatcgggatattaccgtcattatgtgcctcagcggcaatgttcctttcgagaaaaatgctgggcaagggcacctgggatggcaacttaatccattatagtggtggttacacaaaggcaaaactatatcccgtttgccaattactgatggattatcttgttggatctactattcacgacgagttcttgaaaaaatatcaatcgagaagatttttaaaggcttccataatttctatcgaatgggcattgaaggtaaggaaaaatggatatgatattatgacattgcatgagtga

SEQ ID NO: 45665 - DNA, 1143 bp, Saccharomyces cerevisiae
atgaattgtatccctagtccaattagtgaaaggaaaatccaaattaataatgaagattgtataggcaaggaaaatgctttccataccattccaagagaaagttcaattaacttgacacctcactctacgaatgaaaaaaaagttctatccgaggtaaacagtaacaaaatcgattctttacaactccctcgaggtaaattgcaaagagattccacccatttggaaaaaacaagaaagagacaattatcaaatgattcaaccgatcctatagagccaaaaactgtgaaaaaaataaaatgtcatcaatggaaaaatttggattcgatagagatggatgatccattcatggtagcagaatatacagattctatattttctcatctttacgagaaggaaatccaaatgctaccgacacataactatttaatggacacgcaatctccctatcatttgaaaagctccatgagggcgctgttaattgactggttggttgaagttcatgagaaatttcactgcttacctgaaacattatttttagcgatcaacctgctagatcgatttttatcacaaaatgttgttaaattgaataaattacaactactatgcatcacttgcctgttcattgcctgtaaatttgaagaagttaaattaccaaaaataacaaattttgcgtacgtgactgacggtgctgccactgtcgaaggaattaggaaggctgagctattcgttctaagttctttaggttataacatatctctaccaaaccccctaaatttcattaggagaatttcaaaagctgacaattactgcattgaaacaaggaacatggccaaattcatcatggaatattcgatttgttgtaataaattcatccacctgaagccatcatatttagctgcaatgtccatgtatatcgccagaaaaattaaaaatgaaaattccaaatgggatgaaacttttattcattatagtggcggcattgatattgaatcagatccagcgtttaaggattttatcagtgaactagttgaagatattgctgtacctgatacgaatctagattccttgagacttaaatacaaaaagcctaaacatggcatggtttatttcaaggtttttgactggtgtaaacaaaaacgttga

SEQ ID NO: 45666 - DNA, 4645 bp, Saccharomyces cerevisiae
atgagctttatggatcaaatcccaggaggaggaaattatccaaaactcccagtagaatgccttcctaacttcccgatccaaccatctttgaccttcagaggtagaaatgactcgcataaactgaaaaactttatctccgaaataatgttaaacatgtctatgatatcttggccgaatgatgccagtcgtattgtgtactgcagaagacatttattaaaccccgctgctcagtgggctaatgactttgtacaagaacaaggtatacttgaaataacattcgacacattcatacaaggattatatcagcatttctataagccaccagatatcaataaaatctttaatgcaatcacgcaactttccgaagctaaacttggtattgagcgtctcaaccaacgattcagaaagatttgggacagaatgccaccagacttcatgaccgaaaaagctgccataatgacatatactaggctattgacaaaggaaacctataatattgtcagaatgcacaaaccagagacattaaaagacgccatggaagaggcttaccagacaactgcactaactgaaagattcttcccaggattcgaacttgatgctgatggagacactatcatcggtgccacaacccacttacaagaagaatacgactctgactatgattcagaagataatctgacccagaatggatacgtccataccgtaaggacaagaagatcttacaataaaccaatgtcaaatcatcgaaacaggagaaataacaacccatctagagaagaatgtataaaaaatcggctatgcttctattgtaagaaagagggacatcgcctgaacgaatgtagagcacgtaaggcgagttctaaccgatcttgaactcgaatcaaaagaccaacaaactccttttatcaaaaccttaccaattgtacactatatcgccatccccgagatggacaataccgccgaaaaaaccataaaaatacaaaacacgaaagtaaaaaccctgtttgacagtggatcacccacgtcatttatccgaagagatattgtagaacttctcaaatacgaaatctacgagacccctccactccgttttagaggattcgtagccaccaaatccgccgttacatccgaagcagtcaccattgacctcaaaatcaatgacctgcatataactttagccgcgtacatactggataacatggactaccaattgttaattggaaatccaatcttacgccgctacccgaaaatcctgcacacagtactgaataccagagagagccccgactccttaaagcccaagacttatcgctccgaaaccgttaataacgttagaacctactccgctggtaatcgtggtaaccccagaaacataaaactgtcttttgcccccaccattctcgaagcaactgacccgaaatccgctggtaatcgtggtgactccagaaccaaaaccctgtctcttgcaaccactactcctgcagcaattgacccgcttacgacccttgataacccaggtagtactcaaagtacatttgcgcaattcccgatacctgaagaagcgagcatcctagaagaggatggaaaatactccaacgttgtctcaaccattcagagtgtagaacctaatgctactgatcacagcaataaggacaccttttgcactttgccagtttggttacaacagaagtatagagagatcatacgtaatgatctcccaccaagacctgccgacattaataacatccccgtaaaacatgatattgaaattaaacctggcgcaagactacctcgactacagccataccatgttacagaaaagaacgaacaagaaatcaacaaaatagttcaaaaactgctcgataacaagttcattgttccctcaaagtcgccttgcagctcccctgtagtcctcgtcccgaagaaagacggtaccttccgactctgcgtcgattaccgcaccctgaacaaagctaccatctccgacccattcccattacccagaatcgacaacctattgagccgtattggaaatgcccagatatttaccacgctagatttgcatagtggttaccaccagatcccgatggaacccaaagaccgctacaaaaccgcctttgtcacaccatccggtaagtatgaatataccgtcatgccatttggcttagtcaatgcacctagtacattcgcaagatacatggctgatacatttagagacctgagattcgtcaatgtttaccttgatgatatattaatattctccgaatctccagaagaacattggaaacatttagacacggtactagaaagattaaagaacgagaacctcattgttaagaagaaaaaatgtaaatttgcatctgaagaaactgagtttttaggctatagtattggaatccagaaaatagctccactacagcacaaatgtgcagcaatccgagactttccgacgcctaaaacagtaaaacaagcacagagatttttaggaatgattaattactacagacgattcattccaaattgctccaagattgcacagccaatccaactgtttatttgtgacaaaagtcaatggacagaaaaacaagacaaggcaattgataaactaaaagacgccttgtgtaactcccccgtcctagtaccattcaacaacaaagcaaactaccgacttacaacagacgcctcaaaagacggcattggtgctgttctagaagaagtcgacaacaagaacaaacttgttggtgtcgtcggttacttctctaaatccttagagagtgcccagaaaaactatcctgctggcgaattagaactacttggaattatcaaagcactccaccacttccgatatatgcttcacggaaagcatttcacgttaagaacagaccacattagtttgttatcattacaaaacaagaacgaacccgcacgacgcgtgcaacgctggttagatgacctagccacatatgacttcaccttagaatacctagctggacccaagaacgttgtcgcagatgccatatcccgtgccgtatatactataacccccgaaacatcccgacctatcgacacagaaagctggaaatcttactacaaatcagacccattatgtagtgctgtcttaattcatatgaaagaattgacacaacacaacgtcacacctgaagatatgtcagccttccgtagttaccagaagaaactcgaactatcagagaccttccgaaagaattattccctagaagacgaaatgatctattaccaagaccgactagtagtaccaataaaacaacagaacgcagttatgagactatatcatgaccataccttatttggaggacattttggtgtaacagtgacccttgcgaaaatcagcccaatttactattggccaaaattacaacattcgatcatacaatacatcaggacctgcgtacaatgtcaactaataaaatcacaccgaccacgcttacatggactattacaaccactccctatagcagaaggaagatggcttgatatatcaatggattttgtgacaggattacccccgacatcaaataacttgaatatgatcctcgtcgtagttgatcgtttttcgaaacgcgctcacttcatagctacaaggaaaaccttagacgcaacacaactaatagatctactctttcgatacattttttcatatcatggttttcccaggacaataaccagtgatagagatgtccgtatgaccgccgacaaatatcaagaactcacgaaaagactaggaataaaatcgacaatgtcttccgcgaaccacccccaaacagatggacaatccgaacgaacgatacagacattaaacaggttactaagagcctatgcttcaaccaatattcagaattggcatgtatatttaccacaaatcgaatttgtttacaattctacacctactagaacacttggaaaatcaccatttgaaattgatttaggatatttaccgaatacccctgctattaagtcagatgacgaagtcaacgcaagaagttttactgccgtagaacttgccaaacacctcaaagcccttaccatccaaacgaaggaacagctagaacacgctcaaatcgaaatggaaactaataacaatcaaagacgtaaacccttattgttaaacataggagatcacgtattagtgcatagagatgcatacttcaagaaaggtgcttatatgaaagtacaacaaatatacgtcggaccatttcgagttgtcaagaaaataaacgataacgcctacgaactagatttaaactctcacaagaaaaagcacagagttattaatgtacaattcctgaaaaagtttgtataccgtccagacgcgtacccaaagaataaaccaatcagctccactgaaagaattaagagagcacacgaagttactgcactcataggaatagatactacacacaaaacttacttatgtcacatgcaagatgtagacccaacactttcagtagaatactcagaagctgaattttgccaaattcccgaaagaacacgaagatcaatattagccaactttagacaactctacgaaacacaagacaaccctgagagagaggaagatgttgtatctcaaaatgagatatgtcagtatgacaatacgtcaccctga

SEQ ID NO: 45667 - DNA, 1542 bp, Saccharomyces cerevisiae
atgtcaacacccacagcagcagatcgcgcgaaggcacttgaaagaaagaacgaaggaaatgtttttgtgaaggaaaaacattttttaaaggccattgaaaaatatacagaggcgatcgatttagattctacacagtctatctatttttcgaacagagcatttgctcactttaaggtagataactttcaaagcgctttaaatgactgtgatgaagccattaaactggatcccaaaaatatcaaagcttatcatagacgtgcattatcctgcatggctctgctagaatttaaaaaggctaggaaagatttgaatgtgcttctaaaggcgaagcccaatgatccggctgctactaaggcgttacttacatgtgataggttcattagagaagaaagatttaggaaagctatcggaggcgcagaaaatgaagccaagatcagtttgtgtcagactttgaacttgagttcatttgatgctaatgcagatttagccaattatgaaggtccaaagttagaatttgaacagctgtatgacgataagaatgcctttaaaggtgcaaagatcaagaacatgtctcaagagtttatttccaaaatggttaacgatcttttcctaaagggaaaatatttaccaaaaaagtacgttgcagctattatctctcatgctgataccttatttcgtcaagagccatctatggtagaactagaaaataactctactcctgatgttaagatatcagtatgtggtgatacgcatggccaattttatgatgttttgaatttatttcgcaagtttggtaaagtaggtcctaagcacacttatctattcaatggtgattttgtcgaccgtggttcttggtcgtgtgaagttgcactattattctactgtttgaaaatattacatccaaataatttctttttgaacagaggtaatcatgagagtgataatatgaacaaaatctatgggtttgaagatgagtgtaaatacaaatattcacaaaggatatttaacatgtttgcacaaagttttgagagccttccattggctaccttaattaataatgattaccttgtaatgcatggtggtttaccaagtgatccttcagcaactttgtctgatttcaagaatattgatagatttgcccaaccacctagagatggcgcctttatggaacttctatgggcggacccacaagaagccaacgggatgggtccttctcagcgtggtttaggacatgcttttggacccgacattacagatagatttctaagaaacaacaaattgcgcaagatttttagatctcacgagttaagaatgggtggtgtgcaattcgagcagaagggtaaattaatgacagttttcagtgctccaaactattgtgatagccaaggtaatcttgggggtgttattcatgttgtaccaggccatggtattttacaggctggcaggaatgacgaccaaaatctaataattgagacattcgaagctgttgagcacccagatataaaaccaatggcctattctaatggtggttttggtttatag

SEQ ID NO: 45668 - DNA, 552 bp, Saccharomyces cerevisiae
atgccaaacttctggattcttgagaatcgtaggagctatacgtctgatacatgtatgtcgaggatcgtgaaggagtacaaagtcatactgaaaacattggccagtgatgaccccatagcgaacccctaccgggggataatcgagtcacttaacccgattgacgaaaccgacttgagcaagtgggaagctataatttctgggccgtcagacacaccttatgaaaatcatcagtttcgaatactaatagaagtccctagttcctaccccatgaatccaccaaagataagttttatgcagaacaatattttgcactgcaatgttaaatcagccacaggagaaatatgtctgaacatccttaaaccagaggagtggactcctgtatgggatttgttacactgtgttcatgctgtttggagactcctaagggaacccgtttgtgattctccacttgacgtagacattggtaatatcatccgctgtggcgatatgagtgcctatcaggggattgtaaagtacttcctagcagaaagagagcggatcaacaaccattga

SEQ ID NO: 45669 - DNA, 777 bp, Saccharomyces cerevisiae
atgggttccagaagatacgattccaggacaacaattttctcccctgagggacgtctatatcaggttgaatacgcgctagaatccatttcacatgcaggtaccgcaattgggattatggcatctgatgggattgttcttgcagcagaacgcaaagtcacaagtactttactagaacaagacacctctaccgaaaaactttataagttaaacgataaaattgcggttgccgttgctggactgactgcagatgcagaaattctaataaatacggctagaattcacgctcaaaattaccttaaaacctataatgaagatataccagtagaaattttggtgagaaggctaagtgatataaaacaaggttacacgcaacatggtggtttaagaccatttggtgtgtcctttatctacgccggttatgacgatagatacggttaccaattgtatacatctaatccatcgggaaactatacagggtggaaggctattagtgttggcgctaacacatcagcagcacaaaccctacttcaaatggactacaaggatgatatgaaagtcgatgatgccattgaactggctttaaaaacgttatccaaaactaccgacagtagcgcgctgacttatgacaggttggaatttgctactatcagaaagggtgctaatgacggagaagtgtatcagaagattttcaagcctcaagagataaaggatatattggtaaagactggtattaccaagaaggatgaagacgaagaagctgatgaagatatgaaataa

SEQ ID NO: 45670 - DNA, 819 bp, Saccharomyces cerevisiae
atgagagactataaattagtagtattgggtgctggtggtgtcggtaaatcctgcttaaccgtgcagtttgtacagggagtttatttggatacgtatgatccaacgatcgaagattcttacaggaaaaccatcgagatcgataacaaggtattcgacctggaaattttagatacagcgggtatagcacaatttactgcaatgagagaattatacataaagtcaggaatggggttcctgttggtatattcagtaacagatcggcaatctttggaagaattaatggagctaagagaacaggtccttaggatcaaagattccgatcgcgttccaatggttctaataggtaacaaggctgatctaatcaatgaaagggtaataagtgtggaagaaggtatagaggtaagcagtaaatggggtagagttcccttttatgaaacaagcgctttgttgaggagcaatgtggatgaagtgttcgttgatttagttaggcaaatcattcggaatgaaatggaaagtgttgcagttaaagacgcaagaaatcaaagtcaacaatttagcaaaatcgagtctccatcaaccaggctccctagttctgcgaaacaggatacgaaacaatcaaacaataagcaatcatcaaaaggtttatataacaaatcttcacaaggacaagctaaagttaaacaatctactccggttaatgaaaagcacaaaccgtcacatgccgttccgaaatctggttctagcaacaggacaggaattagcgctacttcacaacaaaagaaaaagaagaaaaacgcttccacttgcactattctatag

SEQ ID NO: 45671 - DNA, 2610 bp, Saccharomyces cerevisiae
atgtccagttgtaaaaccactttgtctgaaatggttggttctgtgacaaaagataggggcactatcaacgtcgaagccagaacacgttcgagtaatgtaactttcaaaccacctgtaacccacgatatggtgcgttcgcttttcgatccaactttgaagaaatctctgctggaaaaatgcatcgcgctagctattatatcgaattttttcatttgttattgggtcttccaaaggtttggcttacagtttaccaaatacttttttctggtacagtatttattttggagaattgcttataatttaggtattggactggttctgcattaccagtcacattatgaaacactaacgaattgtgctaaaactcatgcgattttcagcaaaataccacagaataaagatgctaattcgaatttctcaacaaattccaattccttttcagaaaaattttggaattttattaggaagttctgtcaatatgagattaggtctaaaatgccaaaggagtatgatttatttgcctatccagaagagatcaacgtctggttgatatttcgccagtttgtcgatttaatcttgatgcaagattttgtgacttacattatttacgtttacctttctattccatatagctgggttcaaatcttcaactggagatctttgctaggtgttattttgattttatttaacatctgggtcaagttagatgcgcatcgcgtggttaaagattatgcttggtactggggtgatttcttctttttggaagaatctgaattgatttttgatggtgtcttcaacatctctccacatccaatgtattctattggttatttgggttattatggcctatcattgatttgtaatgactacaaggttcttctggtgtccgtatttggacattattctcaatttttgtttctgaaatacgtcgaaaatcctcatattgaaagaacgtatggtgatggcactgattccgattctcaaatgaatagcagaattgatgacttgatatcaaaagagaattacgattattcaagacctctaattaacatgggtctttcttttaacaacttcaataagctaagatttactgactatttcacaattggtaccgtagcggcacttatgttaggaacaatcatgaatgctaggtttatcaatttaaattacctctttattaccgtttttgtaacaaaactggtttcatggttatttatctcgacaatattgtacaagcaatctcagtctaaatggttcacgagattgtttttggagaatggttacacacaagtttattcctatgagcaatggcaatttatttacaattattatttggtattaacctacacacttatgataattcatacagggcttcaaatttggagtaatttttccaacataaacaacagtcaattaatttttggtttaattcttgtggctttacaaacatggtgtgataaggaaacgagactagcaatctctgattttggttggttttatggtgattttttcttgagcaactatatctcaactagaaagctgacttcccaaggtatctacagatatttgaatcacccagaagcggtattaggcgttgttggagtttggggtactgtattgatgacgaattttgccgttacaaatattatcttggctgttttatggacattgacaaattttattcttgtcaagtttattgaaacacctcatgttaataagatatatggtaaaactaaacgagttagtggtgttggaaaaactttactaggcttgaaacctctaagacaagtttcagatattgtcaatagaattgaaaatattataatcaaatcattagttgatgaaagcaagaactccaatggtggggcagaacttttgcccaaaaattatcaagataacaaagaatggaatattttaattcaggaagcaatggatagcgttgcaacaagattgagtccatactgtgaattgaaaattgaaaacgagcaggtagaaaccaattttgtcttgcctactccagtaactttgaattggaaaatgcccattgaactttataacggagatgattggattggtttgtataaagtcattgatacaagggcagatcgtgaaaaaacaagagttggatcaggtggtcattggagtgcgacttctaaagattcatatatgaaccatggattaagacataaagaatctgtaacagaaataaaggcgactgaaaagtacgttcaaggtaaagtgacattcgacacgtctttgctttattttgaaaatggtatctacgaatttaggtatcattctggtaactcccataaggtgttattgatttctacaccatttgaaatttcattgccggtactaaataccacgacacctgaactgtttgagaaggatttgactgagtttttgacgaaagtcaacgttttgaaggatggtaaatttcgtccattaggaaataagttcttcgggatggacagcttgaaacaattgattaagaactcaattggcgtcgaactttcgtctgagtatatgaggagagtcaatggtgacgctcacgttatttcgcatcgcgcttgggatataaaacaaacgcttgatagtcttgcttga

SEQ ID NO: 45672 - DNA, 1107 bp, Saccharomyces cerevisiae
atgggtattatcgacaaaatcaaagccatcgaagaagaaatggccagaacccaaaaaaataaggccacagaacatcatctgggtcttttgaaggggaaattggctagatacagacaacaactgctagctgatgaagctggtagtggtggtggaggagggtctggttttgaagtggcaaaatcaggtgacgctagagtagttttaataggttacccctccgtcggtaagtcctccttattgggtaaaattaccaccaccaagtctgagatcgctcattatgctttcacgacattgacatccgttcctggtgtattgaagtaccaaggtgcagaaatccaaattgtggatcttccaggtattatttatggtgcttcgcagggtaaaggtcgtggtaggcaagttgttgcaacagcaaggaccgcagatctagtattaatggttttagatgccacaaagagtgaacatcaaagagcatctttggagaaggagctggaaaatgtaggcatcaggcttaataaagagaaaccaaatatttactataagaaaaaagaaactggtggcgtgaaagttacgtttacctcccctccaaagaccaatttaaccgaacaggcaatcaaaatgatcttgagagattatcgtatccataatgcagaagttctggtaagagatgaccaatgtacgattgatgattttatcgatgttattaacgaacaacatagaaattatgtcaaatgtctttatgtgtataataagatagatgcagtatcattagaagaggtggataaacttgccagagagccaaacaccgttgttatgtcctgtgaaatggatttgggattacaagacgtcgttgaagaaatttggtaccagctgaacttgagtcgtgtgtatacaaagaagagaggtgttagaccagtatttgatgatcctctagtggtaagaaataattccactattggtgacttatgtcatggtatccacagggatttcaaagataagttcaaatacgcattggtttggggttcttctgccaaacattctcctcagaagtgcggcttaaaccacaggattgatgatgaagatgtagtttctttattcgcgaaatag

SEQ ID NO: 45673 - DNA, 1491 bp, Saccharomyces cerevisiae
atgtctgctgttaacgttgcacctgaattgattaatgccgacaacacaattacctacgatgcgattgtcatcggtgctggtgttatcggtccatgtgttgctactggtctagcaagaaagggtaagaaagttcttatcgtagaacgtgactgggctatgcctgatagaattgttggtgaattgatgcaaccaggtggtgttagagcattgagaagtctgggtatgattcaatctatcaacaacatcgaagcatatcctgttaccggttataccgtctttttcaacggcgaacaagttgatattccatacccttacaaggccgatatccctaaagttgaaaaattgaaggacttggtcaaagatggtaatgacaaggtcttggaagacagcactattcacatcaaggattacgaagatgatgaaagagaaaggggtgttgcttttgttcatggtagattcttgaacaacttgagaaacattactgctcaagagccaaatgttactagagtgcaaggtaactgtattgagatattgaaggatgaaaagaatgaggttgttggtgccaaggttgacattgatggccgtggcaaggtggaattcaaagcccacttgacatttatctgtgacggtatcttttcacgtttcagaaaggaattgcacccagaccatgttccaactgtcggttcttcgtttgtcggtatgtctttgttcaatgctaagaatcctgctcctatgcacggtcacgttattcttggtagtgatcatatgccaatcttggtttaccaaatcagtccagaagaaacaagaatcctttgtgcttacaactctccaaaggtcccagctgatatcaagagttggatgattaaggatgtccaacctttcattccaaagagtctacgtccttcatttgatgaagccgtcagccaaggtaaatttagagctatgccaaactcctacttgccagctagacaaaacgacgtcactggtatgtgtgttatcggtgacgctctaaatatgagacatccattgactggtggtggtatgactgtcggtttgcatgatgttgtcttgttgattaagaaaataggtgacctagacttcagcgaccgtgaaaaggttttggatgaattactagactaccatttcgaaagaaagagttacgattccgttattaacgttttgtcagtggctttgtattctttgttcgctgctgacagcgataacttgaaggcattacaaaaaggttgtttcaaatatttccaaagaggtggcgattgtgtcaacaaacccgttgaatttctgtctggtgtcttgccaaagcctttgcaattgaccagggttttcttcgctgtcgctttttacaccatttacttgaacatggaagaacgtggtttcttgggattaccaatggctttattggaaggtattatgattttgatcacagctattagagtattcaccccatttttgtttggtgagttgattggttaa

SEQ ID NO: 45674 - DNA, 1038 bp, Saccharomyces cerevisiae
atggaagcacataaccaatttttgaagactttccaaaaagaacgtcatgatatgaaagaagctgaaaaggatgaaatccttttgatggaaaacagccgtagattcgtgatgttccctatcaaataccacgaaatctgggctgcttacaagaaggttgaagcctctttctggactgcggaagaaatcgaattggctaaggacactgaagatttccaaaaattgactgatgaccagaagacctacatcggtaacttgttagccttgtccatttcttctgacaaccttgtcaacaagtacttgatcgaaaacttttctgcccaattgcaaaaccctgaaggtaagagtttctacgggttccagattatgatggaaaacatctactctgaagtttactccatgatggttgatgccttcttcaaggaccctaagaacatccctctattcaaggaaattgccaatttgcctgaagtcaagcataaggctgctttcatcgagagatggatttccaacgatgacagcttgtatgctgaaagactagtagcatttgctgcaaaggaaggtattttccaagctggtaactatgcttctatgttctggttgactgacaaaaagattatgccaggtttagcaatggccaacagaaacatctgtagagacagaggtgcctacactgacttttcatgcttgctatttgcccatttgagaaccaagccaaaccccaagatcattgaaaaaatcattaccgaagccgtggaaattgaaaaggaatactactcaaactctttgccagtagaaaaatttggtatggatttgaagagcattcacacctacatagaatttgtcgctgacggtctattacaaggtttcggtaacgaaaaatactacaacgccgtcaacccattcgaattcatggaggatgtcgctaccgctggtaagaccaccttctttgaaaagaaggtttccgactaccaaaaggccagtgacatgtctaagtccgctaccccatccaaggaaattaactttgatgatgacttctaa

SEQ ID NO: 45675 - DNA, 414 bp, Saccharomyces cerevisiae
atggtatgttggtgtgtgtgtgtgctgcttcacatttcaggctaaaaatgttatccgtggaatcttccttagccaagtatcatgggctttggaaattagtttcccaccgatgagcgcaacgacttagcgaagcttatgaaattggtgacagcagctctatgaatatgttccatgcgtttccattcaggttactaacaatgcataaattatgagtagtctttttcatcactatataaaacctttttcaaacgaaacgctgtttttgttggtactatctttgcaggtgcctttgttttccaaactgtatttgatactgctattacttcatggtacgagaatcacaacaaaggaaaattatggaaagatgtcaaggctcgaatagctgcaggcgatggagacgacgatgatgagtaa

SEQ ID NO: 45676 - DNA, 3066 bp, Saccharomyces cerevisiae
atgaatttagatttaggttctactgtacgaggctatgaatcagataaagacacatttccgcaatcgaaaggcgttagctcatctcaaaaagagcagcatagtcaactgaatcagacaaaaatagcttatgaacagagacttctaaatgatttagaggatatggatgatcctttagatttgtttttagattatatgatatggattagcaccagctatattgaagtagattctgaatcaggtcaagaagttctccgaagtacaatggaaagatgcttgatttacatacaagatatggaaacctataggaacgatcccagatttttaaaaatttggatttggtatataaatttgtttcttagcaacaacttccacgagagtgaaaatacttttaaatatatgtttaacaagggaatcggaacaaagctttcgttattttatgaagagttctccaagctactagaaaatgctcaattttttctagaagcaaaggtgttattagaactaggggctgaaaacaattgcaggccttacaacagactattaaggtcattaagcaattatgaagacagactccgagaaatgaacatcgtagaaaaccagaacagtgtacctgattcaagggaaagattgaagggaaggttaatttatagaacagcaccatttttcattcgtaaatttttaacctcatcattgatgactgatgacaaggaaaatcgtgcgaacctgaactctaatgttggagttggtaagtctgctcctaacgtatatcaagattctatagtggttgctgactttaagtcagaaacagagaggcttaatttgaatagctctaaacagccctctaaccaacgcttgaagaatggaaataaaaaaacttcaatatatgcagatcaaaagcaatctaacaatccagtctacaaactaatcaatactccgggacggaaacctgaacggatagtttttaattttaatctaatatatccagaaaatgatgaggagttcaacaccgaagaaatattggcaatgattaagggactttacaaggtacagcgcagaggtaagaagcacaccgaagattatacaagtgacaaaaataggaagaaacgtaagctcgatgtgctggtagagagacggcaagacttaccttcatcacagccacccgttgtccccaaatctacgcgaattgaggtgtttaaagatgacgataatcccagccagagcacacaccataaaaatacacaggtacaagtgcaaacgacaacgtctattttacctttgaagcctgtggttgatggaaacctcgcgcatgagacaccagtgaagccctcactaacatccaacgcttcccgttcacctacagtaacagctttttcaaaagacgctataaatgaggtcttttccatgttcaatcaacattattcaaccccgggtgcgctattagatggtgatgataccactacaagtaaattcaacgtcttcgaaaattttacccaagaatttacagcaaagaatattgaagatttaactgaagttaaagatcctaaacaagagacggtgtcacaacaaactacctcaacaaatgaaaccaacgatcgatatgaaagattgtcgaatagtagcacacggccagaaaaggcagactacatgacgcctataaaagaaactactgaaacagatgtggtacctataatccagacacctaaggaacaaataaggacagaagataagaaatcgggggataatacagaaacacaaactcaattaacaagcacaaccattcaaagttctccatttctcacacaacctgaaccacaagcagaaaagcttttacaaactgcagaacattcggaaaagagtaaagagcattacccaacgatcatacctcccttcactaaaataaaaaatcaaccgcctgtcattattgaaaacccacttagtaataatttaagagcgaagtttttatccgaaatttcgcccccattattccaatataacaccttttataactacaaccaagaattgaaaatgagttctctattgaaaaaaatccatagggtatcccgcaacgaaaacaagaacccaattgttgacttcaagaagacgggtgatttatattgtatacgcggagaattaggcgaaggaggttatgccactgtatatctagcagaatctagtcaaggacatctgcgagcgttgaaagtagaaaaacctgcaagtgtatgggaatattacataatgagccaagtggagtttaggttgaggaagagcacaatattaaagtcaataatcaacgctagtgctttacacttgttccttgatgagagctaccttgttttaaactacgccagtcaaggtacggtcttggatttaattaatttacaacgggaaaaggcaattgacggcaacggaataatggatgaatatttgtgcatgtttatcactgtcgagctaatgaaagtacttgaaaagatacatgaagtgggaataatacatggcgatttgaaaccagataactgcatgatcagattagaaaaaccaggcgaacccctgggtgctcattatatgcgcaatggagaggatggctgggaaaacaagggaatctatttaatagatttcggtagatcatttgatatgacactgttaccacctggaacgaaattcaaatcaaattggaaggctgatcagcaagattgctgggaaatgcgtgcgggcaagccatggagttatgaagcggattattatggattagcaggcgtcatacattcgatgctttttggaaaattcatagaaacaatccagctgcagaatggacgatgcaaattgaagaacccattcaaaaggtattggaaaaaagaaatatggggcgttatatttgatttactgttaaatagcggtcaagcttccaatcaagctttgccgatgactgaaaagattgttgaaataaggaatttgatagaaagccatctggaacagcacgcagaaaatcacttaagaaacgtaattctaagcattgaagaggagttatcacattttcaatataaggggaaaccgtcaaggagattttag

SEQ ID NO: 45677 - DNA, 1524 bp, Saccharomyces cerevisiae
atgaaagtgcttgacctactaacggtactcagtgcctcttcattattatctacattcgcggctgccgaaagtactgctactgcagacagtacaactgcagcttctagcactgcttcgtgtaacccgttaaaaactacaggttgtacgccggatacagctttggcaactagttttagcgaagatttctcatcttcatccaaatggtttaccgacttgaagcacgcaggtgaaatcaagtacggttcagacggtttgtcaatgacactggcgaaaagatacgataatccaagtttgaagtctaacttttatatcatgtatggtaaattggaagttatcttaaaagctgccaatggtaccggtattgtttcatcattctatttacaaagtgatgatttggatgaaattgatattgaatgggtgggtggtgacaacactcagttccaatctaacttcttttctaaaggtgataccacaacatacgacagaggcgaatttcacggtgtcgacactcctaccgacaaatttcataactacactttagattgggcgatggacaagacgacttggtacctcgatggagagtctgtcagagtattatcaaacacatcaagtgagggttacccacaatctcctatgtacctaatgatgggtatctgggccggtggtgacccagacaatgctgctggtaccattgaatgggctggtggtgaaaccaactacaatgacgctccattcactatgtacattgaaaaggtcattgtaactgattattctaccggtaaaaagtacacatatggtgaccaatctggttcttgggaatctattgaagctgacggtggttctatttacggcaggtatgaccaagcccaagaagatttcgcagttttagccaacggtggtagtatttccagcagctctacatcctcttctactgtatcttcctcggcgtcttccactgtatcttcctcggtttcttccactgtgtcctcctcggcttcttccactgtgtcttcctcggtttcttccactgtatcttcttcgtcttctgtatcttcctcttcatccacatctccatcttcttcgaccgctacttcatctaaaacacttgcttcctcatcagtcaccacatctagttccattagttcattcgaaaagcaatcctcctcttcatccaagaaaacagtggcttcctcttctacaagtgagtccattatttcctccactaagaccccagccactgtttcctctaccactaggtctacagttgccccaactactcaacaatcttccgtatcatcggacagtcctgtacaagataagggtggtgtcgcaacatcaagtaatgacgtgaccagttctactacccagatatcaagcaaatacacatctacaatccaaagttcttcctccgaagccagctcgacaaactctgttcaaatttctaacggtgctgatttagctcagagtttaccaagagagggaaaacttttttccgtactcgtagctttactagccttgctataa

SEQ ID NO: 45678 - DNA, 1812 bp, Saccharomyces cerevisiae
atgcctagaaacccattgaaaaaggaatattgggcagatgtagttgacggattcaagccggctacttctccagccttcgagaatgaaaaagaatctactacatttgttaccgaactaacttccaaaaccgattctgcatttccattaagtagcaaggattcacctggcataaaccaaaccacaaacgatattacctcttcagatcgcttccgtcgtaatgaagacacagagcaggaagacatcaacaacaccaacctgagtaaagatctatccgtgagacatcttttaactctagctgtcgggggtgcaataggtactggtttatatgtgaatacgggtgctgctttatctacaggtggtccggccagtttagttattgattgggttattatcagtacatgtctttttactgtgattaactctcttggtgagctgtccgctgcttttcccgttgttggtgggttcaatgtttacagtatgcgttttattgagccttcatttgcattcgcagtgaacttaaactatttagcacaatggctagttcttctacccttggaattagtggccgcatctattactataaaatactggaatgataaaattaattccgacgcctgggttgctatcttttatgccaccattgcactggctaatatgttggatgttaagtcatttggtgagaccgaatttgtattgtccatgattaaaatcctctccatcattggctttactatcttaggtattgttttgtcctgtggtggtgggcctcacggcggttacattggtggtaaatactggcatgacccaggcgcttttgtagggcacagctcgggaactcagtttaaaggtttatgttcagtttttgttaccgctgccttttcttattccggtattgaaatgactgctgtctccgctgctgaaagtaaaaatccaagagaaaccattcccaaggcagcaaagagaactttttggctgattaccgcctcttatgtgactatattgactttgattggttgcttggttccatccaatgaccctaggttactaaacggttcaagttcagtggacgctgcctcatctcctctggttatcgcaattgaaaacgggggtattaaaggtctaccatcattaatgaacgccattattttgattgctgttgtttccgtggctaacagtgctgtttatgcatgttcaaggtgtatggtcgccatggctcatattggtaatttaccaaaatttttgaaccgtgttgacaaaaggggtagaccaatgaatgctatcttgttaactttgttttttggtttgctttcctttgtggcagcaagtgataagcaagctgaagtctttacatggttgagtgccttatctggtttatcgacaattttctgctggatggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttga

SEQ ID NO: 45679 - DNA, 999 bp, Saccharomyces cerevisiae
atggttagagttgctattaacggtttcggtagaatcggtagattggtcatgagaattgctttgtctagaccaaacgtcgaagttgttgctttgaacgacccattcatcaccaacgactacgctgcttacatgttcaagtacgactccactcacggtagatacgctggtgaagtttcccacgatgacaagcacatcattgtcgatggtaagaagattgctacttaccaagaaagagacccagctaacttgccatggggttcttccaacgttgacatcgccattgactccactggtgttttcaaggaattagacactgctcaaaagcacattgacgctggtgccaagaaggttgttatcactgctccatcttccaccgccccaatgttcgtcatgggtgttaacgaagaaaaatacacttctgacttgaagattgtttccaacgcttcttgtaccaccaactgtttggctccattggccaaggttatcaacgatgctttcggtattgaagaaggtttgatgaccactgtccactctttgactgctactcaaaagactgttgacggtccatcccacaaggactggagaggtggtagaaccgcttccggtaacatcatcccatcctccaccggtgctgctaaggctgtcggtaaggtcttgccagaattgcaaggtaagttgaccggtatggctttcagagtcccaaccgtcgatgtctccgttgttgacttgactgtcaagttgaacaaggaaaccacctacgatgaaatcaagaaggttgttaaggctgccgctgaaggtaagttgaagggtgttttgggttacaccgaagacgctgttgtctcctctgacttcttgggtgactctcactcttccatcttcgatgcttccgctggtatccaattgtctccaaagttcgtcaagttggtctcctggtacgacaacgaatacggttactctaccagagttgtcgacttggttgaacacgttgccaaggcttaa

SEQ ID NO: 45680 - DNA, 1275 bp, Saccharomyces cerevisiae
atggcaaacccaacaacagggaagtcctcgattagggctaagctttctaactcatcgctatcaaacctatttaaaaaaaataaaaataaaagacagcgtgaggaaacggaagagcaggacaatgaggataaggatgagagtaagaaccaggatgaaaataaggacacacagctcactccccgcaagcgtcgccggttgacgaaggagtttgaagagaaggaggctcgttacaccaacgagttgcccaaggaactgcgcaagtatcgtcctaaaggtttcagattcaatttgcctccaacggatagacccatcaggatatatgcagatggtgtttttgatcttttccatcttggccacatgaagcaactggaacagtgtaagaaggctttccccaatgtaacactgatagttggtgtgcctagcgacaaaatcactcacaaactaaaaggtttgactgtgctgaccgataagcagcgttgtgaaactttaacgcactgcagatgggttgacgaagtcgtgcccaacgctccctggtgtgtcaccccagaatttctactagaacacaagattgactacgtggcacatgacgatattccttacgttagcgccgacagcgacgatatctacaagccaataaaggagatgggaaaattcttgactacccaaagaaccaatggtgtctctacaagtgatattatcacaaagatcatcagagattatgacaaatatttgatgagaaactttgcaaggggtgctaccagacaggagctgaacgtttcttggttgaagaaaaacgaactggagttcaaaaaacacatcaatgaattcaggtcatatttcaagaaaaaccagacaaatttgaataacgcctccagagacttgtacttcgaagtccgtgaaatcttgctaaagaaaacgttgggcaaaaaactctactccaagttaataggcaatgaattaaagaaacaaaatcaacgacaaagaaaacagaattttttggatgatccgtttactaggaagctaatcagggaggcctctccggctacagagtttgccaacgaatttacgggcgaaaactctaccgctaaatcaccggatgacaatggaaatcttttcagtcaggaagatgatgaagacacaaattctaacaacacgaatacaaattcagattcagattcaaacactaactcaacgcctcccagtgaagatgacgacgacaacgacaggttaactttggaaaacctaacacagaagaagaaacaatcagcgaactga

SEQ ID NO: 45681 - DNA, 6120 bp, Saccharomyces cerevisiae
atgcaggggagaaaaaggacgcttacggaaccatttgagccaaataccaatccatttggggacaatgcagcagtaatgacggaaaatgttgaggataacagcgaaacagatggtaaccgtctagaatcaaaaccacaagctttggtcccaccagctttaaatatcgtgccaccagagagcagcatccacagtactgaagaaaaaaaaggtgacgagtacaatggaaatgataaagatagctccttaatctccaacatatttcgtactcgtgtcggaaggagtagtcatgaaaacttgagcaggcctaaactctcacttaaaacagcatcatttggtgccgctgaatcttcccggcgtaatgtttcaccctctacaaaatctgccaagtctagttcgcagtatattgatttaaatgatgaaaggctacgcaggcgtagcttcagtagttatagccgatcatctagtaggcgtgtttctaattcaccaagctcaacggataggcctccacggtcggcaaaggttttatcgctaattgccgctgatgatatggatgattttgaagatttgcaaaagggatttaaaagtgcaatagacgaagagggcctgacatggctaccccaattaaaatcagaaaaaagccgtcctgtatcagacgttggagaagatagaggagaaggagaacaagaatctatacctgacgttcatacacccaatgtaggagcaagcgctactccaggatcaattcatctaacacccgaacccgcgcagaatggttcggtatctgagggtctagaaggctctattaataattcaagaaagaaacccagtccaaagttttttcatcatttatcaccgcaaaaagaagataaagaccaaacagaagttattgagtatgctgaagacattctagattttgaaacccttcaaagaaaactggaatcaaggccctttgtgctttatggacattctcttggggttttctcgcctacgaatccgctaagaataaaaattgctcgttttttgttgcataggcggtattcgttactttacaacactttgttaacattttatgccattctcctggcgataaggacatataaccctcacaatgtggtttttttataccgtttctctaactggaccgactatttcatttttattttatcagcttgctttacaggcaatgatattgctaaaataattgcgtttggattttgggacgattctgaaatgtttaaagcctatggacgtgagtataaatcaatcttacagagatctggaattatgaaactatacatatatctgagagaaaagtatggtagaaagctaatagatttcattattccatttaggatcatatcgccgggagaagagacaaaatatcaacgaagttcgttgagtacttccctgacgaaaccttatggggcaaaggaaaatcagaggccttttggcaccccaagagcctttgcgagatcatcgtggaatagaatagatctggtatcttctgtcagtttttggctaggtatgtttttatccataaaaagttatgatacaaaaacaggcataagaatattcaagccccttgctatattaaggattcttcgacttgtaaacgtggatactggtatgccctcaattctaaggggattgaaatatggtatcccacagttggtaaatgttagttcaatgctagtttacttttggattttctttgggattttgggagtacagatttttcagggctcttttcgaagacaatgtgtatggtttaaccctgaagatcctaccgatacttaccagtacgatatgcaattctgtggtggttacctagatccagtaacaaaacgaaaacaaaattatatctatgaagacggatcagaaggttctgtttcaaaaggctttctttgcccacaatattcgaaatgtgtttccaatgccaacccctacaacggcagaattagttttgataatattgttaattccatggagctcgtttttgtcattatgagtgcgaatacttttactgacttaatgtactatacgatggattcggatgaaatggctgcctgtttgttttttattgtttgcatctttgttttaactatctggctgctaaatctactcattgcagtgttggtatcatcttttgaaatagccaatgaggagtacaaaaagaaaaagttcatatatggttctagaaagacaggttatgttgctcgcatagtaacaggctactggaaatattttaagcttaaggcgaatcagacaaaattcccaaattggtcccaaaaaggactagctatttattcccacgttgagtttatctttgtcatacttattatttgcgatataggtatgcgcgcctctgttaaagtatcgacttcggcaaactgtaacaatatccttctaaaaactgacaggggaatttcgattgttctcttcatcgaatcactggcaaggttagtattatatctgcccaatatgtggaagtttttaacaaaacctagttacgtttacgattttattatatcaattattactctggttattagttgcctggctgttgaaggggttctaggacatatgtatgcctggctatccatattccacatatccagattttacagggtgattatttctttcaatttaacaaaaaaactatggaaacaaatattgagtaatggtgttatgatttggaacttatcgtctttttacttttttttcacctttttggttgctataatcatggctgtgtatttcgaaggcgtgattcctccagaagaaatggcagaccagccatttggaatgtattcactaccgaattcatttctttctttgtttataataggttcaactgaaaattggacggatatcctatatgccctccaaaaacactcaccaaacatctcctcaacttttttttgctcagtattttttattatatggtttctactatccaactcagtgatcttgaacattttcattgccctaatatcagaaagcatggaagtgaaagaagaagaaaaacgaccacagcaaattaagcattatcttaagttcgtctatcctcagaaaatacaagaatatacacacgctagtttggttgcgagaattcgtaaaaaattctttggaggtcataggaacgaagatacaagagattttaagcaatttcttatgagaggaaccgcgataatgaacatagcgcagaatatgggggagttggccgatgaattcaaagagccaccttcagaaaacctatttaaaaagggcttatcaaagctcacaattggggttccgtcactaaaaaggctgagaatgtttgctaataatccattttataaaaatagtgacgttgtgtttacagaaacgaacgatataaatgggaggacgtatatcttggagttgaatgagtacgaggatgagaagctagattatttaaaaaagtaccctttattcaattactcatattatttcttttctcctcagcatagatttcgaaggttctgtcaacgcttggtaccaccaagcactggaaaaaggactgatggatcacgatttttcgaggatagcactgatctatacaataaaaggagctattttcatcatattgaaagagatgtatttgtattcattttcgcacttgccaccattttactaattgtttgctcatgttatgttacgcctctatatcgtatgcatcacaagatgggaacttggaattggtcctcggcgttagattgcgccttcattggtgccttctcaattgaatttatcgtgaaaacagtagctgacggatttatatattctccaaatgcttacctgaggaatccatggaactttattgatttttgtgtcctaatctcaatgtggattaatttaattgcatacctaaaaaacaatggaaatttgtctaggattttcaagggattgacagccctgagggccctcagatgcctcacgatcagtaacacagctcgtcaaacatttaacctagttatgtttgatggtttaaataaaatttttgaagctgggttgatttcactcagtttgctatttccatttacagtttggggcttaagcatttttaaaggccgtttaggtacttgcaatgacggaagtttgggccgtgcagattgttacaatgaatattcaaattccgtttttcaatgggatatcatgtctccaagggtttaccagcaaccatatcttcatttggactctttcgcaagcgcttttagttcattataccaaatcatttctttggaaggatgggttgatttgttggaaaatatgatgaatagttcaggaataggtacacccgctacggtaatgggttcagcagggaatgctttattcctcgttctgtttaattttttaagtatggttttcatcctgaacttgtttgtttcattcattgttaacaaccaagcaaggacaacaggaagcgcttactttaccattgaggaaaaggcgtggctggaatcccagaaacttttatctcaggccaagccaaaagctatcccaaatttaattgagttatcaagagttaggcaatttttctatcaacttgcagtggagaaaaaaaatttctactacgcatcgtttcttcaggtagtactttatttgcacataatcatgctcctgagtcgaagctacaatccaggaaacttgataggttatcaaggtgtttattttatgttttccactagtgtttttttaattcaagaggcacttcacatgtgcggtgaaggaccaagattatattttaggcaaaaatggaacagcatacgactcagtatcataattatagcctttattatgaacgctgtagcattccacgttccagcctctcactattggttccacaatataaaggggtttttcctgttagtgatatttttgtttattattcctcaaaatgacacactaactgaactattagaaaccgcaatggcaagcttaccgcctattctatcattgacctacacttggggggttttatttttagtatatgctattgctttgaatcaaatcttcggcctaacaaggttagggagtaatacgaccgataacataaattttagaactgtaatcaaatccatgattgttctgtttagatgtagttttggtgagggctggaattatatcatggccgacctaactgtgtcagaaccttattgctcctctgatgataattcaacctatacggactgtggatcagagacatatgcctatttgttattaatgtcgtggaatattatttccatgtatatttttgtgaatatgtttgtttcgttgattattggtaatttcagttatgtttaccgtagcggtggatctcgctctggcatcaacagatcggagataaaaaaatacattgaagcttggtccaaatttgatactgatggaactggcgagcttgagctgtcctacctcccaagaataatgcattcatttgacggtcctctttcatttaaaatttgggaaggtagattgacaataaaaagtctagtcgagaactacatggaggttaacccagatgatccatatgacgtcaaaatagacctgatcggactgaacaaagagctgaatacgattgataaagcaaagatcatacagaggaagttacagtacagaagatttgtacaaagcattcactatacgaatgcttataatggatgtatcagattctcggatttgttattacaaatacctctctatacagcttattctgcaagggaatgtctaggtattgatcaatatgtccatcatctatatatcctgggtaaagtggacaagtacttagaaaatcaaagaaacttcgatgtattggagatggtggtaacaagatggaaatttcattgcaggatgaaacgtaccattgaacccgaatgggatgttaaagatcccacagtatcgtctcacatttcgaatataaacgtaaatctggaacctgctccaggaattttagaaagagaacctattgcgacacctagaatggactacggtgttaacaattttatgtggtctccgagaatgaatcaagactctacgatggagcccccggaagaaccaatagataataatgacgatagcgcaaatgatctaattgatagataa

SEQ ID NO: 45682 - DNA, 3255 bp, Saccharomyces cerevisiae
atggaaggaattttggatttttctaacgacttagatatcgctctattagatcaggtggtatctacattctatcaaggttcaggtgttcagcaaaagcaagcccaagagattttgactaaatttcaagataatccagacgcttggcaaaaagctgaccaaattcttcaattctcaactaaccctcaatcaaaatttattgccctttccatccttgataaattaattactagaaaatggaaattgttgccgaatgatcatagaattggaattaggaacttcgttgttggtatgattatctccatgtgccaagacgatgaagtatttaaaacacaaaagaacctgatcaataagtcggacttgactttggtccaaattttaaagcaggaatggcctcagaattggcctgaatttatcccagaactaatcggcagttcaagttcctctgttaatgtttgtgaaaataacatgatcgttttgaaactgctatccgaagaagtcttcgatttctctgcggaacaaatgacacaagctaaagctttacatttgaaaaattccatgtcaaaagaatttgaacagatttttaaattatgttttcaagttttggaacaaggttcttcaagctctctaatagtggcaaccttagaatctttactgagatatttacattggattccttatcgttatatttatgaaaccaatattttggaattattaagcaccaaattcatgacatcgcctgatacaagagccatcacattgaaatgtttgactgaggtttcaaatctaaaaattccacaagataatgatttgataaaaagacaaactgtactttttttccaaaatactctacaacaaattgccacaagtgtgatgcccgtgactgccgatctgaaagccacttatgcaaatgctaacggtaatgatcaatctttcttacaagatttagcaatgtttctaactacatatctcgctcgtaatagggcccttctagagagtgatgaatcgttaagagagttgttgttgaatgcgcaccaatacttaattcaattatccaaaatcgaagaaagagaactatttaagacgacattggattactggcataatttagtagcagatttgttttatgaggttcagcgtttgcctgctaccgaaatgagcccattgatacagttatcagtcggttcacaagctatctcaactggatctggcgccctaaatccggaatatatgaaaagatttccattaaaaaaacatatttacgaagaaatttgttcacagttgagattggtcattattgaaaatatggttagaccagaagaagtccttgtggttgaaaatgatgaaggagaaattgttagagagttcgttaaagaatcagacactatccaattatacaaatcagaaagagaggttcttgtatatttgacccatttgaatgttatcgatacagaagaaatcatgatcagtaaattggcaaggcaaatcgatggttccgaatggtcatggcataatatcaacactttatcttgggctattggttccatatctggtacaatgagcgaagatactgaaaaaaggtttgtagttactgttattaaagatttactagatttaacggtcaagaaaaggggtaaagataataaagctgttgttgcatcggatattatgtacgtcgtgggccaatatcctagatttttgaaggctcactggaattttctaagaacagttattttgaaactttttgaatttatgcatgaaactcatgagggtgttcaggatatggcatgtgacacattcattaagattgttcaaaaatgtaaatatcattttgttattcaacaaccccgtgagtctgagcctttcatccaaacaataattagggatattcaaaagacaactgctgacctacagccgcaacaggtccatacattttacaaggcttgtggtattattatttctgaagaaagaagcgtagcggagagaaatagattattaagtgatttgatgcaactgccaaatatggcttgggacactatagtggaacaatccactgctaacccaacattgttgttagattctgaaactgtcaaaattattgcgaatattataaaaaccaatgtagctgtctgcacctcaatgggagcagatttctatccacagttgggtcacatctattacaatatgcttcagctatacagagctgtttcttcgatgatttctgctcaagttgccgcagaaggtctaattgctacgaagacaccaaaggttcgtggtttgagaaccatcaaaaaagagattctgaagcttgttgagacctatatatccaaggcgagaaatttggatgatgtcgttaaagtgttagttgagccattattgaacgctgtacttgaagactatatgaacaacgttcctgatgcaagggacgccgaagtgctaaattgtatgacaacagtagtagaaaaggttggtcatatgatcccacaaggtgttattttaattttacagagtgtatttgaatgcactttggacatgattaacaaagacttcacagaatatccagagcatcgtgtagaattttacaagttattgaaggtcatcaatgagaaatcatttgctgcatttttggaactacctccggctgcctttaaattgtttgttgacgctatttgttgggcgttcaaacataacaatagagatgtcgaagttaatggtctacagattgcattagacctagtgaaaaacattgaaagaatgggaaatgtcccatttgcaaatgagttccacaagaattattttttcatttttgtcagtgaaacgttttttgttttaaccgattccgaccacaaatccggtttttctaagcaagctttgttactaatgaagttgatttctttggtttatgataacaagatttcggtaccattatatcaagaagctgaggtaccacaaggaacttcaaatcaagtctacttaagccaatatttggctaatatgttaagtaatgcattcccccatttaacatccgaacaaatcgcaagttttctctctgcattaactaaacaatacaaagacttagtggtcttcaaaggcactttgagggactttttggtgcaaatcaaagaagtcggaggtgatccaacagattatttgtttgctgaagataaagagaatgcattaatggaacagaatagactagagagggaaaaagctgccaagattggtgggttattaaaaccttccgaacttgatgattag

SEQ ID NO: 45683 - DNA, 1518 bp, Saccharomyces cerevisiae
atggatctattcaaaagaaaagttaaagaatgggtatactccctcagcactgacgaccattatgcagagtataaccccgatgaaacgcctacttttaacatgggtaaacgtttaaacagcaacaatggtcaggtaaatccctctcaaatgcatttgaatagtgtagatgaggaaatgagcatgggatttcaaaatggcgtgccatctaatgaagacataaatattgatgaatttacgtccacggagtcaaacgatggtgtctctgaaaccctcttagcttggagacacatcgatttttggaccagtgaacataatccagatttaaatgcaactttgagtgatccttgcacccaaaacgatatcactcacgcagaggaagacttggaagttagctttcccaacccagtaaaagcgtctttcaaaattcatgatggccaagaagatttagaatcgatgaccggtacttctggcttgttttatggcttccaactaatgacactagatcaggttgtagctatgactcaggcctggagaaacgtcgcaaagaacctaaacaaaagatctcaacaaggtttatcccatgttacatctactggctcttcttcatctatggaaagactaaatggtaacaagttcaaactgccaaatatcccagatcaaaaatctattcctccaaatgcagtgcaaccggtatatgcacatcctgcttggattcctttaataacggacaatgccggtaaccatatcggtgttgacttggcgcctggtccaaatggtaaatatgctcaaattataacatttgggagggacttcgatacgaaatttgtcattgctgaaaattggggtgaatttctgttatcgtttgccaacgatttggaagctggtaattggtatttagtagatgacaatgacgactactttagcggtgatggtgaattggtcttcagggataagaaatctaatggtcctatacaagattatttcgaagttttaaaaagaagaacgtggatcaagtatcaagaaaacttgagatcacaacagcaaaaatctcaacctgacacatccttgcaggagcagaaatacgtgcctgcctcgcaaaagaaagtggcagctgaacagccttctaccctcaacgcagaatccataaagggcgaagatagtggtagtgcagatgtacaatctgttcaagatcacgaatctgtcaaaattgtgaaaacagaacctagcgaagcggagactacaactgtaaatacagaaagccttggacaagcagagcatgaaatcaaagctgataatgtagacattaaacaagaaagcgagaggaaagaagacgaaaagcaaccaaaggttgaagaaaaagaacacgttgaaaacgaacatgtcacagaatcagcaaaaaaagacgatgatgtaaataagcaaacagaagaaatgaacaaaaaggaagaaaatgaaataagaagtgatgatgctaaagtggaagaagcgagagaagaatttgaaaatatagctttatga

SEQ ID NO: 45684 - DNA, 3537 bp, Saccharomyces cerevisiae
atgaaattcggcaagtatttggaagccaggcagttggaactggcggagtacaacagccattttattgattataaggctctaaagaaacttatcaaacaattggccattcccacgctaaaggctagttcagatttagatttgcatttaacattagatgacatcgacgaaaaaattatacatcagagactgcaagaaaataaagctgcctttttttttaaactagagagggagctggaaaaagtaaatggttattatttggcgagagagtccgatttaagaataaaattcaatatattacactcaaaatataaagattataagataaatggtaagctaaactcaaaccaagctacctcatttaaaaacttatatgcggctttcaaaaagtttcaaaaggatcttagaaatttggagcagtatgttgagttaaataaaacgggattttcaaaagctctgaagaaatgggacaagagatctcaatctcacgataaagatttttaccttgctactgttgtttccattcaaccaatttttaccagagatgggccactaaaattaaacgatgaaactttacatattctcttagagctgaatgatattgacaacaacaatagaagggcagacatacaatccagtacgtttactaatgacgatgatgacgacaataataccagcaacaataataaacacaataataataataacaataataataacaacaacaacaacaacaataataataacatattacacaataattatgaattaacaacatcaaagatttcggaaaaccaacttgaacatctttttcaagcatcttcctcctccttggacatggagatggaaatcgaaaactggtataaggaaattttgaatatagccacggtgaaagatgttcaaagaaagcatgcactactaagaaacttcagagaaaccaagatattcacatatctgctacaaaattcctcagaatcttttcataaaaatgtcttttctttgttgaaggagtgcttaacgacgctgtttttattactggtggctagtcctttggacgataactctctgcatattttctataaaagcaatcaggatcatattgatctgtcatattgtgacgaagatgatcaagtattttcacgaaaaaacgtatttcacgaggctgcaagttgtccagaaaaatcacgcttatttattctagatgaggctttaacaacatcaaagttatctaaagaaacagtacaaaaactactgaatgcccaagatatacattcgcgggtgccgctacattatgctgcagagctaggaaaactggaatttgttcactcgttgctaatcaccaatcttttagaggacgttgatcccattgatagtgattctaagacacccttggttttggctatcactaacaaccacatagatgttgttagggatctgctgactattggtggtgcgaacgcatcacccattgaaaagccaattctggattatagtaagaatgtaatcagctctactaaagtccagttcgatcctttaaatgttgcttgtaaatttaataatcatgacgccgccaagttacttttagaaattcggagtaagcaaaatgctgataatgccaagaacaaaagttcacaacacttgtgtcaaccgcttttcaaaaagaactcaacaggtttatgcactcttcatatagtggcaaaaattggcggcgatccacaattaattcaactattgatacgttatggggcggatcccaacgaaattgatgggtttaataaatggacgcccattttttacgctgttcgttcaggtcattctgaagttattactgaactattgaaacataatgcacgtctggatattgaagatgacaacggccattcgccacttttttacgccttatgggagagccacgttgatgttttgaatgcacttttacaaagaccattaaatttgccatctgcacccctgaatgaaataaattcgcagtctagtacgcaacgccttaatacaatagatttaaccccaaatgatgacaaatttgatttagacattcaagatagcattccggattttgctttaccaccgccaatcattccactaaggaaatatggtcataattttttggagaaaaaaattttcatcaaattaaagttgaggccaggtctcgagtctatcaagttgactcaggataacggcattattatgtcatcatcaccaggcagaattactttatcctcaaacttacctgaaataataccgcgaaatgttattttacctgttagatctggcgaaattaataacttttgtaaggatatcagtgaaacaaatgatgaagaagatgatgatgaaattagtgaagatcatgatgatggagagataattttccaagtagattcaatcgacgatttttcaatggatttcgagatatttccttcatttggcacaaggataattgccaaaacaacggcaatgccattccttttcaagaaggtggcaataaatagtattgcaaccatgaatttacccttattcgacacaagactaaataatattggatctctcactttggattaccaaattatttttccttatccgggaaatccactgaaaatcataaattatgagccgtattggaaatctacaggaagtgatttaatgacctctagtaaagacggtaattttgttacttcttcatcgttgaatggcagttttattagtgtattagtttgcgctctgaatgatgaaaccatagtggctgcgccaaaaccatacgttgaattcaaaggcacgaagattctgttaaatgatttaacgaaagaacaattggaaaaggtagtggattatgacttcggtaaaattgatggaagcttcgatgaagtaacattgaaacaatacttatcttcgagagtggtgcctctcagaagcctactagaagttattcccgggtcagcccagctggtaattcgtgtatattttcctacagataaggaaattgacacaattcccatcaaaatatcgccatttataaatatcaatcaattcattgataagcttttactaatcattttcgagcatgaacgttttttgcgtcacagcggaagtgggagtatgcgccaaatagttttcagttcatgcaattgggaagcttgctcgatccttaactggaaacaacccaattttccggttttgttgcaaatgaaaaatctactcagagattcaaccacaggcaaatttgtaggtgatactcctaattgtttaaaggaactggccgtaaatcctcaaaaaatgtcgtatttaaacacggaactaataaacatacatacaatggttcaatttgctatgaacaataatttgttaggtgtaacgcttccatatgaagtactgaagatatgcccgtcgttggctaggatcatcaaacaaaacggactactgttgattgcatcggtcggggaaaatgaccaaataccagctgatggaggttacagcgggatctactacgcttgtgagttgctttttgagaataatattgatatgtaa

SEQ ID NO: 45685 - DNA, 2964 bp, Saccharomyces cerevisiae
atgcaatctcaagattcatgctacggtgttgcattcagatctatcatcacaaatgatgaagctttattcaagaagaccattcacttttatcacactctaggatttgcaactgtgaaagatttcaacaaattcaaacatggtgaaaatagcttactatcttcagggacttcccaagattccttgagagaagtttggttagaatctttcaagttgagtgaggttgatgcttctgggttccgtataccacaacaagaagctactaacaaggctcaaagtcaaggtgctctattaaagattcgtttagtgatgtctgctccaatcgatgaaactttcgacaccaacgaaaccgccacaatcacttatttctctactgatttgaacaagattgtcgagaaattcccaaaacaagccgaaaaattgtccgataccttagtgtttttgaaagatccaatgggcaacaacatcaccttctcaggcttagctaatgcaaccgattccgctccaacttccaaagatgctttcttagaagctacctccgaagacgaaatcatctctagagcttcttccgatgcttctgacttactaagacaaacattgggctcttctcaaaagaagaagaagattgctgtcatgacttctggtggtgattctccaggtatgaatgccgctgttcgtgccgttgttcgtacaggtatacatttcggctgtgatgtttttgctgtttacgaaggttacgaaggtttactaagaggcggtaaatatttaaagaaaatggcttgggaagatgtcagaggttggttaagtgaaggtggtactttgattggtactgctcgttctatggaattcagaaagcgtgagggtcgtagacaagctgcaggcaatttaatttcgcaaggtattgacgctttggttgtttgtggtggtgatggttctttaaccggtgctgatcttttcagacacgaatggccatctttggttgatgaattggttgcagaaggtagattcactaaagaagaagtcgccccatacaagaatttgtccattgttggtcttgtcggttccatcgataatgatatgtctggtactgactctaccattggtgcttattctgctttggaaagaatctgtgaaatggttgactacattgatgccaccgctaaatcccactcccgtgcctttgttgttgaagttatgggtagacattgtggttggttggccttgatggctggtattgctaccggtgccgattacatttttattccagaaagagctgttcctcacggaaaatggcaggacgaattgaaggaagtgtgccaaagacacagaagtaagggtagaagaaataacacaattattgtcgctgaaggtgctttagatgatcaattaaaccctgttactgccaatgacgtcaaagatgctttgattgaattgggtctagacaccaaggtaaccattctaggtcacgttcaaagaggtggtacagctgttgctcatgacagatggttagctactctacaaggtgtcgatgctgttaaggccgttctggaatttacccctgaaactccttctccattaattggtattttagaaaacaagataattagaatgccattggttgaatctgtgaagttgactaaatctgttgccactgccattgaaaacaaagatttcgataaggcaatttctttaagagacacagaatttattgaactttacgaaaacttcttatccactaccgttaaagatgatggttccgaattattgccagtatctgacagactaaacattggtattgtccatgttggtgccccatctgctgctttgaacgctgccacccgtgccgcaactctatactgtttgtctcacggccataaaccatacgctatcatgaatggtttcagtggattgattcaaaccggtgaagtgaaggaactatcatggattgatgtcgaaaactggcataacttgggtggttccgaaatcggtacgaacagatctgttgcttcagaagatttgggtaccattgcttactacttccaaaagaacaagctagacggtttgattattcttggtggttttgaaggtttcaggtccttgaagcaattgcgtgacggtagaacccaacacccaatctttaacattccaatgtgtttgattccagccactgtttctaacaacgttccaggtactgaatactcacttggtgttgatacctgtttgaacgcattagtcaattacactgatgacatcaaacagagtgcttctgcgacaagaagaagagtcttcgtctgtgaagtccaaggtggtcactctggttacatcgcttctttcactggtttaatcactggtgctgtttcagtgtacactccagaaaagaagatcgacttagcttctatcagagaagatataactctattaaaagagaactttcgtcacgacaaaggtgaaaacagaaacggtaagctattggttagaaacgaacaagcttctagcgtatatagcactcaattgttggctgacatcatctctgaagcaagcaagggtaagtttggtgttagaactgctatcccaggccatgttcaacaaggtggtgttccatcttctaaagaccgtgtcaccgcttccagatttgctgtcaaatgtatcaagtttatcgaacaatggaacaagaaaaatgaagcttctccaaacactgacgctaaggttttgagattcaagttcgatactcacggtgaaaaggtaccaactgttgagcacgaagatgactctgctgctgttatctgtgttaatggttctcacgtttccttcaagccaattgctaacctttgggaaaacgaaaccaacgttgaattaagaaagggttttgaagttcactgggctgaatacaacaagattggtgacatcctgtccggtagattaaagttgagagctgaggtagccgctttagccgctgaaaacaaatga

SEQ ID NO: 45686 - DNA, 1284 bp, Saccharomyces cerevisiae
atgtactcaagaaaatccttatccctaatttcaaagtgtgggcaattaagcaggctaaacgcgcaagctgctttacaagcaaggagacacttgtcaattcatgaatacaggtcagctcagttattgagggaatacggtattggtactccagaaggatttccagcgttcactcccgaagaggctttcgaagcagccaagaaattaaacactaacaaactggtcatcaaggcgcaggcattgaccggaggtagaggtaaaggtcacttcgacaccggttacaaaagcggtgttcacatgatcgaaagtcctcagcaggcagaggatgttgcaaaagaaatgctcaatcataacctgattactaaacagacgggaatagcggggaagccagtatctgctgtatatatagtgaaaagagtagatacaaagcatgaagcttatttatctattctaatggacagacaaaccaagaaaccgatgatcattgcgtccagtcaaggtggtatgaatattgaagaggtggctgagagaaccccagatgctataaagaaattttcaattgaaacttcaaagggattgagcccacaaatggccaaggatgttgccaagagtctcggtttcagtcccgatgcacaagacgaggcagcaaaagctgtttccaatttgtataaaatattcatggaaagggatgctacacaagtggagattaaccctttgagtgaaattgaacatgatccaacccacaaaatcatgtgtacagacgccaaatttgggtttgatgataacgcatcattcagacaggaaaagatatattcctggagggacttatcacaagaagatcctgatgaagttaaggcaaagaagtatgatttgaattttgttaagttgaagggtaacattggatgtttagtcaatggtgctggtttggctatggctactatggatgtcatcaaattaaatggaggcgatcctgcgaactttttggattgtggtggtggtgccacccctgagaccatcaaacaaggtttcgaattgatcttatccaataagaacgtagatgcaattttcgtcaatattttcggcggtatcgtaagatgtgactatgttgccctggggctggtagaagccgccagagaactagaagttagggtccccattgtggcacgtttgcaaggtaccaaagtagaagaaggccgcgacattatcaataagtcaggcgtgaagatttattcgtttgatgaattagatcctgctgctaaaaaggtcgttgaattgacccaaaattaa

SEQ ID NO: 45687 - DNA, 783 bp, Saccharomyces cerevisiae
atgttcttaactagaagtgaatatgatcgtggtgtaagcacattttccccagaagggaggttattccaagttgagtattctttggaggccatcaaattaggatctacagcaattggtattgccacgaaagaaggtgttgtactaggtgtggagaaacgtgccacctcaccactattagaatctgattctattgagaaaatcgtggagattgatcgtcatattggttgtgcaatgagtgggcttacagcagatgctcgttccatgattgaacatgcgcgtactgctgcagtaacgcataatctatactacgatgaagacatcaatgttgagtccttaacgcaatcggtgtgtgatcttgctctaaggttcggtgaaggtgcctctggtgaagaaagactaatgtctcgaccattcggggttgccttgttaattgctggccatgatgcggatgatggttatcaacttttccatgcagaaccatctgggacattttaccgttataatgccaaagccattggttcaggctctgaaggagcacaagcagaattattgaatgaatggcattcttctttaactttgaaagaagctgagcttcttgttctaaaaatcctaaagcaagtgatggaagagaaacttgatgaaaataacgcgcaattgagttgtataacaaagcaagacggattcaaaatatatgataacgaaaaaactgctgaattgataaaagagttgaaagagaaagaagctgcagaaagtccagaagaagcggatgttgaaatgtcataa

SEQ ID NO: 45688 - DNA, 1314 bp, Saccharomyces cerevisiae
atggctgtctctaaagtttacgctagatccgtctacgactcccgtggtaacccaaccgtcgaagtcgaattaaccaccgaaaagggtgttttcagatccattgtcccatctggtgcttctaccggtgtccacgaagctttggaaatgagagatggtgacaaatccaagtggatgggtaagggtgttttgcacgctgttaagaacgtcaacgatgtcattgctccagctttcgttaaggctaacattgatgttaaggaccaaaaggccgtcgatgacttcttgatttctttggacggtactgccaacaaatccaagttgggtgctaacgctatcttgggtgtttctttggctgcttccagagctgccgctgctgaaaagaatgtcccattatacaagcacttggctgacttgtctaagtccaagacctctccatacgttttgccagttccattcttgaacgttttgaacggtggttcccacgctggtggtgctttggctttgcaagaatttatgattgctccaactggtgctaagaccttcgctgaagctttgagaattggttccgaagtttaccacaacttgaagtctttgaccaagaagagatacggtgcttctgccggtaacgtcggtgacgaaggtggtgttgctccaaacattcaaactgctgaagaagctttggacttgattgttgacgctatcaaggctgctggtcacgacggtaagatcaagatcggtttggactgtgcttcctctgaattcttcaaggacggtaagtacgacttggacttcaagaatccaaactctgacaaatccaagtggttgactggtcctcaattggctgacttgtaccactccttgatgaagagatacccaattgtctccatcgaagatccatttgctgaagatgactgggaagcttggtctcacttcttcaagaccgctggtattcaaattgttgctgatgacttgactgtcaccaacccaaagagaattgctaccgctatcgaaaagaaggctgccgacgctttgttgttgaaggtcaaccaaatcggtaccttgtctgaatccatcaaggctgctcaagactctttcgctgccggttggggtgttatggtttcccacagatctggtgaaactgaagacactttcattgctgacttggtcgtcggtttgagaactggtcaaatcaagactggtgctccagctagatccgaaagattggctaaattgaaccaattgttgagaatcgaagaagaattaggtgacaacgctgttttcgctggtgaaaacttccaccacggtgacaaattataa

SEQ ID NO: 45689 - DNA, 1479 bp, Saccharomyces cerevisiae
atgtcaaaggcagtaggtgatttaggcttagttggtttagccgtgatgggtcaaaatttgatcttaaacgcagcggatcacggatttaccgtggttgcttataataggacgcaatcaaaggtagataggtttctagctaatgaggcaaaaggaaaatcaataattggtgcaacttcaattgaggacttggttgcgaaactaaagaaacctagaaagattatgcttttaatcaaagccggtgctccggtcgacactttaataaaggaacttgtaccacatcttgataaaggcgacattattatcgacggtggtaactcacatttcccggacactaacagacgctacgaagagctaacaaagcaaggaattctttttgtgggctctggtgtctcaggcggtgaagatggtgcacgttttggtccatctttaatgcctggtgggtcagcagaagcatggccgcacatcaagaacatctttcaatctattgccgccaaatcaaacggtgagccatgctgcgaatgggtggggcctgccggttctggtcactatgtgaagatggtacacaacggtatcgagtacggtgatatgcagttgatttgcgaggcttacgatatcatgaaacgaattggccggtttacggataaagagatcagtgaagtatttgacaagtggaacactggagttttggattctttcttgattgaaatcacgagggacattttaaaattcgatgacgtcgacggtaagccattggtggaaaaaattatggatactgccggtcaaaagggtactggtaaatggactgcaatcaacgccttggatttaggaatgccagtcactttaattggggaggctgttttcgctcgttgtttgtcagccataaaggacgaacgtaaaagagcttcgaaacttctggcaggaccaacagtaccaaaggatgcaatacatgatagagaacaatttgtgtatgatttggaacaagcattatacgcttcaaagattatttcatatgctcaaggtttcatgctgatccgcgaagctgccagatcatacggctggaaattaaacaacccagctattgctctaatgtggagaggtggctgtataatcagatctgtgttcttagctgagattacgaaggcttatagggacgatccagatttggaaaatttattattcaacgagttcttcgcttctgcagttactaaggcccaatccggttggagaagaactattgcccttgctgctacttacggtattccaactccagctttctctactgctttagcgttttacgacggctatagatctgagaggctaccagcaaacttgttacaagcgcaacgtgattattttggcgctcatacatttagaattttacctgaatgtgcttctgcccatttgccagtagacaaggatattcatatcaattggactgggcacggaggtaatatatcttcctcaacctaccaagcttaa

SEQ ID NO: 45690 - DNA, 1101 bp, Saccharomyces cerevisiae
atgagtgatcgcaatacaagtaacagcctgaccttaaaagaacgaatgttaagtgccggtgctggatcagtactcacttctttgattttgacaccgatggatgtagtgagaatacggctgcaacagcagcagatgattcctgactgttcatgtgatggggctgccgaagtgcccaacgccgttagctcaggctccaaaatgaagacattcaccaacgtcggaggacagaacttgaacaacgcaaaaatattttgggagagtgcttgttttcaagaactgcactgtaaaaattcatcgttgaagttcaacggtactttagaagcattcacgaaaattgccagcgtcgaaggtattacaagtttgtggaggggtatttctttgaccctattaatggctattcctgccaacatggtttattttagtggttatgaatatataagagacgtttctcctatagcctcgacgtacccaacattaaaccccctcttttgtggtgcaattgcgagggtatttgcagcaacaagtattgcacctttagaattggttaaaactaaactgcaaagtataccgagatcatcaaagtccacaaagacatggatgatggttaaagatttattaaacgaaacgaggcaggaaatgaaaatggtgggtccttctcgggccctcttcaaaggtttggagatcactctgtggagagacgttccgtttagtgcaatatattggagttcctatgaactttgcaaggaaagactatggctagattctactcgatttgcatctaaggacgcaaactgggtccattttataaacagttttgccagtggttgcataagtgggatgatagctgctatatgcacacacccttttgatgtcggtaagacgagatggcaaatatccatgatgaacaatagcgatccgaaaggcggcaataggtctagaaacatgttcaagttcttagagactatatggcgtacagaaggtcttgcggccctctacacgggcctggcagccagagtaattaagatacgcccaagttgcgccatcatgatatctagttatgagatctccaaaaaagtatttggaaacaaattgcatcagtga

SEQ ID NO: 45691 - DNA, 3096 bp, Saccharomyces cerevisiae
atgggtgtgcattcattttgggatattgcaggtcctacggcaagaccggtcaggctggaatccttggaagataagagaatggcagtagatgcctccatttggatatatcagtttttgaaagctgtccgtgatcaggaggggaatgcagtgaagaattctcatattactgggttctttagaagaatttgtaagctattatactttggcattaggccggtattcgtctttgatggtggtgtgcccgtattgaaaagggaaacaatacggcagaggaaagaaagaagacagggaaaacgagagagtgcgaaatccaccgctaggaagctgctggctttacaattgcaaaacggctcaaacgataacgtaaaaaactctacaccgagtagtggcagtagtgtgcagatcttcaaacctcaggacgagtgggacttgcccgatataccgggattcaaatacgataaggaagatgcaagagttaactctaataaaacttttgaaaaactgatgaattcgataaacggtgatggactggaagacattgatttagacactataaatccagcatcggccgaatttgaagagctgccaaaggccacacagtatttgatattatcgtcgttgaggttgaaatcaagactgaggatgggatactcgaaagaacaattggagaccatcttcccaaatagtatggatttctcaagatttcaaatagacatggtgaaaaggaggaatttttttactcaaaagttaatcaacactactgggtttcaggatggtggagcgtctaagctgaacgaggaggtgatcaataggatatccggccaaaagagtaaagagtacaagttgactaagactaataacgggtggattcttggactaggggcaaacgatggctctgatgcgcaaaaagcaatcgtaatagacgataaagatgcaggcgctttggtaaagcagttagatagtaatgctgaggacggggacgtgctccgatgggatgatttggaagataattccttaaaaatagtgcgacatgagtcttctaacgcgacgacagctccacagaaaaggagtaaccggtcagaagatgagggatgtgactctgatgaatgtgagtgggaagaagttgaactcaagcccaagaacgtcaagtttgtggaagatttttctttgaaagctgcaaggttgccttacatgggccaatccctaaacaacgctggcagtaaatcgtttttggacaaaagacatgatcaggcatcgccctccaagactactccaacaatgagaattagcagaatcagcgtggaagacgacgatgaggattacctgaaacaaattgaggaaattgaaatgatggaggcagtgcaactttctaagatggaaaagaaacctgaagcggacgacaaatcaaaaatcgctaagccggtaacgtcaaaaggtacagaggctcgtccaccaatagtacagtatggattacttggcgcacaaccggatagtaagcaaccgtatcatgtcacaaatttgaatagcaaatcagagtcggtcatcaaaaggaccagcaagacagttctttctgagtttaggccaccgtctcagcaggaggataaaggggctattttaacagagggggagcaaaacctgaattttatttctcacaagataccacagtttgattttaacaatgaaaattccctgctttttcaaaagaataccgagagtaatgtgtcccaagaagccacgaaggaaaagtctccaattcctgaaatgccgagctggttttcttcaactgcttcccagcagttgtataatccctataacacaacaaatttcgtggaagataaaaacgtaagaaatgaacaagaaagtggagcagaaactaccaataaagggagtagctatgaactcttgacaggcttaaatgctacggaaatattagaaagagaaagcgagaaagagagctccaatgatgaaaacaaggacgatgacttagaagttttatcagaagaactatttgaggacgttcccactaaatctcagatttcaaaagaagcagaggataacgatagtagaaaagtcgaatctataaataaggagcatagaaagcctcttatattcgactatgacttctccgaagatgaagaagataacatagtagaaaatatgataaaggaacaagaagagtttgatacatttaaaaacacgactttgtccacttctgctgaaagaaacgttgccgagaacgcttttgtggaggatgaattattcgaacaacagatgaaggataaaagagattcggatgaggtaactatggatatgatcaaagaagtgcaagaattactatcgaggtttggaatcccctatatcactgcgcctatggaagctgaagcacagtgtgcggaattgttacaactaaaccttgtcgatggtataattaccgatgacagtgatgttttcctatttggaggtacaaagatctacaaaaatatgttccacgaaaagaactatgttgaattttatgatgcggaatctattttaaaattattgggcttggatagaaagaatatgattgagttggcacagcttttagggagcgattacacgaatggattgaagggtatgggtcccgtttcaagcattgaagtgattgcagaatttggaaacctaaaaaattttaaagactggtataataatgggcagtttgataaacgtaagcaagaaacggaaaataaatttgaaaaagacctgagaaaaaaactggtaaataacgaaattatcttagatgatgattttcctagcgtcatggtttatgatgcgtatatgagaccagaagtcgatcacgataccacgccgtttgtttggggggtaccagatctcgatatgcttcgttcattcatgaagactcaactaggttggccacacgaaaagtctgatgaaattctcattcccttaattagagatgttaataaacgcaaaaagaaggggaagcaaaaaaggattaatgaattttttccaagggagtacatatctggtgataagaagctcaatacaagtaagagaatttcaaccgcaacaggtaaactaaagaaaagaaagatgtaa

SEQ ID NO: 45692 - DNA, 1605 bp, Saccharomyces cerevisiae
atgagcaacaaatttacaatggagtcacctaagcatttggtggatgatgtgcttttcatatcacccaccaatgatggatcagaagaaaagcctacggaagtcacgttccaggaagatgaaggccatgacgctagcttgcataatcgcagccatgacaagaagtcggaacttgccaccgaacgggaaattatggctactaccacggatgatgacggcatcccctccccttcccatccaatggaaaagcgtgtcttgcgcaaaatggatatatacttgattcctcttatggggatgctatatttcctttctaacctggataaatcgaatattggtaacgcagaagttgcaggtctatccaaggatatccaccttgtaggaacgcaatataacacatgtgtcacagtttttttcgcgacgtatgttcttttcgaccccataggtactaaccttctgaaaattatgggtccgccattaatgatgagtatctgtttgacctgtttcggtgctatttcgctcggaactgcttgggttaagaattatgctcaattgatcgttgtcagactactactgggtgcctttgaaggtatgatttatcccgctattaacatgtacctttcagtctgctatagaagagaacaatatgctctgaggttcgcttttgtcttcagtgcagcctgtttgtcttcatcttttggtgggctgattgcttatggttgttccaaaatcagcggttctctaaaggactggcaatacatttacattgtcgaaggttgtatctctttggggttcgtaccattctatgccttcgggttgagcaaaaatttggaggattcgtggtttttcaataaggaggaaaaagagtacatttccgaaagatacaagactatgaacacttttgacccggacgaaaaatttgaatggttccaagtgtggcaagcagttaaggatgtcaagacttgggctagtgctgtggcattattcggtatcgatttgactacttttggtctaacagtcttcttgccgatcatcattaccagtatggggttcactaatgtcagagctcaattaatgaccgtgcccatctatttccttacagcaattgtgttcttcatttgtgccgtttggtctgatcgtataaagttgagatctccattcatcctgggtgcttgtctgacgacttcgataggcatagctatcgtccttggttctcaagttcatggtgtgagatattttggcgtttacattctttgtatgggtatttacgttaatgctgcctgtaactgtttatggttaagtggtaacactggtaattacttcaagagagccaccgctttaggaattaatctatttttcgggtctggttcagggttggtctctggtcaaatttttgttgccaaagacaagccaagatatatcaaagggctgtcgattagtctggcctttcaagtcttctccatatttatgacggttgtgcaaattttcctatacaagagggaaaacgataaaaagaaagcaataatagatcgctgtaatgaattgggagagcctattccatacgacgaaaggttaagcgacaaaaaccctgagtttaagtacatgtattag

SEQ ID NO: 45693 - DNA, 732 bp, Saccharomyces cerevisiae
atgcataacatccaattagtgcaagagatagaaagacatgaaaccccgttaaacattagacctacctctccatacactttaaaccctcctgtcgagagagatgggttttcttggccaagtgtgggtacaagacaacgtgcagaggaaactgaagaggaggaaaaggaacgaattcaacgcatttcaggcgctatcaagacaattttgaccgaactgggtgaagatgtcaacagagaaggtctactagatactccacaaagatacgctaaagccatgctttatttcactaaaggttaccaaacgaacattatggacgatgtcattaagaatgctgtctttgaagaagatcatgatgaaatggttattgttcgtgatattgaaatttactcgttatgtgaacatcatttggtgccatttttcggcaaggttcatatcgggtatataccaaataaaaaagtcatcgggttaagtaagttggccagattggcagaaatgtatgcgagaaggctccaagttcaagaaagacttacaaagcaaattgcaatggccctaagtgatattctaaaaccattaggtgtagccgttgttatggaagcttctcatatgtgcatggtttcaagaggcattcaaaaaacgggatcttctacggtaacttcttgtatgcttggagggtttagggctcataaaacaagagaagagtttttaactcttttaggaagaagaagtatttga

SEQ ID NO: 45694 - DNA, 3201 bp, Saccharomyces cerevisiae
atggtaaagcagcagggatccggcaagaccaacttggccaacgaagatgaagcatatgaagctatttttggcggagagtttggctctttagaaatcgggtcatacattggcggggatgaaggtgccaattcaaaggactatacggagcatttgccggatgctgtagattttgaagatgaagatgaacttgctgatgacgatgacgatttgccagaagaatctgatgctaatttgcatccagctatgatgactatgggcgcgtatgatgatgtaaacgagaacggtgccgtactcggtatcgactcaaatagtttgaatatgcaactgcctgaaattaatggtgatttgtctcaacagtttattttggaggatgatgggggtactcccgcaactagcaatgctttgtttatgggaatggatgcaaatgaaattcatctcgccactgaaactggagttcttgatggtagtggcgcaaatgaaattgggcattctcaactttccattggtggcgttaatggaaatgatatgtcgataaatggcggatttatcatggaaccagatatgtcagatggcaagcataagaaagccaccaaattagacttgataaaccatgagaagtatcttctaaaaaaatactttcctgattttgaaaagggtaaaattttaaaatggaacaagctgatttatagaagatctgttccttatcattggcacagtgaaatatctagggtaaagaaaccgtttatgcctttaaatttgaaattcaaggttcaacaggatgataagaggttatttaactcaaggacaatatcttacgtcgctccgatttatcaagggaaaaacaatttacttcaaagtaactcttctgcatcccgaagaggtttaattcatgtttccattgatgaacttttccctattaaagagcaacaaaaaaaaagaaagattattcatgatgaaaagaccatatcggaagacttgcttattgccactgatgattgggaccaagaaaaaatcatcaatcaaggtacttcatcaacagcaaccttggcggattcgtctatgacacccaacttaaagttctccggcggttataaattgaagagcttgattgaggatgttgctgaagattggcagtgggatgaagacatgatcattgatgcaaaattgaaagagtctaaacatgctgaattaaatatgaatgacgaaaaactgttgctgatgattgagaaaacgaataatttagcgcagcaaaagcaacaactggatagtagtaacttgatattgcccctcaacgaaactattttgcaacaaaaattcaatttatctaatgatgataaatatcaaatcttgaaaaaaacccatcaaacaaaagttcgttctaccatctcgaacttaaatattcagcattctcaacctgcgattaatttacaatctccattttacaaagtggctgttcctagataccagttgaggcatttccaccgtgaaaactttggttcgcacatcagaccaggtactaaaattgtcttcagtaagttaaaagcgcgtaaaaggaaaagagataaaggtaaagatgtcaaagaatcattttctacatctcaagatctaaccatcggggatactgctcctgtttatttaatggaatattctgaacaaacaccggtagctttgtctaaatttggtatggccaataaattaattaattattatcggaaagccaatgaacaagatactctaaggcccaaattgcctgttggcgaaactcacgttttgggagttcaagacaaatcaccattttggaactttggatttgttgaacctggtcatatcgtccccacattatacaataacatgattagagcacccgttttcaaacatgatatatcaggaacagattttcttctgacaaaaagttccggatttggtataagcaatcgattttacttacgtaatattaaccatctttttacggttggacaaacttttcctgtcgaggagattcccggacctaattcaagaaaggtgacatcaatgaaagctacaagactgaaaatgattatttatagaattctaaaccataatcacagcaaggcaatttctattgatcccattgcaaagcactttcccgaccaagattatggacaaaacagacaaaaagtgaaggagttcatgaaatatcaaagagatggtcctgaaaaaggtctgtggaggcttaaagatgatgaaaaattgttagacaatgaagcagtgaaaagtttaattacgccagagcagatcagccaagttgaatcaatgagtcagggcttacaattccaagaagataatgaagcatataattttgattctaagctaaaatctctagaagaaaacttgttaccatggaacattacaaaaaattttattaattcaacacaaatgcgagctatgatacaaatacatggtgttggtgacccaacgggctgtggtgaaggtttttctttcttgaaaacttcaatgaaaggtggttttgttaagtctggttctccttccagtaataacaatagttcaaacaaaaaaggcactaacacgcatagctacaatgtggctcaacagcaaaaagcttacgacgaagaaattgcgaagacctggtatacacatacaaaatcgttgagcataagcaatccttttgaggaaatgaccaatcctgatgagattaatcagaccaacaagcatgttaagacggatagagatgataagaaaattctgaagattgttagaaagaaaagagatgaaaatggtataattcaaaggcagacaattttcataagagatcctagggtcattcaaggatatataaaaatcaaagaacaggataaagaagatgttaacaaattgttagaggaggacacttcaaagataaataacttggaagaacttgagaaacagaaaaaactgttgcaactagaattagctaatttggaaaaatcacagcaacgtagagcagcaaggcaaaattcgaagagaaatggtggtgccacgagaacagaaaactctgtggataatggtagcgaccttgccggtgtaactgacgggaaagcagccaggaataaaggtaagaacactacaaggagatgtgctacatgcggacaaatcgggcacattagaacaaataaatcttgtccaatgtatagcagtaaagataaccctgcttcaccaaagtag

SEQ ID NO: 45695 - DNA, 1662 bp, Saccharomyces cerevisiae
atgcaagtagaagggcctgacactaacttcgtgagtgatttggctttgggatcaaagaaaagaaggttatccaagacttctgtacaagaggatgatcatacaaatgtggtatcggaagtgaataagaataagaagaaaaaaaaggcaaagcctatgacatgcacattgctaaagtctgtggttgaaaaaggtattggtataaaggatgtaagagacatgactcaatacttgttgcaggctgaaaacaactctcccaaatggattgatatttgtaacaggtcaagtttacagaaaatgatagttctgttcattccaggtttacaaccagatgattttgagaacggaaaaaatacctttaatgaaatcagtgatgataacttcaaatatattcctggagaaattgcctccacgtttcatacatttcccgtgatggcacctggttccaagatgacgctcttttcgccctacaattcatttattaatgttggattgtccaaaatggagaaaataaataaattgaaagagttacaaaagaagaagaaaattactattaacgatttggttctatccgaacaacagttagtggcaaacgattacccactggattctggagacaccaattttgatacagactgggtacaaactgttgactttacccatggtggctcccacatctttgcactagactgtgaaatgtgtctttccgaacaaggtttagttctaactaggatttctctagtgaattttgacaatgaagttatctatgaagagttggtgaaacctgatgtccccatagtggactatttgacacgttacagtggtataactgaagagaaactaactgttggtgccaagaaaacattgcgagaagtacaaaaagatttactaaagataataagtcgttcagatattttgataggacattcgctacagaatgatttgaaagtcatgaaattgaaacatccattggtcgtggatacagctattatataccatcataaagctggcgatcctttcaagccaagtttaaaatacttgagcgaaacctttctgaataaaagcattcaaaacggagaacacgattctgtcgaagatgcaagggcttgtcttgaattgacgaaattaaaaatcttaaatgggttagcatttgggataggtatcaatacggagaacttgttcaccaaattacatcgttttgaagtgaaaaccgttcttctcaacgatatgattattaaaaatcatactgaggacgattctaagggccagttaatccgttgcgtcgaagatgatgagacatggacccatattcacgagaatctaaataaagatgtcaaacttattgtggggagaatcaagaacttagagaggtcacgcaactataataaaaagccacggaaggaaactccttcgttcgatgcgtccatggttcttcatgatatagggcaacatctaacacaattatacgagaatgctacaccaggtactatgattttgatcatgtcgggtacaggcgacacaagaccatggaacaatctttcaactgagttagagtttattcaagacaaaaaggaaagattagataaaagacgcgaaagggaacctgaaatagtagaagccataaagttagcccggggtggtgtagcatcctttactgtaaaataa

SEQ ID NO: 45696 - DNA, 4434 bp, Saccharomyces cerevisiae
atgacgattaccgtgggggatgcagtttcggagacggagctggaaaacaaaagtcaaaacgtggtactatctcccaaggcatctgcttcttcagacataagcacagatgttgataaggacacatcgtcttcttgggatgacaaatctttgctgcctacaggtgaatatattgtggacagaaataagccccaaacctacttgaatagcgatgatatcgaaaaagtgacagaatctgatattttccctcagaaacgtctgttttcattcttgcactctaagaaaattccagaagtaccacaaaccgatgacgagaggaagatatatcctctgttccatacaaatattatctctaacatgtttttttggtgggttctacccatcctgcgagttggttataagagaacgatacagccgaacgatctcttcaaaatggatccgaggatgtctatagagaccctttatgacgactttgaaaaaaacatgatttactattttgagaagacgaggaaaaaataccgtaaaagacatccagaagcgacagaagaagaggttatggaaaatgccaaactacctaaacatacagttctgagagctttattattcacttttaagaaacagtacttcatgtcgatagtgtttgcaattctcgctaattgtacatccggttttaaccccatgattaccaagaggctaattgagtttgtcgaagaaaaggctatttttcatagcatgcatgttaacaaaggtattggttacgctattggtgcatgtttgatgatgttcgttaacgggttgacgttcaaccatttctttcatacatcccaactgactggtgtgcaagctaagtctattcttactaaagctgccatgaagaaaatgtttaatgcatctaattatgcgagacattgttttcctaacggtaaagtgacttcttttgtaacaacagatctcgctagaattgaatttgccttatcttttcagccgtttttggctgggttccctgcaattttggctatttgcattgttttattgatcgttaaccttggacccattgccttagttgggattggtatttttttcggtgggtttttcatatccttatttgcatttaagttaattctgggctttagaattgctgcgaacatcttcactgatgctagagttaccatgatgagagaagtgctgaataatataaaaatgattaaatattatacgtgggaggatgcgtatgaaaaaaatattcaagatattaggaccaaagagatttctaaagttagaaaaatgcaactatcaagaaatttcttgattgctatggccatgtctttgcctagtattgcttcattggtcactttccttgcaatgtacaaagttaataaaggaggcaggcaacctggtaatatttttgcctctttatctttatttcaggtcttgagtttgcaaatgtttttcttacctattgctattggtactggaattgacatgatcattggattgggccgtttgcaaagcttattggaggctccagaagatgatccaaatcagatgattgaaatgaagccttctcctggctttgatccaaaattggctttaaaaatgacacattgctcatttgagtgggaagattatgaattaaacgacgctattgaagaagcaaaaggagaagctaaagatgaaggtaaaaagaacaaaaaaaagcgtaaggatacatggggtaagccatctgcaagtactaataaggcgaaaagattggacaatatgttgaaagacagagacggcccggaagatttagaaaaaacttcgtttaggggtttcaaggacttgaacttcgatattaaaaagggcgaatttattatgattacgggacctattggtactggtaaatcttcattattgaatgcgatggcaggatcaatgagaaaaactgatggtaaggttgaagtcaacggggacttattaatgtgtggttatccatggattcaaaatgcatctgtaagagataacatcatattcggttcaccattcaataaagaaaagtatgatgaagtagttcgtgtttgctctttgaaagctgatctggatattttaccggcaggcgatatgaccgaaattggggaacgtggtattactttatctggtggtcaaaaggcacgtatcaatttagccaggtctgtttataagaagaaggatatttatctattcgacgatgtcctaagtgctgtcgattctcgtgttggtaaacacatcatggatgaatgtctaaccggaatgcttgctaataaaaccagaattttagcaacgcatcaattgtcactgattgagagagcttctagagtcatcgttttaggtactgatggccaagtcgatattggtactgttgatgagctaaaagctcgtaatcaaactttgataaatcttttacaattctcttctcaaaattcggagaaagaggatgaagaacaggaagcggttgttgccggtgaattgggacaactaaaatatgaatcagaggtaaaggaattgactgaactgaagaaaaaggctacagaaatgtcacaaactgcaaatagtggtaaaattgtagcggatggtcatactagtagtaaagaagaaagagcagtcaatagtatcagtctgaaaatataccgtgaatacattaaagctgcagtaggtaagtggggttttatcgcactaccgttgtatgcaattttagtcgttggaaccacattctgctcacttttttcttccgtttggttatcttactggactgagaataaattcaaaaacagaccacccagtttttatatgggtctttactccttctttgtgtttgctgctttcatattcatgaatggccagttcaccatactttgcgcaatgggtattatggcatcgaaatggttaaatttgagggctgtgaaaagaattttacacactccaatgtcatacatagataccacacctttgggacgtattctgaacagattcacaaaagatacagatagcttagataatgagttaaccgaaagtttacggttgatgacatctcaatttgctaatattgtaggtgtttgcgtcatgtgtattgtttacttgccgtggtttgctatcgcaattccgtttcttttggtcatctttgttctgattgctgatcattatcagagttctggtagagaaattaaaagacttgaagctgtgcaacggtcttttgtttacaataatttaaatgaagttttgggtgggatggatacaatcaaagcataccgaagtcaggaacgatttttggcgaaatcagattttttgatcaacaagatgaatgaggcgggataccttgtagttgtcctgcaaagatgggtaggtattttccttgatatggttgctatcgcatttgcactaattattacgttattgtgtgttacgagagcctttcctatttccgcggcttcagttggtgttttgttgacttatgtattacaattgcctggtctattaaataccattttaagggcaatgactcaaacagagaatgacatgaatagtgccgaaagattggtaacatatgcaactgaactaccactagaggcatcctatagaaagcccgaaatgacacctccagagtcatggccctcaatgggcgaaataatttttgaaaatgttgattttgcctatagacctggtttacctatagttttaaaaaatcttaacttgaatatcaagagtggggaaaaaattggtatctgtggtcgtacaggtgctggtaagtccactattatgagtgccctttacaggttgaatgaattgaccgcaggtaaaattttaattgacaatgttgatataagtcagctgggacttttcgatttaagaagaaaattagccatcattccacaagatccagtattatttaggggtacgattcgcaagaacttagatccatttaatgagcgtacagatgacgaattatgggatgcattggtgagaggtggtgctatcgccaaggatgacttgccggaagtgaaattgcaaaaacctgatgaaaatggtactcatggtaaaatgcataagttccatttagatcaagcagtggaagaagagggctccaatttctccttaggtgagagacaactattagcattaacaagggcattggtccgccaatcaaaaatattgattttggatgaggctacatcctcagtggactacgaaacggatggcaaaatccaaacacgtattgttgaggaatttggagattgtacaattttgtgtattgctcacagactgaagaccattgtaaattatgatcgtattcttgttttagagaagggtgaagtcgcagaattcgatacaccatggacgttgtttagtcaagaagatagtattttcagaagcatgtgttctagatctggtattgtggaaaatgatttcgagaacagaagttaa

SEQ ID NO: 45697 - DNA, 942 bp, Saccharomyces cerevisiae
atgcgtttctctactacactcgctactgcagctactgcgctatttttcacagcctcccaagtttcagctattggtgaactagcctttaacttgggtgtcaagaacaacgatggtacttgtaagtccacttccgactatgaaaccgaattacaagctttgaagagctacacttccaccgtcaaagtttacgctgcctcagattgtaacactttgcaaaacttaggtcctgctgctgaagctgagggatttactatctttgtcggtgtttggccaacagacgacagtcattacgctgctgaaaaggctgctttgcaaacctatttgccaaaaattaaagaatccactgttgctggtttcttggttggttctgaagccttataccgtaacgatttgactgcctctcaattatcagacaaaattaatgacgtccgtagtgtcgttgctgacatttccgattctgacggaaagtcatactctggtaagcaagtcggtactgtcgattcctggaatgttttggttgctggttacaattctgccgttatcgaagcttccgattttgttatggctaacgcgttctcctactggcaaggtcaaaccatgcaaaatgcctcttactcattctttgatgatattatgcaagctctacaggttatccaatctactaaaggttctaccgatattaccttctgggttggtgagaccggttggccaactgatggtaccaactttgaaagttcttacccatctgttgacaacgccaaacaattctggaaagaaggtatctgttccatgagagcttggggtgttaacgttattgtttttgaagcctttgatgaagattggaagccaaacacctctggtacctctgatgtcgagaagcactggggtgttttcacttcaagtgacaatttgaaatactccttggactgtgacttttcatga

SEQ ID NO: 45698 - DNA, 1770 bp, Saccharomyces cerevisiae
atgactatttcttctgcacatccagagacagaaccaaagtggtggaaagaggccacgttctatcaaatttacccagcaagtttcaaagactctaatgacgatggctggggtgacatgaaagggattgcctccaagctggagtacatcaaagagcttggtgccgatgccatttggatctcaccattctacgactcgccacaagatgatatgggttacgatattgccaactacgaaaaggtctggccaacatatggtacgaatgaagactgctttgccttgatcgaaaagacacataagcttggtatgaaatttatcaccgacttggtcatcaatcactgttccagcgaacatgaatggttcaaagagagcagatcctcgaagactaatccaaagcgtgactggttcttctggagacctcctaaaggttatgacgccgaaggcaagccaattcctccaaacaattggaaatcctattttggtggttccgcatggaccttcgatgaaaagacacaagaattctacttgcgtttgttttgctccactcaacctgatttgaattgggagaatgaagactgtagaaaggcaatctacgaaagtgccgttggatactggttagaccatggtgtagacggctttagaattgatgtcggaagtttgtactccaaagttgtaggtttaccagatgctcctgttgttgacaaaaactcgacttggcaatccagtgatccatacacattgaatggaccacgtattcacgagttccatcaagaaatgaatcaattcatcagaaacagagtgaaggatggcagggagattatgacagttggtgaaatgcaacatgcctccgacgaaactaagagactttatacgagtgcttcaagacacgaacttagtgagttatttaacttttcccacactgatgtggggacttcacctttgttccgttacaacttggtcccatttgaactgaaggattggaagattgcccttgctgagctgttcaggtacattaatggtacagattgttggtcaacaatctatctggaaaatcacgaccaacctcgttcaattacgagatttggtgacgattctcccaagaaccgtgttatttctggtaagttactctctgtgttgctaagtgccttgaccggtactctatatgtgtatcagggacaagagcttggccaaatcaatttcaagaactggcctgttgaaaagtacgaggatgtcgaaatcagaaacaactacaatgccattaaagaagagcatggggaaaactcagaggagatgaaaaagtttttagaagccattgcccttatctccagggaccatgctagaacacctatgcaatggtctcgtgaggagccaaatgctggtttttctggtcctagtgctaaaccatggttttacttgaacgactctttcagagaaggcattaacgtcgaagatgaaatcaaggatcccaactcggttttgaacttctggaaggaggccttgaagtttagaaaggcgcataaagacattactgtgtacggatacgatttcgagtttattgatttagacaataagaagttgtttagcttcacaaagaagtacaacaataaaacattgtttgcggctttgaactttagctctgatgcgacagatttcaagattccaaatgatgattcatcgttcaagttagagtttggaaactatccaaagaaggaggtagatgcctcttccagaacattgaagccatgggaaggaagaatatatatcagcgaatga

SEQ ID NO: 45699 - DNA, 1851 bp, Saccharomyces cerevisiae
atgaaaaatatcatttcattggtaagcaagaagaaggctgcctcaaaaaatgaggataaaaacatttctgagtcttcaagagatattgtaaaccaacaggaggttttcaatactgaagattttgaagaagggaaaaaggatagtgcctttgagctagaccacttagagttcaccaccaattcagcccagttaggagattctgacgaagataacgagaatgtgattaatgagatgaacgctactgatgatgcaaatgaagctaacagcgaggaaaaaagcatgactttgaagcaggcgttgctaaaatatccaaaagcagccctgtggtccatattagtgtctactaccctggttatggaaggttatgataccgcactactgagcgcactgtatgccctgccagtttttcagagaaaattcggtactttgaacggggagggttcttacgaaattacttcccaatggcagattggtttaaacatgtgtgtcctttgtggtgagatgattggtttgcaaatcacgacttatatggttgaatttatggggaatcgttatacgatgattacagcacttggtttgttaactgcttatatctttatcctctactactgtaaaagtttagctatgattgctgtgggacaaattctctcagctataccatggggttgtttccaaagtttggctgttacttatgcttcggaagtttgccctttagcattaagatattacatgaccagttactccaacatttgttggttatttggtcaaatcttcgcctctggtattatgaaaaactcacaagagaatttagggaactccgacttgggctataaattgccatttgctttacaatggatttggcctgctcctttaatgatcggtatctttttcgctcctgagtcgccctggtggttggtgagaaaggatagggtcgctgaggcaagaaaatctttaagcagaattttgagtggtaaaggcgccgagaaggacattcaagttgatcttactttaaagcagattgaattgactattgaaaaagaaagacttttagcatctaaatcaggatcattctttaattgtttcaagggagttaatggaagaagaacgagacttgcatgtttaacttgggtagctcaaaatagtagcggtgccgttttacttggttactcgacatatttttttgaaagagcaggtatggccaccgacaaggcgtttactttttctctaattcagtactgtcttgggttagcgggtacactttgctcctgggtaatatctggccgtgttggtagatggacaatactgacctatggtcttgcatttcaaatggtctgcttatttattattggtggaatgggttttggttctggaagcagcgctagtaatggtgccggtggtttattgctggctttatcattcttttacaatgctggtatcggtgcagttgtttactgtatcgttgctgaaattccatcagcggagttgagaactaagactatagtgctggcccgtatttgctacaatctcatggccgttattaacgctatattaacgccctatatgctaaacgtgagcgattggaactggggtgccaaaactggtctatactggggtggtttcacagcagtcactttagcttgggtcatcatcgatctgcctgagacaactggtagaaccttcagtgaaattaatgaacttttcaaccaaggggttcctgccagaaaatttgcatctactgtggttgatccattcggaaagggaaaaactcaacatgattcgctagctgatgagagtatcagtcagtcctcaagcataaaacagcgagaattaaatgcagctgataaatgttaa

SEQ ID NO: 45700 - DNA, 1755 bp, Saccharomyces cerevisiae
atgactatttctgatcatccagaaacagaaccaaagtggtggaaagaggccacaatctatcaaatttacccagcaagttttaaagactccaataacgatggctggggtgatttaaaaggtatcacttccaagttgcagtatattaaagatcttggcgttgatgctatttgggtttgtccgttttatgactctcctcaacaagatatggggtatgatatatccaactacgaaaaggtctggcccacatatggtaccaatgaggactgttttgagctaattgacaagactcataagctgggtatgaaattcatcaccgatttggttatcaaccactgttctacagaacacgaatggttcaaagagagcagatcctcgaagaccaatccgaagcgtgactggttcttctggagacctcctaagggttatgacgccgaaggcaagccaattcctccaaacaattggaaatctttctttggtggttcagcttggacttttgatgaaactacaaatgaattttacctccgtttgtttgcgagtcgtcaagttgacttgaattgggagaatgaagactgcagaagggcaatctttgaaagtgctgttggattttggctggaccatggtgtagatggttttagaatcgataccgctggtttgtattcgaaacgtcctggtttaccagattccccaatttttgacaaaacctcgaaattacaacatccaaattgggggtctcacaatggtcctaggattcatgaatatcatcaagaactacacagatttatgaaaaacagggtgaaagatggtagagaaataatgacagtcggtgaagttgcccatggaagtgataatgctttatacaccagtgcagctagatacgaagtcagcgaagttttctccttcacgcacgttgaagttggtacctcgccatttttccgttataacatagtgcccttcaccttgaaacaatggaaagaagccattgcatcgaactttttgttcattaacggtactgatagttgggctaccacctacatcgagaatcacgatcaagcccggtcaattacgagatttgctgacgattcgccaaagtaccgtaaaatatctggtaagctgttaacattgctagaatgttcattgacaggtacgttgtatgtctatcaaggtcaggagataggccagatcaatttcaaggaatggcctattgaaaagtatgaggacgttgatgtgaaaaacaactacgagattatcaaaaaaagttttggtaaaaactcgaaggaaatgaaggatttttttaaaggaatcgccctactttctagagatcattcgagaactcccatgccatggacgaaagataagcccaatgctggatttactggcccagatgttaaaccttggtttctcttgaatgaatctttcgagcaaggaatcaatgttgagcaggaatccagagatgatgactcagttctcaatttttggaaaagggccttgcaagccagaaagaaatataaggaacttatgatttatggttacgatttccaattcattgatttagacagtgaccagatctttagcttcactaaagagtacgaagacaagacgctgtttgctgctttaaatttcagtggcgaagaaattgaattcagcctcccaagagaaggtgcttctttatcttttattcttggaaattatgatgatactgacgtttcctccagagttttgaaaccatgggaaggtagaatctacctcgtcaaataa

SEQ ID NO: 45701 - DNA, 1641 bp, Saccharomyces cerevisiae
atggaaccgctgctttttaatagtgggaaagcaaatccctctcaagatgttttcatagatgtggaagttggtgatattaccacaaaatatggttccacaaatactggatcattcagttcgatggatactgtggaagcgcaggcgataaaggcagagacggcaagattcatggaagttccacagggaagacatttaggtgtgttctccacggttgtgttatttgtttcgaggataatggggtcaggtatatttgcagtacccagtgtgattttactgaatacaggtggtaataagctgatatattttgcgatctgggtttttagcgctgcgatcgcttttgcaggattgtatctttttctagaatttggttcctggataccgaaatcaggtggacgtaaaaacttcctcgaacggagttttgaaagacccagactattaattagtgtggtgttttcgtgttacagtgttttaactggctatgcattgacgggatctatcgtcttcggtaaatacgtgttgagcgcatttggagtcacggatgattcgtggtccaagtacgtcagcatatcatttataatatttgccgttctcattcacggtgtctctgtaaggcacggagtgtttatacagaacgcacttggtggtttgaagttgatcatgattgtcttgatgtgctttgccgggctatacacgcttttcttttataaaagcaccggtcaagttgcctgggacctcccagtaacccaagttgagaaagattctctcctgtcggtgtcctctattgctactgcctttatcagctcattcttttgtttttctggatgggatacagttcacacagttacatcagaaattaagaatcccgttaagacgttgaaggtgtcaggtcccttatcgttgataatttgttttgtctgctacacaatgatgaatgtggcatacttgaaagttttgacatatgaggaaattgttagtgcaggccccctggttggttccgtgttgtttaccaaacttttcggacccagagttggtggcaaattcattgctttttctatcgccatttctgcagcatctaatattctggttgtcatttacagtatatcaagagttaaccaggaaatattcaaagaaggttatttaccattcagtattcatatgtccaaaaattggccatttgatgcacctctaccatctatttctttatgtggctttataaccattgcttggatattgattttacccaaagagggcgaatccttcaattatctggtatcgatggatggttatggtaatcagtttttcttattattggtcgctattgggctctttatttggaggttcaaacacaagaacgaagtcccagagattcgtgcatctacttttggagtattagccattattacattatcattatacatgttgatggcaccattctttgccgaccctagcctaaacagagttgggttcctgccgccctaccaaatcatgtcattactggtaatagttgcatgcttctttttctggttagttaaattcgttttactacctaaattcttccattataaacttttacccaaaatcacttatttgcatgatgggctcattgtcacagaatgggtgaaaaagccatgtctgtgttag

SEQ ID NO: 45702 - DNA, 2130 bp, Saccharomyces cerevisiae
atgtttccctctctcttccgacttgtagtattctccaaacgttacatattccgatcaagccagcgcctttacactagtttaaaacaagaacagagccgtatgtccaaaataatggaagatttacgaagtgactacgtcccgcttatcgccagtattgatgtaggaacgacctcatccagatgcattctgttcaacagatggggccaggacgtttcaaaacaccaaattgaatattcaacttcagcatcgaagggcaagattggggtgtctggcctaaggagaccctctacagccccagctcgtgaaacaccaaacgccggtgacatcaaaaccagcggaaagcccatcttttctgcagaaggctatgccattcaagaaaccaaattcctaaaaatcgaggaattggacttggacttccataacgaacccacgttgaagttccccaaaccgggttgggttgagtgccatccgcagaaattactggtgaacgtcgtccaatgccttgcctcaagtttgctctctctgcagactatcaacagcgaacgtgtagcaaacggtctcccaccttacaaggtaatatgcatgggtatagcaaacatgagagaaaccacaattctgtggtcccgccgcacaggaaaaccaattgttaactacggtattgtttggaacgacaccagaacgatcaaaatcgttagagacaaatggcaaaacactagcgtcgataggcaactgcagcttagacagaagactggattgccattgctctccacgtatttctcctgttccaagctgcgctggttcctcgacaatgagcctctgtgtaccaaggcgtatgaggagaacgacctgatgttcggcactgtggacacatggctgatttaccaattaactaaacaaaaggcgttcgtttctgacgtaaccaacgcttccagaactggatttatgaacctctccactttaaagtacgacaacgagttgctggaattttggggtattgacaagaacctgattcacatgcccgaaattgtgtcctcatctcaatactacggtgactttggcattcctgattggataatggaaaagctacacgattcgccaaaaacagtactgcgagatctagtcaagagaaacctgcccatacagggctgtctgggcgaccaaagcgcatccatggtggggcaactcgcttacaaacccggtgctgcaaaatgtacttatggtaccggttgctttttactgtacaatacggggaccaaaaaattgatctcccaacatggcgcactgacgactctagcattttggttcccacatttgcaagagtacggtggccaaaaaccagaattgagcaagccacattttgcattagagggttccgtcgctgtggctggtgctgtggtccaatggctacgtgataatttacgattgatcgataaatcagaggatgtcggaccgattgcatctacggttcctgattctggtggcgtagttttcgtccccgcatttagtggcctattcgctccctattgggacccagatgccagagccaccataatggggatgtctcaattcactactgcctcccacatcgccagagctgccgtggaaggtgtttgctttcaagccagggctatcttgaaggcaatgagttctgacgcgtttggtgaaggttccaaagacagggactttttagaggaaatttccgacgtcacatatgaaaagtcgcccctgtcggttctggcagtggatggcgggatgtcgaggtctaatgaagtcatgcaaattcaagccgatatcttaggtccctgtgtcaaagtcagaaggtctccgacagcggaatgtaccgcattgggggcagccattgcagccaatatggctttcaaggatgtgaacgagcgcccattatggaaggacctacacgatgttaagaaatgggtcttttacaatggaatggagaaaaacgaacaaatatcaccagaggctcatccaaaccttaagatattcagaagtgaatccgacgatgctgaaaggagaaagcattggaagtattgggaagttgccgtggaaagatccaaaggttggctgaaggacatagaaggtgaacacgaacaggttctagaaaacttccaataa

SEQ ID NO: 45703 - DNA, 1818 bp, Saccharomyces cerevisiae
atgcagacgtcaatggtgagcgcaaaagttagtatatggctagtatgtagcgttatatgcagtagcctggtacgggctacgcaatctgtgtgttcgtcgcaaaacacagcgaccactgacggtgtacgaaatcaatttcagagtaatggttggtgttcaaataactgtgctggtcatcagtttgccatcgtacaggggttcatgtgctggtgcagtgattcggaaccgagcactcagacatcggtgggagactgcagtggcacttgtcccggttatggctacgaagattgtggtaatgcggataaggatctttttggttatatatatctggggcaaaccccgctaagttctgtacagagtgtggaaacgtcaacagagtccagtgtgtacgtttcaagtagctctatcacgagtagtagtagtacgagtattgtggacacaaccacaatctcgccgactctgacgtcaacgagtacgaccccattgacaaccgcctcaaccagtacaacaccatcaactgatataacatcggcactgcccacgactacaagcacaaagttgtcaacatccattcccacaagcacgacatcgtcaacctctaccaccacaagtacctcatcgtcgacttctacgaccgtaagtgtcacatcatcaacatctaccaccacaagtactacgtcgtcaaccctcatttccacgagcacatcatcatcatcatcatcaactccaaccacaacatcgtcagcccccatttctacaagcacgacgtcgtcaacttccacttcaacaagtacaacatcgccaacttcttcttcagcacctacaagctcgtctaatacaacaccaacgagcacaacgttcactacgacatcacccagtacagccccttcaagcactacggttacttacaccagtaccacagcatctccaataacgtccactataacttctgtaaacctgcagacctccttaaagtattctgtgataacagtgacttcagtgcacaccatggacactaacatttcggaaatcacctcgagatatctcaccatgaaaaaagtaataacgcagatttactcttccaccctcggggctactcctacttctgcagtggctactacgtctgccagcgtaggtggtagaataacaaacaataacaatagtaacaccaccaacagcaatacaccaactaacaagtctacagaaaagaaagggtactgggattcgcccgggaaaatagccgctactttcgtcgtggttggagtggtatgtttggtaattatatgcatactaatatacttaatacatcattatagaacaagacccgctcggaaggctcaagattttgagaatgaatatcagagtaagttttaccagtccaagtacccaaatgaagttaccactaccacgttacacacgccttcaccatcttcaaattcaactttctcgaccccaagattaatatacactgatgaaaagggacaaattatgtctgaatcaccatccccacgtcaatctacgtattccttgactgcaggcagtccaccaaatgacccaagcacgttggcaagcccatttcacgatcccattcttcccagaagaacttctacttttcttcattcgcccattcaaaagcaacacgaaaaaatggaatcaaacgttactctaggtgaagacacggtactggtggatcagaggctagacccaagtaagatgcttaacactttagcaaatgacgatgccacaaaccactctaccatttcgttatcagacaacgtagactactccaggagggttctgcggctaatgaacgaataa

SEQ ID NO: 45704 - DNA, 1482 bp, Saccharomyces cerevisiae
atgacggttttctctggagtaaataaaatagagtttgaaggtactttcgaaggtattggaaaggatgttgttatgtcacaaatgataagggccttgcagaaacattttccttcgatacgtgacaagaattatgagtttagcctatttttgcacatttttcaaagatatgtcttagaaaatacttcaatcacccatgatctagtttgtgacaaaattagattaccgataattgatgaagtggttgaactcgatgatattaaaaattacggtttgttagagggtaaactattatcaaagttagctattttaaaattaaccggaaaggctaatccaatcattggtaaagaaagccctttattcgaagtaaaaaatgggatgtcttcattggatgtaatagttcgacaaacgcaaaatttgaatgtacgatataattcagacgttcctcttatatttatgacctcgcttgaaactgaatctcaagtatcaaacttccttgaagagcattattcttctagcaaagtgagatggaaaaccgtagttcagtcaagctttccacaaattgataaagatagattattacctatcgatttacaaataaattctcatgaaaatgatttttggtatccttgcgggactggtaacctaactgacactttgtatttttcaggagaattggacaaattaattgctcaaggaaaagagattttatttgtttcaaatgttgacaatttgggcgctacaggagatttgaacattttaaatttcatcataaatgaaaaaatcgagtatcttgttgaagtagttgaaaggactgcaaatgtttcaaacactggagtgttggcaacatataaaggtaaactacgatcggtttattacaactgcttatccaatgaaagtgcaagcacgtgtcgaattgtcaacactaataacatttggattgatttgaaaaagctaaaggtgctaatagagtctaatagtttaaatttgccaattcattctagtgaaagtaaaataacacacaaaaatgaagagatagagtgtcttcaatttaagacacagttggtcgattgtattgccttctttccgaacagtcgagtattgaaagtatcaagagacagatttttacccctaagaacatgtaaggacttgtttttgttgaaatcaacattatatgatctcgattcaaatggaacatttaacctctaccctctgaaatttggattattaccttcaatcgacttgggcgatgagtttgcaacttatgagacttttaagataggagtaccagatattcctaatattctggaattagagcatttaactgtgatgggaaatgtgttttttggtcgtaatataactctgaaagggacggtcattataatatgtgatgaaaatgatgtaattactgttcccgatggctctattttggaaaatgtaacgatttggcataaatctcagctggaggatatgaatggatattaa

SEQ ID NO: 45705 - DNA, 963 bp, Saccharomyces cerevisiae
atgccaacaaattccatcaaattattagcaccagatgtccaccgaggtttagctgaacttgttgccaaaaggctaggtctacagttaacaagcagcaaactaaagagagatccaaccggtgaggtttccttttctattggagaatctgttagggaccaagatatctttatcatcacgcaaattggctctggtgtcgtgaacgatcgtgttctagaactactgatcatgatcaatgcttcgaagactgcgtctgcaagaagaatcactgctattattccaaatttcccatatgcaagacaagatagaaaggataagtctcgtgctcctattaccgctaaattgatggccgatatgttaacaacagccgggtgtgatcatgttattactatggatttgcatgcttcccaaattcaagggttcttcgacgtcccagtagataatttatatgcagaaccaagcgtagttaggtatatcaaggaaaatgtcaactatatggattcaataataatttcgccagatgctggtggggcaaaacgtgctgccactttggctgatcgtttggatctaaattttgcattgatccataaggaaagagctcgtgccaatgaggtttctcgtatggttcttgttggggatgttactgataagatttgtatcattgttgatgatatggccgatacttgtggtactttagctaaggctgctgaaattcttttggagaatagagctaaatctgttattgctattgtcacgcacggtgttttatcaggcagagctattgaaaatattaacaattctaaactggatagagttgtttgcacaaatactgttccatttgaagaaaaaatcaagaagtgcccaaaactggcagtcattgacatcagtagtgtgctggctgaaagtattcgtcgtttgcataatggtgaaagtatttcttatttatttaagaattatcccttataa

SEQ ID NO: 45706 - DNA, 2820 bp, Saccharomyces cerevisiae
atgagcaatgatccatctgctgtatcggaactaccagacaaggacagtcttgataacggtatcagcaatgacaatgaaagggccatgggcggcaatggcgatggcggcgatggattacgattaccaaggaccactggaactttgaacgtcaatgccttacaaaaaggcactaatgctgcccatgaagctggtggatacaaatccatggatcctgcgaagaacgcggagacaaccaatgatgatgacaataatgtcgtttcactagatgatcctattcaatttacccgagtatcttcctcctctgtcatcagtggaatgtcttcatccatgagtcctcattctaacatcgatgaaaccaaatctctagaagcagtcactccaaacataaataccagcaatataaccccggatcattctgctgacaacacattttctaccataaatgcgtccgagtcagatcaccagtttaatgacactttactatcaaaactgtcgttaacagattctacagaaactatagaaaataacgcgacagtgaagcaccagcagccagttgcatcttccacagtaaactcgaataagagctccactgatatacgaagggctacaccagtgtccactcccgttatctctaaaccatcgatgacaaccacgccaagacagatcaattcagcttcccattcgctttcgaaccctaagcataagcaacataaaccaaaagttaaaccgtccaagcctgaagcaaaaagtaaaccggtttctgtgaaaaaaagctttccttcgaaaaatcctttaaaaaactcctctccacctaaaaagcaaacagaaaaatcgtattattcttcctcttcgaaaaaaaggaaaagcggttcaaatagtggtacactaagaatgaaagatgtctttacgtcctttgtacagaatataaagagaaattctcaggatgataaaagggcctcatcgtcgtccaataattcttcctcatcttctataaccaccgctttgaggatatctacgccatacaatgccaagcatatccaccatgtgggcgtggactccaagactggtgagtacacaggtttgccggaggaatgggaaaaattgttgacttctagtggtatttccaaaagagaacaacagcaaaacatgcaagcagtcatggatattgtcaaattctatcaggatgtcacggaaacaaacggtgaagataaaatgttcaagactttcaacacaaccacaggattgccgggaagtcctcaagtttcaacaccgcctgcaaactcattcaataaatttcctccgtcgacaagtgattcgcacaattacggttccagaacaggtacaccaatgtccaatcacgtcatgtctccaaccttaaatacagattctagttcagcaaacgggaaattcataccaagtagaccggctcctaagcccccatcttctgcgtccgcttcagctccaattataaaatcacccgtcatgaattctgccgccaatgtttcgcccttgaagcagactcatgcacctacaactccgaacaggaccagcccaaacaggtcctcaatatcaagaaatgccactttaaaaaaagaggagcagccactaccaccaatacctccaaccaaatccaaaacgtctccaatcatctccacagctcacacaccacagcaagttgctcaatcgccaaaagcgccggcgcaagagacggtaacgacacctacttcgaagccagctcaagcaagaagcttgtctaaagaattaaatgagaaaaagagagaggaaagggaaagacgtaaaaaacaactatatgccaaattgaacgaaatttgctcagacggtgacccaagtacaaaatatgccaatttagtaaaaattggtcaaggtgcatcaggtggtgtttatactgcttatgaaataggtacgaatgtctcagtggccattaagcaaatgaatctcgaaaagcaaccaaaaaaggagctaatcatcaatgagattctggtcatgaagggtagcaaacaccctaatatagttaatttcattgattcttacgttttaaaaggcgacctttgggtcattatggaatacatggaaggtggctccttaactgatgtggtcacccattgtattttgacagaaggtcaaattggtgccgtttgtagagaaactttgagtgggttggaatttttacattctaaaggtgttcttcacagagatatcaaatccgataacatcctattgtccatggaaggggatattaagttaacggatttcggtttttgcgctcaaatcaatgaattgaacttgaaaagaactactatggtgggaacgccttattggatggcgcctgaagtggtttctaggaaagaatatggcccaaaagtagatatctggtcgttgggtatcatgatcattgaaatgatcgagggggagcctccatatttaaatgaaaccccgctaagagcactgtatttaattgctacaaatggtacacccaagttaaaggaacccgagaatctatcgtcaagcttgaaaaaattccttgattggtgtttatgtgtggagcccgaagatagagcaagcgctacggaattgcttcatgatgaatatatcacggagatagctgaagccaattcctcattggccccgctagtcaagttagcaagattgaagaaagtagctgagaacatggatgctgatgaagataatgacgacgataacgacaacgagcatattaataagacaaacaattgtgacgacaataacgatagcaaagaaaccgtaaatttggacgtaactgaagatgataaacaaaagtaa

SEQ ID NO: 45707 - DNA, 1074 bp, Saccharomyces cerevisiae
atgacgcgagatagcccagattctaacgacagctataagcatataaacaagaatactacacaaaaaacctcgtttgatagaaattcattcgattatattgtacgatcgggattagctggaggtatatcaggttcatgtgcgaaaacactaatcgcacccttagatagaataaaaattttatttcaaacatcaaatccgcactacacaaagtacacaggctcactaataggattagtagaggcagccaagcatatatggatcaatgatggggtaagggggttttttcaaggccattcagcaacccttttaaggatttttccatatgctgctgtcaaatttgttgcttatgaacagattaggaataccttgattccctcaaaagaatttgagtcacattggagaaggttggtgagtggttcactggcaggattatgcagtgttttcataacatatccgttagatctcgtgagggttaggttagcatatgaaacagaacataagagagtaaagctaggaagaataatcaagaaaatatataaggaaccagcttcagccacgctaatcaaaaatgattatattcctaactggttttgtcattggtgtaatttttataggggttatgttccaactgtacttggcatgataccatatgcaggtgtttccttttttgctcacgatttacttcatgatgtgctgaagagtcctttctttgccccttattcagtattagaactttcagaagatgatgaattggaaagagtacagaaaaagcagagaaggcctttgcgtacgtgggctgaattgatctctggtggtctagctggtatggcctcccaaacggcagcatatccatttgaaattattaggagaaggctccaagtaagtgcactgtcaccaaaaactatgtatgatcataaatttcaatcgatatctgaaattgctcacataatatttaaagaacgtggagtacgtggattttttgttggtctaagcataggttatattaaagtaacacctatggttgcatgtagttttttcgtctatgaaagaatgaaatggaattttggcatttaa

SEQ ID NO: 45708 - DNA, 1419 bp, Saccharomyces cerevisiae
atggggtgtacagtgagtacgcaaacaataggagacgaaagtgatccttttctacagaacaaaagagccaatgatgtcatcgagcaatcgttgcagctggagaaacaacgtgacaagaatgaaataaaactgttactattaggtgccggtgagtcaggtaaatcaacggttttaaaacaattaaaattattacatcaaggcggtttctcccatcaagaaaggttacagtatgctcaagtgatatgggcagatgccatacaatcaatgaaaattttgattattcaggccagaaaactaggtattcaacttgactgtgatgatccgatcaacaataaagatttgtttgcatgcaagagaatactgctaaaggctaaagctttagattatatcaacgccagtgttgccggtggttctgattttctaaatgattatgtactgaagtactcagaaaggtatgaaactaggaggcgtgttcagagtaccggacgagcaaaagctgctttcgatgaagacggaaatatttctaatgtcaaaagtgacactgacagagatgctgaaacggtgacgcaaaatgaggatgctgatagaaacaacagtagtagaattaacctacaggatatttgcaaggacttgaaccaagaaggcgatgaccagatgtttgttagaaaaacatcaagggaaattcaaggacaaaatagacgaaatcttattcacgaagacattgctaaggcaataaagcaactttggaataacgacaaaggtataaagcagtgttttgcacgttctaatgagtttcaattggagggctcagctgcatactactttgataacattgagaaatttgctagtccgaattatgtctgtacggatgaagacattttgaagggccgtataaagactacaggcattacagaaaccgaatttaacatcggctcgtccaaattcaaggttctcgacgctggtgggcagcgttctgaacgtaagaagtggattcattgtttcgaaggaattacagcagttttatttgttttagcaatgagtgaatacgaccagatgttgtttgaggatgaaagagtgaacagaatgcatgaatcaataatgctatttgacacgttattgaactctaagtggttcaaagatacaccgtttattttgtttttaaataaaattgatttgttcgaggaaaaggtaaaaagcatgcccataagaaagtactttcctgattaccagggacgtgtcggcgatgcagaagcgggtctaaaatattttgagaagatatttttgagcttgaataagacaaacaaaccaatctacgtgaaacgaacctgcgctaccgatacccaaactatgaagttcgtattgagtgcagtcaccgatctaatcatccagcaaaaccttaaaaaaattggtattatatga

SEQ ID NO: 45709 - DNA, 1593 bp, Saccharomyces cerevisiae
atgtctgctaccaagtcaatcgttggagaggcattggaatacgtaaacattggtttaagtcatttcttggctttaccattggcccaaagaatctctttgatcataataattcctttcatttacaatattgtatggcaattactatattctttgagaaaggaccgtccacctctagtgttttactggattccatgggtcggtagtgctgttgtgtacggtatgaagccatacgagtttttcgaagaatgtcaaaagaaatacggtgatattttttcattcgttttgttaggaagagtcatgactgtgtatttaggaccaaagggtcacgaatttgtcttcaacgctaagttggcagatgtttcagcagaagctgcttacgctcatttgactactccagttttcggtaaaggtgttatttacgattgtccaaattctagattgatggagcaaaagaagtttgttaagggtgctctaaccaaagaagccttcaagagctacgttccattgattgctgaagaagtgtacaagtacttcagagactccaaaaacttccgtttgaatgaaagaactactggtactattgacgtgatggttactcaacctgaaatgactattttcaccgcttcaagatcattattgggtaaggaaatgagagcaaaattggataccgattttgcttacttgtacagtgatttggataagggtttcactccaatcaacttcgtcttccctaacttaccattggaacactatagaaagagagatcacgctcaaaaggctatctccggtacttacatgtctttgattaaggaaagaagaaagaacaacgacattcaagacagagatttgatcgattccttgatgaagaactctacctacaaggatggtgtgaagatgactgatcaagaaatcgctaacttgttaattggtgtcttaatgggtggtcaacatacttctgctgccacttctgcttggattttgttgcacttggctgaaagaccagatgtccaacaagaattgtacgaagaacaaatgcgtgttttggatggtggtaagaaggaattgacctacgatttattacaagaaatgccattgttgaaccaaactattaaggaaactctaagaatgcaccatccattgcactctttgttccgtaaggttatgaaagatatgcacgttccaaacacttcttatgtcatcccagcaggttatcacgttttggtttctccaggttacactcatttaagagacgaatacttccctaatgctcaccaattcaacattcaccgttggaacaaagattctgcctcctcttattccgtcggtgaagaagtcgattacggtttcggtgccatttctaagggtgtcagctctccatacttacctttcggtggtggtagacacagatgtatcggtgaacactttgcttactgtcagctaggtgttctaatgtccatttttatcagaacattaaaatggcattacccagagggtaagaccgttccacctcctgactttacatctatggttactcttccaaccggtccagccaagatcatctgggaaaagagaaatccagaacaaaagatctaa

SEQ ID NO: 45710 - DNA, 717 bp, Saccharomyces cerevisiae
atgcctattaatattcgcagagcgacaatcaatgacattatatgtatgcaaaatgccaaccttcataacctacccgaaaattatatgatgaaatattatatgtatcatattctctcgtggccagaggcttcgtttgttgctactaccaccactttggactgtgaagatagtgatgaacaagatgagaacgacaaattggaattgaccttagatgggaccaatgacggcaggacaatcaagttggatccaacatacttggctccgggcgaaaaattagttggatacgttctcgtgaagatgaacgacgaccccgaccagcaaaacgagccaccaaatggtcatattacttccttaagtgtcatgagaacctatagaaggatggggattgccgaaaacttaatgagacaagctttatttgcgttgagagaagttcatcaagcggaatatgtttccttgcatgtgagacaatctaatagagcagctttacacttgtacagggacacattggcgtttgaggtgttgagtatcgagaaaagctactatcaggatggtgaagatgcatacgccatgaagaaggttttaaaattagaggagttgcagataagcaacttcacccatcgccgtttgaaagagaatgaggaaaaactagaagacgatctagaaagcgatctactagaggatatcattaagcaaggcgtaaatgatatcattgtataa

SEQ ID NO: 45711 - DNA, 1392 bp, Saccharomyces cerevisiae
atgtcagacggcactcaaaaactatggggtgggagattcactggtgaaaccgatcctttgatgcacctttacaatgcgtctcttccgtatgattataagatgtataaggcagatttagaaggaactaaagtatacacagcgggcttgcagaagttgggtcttctaacggagacagaattggcaaagatccatgaaggtttggctgaaatcaaaaaagaatgggacgctgacaaatttgtccgtcatccaaacgacgaggatatccatactgcgaatgaaagacgtcttggtgaactaattggccgcgatattgctggtaaagtccacaccggtagatcccgtaatgatcaagttgttaccgatttgagaatatactgtcgtgacattgtcaatgacaccctctttccagctttaaagggcttggttgaagttctaattaagagggccgaaggtgagatagatgtcttaatgccaggctacacacatttacaaagggcacaacctattagatggtctcattggttgagctcttatgcaacatacttcaccgaagattacaagagactgggtcaaatactacacagattgaatcaatcaccactgggtgcaggcgctcttgctggtcatccttacggcattgatagagaatttttggctgaaggtttgggtttcaatagtgtaattggtaactccttggttgctgtttctgatagagatttcatcgtggagttgatgttttggggaactttgttcatgaaccatatttctcgttttgctgaagatttgattatatattgtacagcagaatttggtttcatacagttgagcgacgcctattcaacaggttcttctttaatgcctcagaagaagaatgcagactcgttagagttgttaagaggtaaatccggtagagtatttggtgatctgacaggattcttgatgagtttgaagggtatcccatctacttatgataaagacatgcaagaagacaaagagccactattcgattgcttaacaactgtagagcactccatgctgattgccacaggtgttatttctaccttaactgtaaataaggaaaagatggaagctgctctcacgatggatatgctagctaccgacttggcagattacttggtcagaaagggtgttccattcagagagactcatcacatatctggtgagtgtgtcgctactgctgaaagacttggtctaagcggtattgataaattaaccttggagcagtatcaaaagatcgattcgagattcggacaagatctttttgaaacttttaactttgaacaaagcgttgaaagacgagatgctactggtggaaccgctaaatctgctgtattgaagcaattggataatttgaaatcccaattaaattag

SEQ ID NO: 45712 - DNA, 5787 bp, Saccharomyces cerevisiae
atgaccggcgggcagtcttgcagttctaatatgatcgtctggataccagatgagaaagaagttttcgtaaaaggggagctgatgagtaccgatatcaacaagaataaatttacaggccaagaagaacaaataggaattgtccacccgttggattccacagaggtttctaatctagtgcaggtacgaatatccgatgtatttccagttaacccatcgacttttgacaaagtagagaatatgtctgagttaacccatttgaatgagccgtctgtgctttataacctagaaaagaggtacgattgtgatctaatatacacctattccggcttatttttagtggcgattaacccttatcacaatttgaatttatattctgaagaccatataaacttgtaccacaacaagcataacaggttatcaaagagcagattggatgaaaactcccatgaaaaactgccgccgcatatatttgcaattgcagaagaagcctatgagaatcttttatctgaaggaaaagatcaatctattttagtcactggtgaatccggtgcgggcaagacagaaaatacgaaaaagattctacaatatctagcatctataacttctggctctccttccaatatagctcctgttagtggtagttctattgtagaaagcttcgaaatgaaaattctacaaagtaaccctatcttagagtcttttggtaatgcacagactgtacgaaataacaactcttcaagattcggtaaattcataaagatagaatttaatgaacatggtatgatcaatggtgcgcatatcgagtggtaccttttagagaaatcaagaattgttcatcaaaattcgaaagaaagaaattatcatatattttaccaactattatccggtttagacgattctgagttgaaaaatctacgccttaaatctaggaacgtaaaagattacaaaattttatccaattctaaccaggatattataccaggaatcaacgacgtagagaattttaaagaactgctctcggcattgaatattattgggttttcaaaagatcaaataagatggatatttcaagtagtggcaattattttattaatcggtaacattgagttcgtatcagacagagcagaacaagcatctttcaaaaatgatgttagcgcaatttgtagcaatttaggcgtggacgaaaaagatttccaaactgccatattaaggcctagatcaaaagccggaaaagagtgggtttcacagtccaaaaactctcaacaagctaagttcatcttgaatgccttatcaagaaatctttatgagcggttgttcggatatattgtggatatgattaataaaaacttggaccatgggagtgcaactttgaattacattggattgttggatattgctggttttgaaatattcgaaaataattcctttgaacaattatgcatcaactatacaaatgaaaaattacagcagttctttaataaccatatgtttgttttagaacagagcgaatatttaaaggaaaacattcaatgggattatatagattacggaaaagatttgcaactgacgattgatttgatcgaaagcaaggggccaccgaccggtgtactaccgttgttggatgaggaagccgttttgcccaaatccactgatgagtcattctactctaaactgatctcaacttgggaccaaaactcttcaaagtttaaacgttcaagattaaaaaatgggttcattttgaaacactatgctggggatgtggaatacactgtggaaggctggttatccaaaaacaaagatcctttaaacgataatctcttgtctttgttgtcttcttcacaaaacgatatcatttcaaaactgttccagccagagggcgaaaaatcttctagtgctggtgtggaagccaacatctccaaccaagaagttaagaaatcagctaggacaagtaccttcaagactacatcatcacgccatagagaacagcagataacattactaaatcaactagcttctacccacccacattttgttcgttgtataattccaaacaacgtgaaaaaagtgaaaacatttaacagaaggttaatcttagatcaattacgttgtaatggtgtgctagagggtattagacttgccagagaaggttacccaaataggatagcattccaagaatttttccagcggtataggatcttgtatcctgaaaattcaaccaccacgactttcagttctaaattaaaagccagtaccaaacaaaactgtgagtttcttctaacgtctttgcaactggatacaaaagtttataaaattggtaatactaaactgtttttcaaagctggagtattggcagatttggaaaaacaaaaagatgttaagctgaataatattatgattaaactaacagcaactatacgaggttacacagtaagaaaagaaataacgtaccatctacaaaaattaaagaaaacaagggtgattggtaataccttcagattatacaatagactggtgaaggaagatccttggtttaatttatttatcaggatcaagccacttttaacatcatccaatgacatgaccagaaccaaaaaattcaacgagcaaattaataaactgaagaacgaccttcaagaaatggaatctaagaagaagtttttggaagaaaagaaccaaaaaactgtcaatgagttggaaaatacgcaggacttgctaaatcaggagaaagagaatttaagaaaaaatgagagcttattaaatagagttaaaaccagctcagaaacattacaaaaacaattcgatgaccttgtttctgaaaaggatgaaattagcagggaaaaactagaagttgcgcaaaatcttgaagaagctcatcaaaaaatccaaggccttcaagaaactattagagaacgggaggcgaccttagagaaattacactcaaaaaataacgaactaataaagcaaatatcagacttgaactgtgacatttctaaggaacagagctcccagtctttaatcaaagaatctaaattgaagctagaaaacgaaataaagagattaaaagatgtcataaactcgaaggaggaagaaataaaatcgttcaacgataagttaagttcctcagaagaagatcttgacataaaattggtcactttagagaaaaattgtaacattgcgatgtcaagactacaatcccttgtaacagaaaattcagatttgcgttcgaaaaatgagaatttcaagaaagaaaaggcagcactgaataaccagttgaaaaataaggaaagtgaactgttaaagatgaaagaaaaaatagataatcacaaaaaagagcttgctactttttccaagcaaagagatgacgcagttagcgaacatggtaaaattactgctgaactaaaagagacaagaatccaacttaccgagtataaatctaactatcaaaagattaaagaagaatattccaacttccaaagagaaacgaaggaacaggagcaaaagaaaagaaatagcctggttgagtctctgaacgatagtaaaattaaagaattggaagctcggttgtcacaggaaatatccttaaatcaatacttaaacaaaagaatatcaggaaattctgtagaaacgaatatttcgtctactagacgttccacatcgtattcagatgatccacttgacaaagaagatataataaaaaaatactatgaccttcaattagcgtttactgaaataactaggaatctagagaatgaaattgaagagaagaagaacttaatttctagattgagattcactgaaacaagactagcatcttcgtcttttgaggaccaaaagattaaggcacaaatgaagaaattaaaaaaattgatccaggatatggaccctagtattcctttggacagtattctaaatgagccgctagataactgccctgacaaagagtctgatattaacaaattaatgcttgaggtcgattatttaaaaagacaattggatatcgaaacaagagctcactacgatgcagaaaatgccatatctgctttacacagtaaatttagaaagatccaaggggaaagctccctgtcatcttctgatatttacaaactgaagttcgaagccagtgaagaaagagtcaaatccttggaagacaagctaaaaaccatgcctttacgtgatcgaacaaatttacctgtcggagatattataaagaaccgtgatagcatttcaaaatatgaagaagaaattcgctattataaacttgaaaactacaagctccaagaaatattaaatgaatcaaatggaaaattgagccaactcactcttgacttgaggcaatcaaaatccaaagaagccctacttagtgaacaattagacagattacagaaagaccttgaatctacggaacgccaaaaagaactactatcatccacaataaaacagcagaaacagcaatttgaaaactgcatggacgatctgcaagggaatgaactgcggctaagagaacatattcatgcactaaaacaagctgaagaggacgtaaagaatatggcgtctatcattgaaaaattgaaaactcaaaataagcaaaaggaaaagttaatctgggagcgcgaaatggaaagaaatgactcagatatgcaattacaggaaactctgctggagttgaagagagtccaagatgtaaagaaaatcctgagtgatgatttggcccatttaaaggagcgattgagcgctgtagaagatagatcccaatatacggatgagattaatagattaaaggaagaattgaactgctctttaaaagctgaaacaaacttaaaaaaagaatttgcaacccttaagtacaaactggaaacttcgactaatgattctgaagcaaaaatctccgatctgctgaagcagctcgatcattatacaaaagtggtggaaatgttgaacaacgaaaaagatgctatttctcttgcagaaaaagaactttatcagaaatacgaggcactcaatactgaatgcgagtctcttaaaggaaagatagtgtctttgactaaaatcaagcaggaactggaatctgacttaaatcaaaagactgatgcgctacagatatcaaacgcagcactctcaagttccacacaaaagaataaagagattactgaaaaaatcaaatatctggaggaaacactacaactgcaaatggaacaaaattcaaggaatggggagttggttaagacattacaggccagctgcaatggatataaagataagtttgatgatgagaagcagaagaatattgatttatatgaagaaaatcaaactttacaaaagctcaacaccgacttacagcttcaactaaaaaatttgcatgaaagattatcagacactactgaaaaaaacgcatggttatcaaagattcatgaattggaaaatatggtaagcctagaaacggacttgaaatatgaagaaatgaaaaagaacaagagtttggagagagcagtggaagagttacaaactaagaactcccaacaaacagatgtaatagaactagcgaataaaaatagaagcgaatttgaggaagctactttgaaatatgaggctcaaatctctgacttagaaaagtacatttctcaacaagagcttgagatgaaaaaatccattagagataattcttcttaccgcgacaaagtgcaggaaatggcccaagaaattgaattctggaaaagccgttatgaatctaccatgataggctcgaaaaatattgatagtaacaatgcacagagtaaaattttcagttaa

SEQ ID NO: 45713 - DNA, 1449 bp, Saccharomyces cerevisiae
atgctaaggaacggcgttcagaggttgtactctaacatcgctagaaccgataattttaagctttcgtcactagcgaatggactgaaagtggcgacatcaaatactcctggacactttagtgccttaggcctatacatcgacgcaggatcacggtttgaaggtaggaatttgaagggttgtacacatatcttggatagactagcattcaaatcaaccgaacacgtcgagggccgagcaatggcagagacgttggagttactgggtgggaattaccagtgtacctcgtctagagaaaatttgatgtatcaggcttctgtgttcaaccaggatgtgggtaaaatgcttcaattaatgtcagaaactgtgaggttccctaagattactgagcaagaactgcaagaacagaagctgtcggcagagtatgaaatcgatgaagtttggatgaagccagaattggtattacctgagctgttgcacacagcagcatactccggagaaactttggggtcccctttaatctgccctagagagctcattccttctatttctaaatactacttattggactacagaaataaattctacaccccagaaaatactgttgcggcatttgttggtgttcctcacgaaaaggcattagagcttacagaaaagtatctcggtgactggcaatctacacaccctccgatcaccaaaaaagttgcccaatatacgggcggggaaagttgtattccaccagcaccagtgtttgggaatttaccagaattattccacatccagatcggatttgaaggtctccctatagatcatccagacatttatgctttagcaacattacaaactttacttggaggtggtggttctttcagtgctggtgggccaggaaaggggatgtattctcgtttgtatacccacgttttgaaccagtattactttgttgaaaattgtgttgcgttcaaccattcttattcggattctggtattttcggtatttcattatcttgtataccgcaggcagctcctcaagcggttgaggtaattgcacagcaaatgtataatacatttgctaataaggatttgaggttaactgaagacgaagtctccagggccaagaatcagttgaagtcttcactactaatgaacctagagtctaaactggtagaattggaagatatgggcagacaagttctcatgcatggtcgcaaaatcccagtcaacgaaatgataagtaagatcgaagatttgaagccagatgatatctcacgtgttgccgaaatgatatttacgggaaatgtaaataatgctggcaatggtaagggtagagctactgttgtaatgcaaggagacagaggatcctttggagatgtggaaaatgtactgaaggcatatggattgggtaacagctcctcctccaaaaacgatagtcccaagaagaagggttggttttga

SEQ ID NO: 45714 - DNA, 642 bp, Saccharomyces cerevisiae
atgaacaaggaatctaaagatgatgatatgtccttggggaagttttccttctcccacttcctatattacttggtgctaatagtagtaatagtgtacggtttgtacaagcttttcactggacatggatccgacattaatttcgggaagttcttgttaaggacatccccttatatgtgggccaatcttggtattgccctttgtgtaggcttaagtgtcgtgggggcagcatggggtattttcattactggttcatccatgattggtgccggtgtgcgtgctccaaggattaccaccaagaatttaatttccattattttctgtgaagtggttgccatttacggtctgattattgccattgtcttttcttcgaaattgactgtggctactgctgagaacatgtactcgaaatcaaacctgtacactggttattctcttttctgggcaggtatcactgtcggtgcttccaatttgatttgtggtatcgctgtcggtatcaccggtgcgactgctgccatttccgatgctgctgattccgcattgtttgttaaaattttggtcattgaaattttcgggtccattttaggtttattaggtttgattgttggtttattgatggccggtaaagcttctgaatttcagtaa

SEQ ID NO: 45715 - DNA, 2982 bp, Saccharomyces cerevisiae
atggtagacgaaagtgataagaaacaacagactattgatgaacaatcgcagataagtcctgaaaagcagacaccaaataagaaggataaaaaaaaggaggaagaggagcagctatccgaagaagatgcaaagcttaaaacagatttagagctattggttgaaaggctgaaagaagacgattcatctttatatgaagcgtctttgaatgccttaaaggaatcgatcaaaaattctacgagttctatgaccgccgttcccaaacctttgaaattccttcgtccgacatatccagacctatgttctatctacgacaaatggacagatccaaacttgaaatcctctttagcggatgtcttgtccattttagccatgacatactctgaaaatggtaaacacgattcattgagatatagattactctccgacgtttctgattttgaagggtggggacatgagtacatccgtcatttagctttggagatcggtgaagtatataatgatcaagtggaaaaagatgctgaagatgaaacatcatctgatggatctaaaagcgatggatctgcggctacttccgggttcgaattttccaaggaagatactcttcgtctatgtttagacattgtcccatactttttgaaacacaacggtgaagaagacgcggtagatttgcttttggaaattgaatctattgacaagctacctcaatttgtcgatgagaataccttccaaagagtttgtcaatatatggttgcatgtgttccacttttgccacctcctgaagacgttgcctttttaaaaaccgcatattctatttatctatctcagaacgaacttacagatgcaattgctttggcagttagactaggggaagaggatatgatcagatccgttttcgatgctactagcgatccagtgatgcataaacaattagcatatattttagccgcacaaaagacatcgtttgagtatgaaggtgttcaggatataattggaaatggtaaattgtctgaacactttttatatcttgctaaagaattgaatctaactgggccaaaagtcccagaagacatttataagagccatttggataactctaaatctgtgttctcaagcgccggcctagattctgctcaacaaaatctagcttcgtcatttgtcaacgggttcttaaacttaggttattgtaacgataaattaattgtggataatgataattgggtatataaaaccaaaggtgacggtatgacttccgcggtagctagtattggatctatataccagtggaatctcgatggtttgcaacaactggataagtatctctacgttgatgagccagaagttaaagctggtgcattattaggtattggtatttccgcttccggtgtgcatgatggtgaagttgaaccagctttgttacttttgcaagattatgttactaacccagacactaaaattagttcagcagctattcttggcctgggtattgcatttgctggtagcaagaatgacgaagtgttgggtttgttattaccaattgccgcatccactgacttgcctattgaaactgcagctatggcttccttagctttggctcatgttttcgttggtacttgtaatggtgacattacaacttctatcatggacaactttttagagcgtacagccatcgagttgaagaccgactgggtaaggtttttggcacttgctttaggtattctatacatgggccaaggtgaacaggtggatgatgttttagaaactattagtgctattgaacatccaatgacatcagctattgaagtattagttggttcatgtgcttatactggtacgggtgatgttttgttaattcaagatttgttacatcgtttgacccctaaaaacgtaaaaggtgaagaagatgcagatgaagaagaaactgccgaaggacagactaatagcataagtgactttttgggtgagcaagtgaatgaacctaccaagaacgaggaagctgagatcgaagtggacgaaatggaggttgatgccgaaggagaggaagttgaagttaaagcagaaataacagagaagaagaatggtgagagtttagaaggtgaagagataaaatccgaagaaaagaagggaaaatcttccgataaggatgctactacggacgggaaaaatgatgatgaggaggaagaaaaagaagcaggcatagtcgatgaacttgcttatgcagttttgggtattgctttgattgcccttggtgaagatattggcaaggaaatgtctttacgtcattttggtcatttaatgcattatggtaatgaacacatccgtcgtatggttcctttagcgatgggtattgtttccgtttctgatccacaaatgaaggtgttcgataccttaactcgtttttcacatgacgccgatttagaagtttcaatgaattcaattttcgctatgggtctatgtggtgctggtactaacaatgcaaggttagctcaactattaagacagttggcaagttattattcacgtgaacaagacgctttgtttatcaccagattagcacaagggttattgcatcttggtaaaggtactatgacaatggatgtgttcaatgatgcacatgttttgaataaggtgacattagcatcaatattaactaccgcagttggtttagtatcgccaagtttcatgttgaagcatcatcaattgttctacatgttgaatgccggtataaggccaaagtttattctagcattaaacgatgagggagagccaataaaggttaatgtgcgcgttggtcaagcagtggaaactgtcggccaagcaggcagaccaaaaaagattactggctggattacgcaatccactcctgttttactaaatcatggcgaaagagcagaactagaaactgatgaatatattagttacacaagccatattgagggcgtagtaattttaaagaagaaccctgactatcgtgaagaggagtaa

SEQ ID NO: 45716 - DNA, 2457 bp, Saccharomyces cerevisiae
atggaaggtggcgaagaagaagttgagcgcattcctgatgaacttttcgatacaaaaaagaagcatttgttagataagctcataagggtcggaataatccttgtactcctgatatggggcactgttttgttgctaaaaagtatacctcaccattcaaacacaccagattatcaagaacccaactctaattacaccaatgatgggaaattaaaggtgtcgttttctgttgtaagaaacaatacatttcaacccaaatatcacgagctgcaatggattagtgacaataaaattgaaagcaacgatctaggtctttatgttacatttatgaacgatagttacgttgttaaatctgtctacgatgactcatataatagcgttttattagagggaaaaactttcattcataacggtcaaaacctcactgtggagtcaataactgcgtctcccgacctgaagcggttattaattagaacaaatagcgtacaaaattggagacactcaacgtttggttcttattttgtctacgataagagtagctcgtcctttgaggagattggaaacgaggtggctctagcaatatggtcccctaattctaatgatattgcatacgtccaagataacaatatatatatttattctgctatttccaaaaagaccatacgggctgtgaccaacgacggaagctcctttctttttaacggtaagccagattgggtttacgaggaagaagtttttgaagacgacaaggctgcgtggtggtcaccaactggtgattacctggcattcttgaaaattgatgaatcagaagttggtgagtttatcattccatattatgtccaagatgaaaaggatatataccccgaaatgcgcagtatcaagtatccaaaaagtggcacgccaaatcctcatgcagagctatgggtttacagtatgaaagatggaacatcgttccatccaagaataagtggaaataaaaaagatggaagtctgttaattactgaagttacatgggtaggaaatggaaacgttttagttaaaactaccgatcgatcctcggacatattgactgtgtttttgatagatacaattgcaaagacttcaaacgtggtaaggaacgaaagttctaacggaggatggtgggagattactcataatactctgtttattccggcaaatgaaacatttgataggcctcataatggttatgttgatattcttccgattggtggttacaatcatttggcttatttcgaaaatagtaatagttcacactataaaacattgacagaggggaaatgggaagtggtgaatggcccacttgcctttgattcaatggaaaatcgtctttacttcatttctacacgaaagagttcaaccgaacgccacgtttactacatagatttacggtcaccaaatgaaattattgaagttactgatacttctgaggatggtgtctatgatgtgtccttttcttctggtagaaggtttggtttactcacctataaaggaccaaaagttccatatcaaaaaattgtggacttccattctcgtaaagcagaaaaatgcgacaaaggtaatgttttaggcaaatcactataccatttggaaaagaacgaagtacttaccaaaattttagaagattatgcggtacccagaaaatcattcagggaattgaacctaggaaaggacgaatttggaaaggatatactagtgaactcgtatgaaatcctaccaaatgatttcgatgaaacgttaagtgaccactatcctgtatttttctttgcatatgggggaccgaattctcaacaagttgtcaaaacgttttccgtaggatttaatgaagtggtagcttcacaattaaacgcaattgtagttgttgttgacggtcgtggtactggcttcaaaggtcaagactttagatcccttgttcgcgataggctcggtgattacgaggcccgcgaccaaatatctgcggcttccttatatggttctttaacttttgttgatccgcaaaagatttccttatttggttggtcatacggggggtacctgacactaaaaactttggagaaagatggcggaagacatttcaaatacgggatgtcagttgcgccagtaaccgactggagattttacgattctgtttatactgagaggtacatgcatactcctcaagaaaactttgatggatacgtagaatcaagcgttcataatgtcactgctttggcacaagcaaatagatttttgttgatgcacggaacaggagatgataacgttcactttcaaaattccctaaagtttctggaccttttggatctaaatggtgtggaaaattatgacgtccacgtctttcctgactcagatcatagtataagataccataatgcgaatgtaatcgtttttgacaagctattggattgggcaaagcgtgctttcgatgggcaatttgtcaaatga

SEQ ID NO: 45717 - DNA, 1455 bp, Saccharomyces cerevisiae
atggctgataagatagagaggcatactttcaaggtcttcaatcaagatttcagtgtagataagaggtttcaacttatcaaagaaatagggcatggagcatacggcatagtgtgttcagcgcggtttgcagaagctgccgaagataccacagttgccatcaagaaagtgacaaacgttttttcgaagaccttactatgtaaaagatccctacgtgagctaaagcttttgagacatttcagaggccacaaaaatattacatgtctttatgatatggatattgttttttatccagacgggtctatcaatggactatatctttatgaggaacttatggaatgtgatatgcaccaaatcatcaaatccggtcaacctttgacggatgctcactatcaaagtttcacataccaaatattatgtggtttaaagtatattcattctgcagatgtcttgcatcgtgatttgaagcccggcaatttgcttgtcaatgcagattgtcaattgaaaatctgtgattttgggttagctagaggttattcggagaatcctgtcgaaaacagtcaatttttgacggagtacgtggccactagatggtatagagctccggaaataatgttgagttaccaaggatataccaaggcgattgacgtatggtcagctggctgtattttagcggagtttcttggtggaaagccaatcttcaaaggaaaggattacgttaatcaattgaatcaaatattacaagttttagggacacccccagacgaaactttaagaaggattggttctaaaaatgttcaggactacatacatcaattaggtttcattccaaaagtaccttttgtcaatttatacccaaatgccaattcacaagcattagacttattggagcaaatgctcgcgtttgaccctcaaaagagaattaccgtggatgaggccctggagcatccttacttgtctatatggcatgatccagctgacgaacctgtgtgtagtgaaaaattcgaatttagttttgaatcggttaatgatatggaggacttaaaacaaatggttatacaagaagtgcaagatttcaggctgtttgtgagacaaccgctattagaagagcaaaggcaattacaattacagcagcagcaacagcagcagcaacagcaacagcaacagcaacagcagccttcagatgtggataatggcaacgccgcagcgagtgaagaaaattatccaaaacagatggccacgtctaattctgttgcgccacaacaagaatcatttggtattcactcccaaaatttgccaaggcatgatgcagatttcccacctcgacctcaagagagtatgatggagatgagacctgccactggaaataccgcagatattccgcctcagaatgataacggcacgcttctagaccttgaaaaagagctggagtttggattagatagaaaatatttttag

SEQ ID NO: 45718 - DNA, 2172 bp, Saccharomyces cerevisiae
atgttcaggtcgcatgcctccggtaacaagaagcaatggtctaaaagatcctcaaatggtagcacacctgctgcttcggcatctggctctcacgcatacaggcaacaaacgttgtcttcgttctttatgggttgcggcaaaaaatctgctgctgcttcaaaaaacagcacgacaataattgatttggaaagcggtgacgaaggtaaccgtaatataacagcacctcctaggccaagattaatacggaataattcgtcttccttattctcgcagagtcaaggttcgtttggagatgatgatcccgacgcagaattcaaaaaattggtagatgtgccgagactcaatagctataaaaagtctagcagatcgctgtcgatgaccagctctcttcataagactgcctctgcgtccacgactcagaaaacataccattttgatgaggatgagactttgcgagaggttactagcgtgaaatccaattctagacaattatcgttcactagtacaattaatattgaagattctagcatgaaactttctactgattcagaaagaccagccaagaggtctaaaccttctatggagtttcaaggtttaaagctcacagtaccaaagaaaataaaaccactgctaagaaagacagtatcaaatatggactcaatgaaccaccgaagtgcgtcttcgccagtggtacttacaatggagcaagagagagtggttaatttaatcgtcaaaaaaagaacaaatgtcttttacaccggtagtgcgggtacaggtaagtcggtcattttgcaaacgatcataagacaattgagctctttgtatgggaaagaatcaattgcaattaccgcctcaactgggctagcggcagtgactattggtggttccacattgcataagtggtctggtataggaatcgggaacaaaactatcgaccaattggtgaaaaaaatacaatcacaaaaggacttattggccgcatggaggtatacaaaagttttgataattgatgaaatttctatggtcgatggtaatctgttggataaattagagcaaatcgcaaggagaattcggaagaacgacgatccctttggtggtattcaattggtcctgacaggcgatttttttcaactaccaccagttgctaagaaggacgagcataacgttgtgaaattttgttttgaaagtgaaatgtggaaacggtgcattcaaaaaacgattttactgacaaaggttttcagacaacaggataacaaactaattgatattctaaatgccataagatacggagagctgactgtcgacattgctaaaacaataaggaacctaaatagggatatagactatgccgatggaattgctcctacagaactgtatgccacaagaagagaagttgaactatccaacgtaaagaaattacagtctctacctggtgatttatatgagtttaaagctgtagataacgcgcccgagagataccaagcgatactagattcttcattaatggtggaaaaagttgtcgcattgaaggaagatgcacaggtaatgatgttgaaaaataagcctgatgtagaattagttaatggatcattgggaaaagttttgttttttgttacagaatcgctggtggtgaaaatgaaggaaatttacaagattgtggatgacgaagttgtcatggacatgagattagtgagtcgggtcattggtaatcccttgttaaaggaatcaaaggagtttcgtcaagatttgaatgccaggccattagctagattggaacgtttgaaaatcttgataaactatgcagttaagatctctccgcataaggaaaaattcccctatgtgaggtggacagtgggtaaaaacaagtacatacatgagctcatggtcccagagcgctttcccattgatattcccagagaaaatgtcgggttagaaagaactcagattccattaatgctatgctgggcactgtccattcataaggcacagggtcaaactattcaaagactaaaggtcgacttgaggagaattttcgaagccggccaagtttatgttgcactgtcaagagcggtaactatggacaccttacaggtcctaaactttgatccaggaaagattcgcaccaatgaaagagtaaaagatttctataaacgtttagaaactttgaaatga

SEQ ID NO: 45719 - DNA, 1728 bp, Saccharomyces cerevisiae
atgctatcagcaaggtgcctcaaatctatatacttcaagagatctttctcacaactgggacacatcaagccccccaagcacataagaaatgaacctgttaagccatttagaaacatagacttaaaagactgggacttactgagggcttccttgatgaaattcaaaagttcttctttagaagtgccactggtcatcaatggggaaaggatatatgacaataatgaaagagcgcttttcccgcagactaaccctgcgaaccatcaacaagtactggcaaacgtcacacaagccacggaaaaagatgtcatgaatgctgtaaaagccgccaaggatgccaaaaaggattggtacaatctaccgttttatgacagatctgcaatttttttgaaagccgctgacttaatttccaccaagtatcgttatgacatgttagctgctacaatgctgggccagggaaaaaatgtgtatcaggcagaaatcgactgtatcacggaattatctgacttttttagatactatgtcaagtatgcatcagacttgtatgctcaacaacccgtagagtcagcggatggtacttggaataaagctgaatacagacctttagagggatttgtgtatgctgtttcaccattcaactttactgctattgctgcaaacttgattggggctccagctttgatgggtaatacagttgtctggaaaccttcacaaaccgctgccctttcaaattacttattgatgactgttttggaagaagcgggattgccaaagggtgtcataaatttcattccaggtgatccagttcaagttactgaccaggtattagctgataaagattttggtgccttgcattttaccggttctacaaatgtctttaagagtttgtatggcaaaatacaaagtggcgttgttgaagggaagtacagagattacccccgtattattggtgagacaggtggtaaaaatttccatctagttcacccaagtgcaaatatatcacatgcagtactctctactattagaggcactttcgagttccaaggccaaaagtgctctgccgcttccaggttatatcttccagagtcaaaaagtgaagaattcttatccgatatgtttggcatattgcagtcacagaatgttgtcccaatgaacacatccgcaagtccaatttctggtgggaatttgcggggatttatgggtcctgtcatccatgaacaaagtttcgacaaattagttaaagtaattgaagatgcaaagaaagaccccgagttggaaattctttacggtggacaatacgataaaagccaaggttggtttgtcggacccacagtcataaaagccaagagaccagatcatccatatatgtcaacagaattttttggccctatattaactgtttacgagtatccagatactgaatttaatgaaatctgtgatattatcgataatacgagtcaatacgccttaactggtgctatttttgccaaagatcgtaaagcaattgaatacgcagatgagaagttgaagtttagcgcaggaaatttctacataaatgataagtgtactggtgccgttgtttctcagcaatggtttggtggcgcaagaatgagtggtaccgacgataaggctggtggtccaaacattttaagcagatttgtcagtattagaaacacaaaggagaacttctacgagttgactgatttcaaatatccatcgaattatgaataa

SEQ ID NO: 45720 - DNA, 1935 bp, Saccharomyces cerevisiae
atgtccaaggtctatctgaattcagacatgattaaccatttgaactccacagttcaagcttactttaacttatggttggagaagcaaaacgcaataatgcgttctcaaccccaaattattcaagataaccaaaaactgataggcattacaacgctagttgcctcaattttcactctgtatgttttggtcaagataatctccaccccagcaaagtgttcctcgtcctataagccagtcaaattctcccttcctgcaccagaggccgctcaaaataattggaagggcaagaggtctgtttccactaacatatggaatcctgaagaaccaaactttattcaatgtcattgtcccgccacaggtcaatatctaggttcttttccatcgaaaacggaagctgacatagatgaaatggtttctaaggcaggcaaagctcaatctacttggggcaattctgatttctcaagaagattgagagttttggcttctttgcatgattatattctaaataatcaagatcttattgcgagagtagcgtgcagggattcaggaaagacaatgttagacgcatcgatgggtgaaatcttggttactttagaaaaaattcaatggactataaagcacggccaaagagcgttgcaaccttcgagacgtccgggccccactaattttttcatgaagtggtataaaggtgcagaaatccgttatgaaccactgggtgtgatcagttctatcgtttcctggaactatccattccataacttattgggtccaattattgcagcattgttcacagggaatgccattgtagtaaaatgttcagaacaagttgtctggtcttcggaatttttcgtcgagctgatccgcaaatgtttggaagcttgtgatgaagatccagatttggttcagttgtgctattgtttacctccaactgaaaatgatgattccgcaaattatttcacctctcatcctggtttcaaacatatcacttttattggcagtcagcccgtagcgcactatattctaaaatgcgctgccaaatcattgacacccgtagttgtggagcttggtggtaaggatgcgtttattgtcctagactcagctaagaatttagatgctttatcttctatcatcatgaggggtactttccaatcatccggtcaaaattgtattggtattgagagggttattgtcagtaaggaaaattatgatgatttagtcaagattttgaatgaccgtatgactgcaaatccactacgccaagggtctgatattgatcatttagaaaatgttgatatgggggcaatgatatctgacaacagattcgatgaactagaagctttggttaaagatgctgttgcaaagggagctcgtttacttcaaggtggttcccgcttcaaacatccaaagtatccacaaggtcattatttccaaccaactcttttggtggatgtcactccagaaatgaaaatagcacaaaacgaagtgtttggcccaattttagtcatgatgaaagctaagaatactgaccattgtgtacaactagccaactctgcgccatttggtctaggtggttctgtgtttggtgcggatatcaaggaatgcaattacgtcgcaaatagcctacaaactggtaatgtagccattaatgattttgctacattctatgtttgtcaattaccatttggtggtatcaatggttcaggttacggtaaatttggtggtgaagaaggtcttttgggtttgtgcaatgccaaaagtgtctgttttgatactttgccttttgtctccactcaaattccaaaaccattagactaccctattcgtaacaatgctaaggcttggaattttgtaaagagtttcatcgtaggagcttatacaaattccacatggcaaagaataaagtcactgttctctttagctaaagaagccagctag

SEQ ID NO: 45721 - DNA, 2076 bp, Saccharomyces cerevisiae
atgccgtttggaatagacaacaccgacttcactgtcctggcggggctagtgcttgccgtgctactgtacgtaaagagaaactccatcaaggaactgctgatgtccgatgacggagatatcacagctgtcagctcgggcaacagagacattgctcaggtggtgaccgaaaacaacaagaactacttggtgttgtatgcgtcgcagactgggactgccgaggattacgccaaaaagttttccaaggagctggtggccaagttcaacctaaacgtgatgtgcgcagatgttgagaactacgactttgagtcgctaaacgatgtgcccgtcatagtctcgatttttatctctacatatggtgaaggagacttccccgacggggcggtcaactttgaagactttatttgtaatgcggaagcgggtgcactatcgaacctgaggtataatatgtttggtctgggaaattctacttatgaattctttaatggtgccgccaagaaggccgagaagcatctctccgccgcgggcgctatcagactaggcaagctcggtgaagctgatgatggtgcaggaactacagacgaagattacatggcctggaaggactccatcctggaggttttgaaagacgaactgcatttggacgaacaggaagccaagttcacctctcaattccagtacactgtgttgaacgaaatcactgactccatgtcgcttggtgaaccctctgctcactatttgccctcgcatcagttgaaccgcaacgcagacggcatccaattgggtcccttcgatttgtctcaaccgtatattgcacccatcgtgaaatctcgcgaactgttctcttccaatgaccgtaattgcatccactctgaatttgacttgtccggctctaacatcaagtactccactggtgaccatcttgctgtttggccttccaacccattggaaaaggtcgaacagttcttatccatattcaacctggaccctgaaaccatttttgacttgaagcccctggatcccaccgtcaaagtgcccttcccaacgccaactactattggcgctgctattaaacactatttggaaattacaggacctgtctccagacaattgttttcatctttgattcagttcgcccccaacgctgacgtcaaggaaaaattgactctgctttcgaaagacaaggaccaattcgccgtcgagataacctccaaatatttcaacatcgcagatgctctgaaatatttgtctgatggcgccaaatgggacaccgtacccatgcaattcttggtcgaatcagttccccaaatgactcctcgttactactctatctcttcctcttctctgtctgaaaagcaaaccgtccatgtcacctccattgtggaaaactttcctaacccagaattgcctgatgctcctccagttgttggtgttacgactaacttgttaagaaacattcaattggctcaaaacaatgttaacattgccgaaactaacctacctgttcactacgatttaaatggcccacgtaaacttttcgccaattacaaattgcccgtccacgttcgtcgttctaacttcagattgccttccaacccttccaccccagttatcatgatcggtccaggtaccggtgttgccccattccgtgggtttatcagagagcgtgtcgcgttcctcgaatcacaaaagaagggcggtaacaacgtttcgctaggtaagcatatactgttttatggatcccgtaacactgatgatttcttgtaccaggacgaatggccagaatacgccaaaaaattggatggttcgttcgaaatggtcgtggcccattccaggttgccaaacaccaaaaaagtttatgttcaagataaattaaaggattacgaagaccaagtatttgaaatgattaacaacggtgcatttatctacgtctgtggtgatgcaaagggtatggccaagggtgtgtcaaccgcattggttggcatcttatcccgtggtaaatccattaccactgatgaagcaacagagctaatcaagatgctcaagacttcaggtagataccaagaagatgtctggtaa

SEQ ID NO: 45722 - DNA, 741 bp, Saccharomyces cerevisiae
atgccacaattttcagtagatctttgtctttttgacctagatgggactattgtcagcacaacaactgcagcggaaagtgcctggaaaaaattatgccgtcagcatggggttgatcctgttgagttattcaagcattcccatggtgcaagatcacaagaaatgatgaagaaattttttccaaaattggacaataccgataataaaggtgttcttgcgttagaaaaggatatggcagataattatttggacacagtaagccttatccctggtgcagagaatttattgttatcgttagatgtagatactgagactcaaaaaaagttacctgaaaggaaatgggctatcgttacctctggttctccatatttggcattttcatggttcgagacaatattgaaaaatgttggaaagcccaaagttttcattactggatttgacgtgaagaacggtaagcctgatcccgagggttactcaagagctcgtgatttattgcgtcaagatttgcaattaactggtaaacaggatctgaagtatgttgtctttgaagatgcacccgtgggcataaaggccggcaaagcaatgggcgcaattactgtgggtataacatcctcgtatgataagagcgttttatttgacgcaggtgcagattatgtggtctgtgatttgacacaggtttccgtggttaagaacaatgagaacggtatcgttatccaggtaaacaaccctttgacgagagattaa

SEQ ID NO: 45723 - DNA, 741 bp, Saccharomyces cerevisiae
atggcagaattttcagctgatctatgtctttttgacctagatggtaccatagtgagtacaacagtggccgcagagaaagcatggaccaagttgtgttacgaatacggtgttgatccttccgagttatttaagcattctcatggtgcaagaacacaagaggttttgagaaggtttttccctaaattggatgatacagacaataaaggtgttcttgctctagaaaaagatattgcccatagttacttggacacagtaagccttattcctggtgcagagaacttactgttatcgttagatgtagatactgagactcaaaaaaagttacctgaaaggaaatgggctatcgttacctctggttctccatatttggcattttcatggttcgagacaatattgaaaaatgttggaaagcccaaagttttcattactgggtttgacgtgaagaacggtaagcctgatcccgagggttattcaagagctcgtgatttattgcgtcaagatttgcaattaactggtaaacaggatctgaagtatgttgtcttcgaagatgcacccgtgggcataaaggccggcaaagcaatgggcgccattactgtgggtataacatcctcgtatgacaagagcgttttatttgacgcaggagcagattatgtagtctgtgatttgacacaggtttccgtggttaagaacaatgaaaacggtattgtcatccaggtaaacaaccctttgacaagggcctga

SEQ ID NO: 45724 - DNA, 2571 bp, Saccharomyces cerevisiae
atgtcccgtgaagtactgccaaacaacgttaccccattgcattatgacattacactagaacctaatttccgtgcttttacgtttgaagggtcattaaaaattgacctgcagattaatgatcattcgataaactctgtgcaaataaattacttagaaatagatttccattctgcacgtattgagggtgtcaatgccattgaagttaacaaaaacgaaaaccaacaaaaagctactcttgtctttcctaatggaacttttgaaaacctaggaccttctgcgaagttagaaattatcttttccggtattctaaatgatcagatggcgggattttacagggctaagtatacggataaagtcacaggggagacgaagtacatggctactactcagatggaagccacagatgctagaagagcctttccttgttttgacgaaccaaatttgaaggcgacttttgcagtaactttggtctctgaatcgtttctgactcatttgtccaacatggatgtcaggaatgaaacaatcaaagagggtaagaaatatacaacttttaacacgactccaaagatgtctacgtacttagtagcatttattgtagctgacctgagatacgtggaaagcaataatttccgtattccagtaagagtttattctaccccaggggacgaaaaatttggtcagtttgcagccaatttagctgctaggaccttgagattctttgaggacaccttcaacatagaatatccattgccaaagatggatatggtggcagttcatgagttttctgctggtgctatggaaaactgggggctagtgacttatagagttattgatttgttattagacatagaaaattcgagtttagatcgcattcaaagagttgctgaggttattcagcatgaactagcccaccaatggttcggcaacttggtcaccatggattggtgggaaggcttatggttgaatgaaggttttgccacttggatgtcttggtactcttgcaacaagtttcaaccagaatggaaagtttgggagcaatatgttactgacaatttacaacgtgctctaaatttagattcattaagatcttcccatccaattgaagttcccgttaataatgcggacgaaatcaatcaaatttttgatgctatttcttattctaaaggatcttctttattgaggatgatttccaaatggttgggtgaagagacttttattaaaggtgtgtcccaatacctgaataaattcaaatacggtaatgcaaagaccggagatttgtgggacgccttagcagatgcctctggcaaggacgtttgttcggtgatgaacatctggacaaaacgtgttggttttccagtgttatctgtcaaggaacacaagaacaaaatcacattaactcaacaccgttatttaagtaccggtgatgttaaagaagaggaagatacaaccatataccccattttgttagctttgaaagacagtacaggtatcgataacacattggtattgaacgaaaaatctgctactttcgaattaaagaatgaagagttcttcaagattaatggtgaccaatctggtattttcattacctcttattctgacgaaagatgggctaagctatccaaacaggcaaatttattatccgtagaggatcgtgttggcttagtcgcagatgcaaaagccctttctgcatctggctatacctctactactaacttcttgaatttaatttctaattggaaaaacgaggattcatttgttgtttgggaacaaatcattaatagtttatccgctctgaaatctacttgggtcttcgaaccagaggatatattgaatgctctagataaatttactttggatctagtacttaacaaactttctgaattggggtggaatattggcgaagacgactcctttgctatccaacgtttaaaagtgacccttttcagtgccgcatgcacttctggcaatgaaaaaatgcaatcgattgcggtagaaatgtttgaggaatacgccaatgggaacaaacaggccatacctgcactgttcaaggcagttgttttcaacaccgttgccagacttggcggagaaaacaattacgaaaagattttcaacatctatcaaaaccctgtttcgtcagaagaaaagattatcgctttgagagctttgggcagatttgaagacaaagaacttttagaaaggacattgtcttatctgctagatggtacagttttgaatcaagatttttacatcccaatgcaaggcattagagttcataagaagggtattgaaaggttatgggcttggatgcaagaacactgggacgaaattgctaagagattacagccaggctcgcctgtgttgggtggcgtgttgacattgggtttaactaattttacctcttttgaagcccttgaaaaaattagtgcgttctatagtagaaaggtcactaaaggttttgatcaaaccctggctcaagccttagacactattagatccaaggcgcaatgggtgagcagagatcgtgaaatcgttgctacctacttgcgtgagcatgagtatgatcaatag

SEQ ID NO: 45725 - DNA, 447 bp, Saccharomyces cerevisiae
atgttatcaagggccatattcagaaatccagttataaatagaactttattgagagccagacctggtgcttatcatgcaactagattgactaaaaatacgtttattcaaagtaggaagtattctgacgcacatgatgaagaaacctttgaggaattcaccgcaagatacgaaaaggagtttgatgaagcctatgatttgtttgaagtgcaaagagtgctcaacaactgtttttcctatgatttagttcctgctcctgctgttattgaaaaagctttgagggctgccagaagagtcaatgacttacctaccgcaattagagtatttgaggctttgaaatacaaggtggagaatgaagaccaatacaaggcctacttggatgaattgaaggatgtcagacaagaattgggcgttcccttaaaggaagagctatttccaagctcttcttaa

SEQ ID NO: 45726 - DNA, 945 bp, Saccharomyces cerevisiae
atgactgaaggaaagaggctgcaacagatggagcttcctcaaatgaaatccatttggattgacgaggatcaggaaatggaaaaattgtatggattccaagtaaggcaacgattcatgaatggacctagtacggattccgatgaagacgccgacgaagatttaggaattgttctcgttgacagtaaaaagctggctttgccgaacaagaacaacatcaaattgccccctttgcccaattacatgacgatcaaccctaacataaattccaatcacaagtcattaactaataaaaagaagaatttcctgggcatgttcaaaaaaaaggacctgttgtcgaggagacatgggtctgccaaaaccgcaaaacagtcaagtatatctacaccatttgattttcaccatatttcgcatgctaatggtaaaagggaagacaaccctcttgagtcgcacgaagaaaaacatgatgtagaatcattagtcaaattcacgtctttggcaccgcaaccccgaccagattcaaacgtctcttctaaatattccaatgttgtgatgaacgattcgagcagaatagtgtcttcctccacaatagctacaacgatggattctcaccacgatggtaacgaaaccaacaataccccaaatggcaataagcaattagactcgcctacagatttggaaatgaccttggaagacttgagaaattatacatttccttctgttcttggagatagcgtcagcgaaaagaccaatccttcctctccctctgtttcatcattttctggcaaattcaagccaagagagttgagtgcgctacatacgcccgaattaggaaattgtttcaatgtagatcagtcgctaaattcccctggtaacagaatatctgtggatgacgtgctaaaattctactatcaatgtagtgaaactagtactcctcgaaatacctga

SEQ ID NO: 45727 - DNA, 1719 bp, Saccharomyces cerevisiae
atgaagtacatggtagtcagctcgcctatacaagaggttttaagattacataaatatattgagatctctactaccacaatcacagttaaaattacaaataagatgtcctctccagtgattggtatcacctttggtaacacctcttcttctattgcctacatcaacccaaagaacgatgttgatgtcattgccaacccagatggtgagcgtgccattccatccgctttatcctatgtcggtgaagatgaataccacggtggtcaagctttgcaacaattaatcagaaatcctaagaatactatcattaacttccgtgacttcattggtttgccatttgacaagtgtgatgtcagcaagtgcgctaacggtgccccagctgtcgaagttgatggcaaagttggatttgttatttcaagaggcgaaggtaaggaagaaaaacttactgtagatgaagtggtctccagacatttaaacagattaaagttagccgcggaagattacatcggttctgccgtaaaggaagctgtattgacagttccaacaaacttcagtgaagaacaaaagactgcactaaaggcttctgccgccaaaattggtctgcaaattgttcaattcatcaatgaaccttctgctgctttattagcccacgctgaacaattcccatttgaaaaagatgttaacgttgttgttgctgacttcggtggtattagatctgacgctgctgtcattgccgttcgtaacggtattttcactattttggccactgctcatgacctcagcttaggtggtgacaatttggatactgaattagtcgaatattttgctagtgagttccaaaagaagtatcaagccaatccaagaaagaacgctagatccttggccaagttaaaggctaactcttcaattaccaagaagactttgtccaacgcaacttctgccactatttccatcgattccttagctgatggtttcgactatcacgcttctatcaacagaatgaggtacgaattggtagctaacaaggtcttcgcccaattttcctctttcgttgattctgtcattgccaaggctgaattagacccattggacatcgatgctgttcttttgactggtggtgtatcatttactccaaaattaaccactaacttggaatacactttaccagaatcagtcgaaattcttggtccacagaacaagaacgcttctaacaatccaaacgaattagctgcatccggtgccgcattacaagcaagattgattagcgattacgatgctgacgaattggctgaagctttacaaccagttatcgtcaatactccacatttaaagaagcctattggtttgattggtgctaagggcgaattccacccagtattgttggctgaaacttcgttccctgtacaaaagaaattgactttgaaacaagccaagggtgatttcttgattggtgtttacgaaggtgaccatcacatcgaggaaaagactttggagccaattccaaaagaagaaaatgctgaagaggacgatgaaagtgaatggtccgacgatgaacctgaagtcgtcagagaaaaactatacactttgggtaccaagttgatggaattgggaattaaaaacgctaacggtgttgaaattatctttaacattaacaaagacggtgctttaagagtcaccgctagagatttgaaaactggtaatgctgtaaagggtgaattatag

SEQ ID NO: 45728 - DNA, 1632 bp, Saccharomyces cerevisiae
atgaaaaatttaaaattaatcaatgagcatttagcaattgtacatggtatacacagaattgtgacatatcttagaagcaatatataccaagattctgttaagtacttcactgaatcagctataaaaatgtccaaaattgttaagagaaaggaaaagaaggctaacgatgaattaacttctttagcagaaaagattagagcaaaagctttggaaaatcaaaagaagcttatagaagcagaaaaggaaggtggttcagagtccgattctgaagaagatgctactgctgaaaagaaaaaggttttgaaatcaaaaagcaaatccacagtatcaacccaaaatgaaaatactaatgaagatgaatcttttgaatcctttagcgaactgaatctggtccccgaattaattcaagcttgtaagaacttaaattattccaaacccactcccattcaatctaaggcaattcctcccgcgttagaaggtcacgatataattggacttgcgcaaacaggttctggtaaaactgctgcatttgctattcccattttgaatcggttatggcatgatcaggaaccatactatgcgtgcattctagctccaacaagagaattagcacaacagatcaaagaaacatttgactcattaggatccttaatgggcgtgagatcgacatgtattgtgggtggtatgaatatgatggaccaggccagagacctgatgagaaagccacatattatcattgctacacctggtagattaatggaccatttagagaataccaaagggttttcactgaggaaactgaaattcttggttatggatgaagctgatagattattagacatggaatttggacctgttcttgatagaattttaaagatcatcccaacccaagaaagaaccacttatcttttttccgctactatgacttccaaaattgataaattacaaagagcaagtttgacaaatcctgtgaaatgtgccgtgtcaaacaaataccaaaccgtagatacattagtgcaaacactgatggtcgttccaggtggtcttaagaacacatacctaatttatttattaaatgaatttattggaaagacgatgatcatttttacaagaaccaaggccaacgcggaaaggttgtcaggattatgtaatttgctcgagtttagtgccactgcgctacatggtgatttgaatcaaaaccagagaatgggatctttggatcttttcaaggcaggtaagaggtctattctcgtggctacagatgtcgctgcgagagggttggatattccatcagtggacatagttgtaaactacgatattcctgtggattccaagtcctacattcatcgtgtgggaagaaccgcaagagctggtagatcaggaaaatctatctcactagtatcacaatacgatctggaattgatcttaagaattgaagaagttttaggtaaaaaactaccgaaggaaagtgtggacaagaacattatattgaccctaagagattccgtcgataaggctaatggggaagttgtaatggaaatgaacagaagaaacaaggagaagattgccagaggtaagggaagaagaggaagaatgatgacaagagagaatatggacatgggagaaaggtag

SEQ ID NO: 45729 - DNA, 690 bp, Saccharomyces cerevisiae
atggatggaaatcataggtttactccagattccaaagaatttaatactgttgtaaaaagtaaagagtcttccactggcagaaatccgtatcagactccgcccttagagcacaacggtactcatcatcagacaaattacagcagaaagaaaacaaatctagcaattatcatatcgaatttcttgtccgagatcagtcggcctctttcaaatggcaaaatcaataattctacccacaacattttaaaatttctaaatgaagtgcttaagagatcgaagtgcagtaaagaaaacgctgtgttagccactttctactttcaaaagattcaccaatccagaggtgtccgggatgagtcctcattgcctgaattctcgcactgttcccgcagaatttttctctgctgtcttattctatcgcacaaatttttgaacgacaacacttactcgatgaaaaattggcaaattataagtgggctccatgcaaaggatctatctctaatggaaagatggtgtctgggtaagctgaattatgagctggccattccatatgacgagtttttgctatgggaaacgaacactttaatgaaagcgaaattgcgcgtcggaactcccgccaacgctccggtgaagagacccagagaatcagacaatgattatgatgcaaattcttggaaacagattaaatcttgttaa

SEQ ID NO: 45730 - DNA, 1223 bp, Saccharomyces cerevisiae
taatcaaaacggagttacagaatactgattccttgtgtatagcacctgttaaccaggcgttttgcgcacttgtcactcttattgaagaaggggtagactcggaagcgttccagcgtctccaatataggttcaaggatgcattgttccatggtccacagggtatgaccattatgggaacaaatggtgtgcaaacctgggattgtgcgtttgccattcaatactttttcgtcgcaggcctcgcagaaagacctgaattctataacacaattgtctctgcctataaattcttgtgtcatgctcaatttgacaccgagtgcgttccaggtagttatagggataagagaaagggggcttggggcttctcaacaaaaacacagggctatacagtggcagattgcactgcagaagcaattaaagccatcatcatggtgaaaaactctcccgtctttagtgaagtacaccatatgattagcagtgaacgtttatttgaaggcattgatgtgttattgaacctacaaaacatcggatcttttgaatatggttcctttgcaacctatgaaaaaatcaaggccccactagcaatggaaaccttgaatcctgctgaagtttttggtgacataatggtagaatacccatacgtggaatgtactgattcatccgttctggggttgacatattttcacaagtacttcgactataggaaagaggaaatacgtacacgcatcagaatcgccatcgaattcataaaaaaatctcaattaccagatggaagttggtatggaagctggggtatttgttttacatatgccggtatgtttgcattggaggcattacacaccgtgggggagacctatgagaattcctcaacggtaagaaaaggttgcgacttcttggtcagtaaacagatgaaggatggcggttggggggaatcaatgaagtccagtgaattacatagttatgtggatagtgaaaaatcgctagtcgttcaaaccgcatgggcgctaattgcacttcttttcgctgaatatcctaataaagaagtcatcgaccgcggtattgaccttttaaaaaatagacaagaagaatccggggaatggaaatttgaaagtgtagaaggtgttttcaaccactcttgtgcaattgaatacccaagttatcgattcttattccctattaaggcattaggtatgtacagcagggcatatgaaacacatacgctttaa

SEQ ID NO: 45731 - DNA, 3327 bp, Saccharomyces cerevisiae
atgttagtattgacactgctcgtttgtgtgttttcatccatcatttcatgctcaatcccattgtcgtctcgcacctcaaggcggcagatagtggaagatgaagttgcctccactaaaaagctcaatttcaactatggtgtggataaaaatataaactcgcccattcctgctccaagaaccactgaaggtttaccaaatatgaaactcagctcatatccaactcctaacttattgaatactgctgataatcgacgtgctaacaaaaaaggacgtagggctgccaattctataagtgtaccctatttggagaatcgttccttgaacgaactgagtttatcagatatactaatcgcagccgacgttgagggtggacttcatgctgtagatagaagaaatggtcatatcatatggtcaatcgaaccagaaaattttcaacctctgatagaaatacaagaaccttcgaggttagaaacatatgaaacgttgattatagaacctttcggtgatgggaacatttactactttaacgcccatcaagggttacaaaaactgcctttatccatacgacaacttgtatcaacttccccgctgcacttgaaaacaaatattgtggttaatgactctggaaaaattgttgaagatgaaaaggtctacactggatcgatgagaactataatgtatactataaacatgttgaatggtgaaattatatcagcgttcggacctggttcaaaaaacgggtatttcgggagccagagtgtggattgctcacctgaggagaagataaaacttcaggaatgtgaaaatatgattgtaataggcaaaactatttttgagctgggaattcactcttatgatggagcaagctacaatgtcacttactctacatggcagcaaaatgttttagatgttcccctagcgcttcagaatacattttcaaaggacggcatgtgcatagcgcctttccgtgataaatcattgctagcaagcgatttagattttagaattgctagatgggtttctccgacattccccggaattattgttgggcttttcgatgtgtttaatgatctccgcaccaatgaaaatatactggtaccgcatccctttaatcctggtgatcatgaaagtatatcgagtaacaaagtttacttggatcagacttcgaacctctcctggtttgcattatctagtcagaattttccatctttagtcgaatcagctcccatatcaagatacgcttccagtgaccgttggagggtgtcttcaatttttgaagatgagactttattcaagaacgcaatcatgggtgttcatcagatatataataatgaatatgatcacctttatgaaaactatgaaaaaacgaatagtttggacactacgcacaaatatccacctctgatgattgattcgtccgttgatacaaccgatttacatcagaataacgagatgaattcactaaaggaatacatgtcaccagaagaccttgaggcatatagaaaaaagatacacgagcaaatatcgagagaattagatgaaaagaaccaaaattctttgctactgaagtttggaagtctagtatatcgaattatagagactggagtatttctgttgttatttctcattttttgtgcaatactacaaagattcaaaattttgccgccactatatgtattattatccaaaattggatttatgcctgaaaaggaaatccccatagttgagtcgaaatcgctaaattgtccctcttcatcggaaaatgtaaccaagccattcgatatgaaatcagggaagcaagttgtttttgaaggtgctgtgaacgatggaagtctaaaatctgaaaaagataacgatgatgctgatgaagatgatgaaaaatcactagatttaaccacagaaaagaagaagaggaaaagaggttcgagaggaggcaaaaagggccgaaaatcacgcattgcaaatataccaaactttgagcaatctttaaaaaatttggtagtatccgaaaaaattttaggttacggttcatcaggaacagtagtttttcagggaagttttcaaggaagacctgttgcggtaaagagaatgttaattgatttttgtgacatagctttaatggaaataaaacttttgactgaaagcgatgatcaccctaacgtcatacgatactactgttcagaaacaacagacagatttttgtatattgctttagagctctgcaatttgaaccttcaagatttggtggagtctaagaatgtatcagatgaaaacctgaaattacagaaagagtataatccaatttcgttattgagacaaatagcgtccggggtagcacatttacattctttaaagattatccatcgagatttaaagcctcaaaatattctcgtttctacttcgagtaggtttactgccgatcagcaaacaggagcagaaaatcttcgaattttgatatcagactttggtctttgcaaaaaactagactctggtcagtcttcatttagaacaaatttgaataacccttctggcacaagtggttggagggccccagagctgcttgaagaatcaaacaatttgcagtgccaagtcgaaacggaacactcttctagtaggcatacagtagtttcatctgattctttttatgatccgttcaccaagaggaggctaacaagatctattgatattttttctatgggatgtgtattctattatatcctatccaaagggaagcatccatttggagataaatattcacgtgaaagcaatatcataagaggaatattcagtcttgatgaaatgaaatgtctacatgatagatccttaattgcagaagctacagatctgatctcccaaatgattgatcacgatccgttaaaaagacctactgctatgaaagttctaaggcatccgttgttttggccaaagtcgaaaaaattggagttccttttaaaagttagtgataggcttgaaattgaaaacagagaccctccaagtgccctgttaatgaaatttgacgccggttctgactttgtaatacccagtggagattggactgtcaagtttgataaaacattcatggacaaccttgaaaggtacagaaaataccattcatcaaagttaatggatctattaagagcacttaggaataaatatcatcattttatggatttacctgaagatatagcagaactaatggggccggtacccgatggattttacgattacttcaccaagcgttttccaaacctattaataggtgtttatatgattgtcaaggaaaatttaagtgacgatcaaattttacgtgaatttttgtattcataa

SEQ ID NO: 45732 - DNA, 2067 bp, Saccharomyces cerevisiae
atgaaagtccaaataaccaatagtagaacagaggaaatcttaaaagttcaagctaataatgaaaacgatgaagtcagtaaagctactccgggcgaagttgaagaatcgctaaggttaatcggcgatctaaaattctttttagccacagcgccggtaaattggcaagaaaaccaaattataaggcgatactatctgaatagtggacaaggctttgtctcttgtgtattttggaacaatctatactatattacaggtactgatattgtcaaatgttgtctttacagaatgcaaaagtttgggagagaagtagttcaaaagaaaaaatttgaagagggtattttttcagatttaagaaatctcaaatgtggtatagatgcaactttagaacaaccaaagtccgaatttttgtcgtttctattcagaaatatgtgtctgaaaacccaaaaaaagcagaaagtatttttttggttcagtgtagcacatgataagttgtttgcggatgcgttggaaagagatttaaaaagagaaagtttgaatcagccttcaacgactaagcccgttaatgagcccgccttatctttttcatatgattcctcatctgataagcctctctacgatcagttacttcaacatttagattctagaagaccatctagtacaacaaaatcagataattcgcctccaaaattagaaagcgagaattttaaggataatgagttggtaacagtaactaatcagccgcttttaggcgttggcctcatggatgacgatgcgccagaatccccctctcaaattaatgattttattcctcagaaattgattatagaacccaatactctcgaattgaatggtctcacagaagaaacgcctcatgacttacccaagaataccgctaagggcagagacgaagaagattttcctctcgactattttcctgtatctgttgaataccctacggaggaaaatgcgtttgatccgttccctccacaggcttttacgccagctgccccttccatgcctatttcctatgataacgtgaatgaaagggattctatgcccgttaattctcttcttaatagatacccctatcagttatcagtggcacccactttcccagtgccaccatcatcatcgaggcaacattttatgacaaatcgggatttttattcatctaacaataacaaggaaaaattggtatctcctagcgaccctaccagctacatgaagtatgacgaaccagttatggattttgatgaatctcggccaaatgaaaactgtacaaatgcaaaatctcacaactctggccagcaaactaaacaacaccaattatattctaacaacttccagcaatcttacccaaacggaatggttccaggatactacccaaaaatgccgtataatcccatggggggggatcctctactcgatcaagccttttatggcgcggacgattttttctttccaccagaaggatgtgataacaatatgctgtatccacaaactgcaacttcatggaatgttttgccccctcaagctatgcaaccagctccaacctatgttgggagaccatacacaccgaattatagatcgacaccaggttccgcgatgttcccatacatgcaaagttcaaattccatgcagtggaacactgctgtttcaccttatagttcgagagcaccatctacaactgctaaaaactatcctcctagcacattttattctcaaaatataaatcaatacccacggcgaagaactgtgggaatgaagtcttcacaaggaaatgttccaacaggtaataaacaatctgtgggcaagtctgcaaaaatttcaaagcctctacatattaagacaagtgcttatcagaagcaatacaaaatcaacttggaaacgaaagccaggccaagtgctggtgacgaagattctgctcatcctgataagaacaaagaaatttcgatgcctactccggattccaatactttggtggtccagtcagaagaaggtggagctcattcacttgaggtagataccaatcgaaggtccgataaaaaccttccagatgcaacctga

SEQ ID NO: 45733 - DNA, 1683 bp, Saccharomyces cerevisiae
atgtctgaagaagctgcctatcaagaggatacagcagtccaaaatactccagctgatgctttgtcgccagttgaatccgattctaattccgctttgtctactccatccaacaaagctgaaagagatgacatgaaagatttcgacgagaatcacgaagaatctaataactacgttgaaattccaaagaagcccgcctccgcctacgttacagtttccatctgttgtttaatggttgctttcggtggttttgttttcggttgggatactggtaccatttctggttttgttgctcaaactgattttatcagaagatttggtatgaagcaccacgatggtacttattatttgtctaaggttagaactggtttaattgtctccattttcaacattggttgtgccattggtggtattattttagcaaaattaggtgatatgtatggtcgtaaaatgggtttgattgtcgttgttgtcatctacattatcggtatcattatccaaattgcctcaatcaacaagtggtaccaatatttcattggtagaattatctctggtttaggtgtcggtggtattgccgttttatctcctatgttgatttctgaagtctctccaaagcatattagaggtactttggtttcatgttaccaacttatgattactttgggtattttcttgggttactgtacaaactacggtaccaagacctacaccaattctgtccaatggagagttccattaggtctaggtttcgcttgggctttgtttatgattggtggtatgacattcgttccagaatctccacgttatttagttgaagtcggtaaaattgaagaagctaagcgttctattgctctttcaaataaggtcagcgcagacgatccagctgttatggctgaagtcgaagttgttcaagctacagttgaagctgaaaaattagctggtaatgcctcctggggtgaaatatttagcactaagactaaggttttccaacgtttgatcatgggtgctatgattcaatcattgcaacaattgacaggtgataactatttcttctattacggtactaccgttttcactgctgtcggtttggaagattcttttgaaacttctattgtcttgggtattgtcaactttgcttccacctttgttggtattttcttagtcgaaagatatggtcgtcgtagatgtttattatggggtgctgcttccatgacagcttgtatggttgttttcgcttctgttggtgttacaagattgtggccaaatggtaagaagaacgggtcttctaagggtgctggtaactgtatgattgtcttcacatgtttctacttattctgttttgccactacctgggctccaattccatttgttgttaactctgaaactttcccattgagagttaagtccaagtgtatggctattgctcaagcttgtaactggatctggggtttcttgattggtttctttactccatttatttcaggtgctattgatttctactacggttatgttttcatgggctgtttggtcttttcttacttctacgtcttcttcttcgttccagaaactaaaggtttgactttagaagaagttaacaccttatgggaagaaggtgttttgccatggaaatcaccttcttggttccaccaaacaagagaggtactgactacaacgctgatgatctaa

SEQ ID NO: 45734 - DNA, 1713 bp, Saccharomyces cerevisiae
atgaattcaactcccgatctaatatctcctcagaaatccaattcatccaactcatatgaattggaatctggtcgttcaaaggccatgaatactccagaaggtaaaaatgaaagttttcacgacaacttaagtgaaagtcaagtgcaacccgccgttgcccctccaaacaccggaaaaggtgtctacgtaacggtttctatctgttgtgttatggttgctttcggtggtttcatatttggatgggatactggtaccatttctggttttgttgctcaaactgattttctaagaagatttggtatgaagcaccacgacggtagtcattacttgtccaaggtgagaactggtttaattgtctctatttttaacattggttgtgccattggtggtatcgtcttagccaagctaggtgatatgtatggtcgtagaatcggtttgattgtcgttgtagtaatctacactatcggtatcattattcaaatagcctcgatcaacaagtggtaccaatatttcattggtagaattatctctggtttaggtgtcggtggtatcacagttttatctcccatgctaatatctgaggtcgcccccagtgaaatgagaggcaccttggtttcatgttaccaagtcatgattactttaggtattttcttaggttactgtaccaattttggtaccaagaattactcaaactctgtccaatggagagttccattaggtttgtgtttcgcctgggccttatttatgattggtggtatgatgtttgttcctgaatctccacgttatttggttgaagctggcagaatcgacgaagccagggcttctttagctaaagttaacaaatgcccacctgaccatccatacattcaatatgagttggaaactatcgaagccagtgtcgaagaaatgagagccgctggtactgcatcttggggcgaattattcactggtaaaccagccatgtttcaacgtactatgatgggtatcatgattcaatctctacaacaattaactggtgataactatttcttctactacggtaccattgttttccaggctgtcggtttaagtgactcttttgaaacttctattgtctttggtgtcgtcaacttcttctccacttgttgttctctgtacaccgttgaccgttttggccgtcgtaactgtttgatgtggggtgctgtcggtatggtctgctgttatgttgtctatgcctctgttggtgttaccagattatggccaaacggtcaagatcaaccatcttcaaagggtgctggtaactgtatgattgttttcgcatgtttctacattttctgtttcgctactacctgggccccaattgcttacgttgttatttcagaatgtttcccattaagagtcaaatccaagtgtatgtctattgccagtgctgctaactggatctggggtttcttgattagtttcttcaccccatttattactggtgccatcaacttctactacggttacgttttcatgggctgtatggttttcgcttacttttacgtctttttcttcgttccagaaactaaaggtttatcattagaagaagttaatgatatgtacgccgaaggtgttctaccatggaaatcagcttcctgggttccagtatccaagagaggcgctgactacaacgctgatgacctaatgcatgatgaccaaccattttacaagagtttgtttagcaggaaataa

SEQ ID NO: 45735 - DNA, 1779 bp, Saccharomyces cerevisiae
atgtcggaacttgaaaacgctcatcaaggccccttggaagggtctgctactgtgagcacaaattctaactcatacaacgagaagtcaggaaactcgactgctcctggtaccgccggttacaacgataatttggcacaagctaaacccgtctcaagttacatttcccatgaaggccctcccaaagacgaactggaagagcttcagaaggaggttgacaaacaactagagaagaaatcgaagtcggatttactatttgtatccgtctgctgtttgatggttgcttttggtgggttcgtgtttgggtgggatactggtactatatctggttttgtcaggcaaacagacttcattaggcgatttggcagcacccgtgcaaacgggactacctatctttccgatgtcagaaccggtttgatggtttctattttcaacatcggctgcgctatcggaggtatagttttgtcaaagctcggtgatatgtatggacgtaagattggtctgatgactgttgtcgtcatttactcaattgggatcatcatccaaatcgcctccattgacaaatggtatcaatatttcattggaagaatcatctcaggactgggcgttggtggtattacagttttggcgcctatgctaatttctgaagtgtcgcctaagcagttgcgtggtactctggtttcatgttaccaattaatgatcactttcggtatctttttgggatattgtactaattttggtaccaagaattactcaaactctgtccaatggagggtaccattaggcttatgctttgcatggtctatttttatgattgttggtatgacgttcgttcctgaatccccacgttatctggtagaagtgggaaaaattgaagaggccaagcggtccttagcaagagctaacaaaaccactgaagactctcctttagtaactttagaaatggagaactatcagtcttctattgaagctgagagattggcgggctctgcttcttggggggaattggttactggtaagccccagatgttcagacgtacactaatgggtatgatgattcaatctttacaacagctgacaggtgacaattacttcttttactatggtactacaattttccaggctgttggtttggaagattcatttgaaactgctattgttttgggtgttgttaattttgtttcgacttttttctcgctatataccgtcgatcgttttggtcgtcgtaattgtttgttatggggctgtgtaggtatgatttgttgctatgtcgtctatgcctctgttggtgttaccagattatggccaaacggtcaagatcaaccatcttcaaagggtgctggtaactgtatgattgttttcgcatgtttctacattttctgtttcgctaccacttgggcccccgttgcctatgtccttatctctgagtcgtatcccttaagagtacgtggtaaagcaatgtcgattgcaagtgcctgtaactggatttgggggttcttgatcagttttttcactccatttattacttcagcaatcaatttctattatggctatgtctttatgggttgtatggtgttcgcatacttttatgtgttcttctttgttccagagacaaagggcttaacattagaagaagtcaacgaaatgtatgaagaaaatgtgctaccttggaagtctaccaaatggatcccaccatctaggagaacaacagattatgacctagacgctactagaaatgatccgagaccattttataaaaggatgttcactaaagaaaaataa

SEQ ID NO: 45736 - DNA, 984 bp, Saccharomyces cerevisiae
atgtcttcactggttactcttaataacggtctgaaaatgcccctagtcggcttagggtgctggaaaattgacaaaaaagtctgtgcgaatcaaatttatgaagctatcaaattaggctaccgtttattcgatggtgcttgcgactacggcaacgaaaaggaagttggtgaaggtatcaggaaagccatctccgaaggtcttgtttctagaaaggatatatttgttgtttcaaagttatggaacaattttcaccatcctgatcatgtaaaattagctttaaagaagaccttaagcgatatgggacttgattatttagacctgtattatattcacttcccaatcgccttcaaatatgttccatttgaagagaaataccctccaggattctatacgggcgcagatgacgagaagaaaggtcacatcaccgaagcacatgtaccaatcatagatacgtaccgggctctggaagaatgtgttgatgaaggcttgattaagtctattggtgtttccaactttcagggaagcttgattcaagatttattacgtggttgtagaatcaagcccgtggctttgcaaattgaacaccatccttatttgactcaagaacacctagttgagttttgtaaattacacgatatccaagtagttgcttactcctccttcggtcctcaatcattcattgagatggacttacagttggcaaaaaccacgccaactctgttcgagaatgatgtaatcaagaaggtctcacaaaaccatccaggcagtaccacttcccaagtattgcttagatgggcaactcagagaggcattgccgtcattccaaaatcttccaagaaggaaaggttacttggcaacctagaaatcgaaaaaaagttcactttaacggagcaagaattgaaggatatttctgcactaaatgccaacatcagatttaatgatccatggacctggttggatggtaaattccccacttttgcctga

SEQ ID NO: 45737 - DNA, 1224 bp, Saccharomyces cerevisiae
atgagtgctgccactgcgactgctgcccctgttcctcctcctgtagggatatccaatcttcccaaccagcgttataaaattgttaatgaagaaggtggtacattcaccgtgatgttatgtggtgagagcggattgggtaaaactacatttattaataccttatttcagactgtcttgaaaagggcagatggtcagcaacaccgccaagaacccatcagaaagactgtagaaatcgacatcacaagagctttgctggaagagaagcatttcgaattacgcgttaatgtcatcgacaccccaggttttggagataacgtgaataacaacaaagcctggcaaccattggtggattttattgatgatcaacacgattcttatatgcgtcaagagcagcaaccgtaccgtactaagaaatttgacttgagagttcatgccgttctgtacttcatcaggcccactggacatggtttaaagccaattgacattgagactatgaagagattgtcaaccagagccaatctgattccagttattgcgaaagctgatacattgactgcccaagaattacaacagttcaagtccagaatcaggcaagtaatagaagctcaagaaattcgtattttcacgcctccattagacgctgattctaaggaagatgccaaaagtggcagtaatccagattctgccgctgttgaacatgcaagacagttgatagaagcaatgccatttgccatagtagggtctgaaaaaaaatttgacaatgggcaaggcactcaggtagttgcaaggaagtatccttggggacttgtggaaatcgaaaacgattctcattgtgatttccgtaagctcagagccctgttactgaggacttatctattagatttgatttctaccacccaagaaatgcattacgaaacatacagaagattaagacttgagggtcacgagaacaccggggaggggaatgaagatttcactcttccagcaattgcaccagcaaggaaattgtcacacaatcctagatacaaagaagaagaaaatgcattgaagaagtatttcactgaccaagtcaaagctgaggagcaaagatttagacaatgggagcaaaacattgttaacgaaagaatcagactgaacggtgacttggaagaaattcaaggaaaggtaaaaaaactagaagagcaggtcaaaagcttgcaagtaaaaaaatcccatttaaaatga

SEQ ID NO: 45738 - DNA, 1137 bp, Saccharomyces cerevisiae
atggtggacttgtcaacagctttgattcatggcgatgataaagataacagggttactgacgtggcgcccccaattaatgtctctacaaccttccgttacgacgatgacgacctaattccatggacagagcgtgaaaacttggactttatggagaagaagcccgtatattcacggctagcgcatccaaatagcaccagattagagagtatcttctcagagatcctcgatggttatgctgtcatttattcttcagggttagctgcgttctatgcggcaatggtacattacaaccctaagaagatctttatcggacagagctaccatggtgttcgagcaattgctaacatattgacccgtaattacggcattgagcaacaccccttggaagatattgaaaaatgtgcttctgaaggtgacattgtccatctggaatctcctgtaaacccatatggtacctcttctgatatcgagagtttggcccgcagagctcatgcaaaaggcgccctgcttatagtggattccacattcgcatctcctccattgcaatacgcatggaatttcggagccgatattgtcctatactctgctactaagtactttggtggtcattctgacttgttaagtggcgtccttgtagtcaaagaggaagcaacttcccgacaactaaaagacgacagaatctacttgggtacaaacgtggcaaatttggaaagtttcatgttgttgcgatccctgagaacctacgaaatgagaataaccaaacaatcagaaaatgctacgaaattagttagatttttgtcagatcaccaatctgaatttgacaaagtattgaagacgatttaccactcttctttacaaacagaagagttcgttaaaaagcaactggtaggaggatatggtcccgtttttgctatcactttgtacaccaaagagcagtgtaaacaattacccctcaagctgaaatatttccatcatgcgacctcactgggtggaattgaatcccttgtggaatggagagcaatgactgacccatatatcgaccaaactttaataagagtatctgtgggctgtgaatccgctaatgatttgattaaggatttggcttcggccttgaaagaattgcaggatgcagcctga

SEQ ID NO: 45739 - DNA, 2880 bp, Saccharomyces cerevisiae
atgaagcatttctttaggctaccgacagcattccggcccatttctagggtttccttacgatattctagtactgataccgctcaaccaaaaatatcaaaactcaaaattagttttaataaaatttctgaatcaaatagcgaaaaaaaagataatttgggttcaattgacacacgaaattgtctttcgactcagcaagatgacaaactatcaagcactgagccctcgaaggcttcccttccaccatcattacaatatgttcgtgacttgatggatttgtataaggatcatgtggttttaacacaaatggggtcattttatgaactttactttgaacaagcaattagatacgctccagaattaaatatatcattgacgaatcgagcttatagtcatggcaaagttccatttgctgggtttcctgtacaccagttaagtcgacatttaaaaatgcttgttaacaattgcggatacagtgtaactatcgcagagcaattcaaaaaaaaggacgtggcagataatgaagccaataaattctataggagagtgactagaatcgttactcccggcacttttattgatgaagcatttgaaaatttgagggaaaatacatatctcctgaacatcgaatttcctgaaaactgtatgagtcaagtggcagacacgagtctaaaagttggtatatgttggtgtgatgtgagtactggggagatatttgttcaacaagtgtatcttagagatttggtttctgcaataacaagaattcaacctaaggagattttattagatgaaagattacttgagtttcatatcgagtcagggacgtggtatcctgaacttgttgagcttaaaaaattttttataaaatatcagaaaatgcccagtcaacatcgcactattgaatcattctatgggctgtttaatttgggaggtaaagaagcaacggaaaggcaattgaaaatccaatttcaaacttttactcagaaggagttagctgctttgaggaatacattaatatacgtaagtaatcatctacctgatttctctattaattttcagattcctcagagacaattagcaacggcgataatgcaaattgattcaagaaccagcactgcacttgaattgcattctactgtaagagacaacaataaaaaaggctctctgttatcatctataagaaggacagttacaccttcaggaacaagacttctgtctcaatggttgagtggaccttcccttgatttgaaagaaattaaaaagcgtcagaaaattgtagcatttttcaaagacaaccgtgatatcactgaaacactacggactatgttgaaaaaagtaaatgatctatcccgtatacttcaaaagtttagtttcggaaggggcgaggcattagaacttattcaaatggcacgttcactagaggtttcaagagaaataagaaaatatttactaaataacacgtcgttgatgaaagctacattaaagagtcaaatcacacagctgactgagtctttaaattttgaaaaaaatttgattgatgatattttgaagtttttaaatgaggaagagctagcaaagtcacaagatgctaaacagaatgcagatgtaactagaatgcttgacatagatgtaaaagacaagaaagaaagtaacaaagatgagatttttgaattaagagattttatcgtaaacccttcgttcaataccaaacttaggaaattgcatgacacttatcagggcgtttggcaaaaaaaaactgagtacaatgctttattaaaaggtttttttgttggcgacctaggtgctaagactttcaccttgaaggaaaggcaaaacggtgagtatgccctccatgtgacaggaacagcctctagtttaaagaaaattgatgagttaattagtaaatcgacggagtaccacggaagttgcttccatattttgcaaaaatcaagccaaacacgatggttgagtcacaaaatttggacagacttggggcacgagttggaattattaaatttaaagattaggaatgaagaggctaatattattgatctttttaaaaggaaatttattgatagaagtaacgaggtcagacaagttgcaactacactgggctatcttgataccttatcgtcctttgctgtgttagctaacgagagaaatttagtctgcccaaaagtggatgagagcaataaactagaagtagtgaatgggagacatctaatggttgaagagggtctttccgcgcgctctttggagacattcacggccaataactgcgaattggcgaaggacaatttatgggtaattaccggaccgaatatgggtggtaaatctacattcttaagacagaatgcaattatagtcattctggcgcaaattggatgttttgttccatgcagtaaggcgcgtgtgggtattgtagataagctttttagccgagttggttcagcagatgatctgtacaatgagatgagtacgttcatggttgagatgatagaaacatcgttcatcttgcaaggagctacggaacggtctttagctattctagatgagattggccgtgggactagtggtaaagaaggcattagcatcgcttatgcaactttaaagtatttgttagagaacaatcaatgcagaacgctttttgctacacattttggtcaagaactgaagcaaatcattgataacaaatgttcgaaaggaatgagcgaaaaggtcaagttttaccaaagcggaatcactgatttaggtggaaacaatttttgttacaaccataagttgaagccgggcatctgcacgaaatcagatgccattagagttgcggaattggccggatttccaatggaagcgttaaaagaagcccgcgaaatattgggataa

SEQ ID NO: 45740 - DNA, 1267 bp, Saccharomyces cerevisiae
atgggatattttgttccggattcacatatcgaaaatctaaagtcatataagtatgtgaagcgtccattggctgcctttaaagtgcagaagtcagaagcattgttactaactttcaacaatttttattccttttcatgatagatatcaaagtgaagaccgctcgctggtatcgaagtatttcttaaagccattttggcaaagattttgtcacatatttcccacgtggatggcgcccaacatcatcacattatcaggatttgcttttatagttatcaacgtgttgactgtattctattacgatccaaaccttaacacagatacgcctcgctggacatatttttcttacgctttaggtgtattcctatatcaaacgttcgatggatgtgatggtgtacacgctcgccgtatcaatcaatcaggacccttaggagaactattcgatcatagtattgatgccattaattctactctgtctattttcatcttcgcatccgaaactggaatgggattttcgtataacttaatgttatcccaatttgcgatgctgacgaatttttacttaagtacttgggaagagtaccatacacacacattatacttaagtgagttttctggacccgtggaaggcatcctgattgtttgcgtttcattgatactgacaggtatatacggaaaacaggtaatctggcatacctacttatttacaattacagttggtgataaggtaattgatgtagacactctagatattgttttttccctagctgttttcggtttggttatgaacgcattgtctgcgaaaagaaacgtggataagtattatagaaacagcacttcttcggccaacaatatcacgcaaattgagcaagatagtgctataaaaggtcttttgcccttttttgcctattatgcaagcattgctttactagtgtggatgcaaccaagctttattacactctctttcatcctttccgttggtttcacgggagcatttaccgtcggaagaataatcgtttgccatttaactaagcagagctttcccatgttcaatgcacccatgttaattcctttgtgccagatagtattgtacaaaatatgtctatccctttggggaattgagtctaataaaatcgtctttgccctatcttggcttgggttcggtctctcactaggtgttcacattatgtttatgaatgacattatccatgaatttactgagtacctggacgtttatgctttatccatcaagcgctccaagctgacataa

SEQ ID NO: 45741 - DNA, 1155 bp, Saccharomyces cerevisiae
atggaccagctaagtgacagctatgctttgtacaatcaaccggtagtgatcgacaatggttctgggatcataaaagcaggatttagtggtgaggaaaggcctaaagcactggaatattgtctcgtaggaaataccaaatatgataaagttatgctcgaaggtctgcaaggagatacatttattggaaacaatgcccaaaaactgcgtggattattaaaattacgataccccataaagcacggcgtggtggaagattgggattctatggaactaatatggtcatatgtgttaaatgaagtcctacagttgcaaaatataggtgagcatcctttattaattacggaagccccgatgaatcctttgaagaatagagagcagatggctcaagtattgttcgagacctttgacgtatcggctttgtacgtttcaaaccctgctgttctgtcattatatgctagtgggagaactacaggttgtgtagttgactgtggtgaaggatactgtagcactgttcccatatatgacggctttgcattacctgcgtctatgatgaggatggatattggaggagcagatatcacagagcagttacaatttcaactacggaaatcagctggtgtttcgttgttttccagcagtgaacgagagattgttcgcacgatgaaagagaaagtttgttatttggccaagaatattaaaaaggaagaggagaaatacttacaaggtactcaagatttaatctcgacattcaaattgcccgacgggaggtgtatagaggtggggaatgatcgatatcgtgctccagaaatattattttcacctcaaatcatcggcttagggtacgatggattatctgatatgtgcatgcaatctatttggaaagtcgatctggatttaaggaaacctttactgtcatcgataatcctaagtggcggaactacaacgcttaaaggctttggagaccgaatgctatgggatttggaggcattaaccaaaggaacatccaagataaagattatagccccttcagaaagaaaatatactacatggattggtggttctattttaacggggttatctacctttcaaagactttggaccaaaaagtcagattggctagaggacagtacccgtgtttattcgaacctaatgtaa

SEQ ID NO: 45742 - DNA, 1293 bp, Saccharomyces cerevisiae
atgttgcacatgaattcgttgtggggttgttttcttttcgttttactagccgtgacaggtgctgtgcagggtctccaagaggattacagtgaatacgctgtttacaggtttacttcagacaactattctaccctggtaagagatgtgatcgcaccgctgacagatgattatgatgtatggacgagaagcaataatttcattgatattaagttgcctaaagaaataggtgagcagataaatgatgggcaggtgatcatagataacatgaatgaattgatacaaaatacattgcctacaagtcagatgatggcacgtgagcaggctgtttttgaaaatgattacgatttcttctttaacgaatacagggacctggatactatttatatgtggttggatcttctagaaagaagctttcccagtttggttgcagtggaacacttgggcaggacatttgaaggcagagagctaaaagctctgcatatatccggaaacaagccagaatcaaacccggaaaagaagactattgttatcacaggtggtatacatgccagagagtggatcagtgtcagtaccgtctgttgggcactttatcagttgttaaatcgatatggttcgtctaagaaggaaaccaaatacctggacgatttggactttttagtcatacctgtgttcaatccagacggatacgcatatacgtggtcgcatgacagactatggcgtaagaatcgtcaaaggactcatgttcctcaatgtcttggtatcgacattgatcattcctttggtttccagtgggaaaaggcacacacccacgcttgcagcgaagagtatagtggggaaacgcccttcgaagcttgggaagcatctgcttggtacaagtatattaatgaaaccaagggcgattacaaaatttatggctacattgacatgcattcgtattcacaggagattttatatccctacgcatactcgtgtgatgccttgcccagagacttagaaaatttgttggagttatcatatggcttatccaaggccatccgttcaaaatcaggtagaaactacgacgtaatctccgcatgtaaggaccgtggttccgacatattccccggcctcggtgcaggttctgcgttggacttcatgtaccaccacagagcacattgggcattccagttgaaattacgggatacagggaaccatggatttttattgcctccagaaaacatcaagccagttggaaaggaaacttatgctgctttaaagtacttttgtgacttcctactagacccagagatataa

SEQ ID NO: 45743 - DNA, 1617 bp, Saccharomyces cerevisiae
atgtccatgcccatagcaagtaccactctagcagttaacaacctcaccaatataaacggaaacgcaaattttaacgtacaagcaaacaaacaactccaccaccaggctgtcgactcgcccgcaagatcttcgatgaccgccacgaccgccgccaactccaacagcaactcttccagagatgactctactattgtcggcctacattacaagatcggcaaaaaaataggggaaggttcctttggtgtgctatttgaaggtactaatatgatcaatggcgtacccgtcgcgatcaaattcgagcccagaaaaacggaggcccctcaattaagagatgaatataaaacatataaaattctgaatggcactcccaatatcccctacgcgtactacttcggccaagaaggtttgcacaatatcttggtcattgatcttttgggtccctctttggaagatttatttgattggtgtggaagaaaattttctgtcaaaacggttgtgcaagttgctgtccaaatgattactttgattgaagacttgcacgcacatgacttgatataccgtgatatcaaaccagacaatttcttgattggaaggcccggccaacctgacgcaaacaacatccatttgatcgacttcggtatggccaaacagtatcgtgatccgaaaactaaacagcacatcccatatagagagaaaaaatcactcagcggcactgccagatatatgtccattaatactcaccttggaagagagcagtccagaagagatgatatggaggccttgggtcacgttttcttttatttcttgagaggccacttaccctggcagggtttaaaagctccaaacaataagcaaaaatacgaaaagattggtgaaaagaaaagatctactaacgtttacgatctagctcaaggcttacctgtgcaatttggcaggtatctagaaatcgtcagaagtctttcctttgaagagtgtcccgattatgaaggctatagaaaactattactatctgtactggatgatttaggtgaaaccgcggacggccaatatgattggatgaaactgaacgatggccgtggttgggatcttaacataaacaagaagccaaatctccacggatacggccatccaaatccaccaaacgaaaaatcgagaaaacatagaaacaaacagctccaaatgcaacagctccaaatgcaacagctccaacaacagcaacagcaacagcaatatgctcaaaaaactgaggcagatatgcgcaattctcaatataaaccaaagttagaccctacttcttatgaagcttaccagcatcaaacccagcagaaatacctgcaagaacaacaaaagagacagcagcaacaaaaacttcaggagcaacaacttcaagagcaacaattgcaacagcagcaacagcaacagcaacagctacgtgcaacaggccaacctccatctcagcctcaagcgcaaactcaatctcagcagtttggcgctcgttatcaaccacaacaacaaccttctgctgctttaagaactcctgaacagcacccaaatgacgataattcaagtctagctgcttctcataagggctttttccaaaaattaggttgttgctaa

SEQ ID NO: 45744 - DNA, 549 bp, Saccharomyces cerevisiae
atgtccatcgaggaggaagatacaaataagatcacatgtacgcaagactttcttcaccaatactttgtaactgaaagggttagcattcaatttgggttaaataacaagaccgtaaaaaggataaataaagatgaatttgataaggcagtaaattgtatcatgtcatggacaaactatcctaagcctgggttaaaacgaacagcttcaacgtacctcttaagcaattcctttaagaaatctgcaacagtatctcttccgtttatcttaggcgacccagtatgcatgccgaagagggtggaaagcaataataatgatacctgtcttctgtatagtgacacattatatgacgatcctttaatacagaggaatgatcaagcaggagatgaaatagaggatgaatttagctttacattgctacgaagtgaagtaaatgaaatcagacccatatcttcgtccagcaccgcccaaatactgcaatcggactattctgcgctgatgtatgagagacaggcttcaaatgggagcatatttcagtttagtagtccctga

SEQ ID NO: 45745 - DNA, 4569 bp, Saccharomyces cerevisiae
atgcccggaacgccacagaagaacaagaggtctgcgagtatatctgtttcacctgcgaagaagacagaggaaaaagaaataatacaaaatgattcaaaggcgatattatctaagcaaactaagaggaaaaaaaagtatgcttttgctcctataaataacttaaatgggaagaacaccaaggtatccaatgcaagtgtcctaaagtcaatagccgtttcacaagtacgaaatacatcaagaacaaaagatataaacaaagcagttagcaagagcgtaaagcaattaccaaattcacaagttaaaccgaaacgggaaatgtctaatttgagtaggcatcacgatttcactcaagacgaggacggccccatggaagaagtaatatggaaatattcacctttacaacgagatatgtccgacaaaacaacaagcgctgccgaatactctgatgactacgaagatgtccaaaatccctcttctacacctatagtccctaatcgactgaaaactgttcttagtttcacaaatatccaagtacccaacgctgacgtaaatcaactcattcaagaaaatggaaatgagcaagtgcgtcctaaaccagcagaaatatctaccagggagtctctccgtaatatagatgatattctcgatgatatagagggcgatttaactataaaaccgacgataacgaaattcagcgatttgccatcttcacccatcaaggcacccaacgttgaaaaaaaagcagaggtgaatgcagaagaagtagataaaatggattcaacaggagatagcaacgatggcgatgactctttgatagatattttaactcaaaagtatgttgagaaacgcaagagtgagagtcagataacaattcaaggcaacaccaatcaaaaaagtggagcccaggaaagttgtgggaagaatgataacacaaaatcgagaggagaaattgaagatcatgaaaatgtagacaatcaagccaaaacaggcaatgcattttatgagaatgaagaagacagtaattgccaaagaattaaaaaaaatgaaaaaatagaatacaattcttcagacgaattttcagacgattcactaattgaactattgaacgaaactcaaacacaagtggaacctaacactattgaacaagatttagacaaagtggagaaaatggtctctgacgatttgagaattgctactgattccactttatccgcatatgctctcagagctaagtctggtgctccaagagacggcgtagtacgattagtaatagtaagcttacgtagtgttgaattgccaaaaattggaacgcaaaaaatactagagtgtatagacggcaaaggcgaacaaagttctgttgtcgttcgacatccttgggtatatttggaatttgaggttggggatgtaatacatattatagaagggaaaaatattgaaaacaaacggcttctttctgacgacaaaaaccctaaaactcaactggctaacgacaacctgttggtgctaaaccctgatgtattattttcggcaacatcagtcggaagttcagtaggttgtttaagacgttcaattctgcaaatgcaatttcaagatccccgcggagaaccaagccttgtcatgactttaggcaatatcgtacacgagttattgcaagactcaatcaaatacaagctctcgcataataaaatttctatggaaatcataatacaaaagctggattctttgttagaaacttattctttttcaattatcatttgtaatgaagaaatccagtacgttaaagaattagttatgaaagaacatgctgaaaacattttgtacttcgtcaataaatttgtttcgaaaagtaactatggttgctacacatcaatttccggaacaagaagaacacagccaatttctatatccaatgtgattgatattgaagaaaacatttggtctccaatatatggtcttaaagggttcctagatgcaactgttgaagctaatgttgaaaacaataaaaaacacatcgttcctttagaagtgaaaactggaaaatccagaagcgtttcatacgaggttcaaggccttatttatacacttctgttaaatgatcgctatgagataccgatagagttttttcttctttattttacgagggataaaaatatgacaaagttcccttctgttctgcactccattaaacatattctcatgtcccgaaatagaatgagtatgaattttaagcatcaactccaagaggttttcggacaggctcaatcaaggtttgaattaccacccttactgcgcgattcatcttgtgattcatgtttcatcaaagaatcatgcatggtgttgaataagctactagaggacgggacaccagaagaaagtggcctggtagaaggtgagtttgaaattttgacaaaccatttgtcgcaaaatctcgccaactacaaagagttttttacaaaatataatgatctaataactaaggaggagtcaagtataacatgtgtaaataaagaacttttcttattggatggttccacaagagaatccagaagtggaaggtgcctttctggcttggttgtgtcagaggtggttgaacatgaaaaaacagagggagcgtatatatattgcttctcaagacgtagaaatgataataactcgcagtcgatgttatcatctcaaattgctgctaatgactttgttattattagtgatgaggagggtcatttttgcttgtgccaaggtcgtgtacaatttataaatcccgctaaaattggtatctccgtaaaacgaaagttattaaacaataggcttctagataaggaaaaaggagtcactaccatccaaagtgtggtcgaatcagagctagaacaatccagtctcatagctacccaaaatttggtcacatatagaatcgacaaaaatgatatccaacagagtttgtctttagcgcgatttaatcttttaagcttgtttttaccagctgtttcacctggcgtggatattgttgacgaaaggagtaaattatgtcggaagacaaagagatctgatggaggtaatgaaatactgcgatcacttttagttgataatagagcacctaagtttagagatgcaaatgatgatcccgtcattccgtataagctttcaaaggatacaacattgaacttgaatcaaaaagaagcaatagacaaagtaatgagggccgaagattatgcattgatattgggaatgccagggactggtaagactactgttatcgcagaaattattaaaattctcgtttccgaggggaaacgcgtgcttttgacatcatacacacattcagcagtggataatattttaataaaattgaggaacaccaacattagcataatgagattgggaatgaaacataaggtccatcctgacacgcaaaaatatgtcccgaattacgcgtcagtgaaaagttataacgattatttgtccaaaattaacagcacctctgttgttgctaccacctgcttaggaattaacgatatactatttacactaaatgaaaaggattttgattatgtgattttggacgaggcaagtcaaatttcaatgcctgtcgctttgggacctctgcggtatggaaataggtttattatggtaggagatcattaccagctaccgccattagttaaaaatgacgcagctcgattaggtgggttagaagagtcactgttcaagactttctgtgaaaagcatccggaaagcgttgcagaactgactttacagtaccgtatgtgcggcgatattgtaactttgtctaatttcctaatttatgataataaattaaaatgcgggaataacgaagtttttgctcaatctttagagttaccaatgcctgaggccttgtcgcgctataggaatgaatcggctaactctaagcagtggcttgaggatatactagagcctacaagaaaagtggtatttttaaattacgataactgcccggatattatcgaacaaagcgaaaaggataacattacgaatcacggggaggcagaattgactctacaatgtgtggaaggaatgttattgagcggcgtaccatgcgaagatattggtgtaatgacgttatacagagcacagttaagattactgaagaagatattcaacaaaaatgtgtatgacgggctagagatcttgactgctgatcagtttcaaggtcgtgacaaaaagtgcattattatttccatggttagaagaaattctcaattaaatggaggagcgctgctgaaagagctaagaagagtcaatgttgccatgacaagggccaaatccaagctgatcattataggttcaaaaagtacaatcggctctgttcctgaaataaaatcgttcgtgaacctgttagaagagcgtaattgggtctatacaatgtgcaaggatgcactctacaaatacaaatttcccgacagatcaaacgctattgatgaggcacgcaaaggttgtggaaaaagaacaggtgccaaacccatcacatcaaagtctaaattcgtaagcgataaacctatcataaaggaaattctacaagagtatgaaagttga

SEQ ID NO: 45746 - DNA, 1881 bp, Saccharomyces cerevisiae
atgaatgacgacagccaggataaaataatacatgatatacgtattcagctacgaaaggctgccacagaattatcacgatggaagctatacggctcctcaaagtgggcagcagaggcgctagcaggtcttgcagaagctattgatgttgatcaaacacactctttagccgatgaatcgccactaagaaataaacaaggtgtaccgaaacagatgtttgaaataccacaaaacgggtttggcctatcagagactgagtatgacctgtacctccttggttctacgttgtttgatgctaaagagtttgatcgatgcgttttttttctaaaagatgtcactaatccataccttaagttcttaaaattatacagtaaatttctatcgtgggataagaaaagccaggaaagtatggaaaatatcttaactacagggaagtttacggacgaaatgtacagagctaacaaagatggggatggtagtgggaatgaggatataaatcaaagtgggcaccaacgcgccaatttaaaaatggtcagcaatgagcatgagtcacaatcgaacatatcatctattttgaaggaaattaacacatttctggagtcttatgaaataaagatagacgatgatgaggccgatttagggttagcactgttgtattatttacgaggggtcatcttaaagcaagagaagaatatttctaaggcaatgtcgtcattcttgaaatctctgagttgctactcctttaactggtcctgctggctggagttaatggactgtttacaaaaggttgacgatgcattgcttttaaataattatctatatcaaaatttccaattcaaattttctgaaaatcttggtagtcaacgaacgatagaatttaatataatgatcaaatttttcaagctaaaagtgtttgaggagcttaatggccagttagaggactactttgaagatttagagtttttgttacaagttttccccaatttcacttttttaaaggcttacaatgctactattagttacaacaatttggattatgttaccgcagaaagccgatttgatgacatcgttaaacaagatccgtaccgtctcaacgatttggaaacctactccaatattctatacgtcatgcagaagaattcaaaattagcctatttggcgcaattcgtctcccaaatagatagatttagaccggaaacatgttgtatcatagcgaactattacagtgcccgacaggaacatgaaaaatctatcatgtatttccgtcgagcactaactttggataaaaaaacaacaaacgcatggactttgatgggtcacgaatttgttgaactaagcaattcacatgccgcaatagaatgctatcgtcgggccgtagatatatgccctcgagacttcaaagcatggtttggtttgggccaggcttatgctctcctggacatgcatttatattctctttactacttccagaaagcttgcactttgaaaccttgggatcgtcggatttggcaagtattgggagaatgttatagtaagacgggaaataaggtagaagctataaaatgctacaaaagatccataaaagcttcacaaacggtcgatcaaaatacttcaatatattaccggttagcgcaactatatgaagaacttgaagacttgcaagaatgtaagaagttcatgatgaaatgtgtagatgtggaagaacttctggaaggtatagtaacagatgaaaccgtgaaggctaggctttggctggcaatatttgagattaaggcaggaaactaccaattggcttatgattatgccatgggggtatctagtggaacgtctcaagagattgaagaggctcgtatgctggctcgggagtgcagaaggcatatgtag

SEQ ID NO: 45747 - DNA, 1296 bp, Saccharomyces cerevisiae
atggcagactttaaatctttaggtctttcaaaatggcttacggaatccttaagagctatgaaaattactcagccaaccgctatccaaaaggcttgtattcccaaaatcttagaaggaagagattgtattggtggtgccaagactggttctggtaaaactattgcatttgcagggcctatgctgactaaatggtccgaagatccgtcagggatgtttggagtggtcttgaccccaaccagagagttagccatgcaaattgccgaacaatttactgcacttggtagcagtatgaacattcgcgtgtcagttatagttggtggtgaaagcatcgttcagcaggcattggatttacaaaggaagccgcactttattattgccacgcctggacgtctggcacatcatatcatgagcagcggagatgataccgttggagggctaatgagagctaaatatttagttctagatgaagccgatattttgctaactagcacgtttgccgatcatttagcaacatgtataagtgctctacctcccaaggataagagacaaacacttctattcactgcaactataacggaccaagtaaagtcgttacaaaatgcaccagtgcagaaagggaaacccccattgttcgcttaccaagtagaaagtgtagataatgtggctattccatcgacgttgaaaatagagtatatcttggttccagaacacgtcaaagaagcatatttgtaccaattattaacatgcgaggaatatgagaataaaaccgctataatatttgtaaatagaacaatgaccgcggagatccttagaagaaccctgaagcagttggaagtgagggtagcgtcgttgcactctcaaatgccccaacaggaaagaacaaattccttacatagatttcgagctaacgctgcaagaatcctcatcgctacagatgtagcatccagaggtttggatatcccaactgttgagcttgtagtgaattacgatataccttcagacccagatgtattcatccatagatctggtcgtacggcccgtgctggcagaattggtgacgccatatcattcgttacccagcgagatgtttctaggatacaggccattgaggaccgtatcaacaagaagatgacagagacaaacaaggtacacgataccgctgtaataagaaaagccttgaccaaggtaaccaaggcgaagagggaatcgctgatggcaatgcaaaaggaaaacttcggtgagagaaaaagacagcaaaagaagaagcaaaatgacgggaaaagtttgcgctcttga

SEQ ID NO: 45748 - DNA, 1314 bp, Saccharomyces cerevisiae
atggctgtctctaaagtttacgctagatccgtctacgactcccgtggtaacccaaccgtcgaagtcgaattaaccaccgaaaagggtgttttcagatccattgttccatctggtgcctccaccggtgtccacgaagctttggaaatgagagatgaagacaaatccaagtggatgggtaagggtgttatgaacgctgtcaacaacgtcaacaacgtcattgctgctgctttcgtcaaggccaacctagatgttaaggaccaaaaggccgtcgatgacttcttgttgtctttggatggtaccgccaacaagtccaagttgggtgctaacgctatcttgggtgtctccatggccgctgctagagccgctgctgctgaaaagaacgtcccattgtaccaacatttggctgacttgtctaagtccaagacctctccatacgttttgccagttccattcttgaacgttttgaacggtggttcccacgctggtggtgctttggctttgcaagaattcatgattgctccaactggtgctaagaccttcgctgaagccatgagaattggttccgaagtttaccacaacttgaagtctttgaccaagaagagatacggtgcttctgccggtaacgtcggtgacgaaggtggtgttgctccaaacattcaaaccgctgaagaagctttggacttgattgttgacgctatcaaggctgctggtcacgacggtaaggtcaagatcggtttggactgtgcttcctctgaattcttcaaggacggtaagtacgacttggacttcaagaacccagaatctgacaaatccaagtggttgactggtgtcgaattagctgacatgtaccactccttgatgaagagatacccaattgtctccatcgaagatccatttgctgaagatgactgggaagcttggtctcacttcttcaagaccgctggtatccaaattgttgctgatgacttgactgtcaccaacccagctagaattgctaccgccatcgaaaagaaggctgctgacgctttgttgttgaaggttaaccaaatcggtaccttgtctgaatccatcaaggctgctcaagactctttcgctgccaactggggtgttatggtttcccacagatctggtgaaactgaagacactttcattgctgacttggttgtcggtttgagaactggtcaaatcaagactggtgctccagctagatccgaaagattggctaagttgaaccaattgttgagaatcgaagaagaattgggtgacaaggctgtctacgccggtgaaaacttccaccacggtgacaagttgtaa

SEQ ID NO: 45749 - DNA, 1470 bp, Saccharomyces cerevisiae
atgtctgctgatttcggtttgattggtttggccgtcatgggtcaaaatttgatcttgaacgctgctgaccacggtttcactgtttgtgcttacaacagaactcaatccaaggtcgaccatttcttggccaatgaagctaagggcaaatctatcatcggtgctacttccattgaagatttcatctccaaattgaagagacctagaaaggtcatgcttttggttaaagctggtgctccagttgacgctttgatcaaccaaatcgtcccacttttggaaaagggtgatattatcatcgatggtggtaactctcacttcccagattctaatagacgttacgaagaattgaagaagaagggtattcttttcgttggttctggtgtctccggtggtgaggaaggtgcccgttacggtccatctttgatgccaggtggttctgaagaagcttggccacatattaagaacatcttccaatccatctctgctaaatccgacggtgaaccatgttgcgaatgggttggcccagccggtgctggtcactacgtcaagatggttcacaacggtattgaatacggtgatatgcaattgatttgtgaagcttatgacatcatgaagagattgggtgggtttaccgataaggaaatcagtgacgtttttgccaaatggaacaatggtgtcttggattccttcttggtcgaaattaccagagatattttgaaattcgacgacgtcgacggtaagccattagttgaaaaaatcatggatactgctggtcaaaagggtactggtaagtggactgccatcaacgccttggatttgggtatgccagttactttgattggtgaagctgtctttgcccgttgtctatctgctttgaagaacgagagaattagagcctccaaggtcttaccaggcccagaagttccaaaagacgccgtcaaggacagagaacaatttgtcgatgatttggaacaagctttgtatgcttccaagattatttcttacgctcaaggtttcatgttgatccgtgaagctgctgctacttatggctggaaactaaacaaccctgccatcgctttgatgtggagaggtggttgtatcattagatctgttttcttgggtcaaatcacaaaggcctacagagaagaaccagatttggaaaacttgttgttcaacaagttcttcgctgatgccgtcaccaaggctcaatctggttggagaaagtcaattgcgttggctaccacctacggtatcccaacaccagccttttccaccgctttgtctttctacgatgggtacagatctgaaagattgccagccaacttactacaagctcaacgtgactactttggtgctcacactttcagagtgttgccagaatgtgcttctgacaacttgccagtagacaaggatatccatatcaactggactggccacggtggtaatgtttcttcctctacataccaagcttaa

SEQ ID NO: 45750 - DNA, 1335 bp, Saccharomyces cerevisiae
atgggaaagctattacaattggcattgcatccggtcgagatgaaggcagctttgaagctgaagttttgcagaacaccgctattctccatctatgatcagtccacgtctccatatctcttgcactgtttcgaactgttgaacttgacctccagatcgtttgctgctgtgatcagagagctgcatccagaattgagaaactgtgttactctcttttatttgattttaagggctttggataccatcgaagacgatatgtccatcgaacacgatttgaaaattgacttgttgcgtcacttccacgagaaattgttgttaactaaatggagtttcgacggaaatgcccccgatgtgaaggacagagccgttttgacagatttcgaatcgattcttattgaattccacaaattgaaaccagaatatcaagaagtcatcaaggagatcaccgagaaaatgggtaatggtatggccgactacatcttagatgaaaattacaacttgaatgggttgcaaaccgtccacgactacgacgtgtactgtcactacgtagctggtttggtcggtgatggtttgacccgtttgattgtcattgccaagtttgccaacgaatctttgtattctaatgagcaattgtatgaaagcatgggtcttttcctacaaaaaaccaacatcatcagagattacaatgaagatttggtcgatggtagatccttctggcccaaggaaatctggtcacaatacgctcctcagttgaaggacttcatgaaacctgaaaacgaacaactggggttggactgtataaaccacctcgtcttaaacgcattgagtcatgttatcgatgtgttgacttatttggccggtatccacgagcaatccactttccaattttgtgccattccccaagttatggccattgcaaccttggctttggtattcaacaaccgtgaagtgctacatggcaatgtaaagattcgtaagggtactacctgctatttaattttgaaatcaaggactttgcgtggctgtgtcgagatttttgactattacttacgtgatatcaaatctaaattggctgtgcaagatccaaatttcttaaaattgaacattcaaatctccaagatcgaacagtttatggaagaaatgtaccaggataaattacctcctaacgtgaagccaaatgaaactccaattttcttgaaagttaaagaaagatccagatacgatgatgaattggttccaacccaacaagaagaagagtacaagttcaatatggttttatctatcatcttgtccgttcttcttgggttttattatatatacactttacacagagcgtga

SEQ ID NO: 45751 - DNA, 807 bp, Saccharomyces cerevisiae
atggtattggaagctacagtgttagtgattgataattcagagtactctcgcaatggcgactttcctaggacaaggtttgaagcccagatcgactcggtagagttcatatttcaagccaagagaaacagcaatcctgagaatacagtgggtcttatctctggtgctggcgccaaccccagggtgttatctacgtttaccgccgagtttgggaagattcttgctggactacacgacacgcagatcgagggtaagctgcatatggccactgcgttgcagatcgctcagctgactttgaagcatcgccagaataaggtccaacatcaaaggattgtggcatttgtgtgtagcccaataagtgattctcgagacgaattgatcagattggcaaaaacactgaaaaagaataatgttgccgtggacatcatcaattttggagagattgaacagaacacggagcttttggatgagttcatagctgcagtgaacaaccctcaagaagaaactagtcatttgcttactgtgacgcctggccccagactgctgtacgagaacatcgcatcttcacccataattctcgaagaaggatcctccggtatgggcgcctttggtgggtctggcggtgattccgatgccaatggcacatttatggacttcggggtagacccatcaatggacccagaactggcaatggccttgcgtctgtctatggaagaagagcagcaaagacaggaaaggttaagacagcagcaacaacaacaagatcagcctgagcagtctgaacagcctgaacaacaccaagacaaatag

SEQ ID NO: 45752 - DNA, 1194 bp, Saccharomyces cerevisiae
atgtcgcctttgagaaagacggttcctgaatttttggcacacttaaaatcactgccaatttcaaaaattgcaagcaacgatgtgttaacaatatgtgttggtaacgagtcagcagatatggactcaattgctagtgcaatcacttattcgtactgccaatacatatataatgaaggtacttactcggaggagaaaaagaaaggaagctttattgtcccaattatcgacattcctagagaagacctcagtttaagaagagacgtaatgtatgtcctagaaaaactgaaaattaaggaggaggaattattcttcattgaagatttaaagagcttgaagcaaaatgtctcccagggtactgaattaaactcttacttggtagataataacgatacaccaaagaatttgaaaaattatatagataacgtcgttggcattatagaccaccattttgacttgcaaaaacatttggatgctgaacctcggattgtaaaagtgtccggcagttgctcatcgctggtttttaactactggtatgaaaaattgcaaggtgaccgtgaagtggtgatgaacattgcaccacttttgatgggggccatcttaatagacacttcaaatatgaggcgcaaagtcgaggaaagtgataaattagctatcgagagatgccaagctgttcttagtggtgcggttaatgaagtgtctgcgcaaggtttagaggacagcagtgagttttataaagagataaaatcaagaaagaacgatattaaaggattttcggtaagcgatattctaaagaaggactacaaacaattcaatttccaaggaaagggacacaaagggttagagattggtctttcatcaatagtaaaaagaatgtcttggctattcaatgaacacggtggtgaagcagatttcgtcaaccaatgcagaagatttcaggcggagagggggctcgatgtattggttctgttgacttcatggaggaaagctggtgattcacacagagaattggtcatattgggagactctaacgtggtacgtgaactcattgaaagggttagcgacaagctccaacttcaattatttgggggcaatcttgatggaggtgtggcgatgtttaagcaactgaacgtcgaggccaccagaaagcaagtcgtcccctatttagaggaagcgtactcaaacctggaagagtga

SEQ ID NO: 45753 - DNA, 2391 bp, Saccharomyces cerevisiae
atggtttgctgcttatgggtgcttctagcattgttgcttcatctcgatcatgtagcatgcgaagacgatgcgtactcattcacttctaaagaacttaaggcttacaagcaggaagtgaaggagctgttttatttcggcttcgacaattatttagagcatgggtatccatatgatgaggtaaaacccatttcatgcgttcctaagaagagaaactttgaagatcctactgatcaaggcaccaacgatatattgggcaattttacaatcactttaatagattctttaaccactattgctatactggaagaccggccgcagtttttgaaagctgttcgacttgttgaaaggacatttcctgatggcaatttcgatattgattccacaatacaagtttttgaaattactatacgtgttatcggatcactactatcatcacatctttatgctacggatcccacaaaggcagtgtatttaggggacgattatgatggctcactgttacgtctcgcccagaatatggcagataggctcttacctgcatatttaacgtctaccggattacctatgccacggagaaacatcaaacgaaaatgggatgtctctgaatttccagaatttttggagacagagaataatgtggccgctatggcgtctcccatgttcgaattcactattttatcttacttgacaggcgatcccaagtatgagaaagttaccagatacgcatttgataaaacatggtctcttagaactggtttggatttgctacccatgtcctttcaccccgaaaaactaacaccatatacgcccatgactggaatcggcgcctccatcgactcccttttcgaatacgctttgaaaggtgctattttatttgatgattcagaattaatggaagtttggaacgtagcatacgaggcattaaagactaactgtaaaaacgattggttttttgctaatgtaatggctgacacagggcatttgtttgttccctggattgattctttgagtgcttttttctccggtttacaggtgcttgctggtgatttggatgatgccatagcgaaccatttaatgtttttaaaaatgtggaacacctttggcggtattcctgaaaggtggaactttagtcctccggagtttcccccactatctccattagagcgatcgggagctgttgctttggataatatcctccccttagaatggtacccattaagaccggaattttttgagtcaacctatttcttatatagagctacaaaagacccgttttacttaaatattggggtacatctgctaaaagacctcaagcaacgatttaagtctaactgcggatttgcaggtttccaaaatgtaatcacgggcgaactgcaagatagaatggaaacatttgtgttgagtgaaactttgaaatacctgtatttattatttgatgaagagaacgaattacataacagcgctagtgacgtaattttcagtacagaagcccatccaatgtggttgccccaagaagtgaggtccaactataaacgtaacgctaaatttaacaactctgtctactcgtcgcacttggaaatttgccagaaaaaggacagggaacaagctggagagaacacattgagccaaagaattgtggggttcgccaaatcgatctttcataaaggtccaccagacgaagaggctactgatccaattatagactataccattgatactgaacttcccggtacatgctctataaagcctcatcatgtaattggtgacgaattttggtattctccaatgttgagcaattttgacagattattcgagattgactcccggttcgctgccacgctaattaaaccttcacacatgcataactataatgcaattgaactagaacctggattttataacaggtggtccaatccgcaatttagcacgtgcctgatcccacccaccaccgaaattttcgaactactattcgaccttcctggatatcatcagttgaatccattaatgttagaaaacaaaactattacatttgaaacctttggaggtaggtcaaggttgaagatcgaaaaattgcaaatctaccaaattgattactatggagacttaatcactgcatcgacattccaagacgtctcccgcaaggatattttctcgaatgcatgcgatgcagtggcaagcttgtattctcccacttatctttacagagtagtagccatcaacggacgcatattgcctcgccatggaagtgtacaaatcaagaaacatagtcctgtgctcacttccaatggcacaagagaggaagacgaattcaaaatggatggcatcgggattaatgaccattcccaactcatgttagaatgcacgcccatcatcaacttatttattgtatga

SEQ ID NO: 45754 - DNA, 2472 bp, Saccharomyces cerevisiae
atgaatttttttacatcaaaatcgtcgaatcaggatactggatttagctctcaacaccaacatccaaatggacagaacaatggaaacaataatagcagcaccgctggcaacgacaacggatacccatgtaaactggtgtccagtgggccctgcgcttcatcaaataatggtgccctttttacgaattttactttacaaactgcaacgccgaccaccgctattagtcaggacttatatgcaatgggcacaacaggaataacatcagaaaatgccctttttcaaatgaagtcaatgaataatggaatatcatcagttaataataacaacagcaacacccctacgattattaccacgtcacaggaagaaactaatgctggaaatgtacatggcgataccggtggcaattctttgcaaaattctgaagatgacaacttttcttccagttctaccaccaaatgcttactctcttccacttcttcgctatcaataaatcaacgagaagcagcagcagctgcttatggtccagataccgatattcctaggggtaaactagaagttacaataatagaagcacgtgacctagtcactagatcaaaggattcacagccttatgttgtttgtacttttgagagttcagagttcatttctaatggtcctgagtcactaggcgccattaataataacaacaataacaacaacaataatcagcataatcaaaaccagcatattaacaacaacaacgaaaataccaaccctgacgctgctagccagcatcataataataacagtggttggaacggttctcagttaccatcgataaaagagcacttgaagaaaaaacccctttatacacacagatcatcttcccaattagatcagctaaactcttgctcttcagtaaccgatccgagcaaacgttcttctaattcttcgtcgggttcttcaaatggtccaaagaatgatagttcacatccaatatggcatcacaagacaacgtttgatgttttgggatctcactcggaattagatatttctgtttatgatgctgcccacgaccatatgttcttaggccaagttagactgtatccaatgattcataatttagcacatgcttcccaacaccaatggcacagtttgaaacctcgcgttattgatgaagttgtgtccggtgatattttaatcaaatggacttacaaacagacaaagaaaagacattatggcccacaagattttgaagttcttcgattattgggtaagggtacttttggccaagtctaccaagttaagaagaaagacactcaaagaatttatgcaatgaaagttctctccaagaaagttattgtcaagaaaaatgagatcgcccacacaattggcgaaagaaatatcctagtcacgacagcgtccaaatcgtccccattcattgtcggattgaagttttcctttcaaacaccaacagatctgtatttggtcactgattatatgagtggtggagaattattctggcatttacaaaaggagggccgtttttcggaagacagagcgaaattctatatcgctgagttagtcctagcgttagaacatttacacgataacgatatcgtttacagggacctaaagcctgaaaacattctactcgatgccaacggtaacatcgctctttgcgattttggtctttctaaagctgacttgaaggatagaacaaacacattttgcggcaccacggaatacctggcaccagaattgttactggacgaaaccggctacaccaaaatggtcgatttctggtctctaggtgttttgatatttgaaatgtgttgtggttggtcccctttctttgcggaaaataatcaaaaaatgtaccaaaaaattgcctttggtaaagtcaaattccccagagacgtactgtcacaagaggggaggtcttttgtaaagggtttactaaacagaaaccccaaacatagactcggtgccattgatgatggaagagaactacgagctcatccatttttcgcagatatcgactgggaggccttgaagcagaaaaaaattccaccacctttcaaacctcacctagtctcggagacggatacctcgaattttgacccagagttcacaacagcttcaacttcatacatgaacaagcaccagccgatgatgactgctaccccgctatctccagccatgcaagcaaagtttgctggtttcacctttgttgatgagtccgccatcgatgaacacgttaataacaacagaaaattcctacaaaactcgtactttatggaacctggttcctttatcccgggaaatccaaacttacctccagacgaagatgtcatcgatgatgacggggacgaggacatcaatgatggattcaaccaagagaaaaatatgaacaacagccattcgcagatggacttcgacggcgaccaacacatggatgacgaatttgtcagtggaagattcgaaatatga

SEQ ID NO: 45755 - DNA, 3228 bp, Saccharomyces cerevisiae
atgacaattgcacaccactgcatatttttggtaatcttggcctttctggcactaattaatgtggcctcaggagccacagaggcgtgcttaccagcaggccagaggaaaagtgggatgaatataaatttttaccagtattcattgaaagattcctccacatattcgaatgcagcatatatggcttatggatatgcctcaaaaaccaaactaggttctgtcggaggacaaactgatatttcgattgattataatattccctgtgttagttcatcaggcacatttccttgtcctcaagaagattcctatggaaactggggatgcaaaggaatgggtgcttgttctaatagtcaaggaattgcatactggagtactgatttatttggtttctatactaccccaacaaacgtaaccctagaaatgacaggttattttttaccaccacagacgggttcttacacgttttcttttgcaacagtagatgattctgcaattttatcagtcggtggtagcattgcgttcgaatgttgtgcacaagaacaacctcccatcacgtcgactaacttcacaatcaatggtatcaagccatgggatggaagtctccctgacaatatcacagggactgtctacatgtatgcaggctactattatccgctgaaggttgtttactccaatgccgtttcctggggcacgcttccaattagcgtggaattgcctgatggtactactgttagtgataactttgaagggtacgtttactcttttgacgatgacctaagtcagtcaaattgtactatccctgatccttcaatacatactactagcactatcacaactaccaccgagccatggaccggtactttcacttctacatccactgagatgaccaccatcaccgatactaacggtcaattaactgatgaaactgtcattgtcatcagaactccaacaacagctagcaccatcacaactaccaccgagccatggaccggtactttcacctctacatccactgagatgactactgtcaccggtaccaacggtcaaccaactgacgaaactgttattgtcattagaactccaactagtgagggtttgattactacaactaccgaaccatggaccggtactttcacctctacatccactgagatgactactgtgaccggtaccaacggtcaaccaactgacgaaactgttattgtcattagaactccaactagtgagggtttgattactacaactaccgaaccatggaccggtactttcacctctacatccactgaggttaccaccatcactggtaccaacggtcaaccaactgacgaaaccgtgattgtcattagaactccaactagtgagggtttgattactacaactaccgaaccatggaccggtactttcacctctacatctactgagatgactactgtcaccggtaccaacggtcaaccaactgacgaaactgttattgttatcagaactccaaccagtgaaggtctaatcagcaccaccactgaaccatggactggtactttcacctctacatctactgaggttaccaccatcactggtaccaacggtcaaccaactgacgaaaccgtgattgtcattagaactccaactagtgagggtttgattactacaactaccgaaccatggaccggaactttcacctctacatccactgagatgactactgtgaccggtaccaacggtcaaccaactgacgaaactgttattgtcattagaactccaactagtgagggtttgattactagaactaccgaaccatggactggtactttcacttctacatctactgaggttaccaccatcaccggtaccaacggtcaaccaactgacgaaactgttattgtcatcagaactccaactactgccatctcatccagtttgtcatcttcttcaggacaaatcaccagctctatcacgtcttcgcgtccaattattaccccattctatcctagcaatggaacttctgtgatttcctcctcagtaatttcttcttcagtcacttcttctctagtcacctcttcttcattcatttcttcctctgtcatttcttcttctacaacaacctccacttctatattctctgaatcatctacatcatccgtcattccaaccagtagttccacctctggttcttctgagagcaaaacgagttcggctagttcttcctcttcttcctcttctatctcttctgaatcaccaaagtctcctacaaattcttcttcatcattaccacctgttaccagtgcgacaacaggccaggaaactgcttcttcattaccacctgctaccactacaaaaacgagcgaacaaaccactttggttaccgtgacatcctgcgaatctcatgtgtgtactgaatccatctcctctgctattgtttccacggccaccgttactgttagcggcgtcacaacagagtataccacgtggtgccctatttctaccacagagacaacaaagcaaaccaaggggacaacagagcaaaccaaggggacaacagagcaaaccacagaaacaacaaaacaaaccacagtagttacaatttcttcttgtgaatctgacatatgctctaagactgcttctccagccattgtgtctacaagcactgctactattaacggcgttaccacagaatacacaacatggtgtcctatttccaccacagaatcgaagcaacaaactacgctagttactgttacttcctgcgaatctggtgtgtgttccgaaactacttcacctgccattgtttcgacggccacggctactgtgaatgatgttgttacggtctatcctacatggagaccacagactacgaatgaacagtctgtcagctctaaaatgaacagtgctaccagtgagacaactaccaatactggggctgctgagacaaaaacagcagtcacctcttcactttcaagattcaatcacgctgaaacacagacagcttccgcgaccgatgtgattggtcacagcagtagtgttgtttctgtatccgaaactggcaacaccatgagtctaacaagttccgggttgagcactatgtcgcaacagcctcgtagcacaccagcaagtagcatggtaggatctagtacagcttctttagaaatttcaacgtatgctggcagtgccaacagcttactggccggtagtggtttaagtgtcttcattgcgtccttattgctggcaattatttaa

SEQ ID NO: 45756 - DNA, 597 bp, Saccharomyces cerevisiae; identical to SEQ ID NO: 25087

SEQ ID NO: 45757 - DNA, 1404 bp, Saccharomyces cerevisiae
atgttgaagtcagccgtttattcaattttagccgcttctttggttaatgcaggtaccatacccctcggaaagttatctgacattgacaaaatcggaactcaaacggaaattttcccatttttgggtggttctgggccatactactctttccctggtgattatggtatttctcgtgatttgccggaaagttgtgaaatgaagcaagtgcaaatggttggtagacacggtgaaagataccccactgtcagcaaagccaaaagtatcatgacaacgtggtacaaattgagtaactataccggtcaattcagcggagcattgtctttcttgaacgatgactacgaatttttcattcgtgacaccaaaaacctagaaatggaaaccacacttgccaattcggtcaatgttttgaacccatataccggtgagatgaatgctaagagacacgctcgtgatttcttggcgcaatatggctacatggtcgaaaaccaaaccagttttgccgtttttacgtctaactcgaacagatgtcatgatactgcccagtatttcattgacggtttgggtgataaattcaacatatccttgcaaaccatcagtgaagccgagtctgctggtgccaatactctgagtgcccaccattcgtgtcctgcttgggacgatgatgtcaacgatgacattttgaaaaaatatgataccaaatatttgagtggtattgccaagagattaaacaaggaaaacaagggtttgaatctgacttcaagtgatgcaaacactttttttgcatggtgtgcatatgaaataaacgctagaggttacagtgacatctgtaacatcttcaccaaagatgaattggtccgtttctcctacggccaagacttggaaacttattatcaaacgggaccaggctatgacgtcgtcagatccgtcggtgccaacttgttcaacgcttcagtgaaactactaaaggaaagtgaggtccaggaccaaaaggtttggttgagtttcacccacgataccgatattctgaactatttgaccactatcggcataatcgatgaccaaaataacttgaccgccgaacatgttccattcatggaaaacactttccacagatcctggtacgttccacaaggtgctcgtgtttacactgaaaagttccagtgttccaatgacacctatgttagatacgtcatcaacgatgctgtcgttccaattgaaacctgttctactggtccagggttctcttgtgaaataaatgacttctacggctatgctgaaaagagagtagccggtactgacttcctaaaggtctgtaacgtcagcagcgtcagtaactctactgaattgacctttttctgggactggaataccaagcactacaacgacactttattaaaacagtaa

SEQ ID NO: 45758 - DNA, 1770 bp, Saccharomyces cerevisiae
atgactatttcttctgcacatccagaaacagaacccaagtggtggaaagaggccacaatttatcaaatttatcccgcaagtttcaaagactccaacaacgatggttggggtgatatgaagggtattgcctccaagttggagtacatcaaagagcttggtaccgatgccatttggatctcgccattttacgactcgccacaagatgatatgggttacgatattgccaactacgaaaaggtctggccaacctacggtacgaacgaggactgctttgccttgatcgaaaagacacataagcttggtatgaaatttatcaccgacttagtcatcaaccattgctccagcgaacatgaatggttcaaagagagcagatcctcaaaaaccaatccaaaacgtgactggttcttctggagacctcctaagggttatgacgccgaaggcaagccaattcctccaaacaattggaggtcttacttcggtggttctgcatggacgttcgatgaaaagacacaagagttttacttgcgtttgttttgctccacccaacctgatctaaactgggagaacgaagactgcagaaaggcaatctacgaaagtgccgttggatactggttagaccatggtgtagacggctttagaattgatgtgggaagcttgtactccaaggttgctggtctaccagacgctcctgtgattgacgaaaactcaaagtggcaactcagtgatcctttcacaatgaacggaccacgtatccatgagtttcatcaagaaatgaacaagttcatcagaaacagagtgaaggatggcagagaaattatgacagttggtgaaatgcgacatgctactgatgagaccaagaggttgtatacaagtgcgtcaagacacgaacttagtgagttattcaacttttcccacactgatgtcgggacttcgcccaagttccgtcaaaatttgataccatatgaactaaaggattggaaggttgcccttgctgaacttttcagatacgttaacggaactgattgttggtcaacaatttatctggaaaatcacgaccaacctcgttcaattaccagatttggtgacgattctcccaaaaaccgtgttatttctggtaagttgttgtctgtgttgttggtgtcactgagcggtactctatatgtgtaccaaggacaggaactgggtgaaatcaatttcaagaactggcctatcgaaaaatacgaggatgtcgaagttagaaataactatgatgcgatcaaggaagagcatggagaaaactcgaaggagatgaagaggtttttggaagcaattgcccttatttccagagaccatgctagaacacctatgcaatggtctcgtgaggagccaaatgctggtttttctggtcctaatgctaaaccatggttttacttgaacgagtctttcagggaaggaattaacgctgaagacgaatccaaggaccccaactcggttttgaacttctggaaggaggccttgagatttagaaaggcacacaaggatattactgtgtatggatatgattttgagtttattgatttggacaataagaaactgttcagcttcacaaagaaatacgacaacaaaacattgtttgctgctttgaacttcagctctgattcgatcgacttcacgattccaaacaatagctcatcgtttaagttggaattcggaaactacccaagaagtgaagttgatgcgtcttccagaacattgaagccatgggagggcagaatttacatatctgaatga

SEQ ID NO: 45759 - DNA, 1374 bp, Saccharomyces cerevisiae
atgggtttgattgtctcaatattcaacattggctgcgccataggcggaattgtcttgtcaaaagtcggtgatatatatggtcgtcgtattggattgattacagttactgccatttacgttgtaggcatcctaatccaaataacctccataaacaagtggtaccaatacttcattggaagaattatttctggcataggagtgggaggaattgctgtcctttccccaatgttgatatctgaagttgctcccaaacatatcaggggaaccctggtccaattgtaccagctgatgggtacgatgggtatttttctaggttactgtaccaattacggtaccaagaactatcacaacgccactcaatggagagtcggccttggtctttgctttgcctgggctacattcatggttagtgggatgatgtttgtaccagaatcaccacgttacctgatcgaagttggtaaagatgaggaagcgaaacattcactatcgaaatccaacaaagtctcagttgacgatccagccttgttagcagaatatgacactataaaggcgggaattgaaattgaaaagttggcaggtaacgcatcatggtctgaactactctccactaaaacaaaggtctttcagcgtgttcttatgggagtgataatccaatcgctgcagcaattaaccggtgacaactacttcttttactacggtaccaccatcttcaaatctgtcggtctaaaggactcctttcaaacttcgatcatcattggtgtggtcaattttttctcttcattcatagcggtatacaccattgagaggtttggacgccgtacgtgtctattgtggggtgctgcttctatgctgtgctgctttgctgtctttgcctccgttggtgtgacaaagctgtggcctcaaggaagcagtcaccaagacattacttctcagggtgccggtaactgtatgattgtgtttactatgttcttcatcttttcgtttgccaccacctgggcgggcggctgtttcgttattgtgtcagagacgtttcctcttagagccaaatcaagaggaatggcaatcgcaacagctgcaaactggatgtggggtttcctgattagtttctttaccccattcattaccggggcaatcaacttttactacggttatgtattcttaggctgtctggtttttgcatacttttatgtctttttctttgtcccagaaacaaaaggcttgacgctggaagaggtaaatactatgtggctggaaggtgtgccagcatggaaatcggcctcatgggtgccaccggagagaagaaccgcagattacgatgctgatgcaatagatcatgacaatagaccaatttacaagaggttcttttccagctga

SEQ ID NO: 45760 - DNA, 1629 bp, Saccharomyces cerevisiae
atgtccgtacaaaaagaagaatacgatattgtagaaaaggcccaattatctgtgtccgcagaaagcttaacatcagattcggagagtatttcacataacccatttgacgattttcataaagcagagcgttggagaaaagtctatgaatccagtggttatgaaggcttgtctaaattcgatcctgagtttacatggacaaaggatgaggaaaagaaattggtaagaaaaatggacttgaagatttttttgtgggtttttattatgtttgcctttttggatttaataaggaaaaatattgcaagggcagtttcagacaacttcattgttgacttgaaaatgaacacgaacgactacaaccttggccaaactgtttatctagttatatttctagcaagtgaactacccggcaatctgctgtccaaaagatttggtccagaaagggtcattccggttcaaattgtgttgtggagtgtaatttgtattactcaagctggtctgaaaaatcgaggtcaatttattgctactagatgcttattaggaatggtacagggcgggttcatcccggacaatattctatacttgtcatattattatactggagctgagctcacattccgcctaagtttcttttggtgtgctatacctcttttccaaattttaggctctcttttagcttccggaatcatagagatgaggggtattcataacttagctggctggcagtacctatttataattgaagggtttctgtccctttctgttggcgtggcatccttttatttaatgcgtagaggacctacgcaaactggtgagtctgcatttcacaaaggaaaatcgttattcactgagtatgaggagaaaattatggttaacagaattttaagggatgacccatcaaagggtgacatgagtaaccgacaaccagttaccttcaaggagattttgtacactctaacagaatttgatctatggccattgtttatccaaggtattacagcattcatatctcttcaaacagttggttcctatttatctttgatattaaagagtttaaattactctacatttctttcgaacattttagcaattccaggccaagccctgctgctaataaatttaccattagcggcactattatcgcgtaaattgaaagaaaaatcactttgtgtgggaattgccaacgtttgggtgctccctttcatagtttctctggtcgctttaccgactgacacaaacccctggatcaagtatatattactaaccggtatacttggtcttccctatacacattccattcttgctggttgggtctccgagatttcaaattcggtaagatcgcgtacagtgggcacagcgttatacaatatgagtgcccaagttggagcaatcattgcttctaacatgtatagaaatgatgataaaccttactatactagaggtaacaaaatacttctaggattcacttgcttcaacatttgtatggctgttgctactaagttttactatattagtaggaataaatacaaggaccgcaaatggaactctatgacaaaagaagagcagatcaattacttggacacaactaaagataagggaatgaagcgtcttgattataggtttattcactag

SEQ ID NO: 45761 - DNA, 1599 bp, Saccharomyces cerevisiae
atgcttttgcaagctttccttttccttttggctggttttgcagccaaaatatctgcatcaatgacaaacgaaactagcgatagacctttggtccacttcacacccaacaagggctggatgaatgacccaaatgggttgtggtacgatgaaaaagatgccaaatggcatctgtactttcaatacaacccaaatgacaccgtatggggtacgccattgttttggggccatgctacttccgatgatttgactaattgggaagatcaacccattgctatcgctcccaagcgtaacgattcaggtgctttctctggctccatggtggttgattacaacaacacgagtgggtttttcaatgatactattgatccaagacaaagatgcgttgcgatttggacttataacactcctgaaagtgaagagcaatacattagctattctcttgatggtggttacacttttactgaataccaaaagaaccctgttttagctgccaactccactcaattcagagatccaaaggtgttctggtatgaaccttctcaaaaatggattatgacggctgccaaatcacaagactacaaaattgaaatttactcctctgatgacttgaagtcctggaagctagaatctgcatttgccaatgaaggtttcttaggctaccaatacgaatgtccaggtttgattgaagtcccaactgagcaagatccttccaaatcttattgggtcatgtttatttctatcaacccaggtgcacctgctggcggttccttcaaccaatattttgttggatccttcaatggtactcattttgaagcgtttgacaatcaatctagagtggtagattttggtaaggactactatgccttgcaaactttcttcaacactgacccaacctacggttcagcattaggtattgcctgggcttcaaactgggagtacagtgcctttgtcccaactaacccatggagatcatccatgtctttggtccgcaagttttctttgaacactgaatatcaagctaatccagagactgaattgatcaatttgaaagccgaaccaatattgaacattagtaatgctggtccctggtctcgttttgctactaacacaactctaactaaggccaattcttacaatgtcgatttgagcaactcgactggtaccctagagtttgagttggtttacgctgttaacaccacacaaaccatatccaaatccgtctttgccgacttatcactttggttcaagggtttagaagatcctgaagaatatttgagaatgggttttgaagtcagtgcttcttccttctttttggaccgtggtaactctaaggtcaagtttgtcaaggagaacccatatttcacaaacagaatgtctgtcaacaaccaaccattcaagtctgagaacgacctaagttactataaagtgtacggcctactggatcaaaacatcttggaattgtacttcaacgatggagatgtggtttctacaaatacctacttcatgaccaccggtaacgctctaggatctgtgaacatgaccactggtgtcgataatttgttctacattgacaagttccaagtaagggaagtaaaatag

SEQ ID NO: 45762 - DNA, 1254 bp, Saccharomyces cerevisiae
atgtctcaaagactacaaagtatcaaggatcatttggtggagagcgccatgggtaagggtgaatcgaagaggaagaactcgttgctggagaaaagacccgaagatgtagttattgtggctgctaacaggtctgccatcggtaaaggttttaaaggtgccttcaaagatgtaaacacagactacttattatacaactttctcaatgagttcatcgggaggtttccggaacctttgagggctgatttgaacttaatcgaagaagttgcctgtggaaatgttctcaatgttggagccggtgctacagaacacagggctgcatgcttggcaagtgggattccctactcgacgccatttgtcgctttaaacagacaatgttcttcaggtttaacggcggtgaacgatattgccaacaagattaaggttgggcaaattgatattggtttggcgctgggagtggaatcaatgaccaataactacaaaaacgtcaatcccttgggcatgatctcctctgaagagctgcaaaaaaaccgagaagcgaagaaatgtctaataccaatgggcattactaatgagaatgttgccgctaatttcaagatcagtagaaaggatcaagacgagttcgctgcgaattcatatcaaaaagcttacaaggcgaaaaatgaggggcttttcgaagatgaaattttacctataaaattaccagatggctcaatttgccagtcggacgaagggccacgccctaacgtcactgcggagtcgctttcaagcatcaggcctgcctttatcaaagacagaggaaccacaactgcgggcaatgcatcccaggtctccgatggtgtggcaggtgtcttgttagcccgcaggtccgtagccaaccagttaaatctgcctgtgctaggtcgctacatcgattttcaaacagtgggggttccccctgaaatcatgggtgtgggccctgcatacgccataccaaaagtcctggaagctactggcttgcaagtccaagatatcgatatttttgaaataaatgaagcattcgcggcccaagcattatactgcatccataaactgggcatcgatttgaataaagtaaatccaagaggtggtgcaatcgcgttaggccatcccttgggttgtactggcgcaaggcaagtagctaccatactaagagaactgaaaaaggatcaaatcggggttgttagtatgtgtatcggtactggtatgggtgccgccgccatctttattaaagaatag

SEQ ID NO: 45763 - DNA, 4128 bp, Saccharomyces cerevisiae
atggactcttccccgaacaagaagacgtaccgctaccctcgcagatcgctgtcacttcacgcgcgtgatagggtcagcgaagcccgtaaattggaagaattgaatttgaacgatgggctggttgccgctggcttgcagttggtcggtgtagcgttagagaaacaaggtacaggatcacatatatacatgaaacagaagaatttctcagctaatgacgtttcttcgtcaccaatggtttccgaagaagtgaacggatcggaaatggattttaatccgaagtgcatgcctcaggacgcatcactcgtcgaaagaatgtttgatgagcttttaaaagatggaacttttttttggggggctgcttataagaatttacaaaacatctctctacgaaggaaatggttattgatatgtaaaatccgtagttccaatcattgggggaaaaagaaagtgacttcgagcacgacatactctacacatttggccactaatgaactagctgaaaacgcacactttttggatggcctagttagaaacctttcaacaggtggcatgaagttatcgaaggctctatataaactagaaaaattcctgcgaaagcaaagctttttgcaactttttctcaaggatgaaatttacttgacgacattgatcgaaaagactttgccactcatatccaaggaattacaatttgtttatcttcggtgctttaaaatactgatgaacaacccactggcgagaataagagcactacattctgagcctttaattcgctggttcaccgagcttctgacggatcaaaattctaatttgaaatgtcagttactttctatggagttacttttattattaacgtatgttgagggttccacgggttgtgagttgatatgggaccagctttccatattattcaccgattggctagaatggtttgacaaaatccttgcggatgatattgcaattcattcatccctttatttgaactggaaccaattaaaaatagactattcgacaactttcctactgctaataaactccatactgcaaggtttcaacaacaagactgcactagaaattttgaattttttgaaaaagaataatatacataacactatcacatttttagaactggcctataaagatgatcctaatagtgtcgtgatcatggaacaaataaaacaattcaaatccaaagaatctgcgatatttgactcgatgataaaaactaccaacgatacgaattcgcttcacccaacaaaagatatcgcaagaatagaaagcgagcctctatgtcttgaaaattgcctgttattgaaggcaaaagatagtcccgtagaggcaccaataaacgagattattcaatcgctgtggaaaatcttagactctcaaaaaccatactcagaatctattaaactattaaaattgataaattctttgctgttttatctcatagattcctttcaagtgtcaacgaatccttcttttgatgaaaccttggagtccgcagaaaatgtggattatgtttttcaagattctgttaataaattgttggattctctacaatctgatgaaattgctagaagagcggtcacagaaattgatgatcttaatgctaagatttctcatttgaatgaaaaattaaatttagtagaaaatcatgataaagatcatttaatagcaaaactagatgaaagtgaatctttgatatctctgaaaaccaaggaaattgaaaatctgaaactgcagttgaaggcaaccaagaaaagactagaccaaattaccacgcatcaaaggttatatgaccagccaccttcattggcaagtagcaacttgagtattgccggctcgataataaaaaataatagtcatggaaatatcattttccaaaatttagcaaaaaagcaacagcagcagcaaaaaatttctctgcccaagcgttcaactagtctactaaaaagtaaaagagttacgtccctttcatcatatttaactgatgcaaataacgaaaatgagtcccaaaatgaatccgaagataaatcaaaagactcattatttcaaagatctacgtcaaccattaattttaatatcccttctatgaaaaatattactaatatgcaaaatgtctctctaaattcgatactttcagagttggaattttcaaatagcctaggaacacaacctaattaccaatcgtctcccgtgttgtcttcggtttcttcttcaccaaaacttttccctcgactttcctcagatagtcttgataatggaatccaactagtacctgaagttgttaaactacctcaacttccaccgccccctcctccacctccccctcctccacttccacagtctcttttgactgaagcagaagctaaaccggatggtgtttcctgtattgcagcacctgcaccgccaccccttccagatctatttaaaactaaaacttgtggcgccgttccaccaccaccaccgccaccgcctttacccgagtccttgtcgatgaacaaaggcccctccaatcacgatttagttactcctccagctccacctttaccaaatggtcttctttcttcctcctcagtgtctatcaatccaacgacaaccgatttaaaaccacctccaactgaaaagcgattgaagcaaatccactgggataaggtggaggatatcaaagacacactttgggaagacacgtttcaacgccaagaaacaatcaaagaattacaaactgatggtatattctctcagattgaagatatttttaagatgaaaagtccgactaagattgcaaataaaaggaacgcagaatcctcaattgccttgtcttcaaacaatggcaagtcttccaatgagctgaagaaaatttcattcttatcaagagatttggctcagcaatttggtattaatttacacatgttttcccaattatctgatatggaatttgttatgaaagtattgaactgtgataacgacattgtccaaaatgttaacatactgaaatttttttgtaaagaagagttagtaaatataccaaaaagtatgcttaataagtacgagccatattcacagggtaaggatggtaaagcagtaagtgacttacaaagagctgacagaatatttttggagttgtgtatcaatttaagattttattggaatgcaagatcaaagagtctgctgacattgtcaacatacgagagagattattacgatttgattttcaagttacaaaaaattgatgatgcaatttcacacttaaatcgttcacctaaatttaaaagtttgatgtttattatcacggaaataggcaatcatatgaataaaagaattgttaagggtatcaaattgaagtcattgactaaacttgcctttgtcagatccagtattgatcaaaatgtatcatttttgcattttattgaaaaagtcataagaataaaatatcctgatatatacggttttgtggatgatttgaagaacattgaagatttaggtaaaatctcactagaacacgttgaatcagagtgtcatgaatttcataaaaaaattgaggatttagttactcagtttcaagtaggaaagctatccaaagaggagaacttagaccccagagatcaaattattaaaaaggtcaagtttaagattaatcgggccaaaacaaaaagtgaattattgattggtcaatgtaaattaactttaatagatttgaataaactgatgaaatattacggtgaagatcccaaagataaagagagtaaaaacgaatttttccaaccctttattgaatttttagccatgtttaagaaatgtgccaaggaaaacattgaaaaggaggaaatggaaagagtgtacgaacaaaggaagagcttgttagatatgaggacaagcagtaataagaaaagcaatggaagtgatgaaaacgatggtgaaaaagtaaacagggatgctgttgatctactcatatctaaattacgcgaagtaaagaaggatccagaacctctaagaagaagaaagagtacaaaactcaatgaaatagccattaacgtacatgaaggagatgtaaaaacgagaaaggatgaagatcacgttttactagagagaacgcatgctatgctgaacgatattcaaaatatatag

SEQ ID NO: 45764 - DNA, 3216 bp, Saccharomyces cerevisiae
atgctagacgatgataagggcacggccatgcatccacatataacgccgttcacgcctgagtactcaaatgaattactgcgaagggtccaggacctgtaccacgaagatatcaagcactactatccgcagctaaaactggagaagctgctggaccttctggagcatacagagtacctattcgagttatatctagattcaatccatcacgataggcccaacgatgcactgacagcgtttatcattggatgctactacgtgttcttaattattccacaatctttgcagttccaaacacgaaacaagtcctacagcatctatacagatctaaaaaagatgtatgagaatgaaatgaacatgaccaatgttgtgcttatggtgaagaaagaaatcggtgtggtcctagatgaatcggttaaacacggggccggtattgagcacagaatcaccaagaagagggcattttcagttccagctgacgatctttcaggtcaggtagcttcactatcacttgacaccgcggcaccgcaagatcatggcctcaaaggcacgtttactgaagacgacgcagaacaatcttcacctgtttggacagcaccaaacttagagcccaacgaccaattgaaactggctttattgcccgaagtgataccaacgccagcttttcgtgagcctgaaagaaagacaagtgttccagtgagaccatctgttttattggaagatgtaccctccatataccacgaggatgacactagtttcgcatctttgaacccaccatttcgagaaataaccgcagatagatcagtaactcatcgaaaggattcttaccattctgtttatatggtggatagcggcaacctcaaggaagacaatgatgatctgttcaacgttgagaatgatggcttcatccagagtttggatattttacaaaagcagagtataatcacagcaccagaattgtttagtattttatcgaatcgcgttgaacgtgaaaaggttttactcatcgacttgagaataccacaaagatctgcaataaatcacattgtggctccgaacttagtgaatgtggatccaaacttgttgtgggacaagcagacgaacacacctatctacaaggatgacatattggaacatttactgaaggagaatgagaattttataaaccgtaataaatttgattacattgtttactatactgatgtgaagaccttcatgactataaattttgattatgcatttatttttttttatttgatgctgacttctcagaagactcctttaacaactgtacctactaccctcttaggtgggtacgaaaaatggaagaaaactctgcattcgtatgcccaggagtatcatatctctattgaagattacttgtacagaccttactcacagaaggcgcgcttacaacaggagcagcagcagcagcagcagcagccggattctcaggactctttttccgctaaggaatcatctacaaaagttcctgagcctccctcctggaagccccctgacctgcctataaggttaaggaaacgtcctccacctccaccgcctgtatcaatgcccacaaccccagaaattccacctcctctgccccctaagataatggttcattcacaagtcagttctatctctcgaaagccgccaataccagcaaagcagcatgtcaaaaaggaacaacttaactccaatgaaattattcaaagaaaaagacagcaccagcatcagcattacgaccaacaaatattacaaccgcaaagggcgtacaatattccaactattgaacgcagtccaaacgtatacgtttcgttgtccatcacgggactaagaaatttgggcaatacatgttacattaatagtatgatacaatgtctattcgctgcgaaaacattccggacactcttcatttcatccaaatataagagctatctgcaaccaataaggagcaacggatctcattattctcctaaactttcgaattcactaagtatgctcttcaacaagatgtatctaaatggtggttgctcagttgtcccaacaggatttctcaaagttatcaatcaattgcgtcccgatttgaaaattcctgatgaccaacaggatacccaagagttcctaatgatacttttagacaggttacacgatgaactttccgaccaacagcatgtagcgaacgattatccgaatttattattgtataatgcagatgccctaaaggtttcaaacaacgaatataagcactggtttgacaaaaatgtcattggtaatggtatatctcctattgatgacatttttcaagggcaaatggagaacagcttacaatgtaaaaggtgcggttacactactttcaactatagcacattttatgttttatcactggctataccaagacgttccatgaagttgagtaaacttggtaggtctactgagaaaagagttaagttagaggattgtattaatatgtttacaagcgatgaggtactctctggtgaaaatgcatgggattgcccacgctgtggccccacggcgtctgtgtctacatctgtgtctgcattagagaatgagccatccattgttaagagtaaaaagaaaaaaagtcggttttttacattacatacaggaaccaagcgtcgtcatctcgacttttttggagacggtattactgagggccataatagcaataataataatacgacaatctttgaacgagaaaggtccagatcacccttcaggatgttgggtggtagtgggaagaggtccagttccagtacaccgttcagtactggtggtaatgatagtaacaactcgagtgattacaagaacaaaaaattgacaacagtgaaaacgataaattttgtaactttaccaaaaatcttagtcatccatttatcgagattttattacgatttgaccaagaaaaataacaccgtcgtaacatatccattgatactaaacattatattgaaaaacaatgacactatgaaatataagctatttggagtggttaaccatacaggcacattaatcagtggccattacacgtcactggtgaataaagaccttgaacacaatgtgaatattgggcgttctaaatggtactatttcgacgatgaggttgtcaaggcagataggaaacatggatctgataaaaacttgaaaatttcaagtagcgatgtctacgtattgttttatgaaagggtttatgactag

SEQ ID NO: 45765 - DNA, 1950 bp, Saccharomyces cerevisiae
atgttttcggtaacgagaagaagagctgccggtgcagctgctgccatggccacagccacggggacgctgtactggatgactagccaaggtgataggccgttagtgcacaatgacccgagctacatggtgcaattccccaccgccgctccaccgcaggtctctagacgagacctgctggaccgtctggccaagacgcatcaattcgacgtgttgatcatcggtggcggggccacggggacaggatgtgccctagatgctgcgaccaggggactcaatgtggcccttgttgaaaagggggattttgcctcgggaacgtcgtccaaatctaccaagatgattcacggtggggtgcggtacttagagaaggccttctgggagttctccaaggcacaactggatctggtcatcgaggcactcaacgagcgtaaacatcttatcaacactgcccctcacctgtgcacggtgctaccaattctgatccccatctacagcacctggcaggtcccgtacatctatatgggctgtaaattctacgatttctttgccggttcccaaaacttgaaaaaatcatacctactgtccaaatccgccaccgtggagaaggctcccatgcttaccacagacaatttaaaggcctcgcttgtgtaccatgatgggtcctttaacgactcgcgtttgaacgccactttagccatcacggctgtggagaacggcgctaccgtcttgaactatgtcgaggtacaaaaattgatcaaagacccaacttctggtaaggttatcggtgccgaggcccgggacgttgagactaatgagcttgtcagaatcaacgctaaatgtgtggtcaatgccacgggcccatacagtgacgccattttgcaaatggaccgcaacccatccggtctgccggactccccgctaaacgacaactccaagatcaagtcgactttcaatcaaatcgccgtcatggacccgaaaatggtcatcccatctattggcgttcacatcgtattgccctctttttactgcccgaaggatatgggtttgttggacgtcagaacctctgatggcagagtgatgttctttttaccttggcagggcaaagtccttgccggcaccacagacatcccactaaagcaagtcccagaaaaccctatgcctacagaggctgatattcaagatatcttgaaagaactacagcactatatcgaattccccgtgaaaagagaagacgtgctaagtgcatgggctggtgtcagacctttggtcagagatccacgtacaatccccgcagacgggaagaagggctctgccactcagggcgtggtaagatcccacttcttgttcacttcggataatggcctaattactattgcaggtggtaaatggactacttacagacaaatggctgaggaaacagtcgacaaagttgtcgaagttggcggattccacaacctgaaaccttgtcacacaagagatattaagcttgctggtgcagaagaatggacgcaaaactatgtggctttattggctcaaaactaccatttatcatcaaaaatgtccaactacttggttcaaaactacggaacccgttcctctatcatttgcgaatttttcaaagaatccatggaaaataaactgcctttgtccttagccgacaaggaaaataacgtaatctactctagcgaggagaacaacttggtcaattttgatactttcagatatccattcacaatcggtgagttaaagtattccatgcagtacgaatattgtagaactcccttggacttccttttaagaagaacaagattcgccttcttggacgccaaggaagctttgaatgccgtgcatgccaccgtcaaagttatgggtgatgagttcaattggtcggagaaaaagaggcagtgggaacttgaaaaaactgtgaacttcatcaagacgtttggtgtctaa

SEQ ID NO: 45766 - DNA, 1041 bp, Saccharomyces cerevisiae
atgcagaagagcatattgctgactaaacctgacggaacacaatcgaatctacacagcatcaaaacggaaacgcccaccacggtggagttcgactcggagcagatggaaaggggccacagggaaagaggtcgtagcaagaagaaaagaggcgaacgagactcaaacgtgagcagtctgtcgcggtcgagaagcagggccagtagccgcagcagagtaagggaggaagagttcctcaagtggaccgtgttgaggcaggacccctcgatgcggttgagggtcgtggatgtggattctgaagaggaaggtgagggcaacgacgaagatgacgacgacggcgacggcgacgatatggacgaggaagagtccgatgaagagcaagtgagcgatatagagaacgatttagagattgacgaggagttccactacgatctgggcatgaaagtgttacccaacttttgtaccagcataaacgaagtgctagactccagcaagccctggatagccaagtacgagatcagcatccgtggccacgaaaacgaagacgtgtctctggagcaactcgacggaggctacgtcagagccatgcaactactcaccaagggtgccggcgcagaggccgggaaccaaaggtccttcatcctctacacggacctgagcagcgagtccacctacgccctgacctatctcatgggcgcagctgtcaaccagggagacaccgtctacattgtccactgggagccctcgaagcccacggacgactcccagatgttcgccaacgttgccagaatcagaaagcacgtcatgcacctgtttgactgcgtcgcgggcgtgctcgacgacctcgacgtcgtcgtcctctccttgacccatccgtacccaaaacacctcctcaacgagatgatccacggcctcaagccagtcgccctgtgctgctccctctcggtcatcctgtccactctgcagaacttcgtctgctctgtgcccatcctcgcggttagaaagaagctgaaacgtgccaagcgcaagggcatcagcgagtga

SEQ ID NO: 45767 - DNA, 5040 bp, Saccharomyces cerevisiae
atggaggacaaaatatctgagtttttaaatgttccattcgaatcacttcaaggtgttacctatcctgtcttaagaaagttatacaagaaaatagccaagtttgaacgttctgaagaggaagtgacaaaactcaatgttttggtcgatgagatcaaatcgcagtactattcaaggatttcaaaacttaagcagctactagatgaatcttctgagcagaagaacacagctaaagaagaattgaatggcttgaaagatcagctgaatgaagaacgttccagatataggcgggaaatagatgcactaaaaaaacaattgcatgtgagccatgaagctatgagagaagtaaatgacgaaaaacgagttaaagaagaatatgacatttggcagagtagagatcaggggaatgattctttaaatgatgatttgaacaaagaaaataagcttcttcgaagaaagctgatggaaatggaaaatatactacaaaggtgcaagtccaatgctatatcattacagttaaagtacgatacctcagtacaggaaaaagaattaatgttacaaagtaaaaaattaattgaagaaaaattatcatcttttagcaaaaaaacgctaacagaagaagtcacaaaatcatcgcacgtagagaacctcgaagaaaaactataccaaatgcaatccaactatgaatctgtctttacgtacaataagtttttactaaatcaaaataaacaattatcccagtcggtggaagagaaagtactggaaatgaaaaatttgaaagataccgcaagtgtggaaaaagcagaattctccaaagaaatgactttacaaaaaaatatgaacgatttgctacgctcacaactaacatcattggaaaaagattgttccttgagagcaatagagaaaaatgatgataattcctgcaggaaccctgaacatactgatgtgatagacgaacttatagacacaaaattaagactcgaaaaatcaaaaaatgagtgtcaaaggttacagaatatagttatggattgtaccaaggaagaagaagctacaatgactacgagtgcagtttctcccacagtaggtaaactattttctgatatcaaagtgctgaaaagacaattgataaaggaaaggaatcagaaatttcaattacagaatcaactggaggattttatactagaattagagcataaaacccctgaactgatctcttttaaggaaagaacaaaatcattggaacatgaactaaaacgttccacagaactactagaaactgtttctttgactaagcgtaagcaagaaagagaaataacttcactgagacagaagataaatggctgtgaagcaaatattcattctctggtgaaacaacgtttggatttggcccgtcaagttaaactacttcttttaaatacatctgcgatacaggaaacggcatcgccgttatcgcaagatgaactgatatcattaagaaaaatactggagtcgagcaatatcgtaaatgaaaatgattcccaagccatcattacggaaagactggttgaattcagtaatgtgaatgagctacaagaaaaaaatgttgaactcttgaattgcattcggattttggctgataaattagaaaattatgaaggaaaacaagacaagaccttacaaaaggtagaaaaccagaccattaaagaagcaaaagatgcaataattgaactggagaacatcaatgcgaagatggaaacccggataaatatcctattaagagagcgggattcttacaaattgctggcatcaactgaagaaaacaaggccaacacaaattctgtcacttctatggaagcagcccgtgaaaagaagattagagaacttgaggcagaactttcatctacaaaagtcgaaaactctgctattattcagaatttaagaaaagagttgttaatttataagaaatcacaatgcaaaaaaaaaacaactttagaggattttgaaaatttcaagggtttggcaaaggaaaaagaacgtatgttagaggaagcaatagaccacctaaaagctgaactcgagaaacaaaaatcatgggttccatcatacatacatgttgagaaagaaagagcctcaactgaactgtcacagtctaggatcaaaatcaaatctttggagtacgagatttccaaactgaaaaaggaaactgccagctttatacccacgaaagaatctttaactagagatttcgaacaatgctgcaaagaaaaaaaagaattgcagatgagactaaaggagtctgaaatcagtcataatgaaaataaaatggattttagctcgaaagagggccaatacaaagccaaaatcaaagaattggaaaacaatttggaaagattacgttccgacttacaatcaaagatacaagaaatagaatcgatacgctcatgcaaggattcgcaactcaaatgggctcaaaataccatcgatgatacagaaatgaaaatgaagtccttactaactgaattatcaaataaggaaacaacgattgaaaaactttcatcagaaatagagaacctggataaggaactaagaaaaaccaaattccaatataaattcttggatcaaaatagtgatgcaagcacgttagaaccgactttgagaaaagaattagagcaaatccaagttcaattgaaggatgcaaactcacagatacaggcttatgaagaaattatatcatcgaatgaaaatgcgctaatagaattgaaaaatgaactagcaaaaaccaaagaaaattacgatgctaagattgaactagagaagaaggaaaaatgggcgagggaagaagatctatctcgtttacgcggagagctcggtgaaataagagctttgcaaccgaaactaaaagaaggtgcattgcatttcgttcaacaatcagaaaagttgaggaatgaggtagaaaggatccaaaaaatgatagaaaaaattgaaaaaatgagtacgattgtccaactgtgcaaaaaaaaagaaatgtcccaatatcagtccacaatgaaggaaaataaagatctatctgaattggttatccgccttgaaaaggatgcggctgattgccaagcagaattaacaaaaaccaaatcctcattgtatagcgctcaggatttactcgataaacatgaaaggaaatggatggaggaaaaggctgattatgaaagagaattgatatctaatattgaacagacggaatccttgcgtgttgaaaattcggtattgattgaaaaggttgatgacacagcagcaaataatggcgataaagatcatttgaagctagtttctttgttttcaaacttacgtcatgaaagaaattctttagagacgaagttaaccacctgtaagagagaattggcattcgttaaacaaaagaacgatagtttagaaaaaacgataaatgacctgcaacgaacccagactttatcggagaaggaataccaatgctctgcagttattattgacgaattcaaggatatcacgaaagaagttactcaagttaacattttaaaagagaataatgccatcttacaaaagagtctcaaaaacgtaaccgaaaaaaacagggaaatttataaacaattaaatgataggcaagaagaaatttctcgattacagcgtgatctcatacaaacaaaagaacaagtttcgataaattctaacaaaattttagtatatgaaagtgaaatggagcaatgtaaacagaggtaccaggacttatctcaacaacaaaaagatgcccaaaaaaaagacattgaaaagctaactaatgagattagtgatttgaagggaaaactttcaagcgctgagaacgcaaacgctgacttggaaaataaattcaataggctaaagaagcaggctcatgaaaaattggacgcatctaagaaacaacaagctgctttaactaacgaactcaacgaattaaaagcaattaaagacaaattagaacaagatctacactttgaaaacgctaaagttattgatctagatacgaagctcaaagcacatgaactccaatcagaagacgtctcgagagatcacgaaaaggacacttatcggacattaatggaggaaattgaatcactcaaaaaggagttacaaattttcaaaactgcgaatagctcatctgatgcatttgagaaattgaaagttaacatggagaaagaaaaggacagaattattgacgaaagaacgaaggaatttgaaaaaaaattacaagagaccttaaataagagtacaagctcagaagcagaatacagtaaagatatcgaaacattgaaaaaggaatggctaaaggaatatgaagatgaaacgttaaggagaattaaggaagcagaagagaatttaaagaaaagaataaggttaccaagcgaggaaaggatacaaaagatcattagtaagcgtaaagaagaattagaagaagaatttcgaaagaaattgaaagaaaacgcgggaagcttaacgtttcttgataacaaaggtagcggggaagatgccgaagaagaattatggaacagtccatcgaaggggaattctgagaggccgtcggctgtcgctggctttataaatcaaaaaaaccttaaacctcaagaacaattgaagaatgtgaagaatgacgtttccttcaatgacagccagtcaatggttacaaataaagaaaataatatcgtggatagtagcgctgctggtaacaaggccattccaacctttagttttggtaagccattcttctcctctaatacatcatctcttcaaagttttcagaacccattcacagcatcccaatctaatatcaatacgaatgcccccctacgtacactcaatattcaacctgaagttgcagtcaaagcggcgattaacttttccaacgtaaccgatctaactaacaatagcaccgatggagcaaaaataacagaaattggaagtacatctaaacggccaattgagagcggtacatcttctgatccagacaccaaaaaggttaaagagagtccagcaaatgatcaagcttccaacgagtga

SEQ ID NO: 45768 - DNA, 821 bp, Saccharomyces cerevisiae
atgcaaatgtatgcaccatatccattctaaacatagtttttcgaacgttcagagcttaaagggacaattattttagaaactgaatttttacccagtggaataacatcgtatctgtaaagtctacaaaattttttatccatcaaaaattaaaacaaagaaaactgccaaactgaatatgaggaactttcctctctaggaatgacttagtgaatgtacagtgacttgtggaaaatatgattagattttgagcgggtgatgcgacttaacagtctcattgcctaagaaatatccaaatttgtggttcatgctctcccccaagatatgacgatgagagctcgtttaaaattttgtcttcttccgaacagttatgaaaaaactattacgtgtttttatgatatccttactaacttgtcatttttttataaaattatttttttaacagttttgtcaagactttgactggtaagaccatcactttggaagttgaatcttctgacactattgacaatgtcaagtcaaagattcaagacaaggaaggtatcccacctgaccaacaaagattgatctttgctggtaagcaattggaagacggtagaaccttgtctgactacaacattcaaaaagaatccactttgcacttagtcttgagattgagaggtggtatcattgaaccatctttgaaagctttggcttccaagtacaactgtgacaaatctgtttgccgtaagtgttatgctagattgccaccaagagctaccaactgtagaaagagaaagtgtggtcacaccaaccaattgcgtccaaagaagaagttaaaatga

SEQ ID NO: 45769 - DNA, 3663 bp, Saccharomyces cerevisiae
atgcgatttggcctgccatcaaaattggaactcactcctccgtttaggataggcatccgaactcaactaacggcactagttagtatagtggctttgggctcactgattattctggctgtaacgacaggggtctattttacctcgaactataaaaatttaaggtccgatagactgtacattgccgctcagttaaagtcatcacagattgaccaaactctaaactacttatattaccaggcgtactatttggcatcaagagacgccctgcaaagctcactaacaagttacgttgcaggtaacaagagtgcagataattgggtagattccttgagtgtgattcaaaaatttttgagctcttcaaacttgttttatgttgctaaagtttacgattcttcatttaatgctgttttgaacgctacgaataatggaactggtgatctaattccagaagatgttttagacagtttgttcccattatccaccgatacaccgctaccttcttcactggaaactataggtatattgacggatccagtactaaatagcaccgactatttgatgtctatgtctttacctatttttgccaatccttctattatcttgactgattcaagggtttacggatacattactataataatgtcggcagagggtctgaaaagtgtgttcaacgatacaactgctttagaacattccacaattgccattatttctgcagtatataatagtcaaggcaaagcttcagggtatcattttgtctttccaccgtatggatcacgatcagacctcccgcaaaaagttttttctataaaaaatgatacattcattagtagcgcatttagaaacgggaagggagggtctttgaaacaaaccaatatcctttctacacggaatactgctttaggctattcaccatgttcgtttaacctagttaattgggtcgcgatagtttcacagcctgagtcggttttcctttctccagcaacgaaactagcaaaaatcatcaccggcactgtcatcgctattggtgtctttgtcattttgttaacccttcctctagcacactgggcagtgcaaccaattgtacgtctacaaaaggcaactgaattaattacagaggggagaggccttcgaccgagcaccccaagaacgataagcagagccagttcattcaaaagaggatttagttctggatttgctgttccttcttcgttattacaatttaatactgctgaagctggcagcaccacaagcgtaagtggccatggaggcagtggccatggcagtggtgcagctttttcagcaaatagtagcatgaaaagcgctataaaccttggaaatgagaaaatgtcacctccagaggaggagaacaaaataccgaataaccacaccgatgctaaaatatcaatggatggctcgctaaatcacgatttgcttggaccacattccttgagacataatgacactgacagaagttccaatagatctcacattctcacaacttctgcaaatttaactgaagctaggctaccagattatagaagactattttctgatgaactttccgatttaacagaaaccttcaatactatgacagacgcattagaccaacattatgctcttctagaagaaagagttagggcgaggacaaaacaactcgaagctgccaagattgaggcagaggccgcaaatgaagcaaaaaccgtctttattgccaatatttcgcacgaattgagaacgcctttaaatggtattctgggtatgacggctatttcaatggaagaaaccgatgttaacaaaataagaaatagtttaaaactcatttttagatcaggtgagcttttgcttcatattctaacggaattgttaactttttccaaaaacgttcttcaaagaacgaaactggagaaaagagatttttgcattaccgatgttgccttacaaataaaatcgatatttggtaaagttgcaaaggatcagcgtgttcgtctttcaatatcattgtttcctaatttgataaggacaatggttctttggggtgattccaacagaattattcaaattgtgatgaatctagtgtccaatgcactaaagttcacccctgtagatggtaccgttgatgtaagaatgaaactgttgggtgaatacgacaaagaattaagcgagaagaagcaatacaaagaagtgtatatcaaaaaagggacagaagtaaccgaaaatttagaaactacagataaatacgatcttccaactttatcgaaccataggaaaagtgtcgatttagaatccagcgctacttccctaggaagtaatagagacacttcgacaattcaggaagagataacaaaaagaaatactgttgcgaatgaaagtatctataagaaagtgaatgacagggaaaaagcttcgaatgatgatgtatcttctatagtatcaacaactaccagctcgtatgataacgctatcttcaatagtcagttcaataaagcacctggctcagatgatgaagaaggtggtaacctaggaagacctatcgaaaaccccaaaacgtgggttatttctattgaagtggaagacactgggcctggtattgacccttccttacaagaatctgtatttcatccatttgttcaaggtgatcaaacattgtccaggcaatatggtggtactggcttaggtctatcaatctgtagacagttagcaaatatgatgcatggaacgatgaaattagagtcgaaagtaggtgttggtagtaaattcacttttaccttgccattaaatcaaactaaagagatcagttttgcagatatggagtttccttttgaggacgaatttaatcctgagagtagaaagaacagaagagtcaagtttagtgttgctaaaagcatcaagagccgacaatccacatcatctgttgcaacaccagctacaaatagaagtagcctaaccaacgacgtgctaccggaggtaagaagtaaaggtaagcatgagacgaaagatgttggaaatcctaacatgggaagagaagaaaaaaacgacaatggagggcttgaacaactgcaggaaaaaaatattaaaccttctatatgtcttacaggtgctgaagttaacgaacaaaattccttgtcttctaagcatcgttctcgacatgaaggtctaggttctgtcaatcttgatagaccatttttgcaaagtactggtacagccacatcaagtagaaacatccccacagtcaaagacgacgataaaaatgaaacaagtgtcaaaattttggttgtagaagataatcatgtaaatcaggaagttatcaaaagaatgttgaacttggagggcattgaaaatattgaactggcttgcgatggccaagaagcattcgacaaagttaaagaattgacatctaagggcgaaaattataatatgattttcatggatgtccagatgcctaaagtggatggtttactttctaccaagatgataaggcgcgatttaggttatacctcacctattgtcgctctaaccgcttttgctgacgatagcaacattaaagaatgtttggaatcaggaatgaacggatttttatcgaaaccaatcaaaagaccaaaattgaaaactattcttactgagttttgtgcagcatatcagggaaagaaaaataacaaatga

SEQ ID NO: 45770 - DNA, 2532 bp, Saccharomyces cerevisiae
atgacggacgttgaaggctaccaacctaagagcaaggggaaaatctttccagatatgggtgagtcctttttctcatcagatgaggattcaccagctactgatgcagagatcgatgagaactatgatgataacagggaaacgtcagaaggacgtggagaaagggataccggcgccatggtaacagggttgaagaagcctcggaaaaagaccaagagtagcaggcatacagcggcggattcctctatgaatcaaatggacgctaaggataaagcgcttttgcaggacactaatagcgatataccagcagatttcgttccagattccgtctctggaatgttcagaagccatgactttagttatttgcggttaagaccagaccatgcttccaggcccctttggatctcgccaagtgacggtaggatcattctggagagtttctctccattagcagaacaggctcaggactttctggtcaccattgcagagcctataagtagaccctcccatattcatgaatacaagatcacagcatactctttgtatgcagctgtttctgtagggttggagacggatgatatcatttcagttctggatagattatccaaagtacccgttgctgaatcgataatcaacttcattaaaggggctaccatttcatacggtaaagtgaaactagttattaagcataatagatatttcgtggagactacacaagcagatattctgcaaatgttgctgaatgattccgtcatcgggcccctaagaatagatagcgatcatcaagtacagccaccagaggatgtactacagcaacaacttcagcaaaccgctggaaaacccgctactaatgttaatccgaacgatgtggaagccgtgtttagtgcagttataggtggtgataatgagcgggaagaagaagatgatgatattgatgccgttcactcctttgaaattgccaatgagtctgttgaagtcgtaaagaaaagatgtcaagaaatcgattatcccgtgttggaagaatacgactttagaaacgaccatagaaacccggatttagatattgatttgaaaccttccactcaaatcagaccctatcaagaaaaatcgctgagtaaaatgtttggtaatgggcgtgctcgttcagggattattgttttgccatgtggcgcaggtaaaactttggtcggtattaccgcagcatgtactataaaaaaatccgtaattgttttatgtacttcatcagtctccgtcatgcaatggaggcagcaatttttacaatggtgtaccttacaacctgaaaattgtgctgttttcacctctgataataaggaaatgttccagacagaatccggtttggttgtttccacttattcaatggtggcaaacacaagaaacaggtctcatgattcacaaaaagttatggatttcttgaccggtagggaatgggggttcattattcttgacgaagttcatgtggtgcccgccgcaatgttccgtagggtggtctccaccatcgcagcacacgccaaattgggactgaccgcaacgctggttagagaagatgataaaattggtgatctgaattttttaattggtccaaaactttatgaagcaaattggatggaattatcccaaaaaggacatattgcaaatgtccaatgtgcagaggtttggtgtcccatgacagcagaattttaccaagagtatttaagagaaactgcaaggaaaagaatgctactgtatatcatgaatccaacaaagtttcaggcatgccaattcttaattcaatatcacgaaaggaggggtgataagatcatcgttttttcagataatgtttacgccttacaagaatatgctttgaaaatgggaaaaccatttatttatggttccacaccacaacaagagcgtatgaacattctgcaaaatttccagtacaatgaccaaatcaataccatatttctatcaaaagttggtgatacttccatcgatttaccagaagctacctgtttaattcaaatatcttcgcactatgggtctcgtcgtcaagaagcccaaagattaggaagaattttaagagctaaaagacgtaatgacgaaggtttcaatgcgttcttttattctctggtttctaaggatacgcaagaaatgtactactcaacaaagagacaagcgtttttggtagatcaaggttacgcattcaaagtcattacacatttacacggaatggagaacattccaaatttggcatatgcttcacccagagaacgtagagagctattgcaagaagtattattgaagaacgaagaagctgctggtatcgaggtcggtgatgacgctgacaattctgttgggagaggttcaaatggccacaaaagatttaaatcaaaggccgttagaggtgaaggttcattgtctggtcttgctggcggtgaagatatggcatatatggaatacagtaccaataaaaacaaagaactgaaggaacatcatccattaatcagaaagatgtattataagaatttgaagaagtga

SEQ ID NO: 45771 - DNA, 1584 bp, Saccharomyces cerevisiae
atgagtgtacagatatttggagaccaggttacagaagaaagagcggaaaacgcccgtttgtcggcgtttgtcggtgccattgccgtgggtgatttggtgaaaagcacattaggcccaaaagggatggataaattattgcaaagtgcgtccagtaacacttgcatggtaacaaacgatggtgctacgattctgaagtcaattccgctggataatcccgcagccaaagtgttggtgaacatcagtaaggtgcaggatgacgaagttggagatggtaccactagtgttactgttttgagcgcagagttgcttagagaagcagagaagttgattgatcaatccaaaatccaccctcaaactattattgaaggttaccgactagcttcagcagccgcattggatgcgttaacgaaagcggctgttgacaactctcatgataagaccatgttccgtgaagatctgatccatattgccaagactactttatcttccaaaattttgtctcaggataaggatcacttcgcagaattagcaactaatgctattttgagattgaagggctccactaacttagaacatattcagatcattaagattcttggtggaaagctatcagattcgttccttgacgaaggtttcattcttgccaaaaaatttggtaacaaccaacccaagagaattgaaaatgctaagattctaatcgccaatacaactttggatacagacaaggtcaaaatattcggcaccaaattcaaagtcgattctactgctaaattggcacaactagaaaaggcagaacgtgaaaagatgaagaataaaattgccaagatttccaagtttggtatcaacactttcatcaatagacaactaatttatgactatccagagcaattatttacagatttgggcataaactcaattgagcatgctgattttgaaggtgtagaaaggctcgccctggttacaggcggtgaggtggtgtctacatttgacgagccaagtaaatgcaaactgggagaatgtgacgtgatcgaggaaattatgcttggtgaacagccattcttgaagtttagtggttgcaaagctggtgaagcttgtaccatcgtcctaagaggtgctaccgaccaaacgcttgatgaagctgagagatccctgcatgacgcattgtccgtgttgtcacagaccacaaaggaaacaagaactgttcttggcggcggttgcgccgagatggtcatgtcaaaagctgtggacaccgaagctcaaaacatcgacggaaagaagtcccttgccgtggaggcttttgcccgtgctctgagacaactgccaaccattttggcagataatgctggttttgacagcagcgaacttgtgtccaaactaagatcctccatatacaacggtatctccacctcaggtttagatctcaacaacggaaccattgccgacatgagacagttaggtatcgtcgagagttacaagctaaaacgagcagtagtcagctctgcatctgaagccgctgaagttctactaagggtggataacatcatccgtgcaagaccaagaaccgccaatagacaacatatgtaa

SEQ ID NO: 45772 - DNA, 738 bp, Saccharomyces cerevisiae
atgaatagatgggtagagaagtggctgagggtatacttaaaatgctacattaatttgattttattttatagaaatgtatacccacctcagtcattcgactacactacttaccagtcattcaacttgccgcagttcgttcccattaataggcatcctgctttaattgactatatagaagaacttatactggatgttctttctaaattaacgcacgtttacagattttccatctgcattattaataaaaagaacgatttatgcattgaaaaatacgttttagattttagtgaattacaacatgtggataaagacgatcagatcattacggaaactgaagtgttcgacgaattccgatcttccttaaatagtttgattatgcatttggagaaattacctaaagtcaacgatgacacaataacatttgaagcagttattaatgcgatcgaattggaactaggacataagttggacagaaacaggagggtcgatagtttggaggaaaaagcagaaattgaaagggattcaaactgggttaaatgtcaagaagatgaaaatttaccagacaataatggttttcaacctcctaaaataaaactcacttctttagtcggttctgacgtggggcctttgattattcatcagtttagtgaaaaattaatcagcggtgacgacaaaattttgaatggagtgtattctcaatatgaagagggcgagagcatttttggatctttgttttaa

SEQ ID NO: 45773 - DNA, 2841 bp, Saccharomyces cerevisiae
atgtctgataatttgttatctttagagaatccggtggtgcctagtcactatgagttgcgtctagaaattgaccctaagcagtcgtcgcccaatttcaaaggatccgccataatccatttgaaattcaatccgaactccaccaccttagcttctatcgaagacagttttacccagttcaagttacattccaaggatttgattgtgttgtctgcacatgccaccatagggtctactaagtttgatctaaaaatttctcaggacactggaaagcatttgtcgattttcaactctgaatctcctattcaattgtccaacgattgccctctgattttgtccgtgcaatacgtgggtaaaattcgtgacataaaaacacatcatgataagacttttggtattttcaaaaccaattttatggatcgtaaaaccggtactgccaataatcacgtcgttgctactcactgccaaccgttttccgctagcaatattttcccatgtattgacgagccttcaaacaagtccacttttcaattgaacattgcaacggatgcacaatataaagccgtttccaatactcctgtagagatggtcgaagctttggatagttctcaaaaacatttggtgaaatttgccaagacacctttgatgactacttccgtatttggtttttctattggtgatttagaatttttgaaaacggaaatcaagttggaaggtgataggactattcccgtttcaatttatgcaccttgggatattgctaatgcagctttcactttagatacagtccagaaatatctacctttgttggaatcctattttaaatgtccataccctctgccaaagttagatttcgtcctactaccatatttaagtgacatggcaatggagaactttggtatgatcaccatccaactaaaccacctgctcataccaccaaatgccttggccaatgaaaccgtcagagagcaagcacagcaactcattgtccacgaactcgttcatcaatggatgggcaactacatatcttttgactcgtgggaatctctttggtttaatgagtctttcgctacttggttagcttgccacatactagaacagaatggtgacctatcccattattggacctcggaaccttatttactacagcaagtggagccgaccatgtgcagagatgcagctgacgttaatggaagaagcatatttcagattgcgcaacggaacactggcatagattctcaaacctccgatatttttgatcctgaggcatacacaaagggtattatcatgctgaggtccctgcaattggctacaggcgaatctcatctacaaaagggcctggaaagtgtatttgaagatactaaaacatttcatgcgagaagcgtcaaaccaatggatatatggaatcatatcggaaaatttttgaagtctcaaaatattacaaactttgtttcatcttggacaagaacgccaggcttacctgtcgttaaggtcgaagtagaagagaaagacgggaaaacgcaaacaaaattgactcaacacagatttatcaatcaattatctactgaagaaaaggatcagttagaagatgtcccatatcaggtacccttattcggggttctgccagatggtaaaatggatactaaaaatgtactattgacggataggaccttaaagttcgattatcctatcttagtaattaaccatttagcccaaggttattaccgcgtttcatatgagtccgaagagtgctatgcattgattaatgataaaataactgaggagacgttatccgagattgaccttcggaagattttcttagacttgtcgcagtttattggagatgagggtttccagaattctattcatttgcacggtctctttaagatactaaaccatatcgcttctccttccacaaagattgcatcaaaatattgggatcctctttccaaggggttggaagttctgcaaacgatcgatcgtgccagtttaacgagctctaaattacaatctttcttaaagaaaaaaattgtcattccccttttcaataagattgattggccccacggtgaatttgataaaagcacaaaccctcacgagttgaaagtcatgtctcaagtcttgtttttaaataaaaactccgcaaaatgtgctgaattgtgtcaaatttattttaaacatctattacagggcccacgttcgagcgtaccgttagaattagtgaactcaatccttgtcgtcgtatcgcaacattgtgcaaacatcaagcagtggaagaaaatattcgatttggtgaaacgcagttcctgtactggtatcacaaaccatgtcattaatatgtatgaccaaaacagtagcgaaaccgccatgttgattcaaaacggtgcaatagaatctcttggattctgtttagattctgatatcgtgaaaaaaactttgaattttatcacttccaatattgagtcagaggggatggaactggcattattcggatttaattacaactttaagaagaggctgaacaaaaacgagaaacctcaagaccaagtcgttcgtgaaacgatctgggagtggtatatgggcaattttgaccaatgggcacggaaggctacaaggaaaggtaccaccacgggggatcatctacacaaggcgttaaggagtatttccctgataatctttcaaatgtttgtagcagacgagccacagaagatagaaaagtttattaatttggagaaagagaagttgggtcaaagcttgttatctttggacgacatctgggcctctgtccagcaagatgaagagtccagaaagactataagaagagacttggcctccttggtctga

SEQ ID NO: 45774 - DNA, 1182 bp, Saccharomyces cerevisiae
atgtcatcaagaataattgtcggcagtgcagcattggcagctgccatcacagctagcatcatggtcagagaacagaaggccaagggtcagagaagagagggcaacgtctccgcttactacaacggccaggagtacggcagttcagcacccccacagttgggaaagctacataacataaagcaaggcataaaggaagatgccttgtcgttaaaagacgcgcttctgggcgtatctcaaaaggctagggaagaggctccaaaggtaactaagcgtgtgatatcaccggaagaggatgctcagacacgcaagcagctaggccaaaaagccaaggattcttcctcgcaaagcatcttcaattgggggtttagtgaggctgaaagaaggaaagccatagccatcggggaatttgatactgctaagaagcgtttcgaagaggcagtggatcgtaatgagaaggagctcttgtccacggtgatgagagagaagaaggccgctctggacagagcatccattgagtacgaaaggtacgggagagccagagactttaatgagctttcggacaagctagaccaacaggaaaggaacagtaatcctttgaaacgcctgttgaagaataacacgggtgacgctaatactgaagaagccgctgcaagaagtgtccaaggctggggtgatacggcacaggagtttggtagagaagagttggaggaagccaagagaaatgcttcttcagagccaagcgaggcgcaaaaacgtcttgacgagctgaagaagatcaaggaaaagggctggtttggttacaacaaaggggagcaaagcgagcaacagattgctgaacgggtagccagaggtttagaaggatggggtgaaacagccgctcaactttccaaggacgaaatggacgatttaagatggaattatgagaattcaaagaaacaactggataagaacgtgtccgatgccatggactcgttatctaaggcgaaggaggacttgaaacagtacggcagccactggtggtctggatggacttccaaggtcgacaatgacaagcaggctttaaaagatgaggcccaaaagaagtacgatgaagcgttgaaaaagtacgatgaagccaagaacaaattcaaagaatggaatgataagggtgatggtaaattctggagctcgaaaaaggactag

SEQ ID NO: 45775 - DNA, 936 bp, Saccharomyces cerevisiae
atggtcgatcaccagtggacgccactgcagaaggaggttatctcaggtctgtccgcgggatccgtcaccacattggtagtgcatccattagatttactgaaggttcgtttgcaattatccgctacaagcgcacaaaaggcccattacggcccatttatggtaatcaaagagattatacgttcgtcggcgaatagtggacgtagtgttacgaacgaactgtatcgcggattaagcataaatttgtttggaaatgccattgcatggggagtttatttcggtttatatggtgtcacgaaagaattgatatacaagtcagtggcaaagccaggggaaacacagcttaaaggtgttgggaacgaccacaaaatgaattcgcttatttatttgtctgccggtgcttccagtgggttgatgacagctatcctaacaaaccctatctgggttataaagaccaggataatgtctacaagtaaaggcgcccaaggagcgtacacttctatgtacaacggtgtccaacaactgttacgaactgatggcttccagggcctatggaagggccttgtacccgcactgtttggtgtttcgcaaggtgccttatattttgcagtttacgataccttaaagcaaagaaaattgcgacggaagagggaaaatgggcttgacatccatttaacaaatcttgaaaccattgaaatcacatcgttgggaaaaatggtctccgtcactttggtttacccttttcaattattgaaatcaaacttacaaagtttcagggccaatgagcaaaaatttaggctctttcctttgataaaattaatcattgctaatgatggttttgttggactttataagggcctatctgcaaacttagtacgggccattccatccacttgcattaccttttgtgtatacgagaaccttaagcataggctttag

SEQ ID NO: 45776 - DNA, 2616 bp, Saccharomyces cerevisiae
ggatcctcgaccgaacaagtcaaacgaatcaacgatttgtttattgaaacatttcttcatgttgccaatggtgaaaaagaccctagaaatttactcttgtcatttgcacttaataaatctatcacatcgtccttgcaaaacgtggagaattttaaagaagacttatttgatgtcttattttgctatttcccaatcactttcaagccaccaaagcatgatccttacaagatctccaaccaagatttaaaaacagctttgcgatcagcaattactgcgacgccattatttgccgaagatgcttatagcaatttgctggacaaactcactgcttcttcaccggtagtgaaaaatgatacacttctgacgctattagaatgcgttagaaaattcggcggctcttctatattggaaaattggacgttactttggaacgctttgaaatttgaaattatgcaaaacagcgaaggaaatgaaaacactctactaaatccgtacaataaagaccaacagagtgatgatgtgggccaatatactaactacgatgcttgcttgaaaattattaatctaatggcattgcaactatacaattttgacaaagtatcatttgaaaagttcttcactcatgtattagatgagttgaaaccaaattttaaatatgaaaaggatttgaagcaaacctgccagattttgtccgctataggtagtgggaatgtcgagatatttaacaaggtcatttcgtcaactttccccttatttttgatcaatacatctgaagttgccaaacttaagctgctgattatgaatttttctttttttgttgactcgtacattgatttgtttggaagaacatctaaagaatcgttgggaacaccggtgccaaataataaaatggctgaatacaaagacgagatcataatgattttgagcatggccttgacaagaagctccaaggcagaggttaccataaggactctatctgtgattcaattcacaaaaatgattaaaatgaagggctttttaaccccagaggaagtttcactaattattcaatacttcacggaagaaatattaacggataacaacaaaaacatttactatgcttgtttggaagggttaaagacaatcagtgagatatatgaggatttagtttttgaaatatcattgaagaaattattggatttgttacctgattgcttcgaggaaaaaattcgagtaaatgatgaggaaaatattcacattgaaacaattttgaagattattcttgatttcaccacttcgagacatattttggtcaaagaaagcattacatttttagcgacaaaattgaatagggtagctaaaatttcgaaatccagagaatattgctttctacttatttcaaccatatattctctttttaataataataatcaaaatgagaacgtgctaaatgaagaagatgctcttgcactcaagaatgccattgagccaaaattatttgagataattactcaggaatcggccattgtaagtgacaattacaatttgacacttctatctaacgttcttttcttcaccaatttgaaaattccacaggctgcacaccaagaagaactagacagatataacgagcttttcatttctgaaggtaagataagaatcttagacacaccgaatgtattggctatttcatatgctaaaatattatccgcactaaataaaaactgccaattcccccaaaaatttacagtgcttttcggaacggttcaactactcaaaaaacatgctccaagaatgacggagactgaaaaattaggatacctggaattgctgttggtcttatcaaataaattcgtctctgaaaaagatgtgataggattattcgattggaaagacttatcagtaattaatcttgaagtgatggtttggttgactaaagggctgataatgcaaaactcattagagtcatcagaaattgcaaaaaagtttattgatttactgtctaatgaagagattggctcacttgtatcgaagctattcgaagtttttgtcatggatatcagttctttgaagaaatttaaaggtatcagttggaataataacgttaaaatcttgtacaaacaaaaattcttcggtgacatttttcaaacactagtcagcaactataaaaataccgtggacatgaccattaaatgcaattatttaactgcattatccttagtgttgaagcatactccaagccaatcggttggtccttttatcaacgatttattcccgcttttattgcaggctttggatatgcctgatcctgaagtaagggtatccgctttagaaactctgaaggacactacggataaacatcacactttaattactgaacacgtaagcacaatagttccattattactatctctttcgcttccgcacaaatataatagtgtcagtgtcaggttaatagccttacagcttctagaaatgattacgactgtagtacctctaaactattgtttgagctatcaggacgatgttctaagcgctttaataccagttttatctgacaaaaaaagaataataagaaagcaatgcgttgacacaagacaggtttattatgaattaggccaaatcccgttcgagtaa

SEQ ID NO: 45777 - DNA, 4080 bp, Saccharomyces cerevisiae
atgcttcaggaacaatctgagttgatgagcacggtgatgaataatacacctacaacagttgccgcattggctgcggttgctgcagcctctgaaacaaatggaaagctggggtccgaggaacaacctgaaatcactattccaaagccgaggagtagtgcacagttggagcagctactctaccgctatagggctattcaaaaccatccaaaggaaaacaagttggagatcaaggcaatagaagacacttttaggaatatatcacgtgatcaggatatctacgaaacaaagttggataccttgagaaagagtatagataaaggatttcagtacgatgaggatttattgaataaacacttggttgccttacagttactggagaaagatacagatgtccctgactacttcttagacttaccagacaccaagaacgataacactacggcgatcgaagtagactattctgaaaagaaaccaataaaaatatcagcagatttcaatgcgaaggccaaaagtttgggtttagaatcaaaattttctaacgctacgaagactgcattgggcgatccagataccgaaataaggatttctgcacgtatatccaacagaattaacgagctggaaagattacctgccaatctgggtacatactcactagatgattgtttagagtttattacaaaagatgatttatcgtccagaatggatactttcaaaatcaaagctcttgtggaattgaaaagtttaaagctactaactaaacaaaaatcgattaggcaaaagttaatcaacaatgttgccagccaggcacaccacaatattccatatctacgtgattctcctttcacagcagctgcacaaagatctgttcaaattagaagcaaagttattgtcccacaaaccgttcgtttggcagaagaattagaaaggcaacaactattggaaaaaagaaaaaaggaacgtaatttacatttacaaaaaataaacagcatcattgatttcatcaaagaaaggcagtccgagcaatggtctcgtcaagaacgttgctttcagttcggtagattaggcgcttcattacacaatcaaatggagaaagatgaacagaaaagaatagaaagaactgctaagcaacgtttagctgctttgaagtctaacgatgaggaggcttatttaaagcttttagatcaaactaaggatactagaattacacagttattgaggcagactaattcctttttggattctttgtcggaggctgttagagcacaacaaaacgaagcaaaaattcttcatggtgaggaagtccaaccaattacagatgaagaaagagaaaagactgactattatgaagtcgctcataggatcaaagaaaaaattgataaacaaccttctattcttgttggcggcactttaaaagagtatcaattacgaggtttagaatggatggtgtcgttgtacaataatcatttgaacggtattctagcagatgagatgggtttaggtaaaaccatccaatctatttctctaataacatatctttatgaagttaagaaagacatcggccctttcctagtcattgtacctttatccacaataaccaattggactttagaatttgaaaaatgggctccgagcttaaacactattatatacaaaggtacaccaaatcaaagacactctttacagcatcaaataagggttggaaattttgacgtcttattgacaacatatgagtatattattaaagataaatctcttttatcaaaacatgattgggctcatatgatcattgacgaaggtcatagaatgaaaaatgctcaatcgaagttatcattcacaatttctcattattatcgtacaagaaacagattgattttaacgggtactcctttgcagaacaatctaccagaattatgggcactgttgaactttgttttgcctaaaattttcaattctgcgaagacttttgaagattggtttaatactccatttgccaacaccggtacccaagagaaactagaattaacggaagaagaaactctgttaattattagaagattacataaggtgttaaggccatttttattgcgtcgtttgaaaaaggaagtggaaaaggatttgcctgataaagtggaaaaagttatcaaatgtaaactgtctggtttgcaacaacagttatatcagcaaatgctaaagcataacgcgctatttgttggtgcagggactgagggggctacaaagggtggtattaaaggtttgaacaataagattatgcaattaagaaaaatctgcaaccatccattcgtatttgatgaagtggaaggtgttgtaaacccctcaagaggtaatagtgatttacttttcagagtagcgggcaagtttgaattactggatagagtgctaccgaaattcaaagcctcaggccacagagtgctaatgtttttccaaatgactcaagttatggatattatggaagacttcctaagaatgaaagatttgaagtatatgagattagatggtagcactaagactgaagaaagaacagaaatgctgaatgcatttaatgctccagattcagattatttctgtttccttttgtcaactagagccggtggtttgggtttgaatttacaaactgcagatacggtgatcatctttgatacagattggaatccacaccaagatttacaggcccaagatagagctcacagaattggacaaaagaatgaggttagaattttaagattaattaccactgattccgtagaggaagttattttggaaagagctatgcagaaattggacattgacggcaaggttatccaggcaggtaagtttgataacaaatcaactgcagaagagcaagaagcttttttgagaagattgatcgaaagtgaaacgaacagggatgatgatgacaaagcagaattagatgacgatgagttaaacgatactttggccagaagcgctgatgaaaaaatactatttgataaaattgataaggagagaatgaaccaagaaagagcagatgctaaagcgcaaggcctgagagtccctcctcctagattgattcaattagacgagctacccaaagtattcagagaagacattgaagaacatttcaagaaagaggattctgaaccattgggaaggattagacaaaagaaaagagtttactatgatgacggtctaactgaagaacaatttttggaggctgtagaagatgataatatgtctttagaagatgccattaaaaaaagacgtgaagcacgtgaaagaaggagattacgtcaaaatggtacaaaagagaatgaaatagaaaccctggaaaacacgcctgaagcatccgaaacttcattgattgagaacaatagcttcactgcagctgtggatgaggaaactaatgctgataaagagactacagcttccaggtcaaaacgccggagtagtagaaagaaaaggaccattagcattgttacggcagaagacaaagagaatactcaagaagagagtacatctcaagaaaacgggggcgctaaggtggaagaggaagtaaaaagtagctccgttgaaattataaatggttcagaatccaagaaaaagaaaccgaaactgaccgtcaagatcaaactaaacaaaacaactgtgttggagaataatgatggtaagcgagcagaagaaaagccagagagtaaatcgcccgcgaagaagactgcagccaaaaaaactaaaactaaatccaagtcgcttgggatttttcccacggtggaaaaattggtggaagaaatgcgcgaacagttagatgaggtagactcccatccaaggacgtccatttttgaaaagcttccttcgaaacgcgactatccggactattttaaagtaattgaaaaacccatggccattgatattatattgaaaaactgcaagaatggcacttacaaaactttggaggaggtaaggcaagccttacaaacgatgtttgaaaatgctagattctataatgaagagggatcctgggtttacgttgatgctgacaagttaaatgagtttactgatgaatggttcaaggaacactcttcgtaa

SEQ ID NO: 45778 - DNA, 3045 bp, Saccharomyces cerevisiae
atgctaaggttcgtgtcttcgcaaacctgccggtatagttcaagaggactattaaaaacatctttacttaaaaatgcatctactgtcaaaattgtcggaagagggttagccaccactggtacagataattttctatcgacatcaaatgccacctatatcgatgaaatgtaccaagcttggcaaaaagacccatcttcagtccatgtttcatgggacgcatatttcaagaatatgtctaacccaaagattccagctacaaaggcttttcaggctcctcccagtatcagtaactttccccagggtaccgaagcagctcccttagggaccgcaatgactggttcagtagatgagaacgtctccattcatctaaaagtgcaattgctatgtagagcttaccaagttagaggtcatttaaaagcccatatagatcctttagggatctcatttggtagtaataaaaataaccctgttcctccggaattgactctagactactacggctttagcaaacacgatcttgataaagaaatcaacctaggacctggtatcctgccaaggtttgcaagggacgggaaatctaaaatgtctctgaaagagattgtggatcatctagaaaagttatattgttcctcttatggggtacaatacacacatattccatctaagcaaaagtgtgattggttaagagagagaattgagattcctgaaccttaccaatatacagtggaccaaaagagacaaatcttagatagattaacatgggccacttcttttgagtcattcttatctacaaaatttccaaatgataagaggttcggtttagaaggtttggaaagtgttgttccaggtattaaaactttggttgatcgttctgttgaattgggtgtagaagatattgttttgggtatggctcaccgtggtagattgaacgttttatccaatgtggtccgtaaaccaaatgaatctattttttctgaatttaagggttcgagcgctcgcgatgatattgaaggatcgggtgatgtcaagtaccatttgggtatgaactaccaaagaccaactacgtctggtaagtacgtcaatttatcgctggtggcaaatccttctcatttagaatcccaagatccagttgttcttggtagaactagagctttattgcatgccaagaacgatttgaaggaaaaaacaaaggccttaggtgtgttattacatggtgatgctgcttttgctgggcagggtgttgtttatgaaaccatgggtttcttgaccctaccagaatactctactggtggtactattcatgttattacaaacaaccagatcggattcactacggatccaagatttgcaaggtccacaccatatccttccgatttggctaaggccattgatgccccaattttccatgttaacgctaatgacgtggaagctgtgacctttattttcaatttagccgcagaatggagacataagttccacacagatgccataattgatgtcgttggttggagaaaacatggacataatgaaaccgatcagccatcgtttactcaaccattaatgtacaaaaaaattgcaaaacaaaaatctgtcattgacgtctatacggaaaaattgataagtgaaggcacattttctaaaaaagatattgatgagcacaagaaatgggtatggaacttatttgaagatgctttcgaaaaggcaaaggattacgtcccatctcaaagagaatggttaactgctgcctgggaaggattcaaatccccaaaggaattggccactgagatattaccacatgaaccaactaatgttccagagagtactttgaaagaactaggtaaggtactctcttcgtggccagaaggttttgaagtgcacaaaaatctaaagagaattttgaaaaatagaggaaaatctattgagacaggtgaaggcatcgattgggccaccggtgaagcattagcgttcggtacattggttttggatggtcagaacgttagggtttccggtgaagatgtagaaagaggtacattttctcaacgtcatgcagtcttgcatgaccaacaatctgaagccatttacacaccgctaagcactctgaataatgaaaaggcagacttcaccattgcaaattcctcgttatctgagtacggtgtaatgggtttcgaatatggttattcgctaacctccccagattatctagtcatgtgggaggctcaattcggtgactttgcaaatacagcacaggttattattgaccaatttattgccggtggtgaacaaaaatggaagcaacgctctggtttagttttgtctttaccccatggttatgatggccaggggccagaacattcgtctggtagattggaaagattcttgcaactagccaatgaagacccaagatatttcccatctgaagaaaagctacagagacaacatcaggattgtaatttccaggttgtttatccaactacgcctgctaatttattccacattctaaggagacagcaacatcgtcaattccgtaaaccattggcgttattcttttctaaacagctgctgcgtcacccattggccagatcatctctttccgaattcactgaaggcggattccaatggattatcgaagatattgaacatggaaaaagtattggtacgaaagaggaaaccaagagattagttttgctgagtggccaagtgtacactgccctacataaaagacgtgaaagtttgggtgataagaccactgctttcttaaagattgaacagctgcacccattcccatttgctcagctacgtgattcattaaattcttatccaaacttggaagaaattgtttggtgccaggaagagccattgaacatgggttcgtgggcatacacagaaccacgcttacacacaacattaaaagaaacggataaatataaggatttcaaggtcagatactgtggtagaaacccaagtggtgctgttgctgccggtagcaaatcactacatttggccgaagaagatgcctttttgaaagatgttttccaacaatcctaa

SEQ ID NO: 45779 - DNA, 1428 bp, Saccharomyces cerevisiae
atgaaattctcaactgccgttactacgttgattagttctggtgccatcgtgtctgctttaccacacgtggatgttcaccaagaagatgcccaccaacataagagggccgttgcgtacaaatacgtttacgaaactgttgttgtcgattctgatggccacactgtaactcctgctgcttcagaagtcgctactgctgctacctctgctatcattacaacatctgtgttggctccaacctcctccgcagccgctgggatagccgcttccattgctgtttcatctgctgccttagccaagaatgagaaaatctctgatgccgctgcatctgccactgcctcaacatctcaaggggcatcctcctcctcctcctcctcctcggcaacttctaccctagaaagcagctctgtttcttcatctagtgaagaagctgctccaacatctactgtcgtgtcaacttcttccgcaacccaatctagtgcttcttctgccactaaatctagtacttcttccacttcaccatctacttctacttctacttccacttcttctacttcctcttcctcttcctcctcctcctcctcttcttcttcttcttctggcagtggtagtatctacggtgatttggccgacttttcaggcccaagtgagaaattccaagacggcactattccatgtgacaaattcccatctggtcaaggtgtcatttctattgactggattggcgagggtggatggtccggtgtggaaaacaccgacacttccactggcggttcatgcaaggaggggtcctactgttcctactcctgccaaccaggtatgtctaagacccaatggccatccgatcaaccatctgacggtagatctgtcgggggtttgttgtgtaaaaatggttatttgtaccgttctaacactgacgcggattacttatgtgaatggggtgtcgaggctgcctatgttgtttctaaactaagcaagggtgtcgccatttgcagaaccgactacccgggcactgaaaacatggttatcccaacctatgttgaagggggtagctctttgccattgaccgttgttgaccaagatacttactttacttgggaaggcaaaaagacatctgctcaatactacgttaataacgccggcgtctcagttgaagatgggtgtatctggggtacttctggatctggtattggtaactgggcaccattaaactttggtgctggctccactggtggagtgacatacttatcattgattcctaacccaaacaacagcgacgcattgaactacaacgtcaagatagttgctgctgatgattcatccaatgtcatcggtgaatgtgtttacgaaaatggtgagttctctggcggtgctgacgggtgtaccgtctctgttacttccggtaaagctcatttcgtcttatacaattaa

SEQ ID NO: 45780 - DNA, 1224 bp, Saccharomyces cerevisiae
atgtacttggaatatcttcaaccgaagttgaacctaatggatgagtctagcactataagcaaaaatttccctgattattcaccaaatttaaacacacccattacttcaaattttaatgaagaaacgggttcggactgctctttagttactccaagaataatttccagttcaaattcgaattcgaactccaattctaattcgaactccaactccaactcaggctctattgacgaaaatgagctaaacaactctaattcatcctcctcgtctgcaagacagataaggaaaaaatggaaagagcctgaggatatagcattcattactacaataatgaataattctcaattactaacattcgtagaatatttcaagcctatgaagaatttttggaaaaaaatttcaaaaatcctattccaacaatatgggtacgagagaaactctcgtcaatgtcatgatagatttaaagtcttatacacaaagtctttgaaagtgcatccatcaaagaaatccaagcaaaagaaaaaaaaatcaaaacaagaggcaggctcaaacttaaattttgatccgtcaaaattatctagaatgcagtatttgctagtgcagttacaaaacacttttagttttgtaaacggaaacattatactcaagtcgcaaaaaacattgaagccgaacaagaatggtactaatgataatattaataaccattattataataattgtaacaataacaataataatattaacaatagtaacaatagcaacaataataatagcaataatattaataggaatagtaatcatagtactaatgtttttagtacaccagagcatattcagtcaagtatcaacctcgataaattagaatctttgccagctttggataccaaaggagaaccatccttcattagcccggctcaattttcccttttgtcatcagcaccggcagacaatctaatcctgcaaactccaccatcgccatttttccagcaaacaatgcctatacagctaccgcgcgatgcacaacaagaacaaatttccccagttttctctacagatgtcatatacatgtggcaaacaatgtttaacactattgaaaatttaaaggaacaagtaaactgcttaaaaaatgaagttaagcaattaaaccataaattttaccaacaaaataaaccgttgcataatatgtcaacttcagactcagaaaattttatgcaacaacattaa

SEQ ID NO: 45781 - DNA, 682 bp, Saccharomyces cerevisiae
atgtcatttctatgtgggtcagcttcaacgtcaaataaaccgatcgaaagaaagatcgttattttgggcgacggtgcctgtggtaaaacttcgttgctgaatgttttcaccagaggttattttcccgaagtttatgagcctactgtttttgaaaactatatccatgatattttcgttgacagtaaacatatcacgctatcgttgtgggatactgcgggccaagaggaatttgacaggttacgatccttgtcttattcagatacgcaatgtataatgttatgtttcagtattgattcacgcgattctttagaaaatgtccaaaataaatgggtgggtgaaatcactgatcattgtgaaggcgtcaagttagtcttagttgcactaaagtgtgacttaagaaacaatgaaaatgaatctaacgcaatcacaccgaacaatatccaacaggataacagcgtttctaacgacaacggaaataacataaatagcacctcaaacggcaaaaacctgataagttatgaagaaggtctagctatggctaaaaagatcggtgcgctacgttatttggaatgtagcgctaagctgaataaaggtgtcaacgaagctttcacagaagccgcaagagttgctttaaccgcgggcccagtagcaaccgaagtgaaaagtgacagtggatccagct

SEQ ID NO: 45782 - DNA, 1158 bp, Saccharomyces cerevisiae
atggtttttgatttgaaaagaattgttagaccaaaaatttataacttggaaccttatcgctgtgcaagagatgatttcaccgagggtatattgctagacgccaatgaaaatgcccatggacctactccagttgaattgagcaagaccaatttacatcgttacccggatcctcaccaattggaattcaagaccgcaatgacgaaatacaggaacaaaacaagcagttatgccaatgacccagaggtaaaacctttaactgctgacaatctgtgcctaggtgtgggatctgatgagagtattgatgctattattagagcatgctgtgttcccgggaaagaaaagattctggttcttccaccaacatattctatgtactctgtttgtgcaaacattaatgatatagaagtcgtccaatgtcctttaactgtttccgacggttcttttcaaatggataccgaagctgtattaaccattttgaaaaacgactcgctaattaagttgatgttcgttacttcaccaggtaatccaaccggagccaaaattaagaccagtttaatcgaaaaggtcttacagaattgggacaatgggttagtcgttgttgatgaagcttacgtagatttttgtggtggctctacagctccactagtcaccaagtatcctaacttggttactttgcaaactctatccaagtcattcggtttagccgggattaggttgggtatgacatatgcaacagcagagttggccagaattttaaatgcaatgaaggcgccttataatatttcctccctagcctctgaatatgcactaaaagctgttcaagacagtaatctaaagaagatggaagccacttcgaaaataatcaatgaagagaaaatgcgcctcttaaaggaattaactgctttggattacgttgatgaccaatatgttggtggattagatgctaattttcttttaatacggatcaacgggggtgacaatgtcttggcaaagaagttatattaccaattggctactcaatctggggttgtcgtcagatttagaggtaacgaattaggctgttccggatgtttgagaattaccgttggaacccatgaggagaacacacatttgataaagtacttcaaggagacgttatataagctggccaatgaataa

SEQ ID NO: 45783 - DNA, 1650 bp, Saccharomyces cerevisiae
atggcaagacaaaagatgttttataacaaattactcggcatgctcagcgtaggattcgggtttgcttgggcgctcgagaacattactatatacgaatttgactttggcaagggcattctcgatcaaagctacggcggtgtattttcaaacaacggcccttcgcaagtgcagctgcgggatgcagtcttgatgaatgggacagtggtatacgattcaaacggcgcttgggacagtagtgcgctggaggaatggctccagggacagaaaaaagtttccatcgaaaaaatatttgaaaatattgggcccagcgccgtgtatccgtctatttcgcctggggtcgtgattgcgtcaccatcgcaaacgcatccagactacttctaccaatggataagggacagcgcgttgacgataaacagtattgtctctcattctgcgggcccggcaatagagacgttattgcagtacctgaacgtttcattccacttgcaaagaagcaacaacacattgggcgctggcattggttacactaacgatacagtggctttgggagaccctaagtggaacgtcgacaacacggctttcacggaagattggggtcgtcctcaaaacgatgggcctgctcttcgaagcattgccatcttaaaaatcatcgactacatcaagcaatctggcactgatctgggggccaagtacccattccagtccaccgcagatatctttgatgatattgtacgttgggacctgaggttcattattgaccactggaattcttccggatttgatctatgggaggaagtcaatggcatgcatttctttactttactggtacaactgtctgcagtggacaagtcgctgtcgtattttaacgcctcagaacggtcgtctccctttgttgaagaattgcgtcagacacgccgggacatctccaagtttttagtggaccctgcgaatgggtttatcaacggcaagtacaattatattgttgggacacccatgattgccgacacattgagatccggactggacatatccactttattagctgcgaacaccgtccacgatgcgccatctgcttcccatcttccgttcgatatcaatgaccctgccgtcctgaacacgttgcaccatttgatgttgcacatgcgttcgatataccccatcaacgatagctccaaaaatgcaacgggtattgccctgggccggtatcctgaggacgtatatgatggatatggctttggcgagggaaatccctgggtcctggccacgtgtaccgcttcaacaacgctttatcagctcatttacagacacatctctgagcagcatgacttggttgtcccaatgaacaacgattgttcgaacgcattttggagcgagctggtattctccaacctcacgactttgggaaatgacgaaggctatttgattttggagttcaatacacctgccttcaatcaaaccatacaaaaaatcttccaactagctgattcattcttggtcaagctgaaagctcacgtgggaacagacggggaactaagtgaacaatttaacaaatacacagggtttatgcagggtgcccaacaccttacctggtcctatacttcattctgggatgcctatcaaataagacaagaagttttacagagtttgtag

SEQ ID NO: 45784 - DNA, 1116 bp, Saccharomyces cerevisiae
atgtttagatctgttgctactagattatctgcctgccgtgggttagcatctaacgctgctcgcaaatcactcactattggtcttatccccggtgacggtatcggtaaggaagtcattcctgctggtaagcaagttttggaaaaccttaactccaagcacggcctaagcttcaactttattgatctctacgccggtttccaaacattccaagaaacaggaaaggcgttgcctgatgagactgttaaagtgttgaaggaacaatgtcaaggtgctcttttcggtgcagttcagtctccaactactaaggtggaaggttactcctcaccaattgttgctctaaggagggaaatgggccttttcgctaatgttcgtcctgttaagtctgtagagggagaaaagggtaaaccaattgacatggttatcgtcagagaaaatactgaggacctgtacattaaaattgaaaaaacatacattgacaaggccacaggtacaagagttgctgatgccacaaagagaatatccgaaattgcaacaagaagaattgcaaccattgcattagatattgccttgaaaagattacaaacaagaggccaagccactttgacagtgactcataaatcaaatgttctatctcaaagtgatggtctattcagagaaatctgtaaggaagtctacgaatctaacaaggacaagtacggtcaaatcaaatataacgaacaaattgtggattccatggtttataggctgttcagagaaccacaatgttttgatgtgatagtggcaccaaacctatacggggatatattatctgacggtgctgctgctttagtcggttcattaggtgttgttccaagcgccaacgtaggtccagaaattgtcattggtgaaccatgccatggttctgcaccagatattgctggtaaaggtattgctaacccaatcgccactataagatctactgctttgatgttggaattcttgggccacaacgaagctgcccaagatatctacaaggctgttgatgctaacttaagagagggttctatcaagacaccagatttaggtggtaaggcttctactcaacaagtcgttgacgacgttttgtcgagattatag

SEQ ID NO: 45785 - DNA, 1554 bp, Saccharomyces cerevisiae
atggctataagattgaatccaaaagtcagaaggttcttgctggataagtgtcgacaaaaacgatatggtttcctctttttaggatgtatcttcgccatactttactgtatggggacctggccatttttcgcaaaagatattgtacatgatccaaataatttgccttattccttacaggattattcgactgacaaagacgagccatttttccggggctgcactgatacaaagctgtacttgcaaaatcctgcttactccaaaatgaacgcatctttcgttatgctaacgagaaacgaagaaatagaagacgtactgaaaactatgagaagtatagagggccatttcaataagtggttcaaatatccgtacgttttcttgaatgatgacccctttacagatcattttaaggaccaaattcaagctgcaactaatgccactgtagagtttggcactgttgatgaaattatgtgggagtttcctgctaaggttcgtaattcattgcagtttaaggcttcattagaagaccaaaacgatcgcggtataatgtatggtaatatggaatcatatcacaagatgtgtcgattttactccgggatcttttataaacatccattagtttccaagtatgaatggtattggagaatagaacctgatgtggactttttttgtgacatctcgtatgatccctttttcgagatggccaaacataacaagaaatatgggtttaccgtacttataactgaactgtactggactgtccccaacttgttcagaacaaccaaaagctttataaaaaaaacggcaggtttaaaggaaaatctcggcacgttgtggaaattatttacatttaattataatattctagatacagatgatgaagaaatttctaggtgggtcaattttccctgggatgcaaagccaaagttgacagaaaagttgatggtagactttttgctagagaatcatggtcaagtcaataatgaggaagatttggaaggtatacaatatctcgttgaaagggcccgctctaaggtgccaatgctagaggattcccttgaaggggaagattacaatttgtgtcatttttggagtaactttgaaattgcccgcgttgatttattcgacaatgagatctataacgcctattttaaatttttggaagagtctggaggtttctggactgaaaggtggggtgacgcgccaattcattcaattgggttgggaatgaccttggatctagaagacgttcattatttcagagacattggttatagacactcatcgctgcagcattgtccgaagaatgccttacaaagccaagaaaatctcaacactttcgatgaaggttataacttcggatgtggatgtcgatgcgtgtgccccaagaaaggtgaagacatcgaagaccactccaccccttgcatggatattttttttgaattgcttcacggcagggaatatgagaaggaattccctggttgttacaagccctccataaaggacaaagacgtgattgaagagatcagaagagaaaattttagagtaattgaatag

SEQ ID NO: 45786 - DNA, 3299 bp, Saccharomyces cerevisiae
acgaatgtagagcacgtaaggcgagttctaaccgatcttgaactcgaatcaaaagaccaacaaactctttttatcaaaaccttaccaattgtacactatatcgccatccccgagatggacaataccgccgaaaaaaccataaaaatacaaaacacgaaagtaaaaaccctgtttgacagtggatcacccacgtcatttatccgaagagatattgtagaacttctcaaatacgaaatctacgagacccctccactccgttttagaggattcgtagccaccaaatccgccgttacatccgaagcagtcaccattgacctcaaaatcaatgacctgcagataactttagccgcgtacatactggataacatggactaccaattgttaattggaaatccaatcttacgccgctacccgaaaatcctgcacacagtactgaataccagagagagccccgactccttaaagcccaagacttatcgctccgaaaccgttaataacgttagaacctactccgctggtaatcgtggtaaccccagaaacataaaactgtcttttgcccccaccattctcgaagcaactgacccgaaatccgctggtaatcgtggtaaccccagaaacacaaaactgtctcttgcccccaccattctcgaagcaactgacccgaaatccgctggtaatcgtggtgactccagaaccaaaaccctgtctcttgcaaccactactcctgcagcaattgacccgcttacgacccttgataacccaggtagtactcaaagtacatttgcgcaattcccgatacctgaagaagcgagcatcctagaagaggatggaaaatactccaacgttgtctcaaccattcagagtgtagaacctaatgctactgatcacagcaataaggacaccttttgcactttgccagtttggttacaacagaagtatagagagatcatacgtaatgatctcccaccaagacctgccgacattaacaacatccccgtaaaacatgatattgaaattaaacctggcgcaagactacctcgactacagccataccatgttacagaaaagaatgaacaagaaatcaacaaaatagttcaaaaactgctcgataacaagttcattgttccctcaaagtcgccctgcagctcccctgtagtcctcgtcccgaagaaagacggtaccttccgactctgcgtcgattaccgcaccctgaacaaagctaccatctccgacccattcccattacccagaatcgacaacctattgagccgtattggaaatgcccagatatttaccacgctagatttgcatagtggttaccaccagatcccgatggaacccaaagaccgctacaaaaccgcctttgtcaccccatccggtaagtatgaatataccgtcatgccatttggcttagtcaatgcacctagtacattcgcaagatacatggctgatacatttagagacctgagattcgtcaatgtttaccttgatgatatattaatcttctccgaatctccagaagaacattggaaacatttagacacggtactagaaagattaaagaacgagaacctcattgttaagaagaaaaaatgtaaatttgcatctgaagaaactgagtttttaggctatagtattggaatccagaaaatagctccactacagcacaaatgtgcagcaatccgagactttccgacgcctaaaacagtaaaacaagcacagagatttttaggaatgattaattactacagacgattcattccgaattgctccaagattgcacagccaatccaactgtttatttgtgacaaaagtcaatggacagaaaaacaagacaaggcaattgagaaactaaaagccgccttgtgtaactcccccgtcctagtaccattcaacaacaaagcaaactaccgacttacaacagacgcctcaaaagacggcattggtgctgttctagaagaagtcgacaacaagaacaaacttgttggtgtcgtcggttacttctctaaatccttagagagtgcccagaaaaactatcctgctggcgaattagaactacttggaattatcaaagcactccaccacttccgatatatgcttcacggaaagcatttcacgttaagaacagaccacattagtttgttatcattacaaaacaagaacgaacccgcacgacgcgtgcaacgctggttagatgacctagccacatatgacttcaccttagaatacttagctggacccaagaacgttgtcgcagatgccatatcccgtgccatatatactataacccccgaaacatcccgacctatcgacacagaaagctggaaatcttactacaaatcagacccattatgtagtgctgtcttaattcatatgaaagaattgacacaacacaacgtcacacctgaagatatgtcagccttccgtagttaccagaagaaactcgaactatcagagaccttccgaaagaattattccctagaagacgaaatgatctattaccaagaccgactagtagtaccaataaaacaacagaacgcagttatgagactgtatcatgaccataccttatttggaggacatttcggtgtaacagtgacccttgcgaaaatcagcccaatttactattggccgaaactacaacattcgatcatacagtacatcaggacctgcgtacaatgtcaactaataaaatcacaccgtccacgcttacatggactattgcaaccactccccatagcagaaggaagatggcttgatatatcaatggattttgtgacaggattacccccaacatcaaataacttgaatatgatcctcgtcgtagttgatcgtttctcgaaacgcgctcacttcatagctacaaggaaaactttagacgcaacacaactaatagatttactctttcgatacattttttcatatcatggttttcccaggacaataaccagtgatagagatgtccgtatgaccgccgacaaataccaagaactcacgaaaagactaggaataaaatcgacaatgtcttccgcgaaccacccccaaacagatggacaatccgaacgaacgatacagacattaaacaggttactaagagcctatgtttcaaccaatattcagaattggcatgtatatttaccacaaatcgaatttgtttacaactctacacctactagaacacttggaaaatcaccatttgaaattgatttaggatatttaccgaatacccctgctattaagtcagatgacgaagtcaacgcaagaagttttactgccgtagaacttgccaaacacctcaa

SEQ ID NO: 45787 - DNA, 2418 bp, Saccharomyces cerevisiae
atgtcttcagatcccttgcagcaagtttgtgatttaataaagggagatctatcacttgaaagggtacgagatattaaggaacagttgctaaaagaaaaatccgttgtagaataccaattgaataaagaatcagacaaatactatggcgaagtcgaagaatccctcaaactactgaatctgtccaaaaattcggtcacttcaatcaaacaacaaatcaatgaagttaataaattgggtaatgataatcgatttgcaattaatcgttatgatatacttttccgagccacaaaactttatgaaacggtcaatacgacatcatcgatttatgatcgaatatataactttgttgcactaatggagcatatagaaagactattagtggcggaattagcggaagatgccctggaaactggttgtccccatcttttggaaattcatttcctattaacttcagcacgcgactttcaagagcaggttgttgttatggctaaagaagcaactgaagatgcacaacgtacagtcatgaaattgttttcaagattatccggaataatatcaaaatttgataaattgctggacggcttaacttacgatattgtagaaatggccagagctgagcaaatatctttagcaattcgactttttaaaatttatgacctagaagaaagggaagatttgagaattgaagctatcagaaatataatcaagaagaaagaaattgaaatagaaaaatcctcaattaaaaaacttccaaatagcaaaaacaccgcaaggttacaagatgagacacccaaagttatagaatatccgacaaacaagggattataccaagaaataatgagcggtaccatctcaacaagaacagcacctcgaggttacaagcattttctaataaatggtataaataattccatttctgaaatgtttggtgaaatgagagaaaaatacgttggtgatcaaaaatttgatgttcttgataacatggattggattttcaacgaattgattattgtaaaggaacatattgccaactgctgtccaccacattggaacatatttgaagtatactttgaccaatactataaggaattgcattcattaattacggatctcgtggagtccgaacccgagaccattattattcttgatattcttgcattcgataagacgtttcaagatacacttaagcaagattttggatttaccaaaagcgaagtcaaatctgtcatcggcgataaagaaaaggaaacactatttaaagactatttgaatttgatagtggttaaaatgaccgagtggataggtaatttagaaaaagcagaatttgatgtattcttggaaagaagtaccccgccacattctgattcagatggattgctttttcttgatggtactaagacttgttttcaaatgtttacacagcaagtggaagtggctgcaggtactaatcaggccaaaatacttgtgggtgtggttgaaaggttcagtgatctactaacaaagaggcaaaaaaactggatttctaaaataagtgaagaaatcaaaaagcaaatcaattacaatcacaagtatgatatagatccagagagtataactcctgaagatgagtgtccaggaggtttggtggaatacttaattgctgtatcaaacgaccaaatgaaagctgcggactatgccgttgccatttcatccaagtatggtaaactggtttctaaagtttatgagaagcaaattacaaatcacttggagggcactttagatggttttgctgaagttgctcagtgcagttctttaggcctaatcacattgatgttcgatgatctgagaaaaccctaccaagagatttttagcaagacatggtatatggggagccaagcgcagcaaattgcggacacactagatgaatatcttttggatatcaaacctcagatgaattctgtgctgttcgtgaacttcatagacaatgttattggtgagacaattataaaatttttgactgctttatcgttcgagcattcattcaaaaacaaaaacaataagtttttagaggcgatgaagagggattttgaaattttttatcagctctttgtcaaggtgctggatggtaatgaaagcaaggatacgctaattacacaaaattttactgtaatggagttcttcatggacctaagctgtgagccgatagatagcatattagatatttggcaaaagtatcttgaagtatactgggactcgcgcatagatttactggtaggaatattgaagtgtaggaaagatgtgagtagctcagaaagaaagaagatcgtacaacaggctacggaaatgttacatgaataccgccgtaacatggaggccaacggtgtggatcgcgaacctactttgatgaggcggtttgtattagaattcgaaaagcaataa

SEQ ID NO: 45788 - DNA, 2658 bp, Saccharomyces cerevisiae
atgacaagcaagaatagcagcagcaataaatcaaatactcccacacaaatgtacgttattaaaagagacggccgcaaagagcccgttcaattcgataaaattacctcccgtatcacccgtttgtcatacggtttagacccaaaccgtattgatgctgttaaggtaacccaacgtattatttctggtgtgtactccggtgttactaccgttgagctggacaatcttgcagctgaaacatgtgcatacatgaccactgtgcaccctgattatgccactctagccgctagaatcgccatctctaacttacataagcaaaccacaaagcaattctccaaagttattgaggatttacacgactggattaacccagctactggaaagcatgctcctatgatttcggacgaaatttacaacattgtcatggaaaacaaagatactttgaactcggccatcgtgtacgatagggatttccagtatacgtatttcggattcaagacactggagcgttcgtacttgctaagactgaacggtgaagtggcagaacgtcctcagcatttggtaatgcgtgtggcgctaggtatccatggtagcgatatcgaatctgtgctgaagacttataatttgatgtcgttaagatacttcactcacgcttccccaactttattcaacgctggtacgccacatcctcaaatgtcttcatgtttcttaattgccatgaaggatgactctatcgaaggtatttatgatactttgaaagaatgtgctatgatttccaaaactgcaggtggtgttggtcttcatatcaacaacatccgttccacaggttcttatatcgctggtaccaacggtacttcaaacgggttgattcctatgattcgtgttttcaataatactgcccgttatgtggaccagggtggtaacaagagacctggtgctttcgcccttttcttggagccatggcatgcagatatcttcgactttgtcgatatcagaaaaacacatggtaaggaagaaattcgtgcaagagatttgttccctgctctatggatccctgatcttttcatgaaacgtgttcaagaggatgggccttggactttgttttcgcccagtgctgccccaggtttagatgatgtgtggggtgatgaatttgaagaactatatactcgttacgaaagagaaggtcgtggtaaaacaattaaagcccaaaagttgtggtatgccattttgcaagcacagacagaaacaggtacacctttcatggtttataaggacgcatgtaacaggaagacaaaccaacagaacttaggtactatcaaatcatctaatttatgttgtgaaatcgtcgaatattcctccccggatgaaactgcagtttgtaatttagcttctattgccctaccagcattcgttgaggtttcagaagatggtaaaactgcaagctataatttcgagagattacacgagattgctaaagtcattactcacaacttgaacagagttatcgaccgtaattactatccagttcccgaggctagaaattcaaatatgaagcatagacctattgctcttggtgtccagggtttggccgatacttatatgatgttgcgtctaccctttgaatcggaagaagctcaaactctaaacaaacaaatcttcgaaactatttaccatgctactcttgaagcctcctgtgaattggcccaaaaagaaggtaaatattctacttttgaaggttctccagcttctaagggtattttacaattcgatatgtggaacgctaaaccatttggcatgtgggattgggaaaccttaagaaaggacattgttaaacatgggttaagaaactctttgactatggcaccaatgccaaccgcctcaacttcccaaattcttggttataatgaatgcttcgaaccagtgacctcaaacatgtactctcgtcgtgtcctgtctggtgaattccaagttgttaatccatatttactacgtgatttagtcgacctgggtatttgggatgatagtatgaaacaatatctaattacacaaaatggttctattcaaggcttaccaaatgtgccacaagaattgaaggaattatacaaaaccgtctgggaaatctctcaaaagaccattatcaatatggctgctgatcgtgccatctacatcgatcagtctcattccttgaatcttttcttgcaagcaccatcaatgggtaagattactagtatgcatttctacggttggaagaagggtttaaaaactggtatgtactacttaagaacgcaagccgcctccgctgctattcaatttaccattgatcaagaggttgccgatcaagccgctacacatattgcttccgtctcagaattggatcgtccagtttatgttccaaagggtacaaaattctctgaacaaaaggcggcatctgcgcttaccgaaagctcagataatgagaaggatgcatctccagttccatccgaacaatcatcggtgtcgagtgccatgtcaaatgtgaaattggaagatagtgttgccccagcagttccaacggaaacaataaaagaagattccgacgagaagaaatgtgacatttacaatgaaaaggtgattgcttgtactgctcctactccagaagcttgtgagtcatgttccggttga

SEQ ID NO: 45789 - DNA, 816 bp, Saccharomyces cerevisiae
atgaaacgtttcaatgttttaaaatatatcagaacaacaaaagcaaatatacaaaccatcgcaatgcctttgaccacaaaacctttatctttgaaaatcaacgccgctctattcgatgttgacggtaccatcatcatctctcaaccagccattgctgctttctggagagatttcggtaaagacaagccttacttcgatgccgaacacgttattcacatctctcacggttggagaacttacgatgccattgccaagttcgctccagactttgctgatgaagaatacgttaacaagctagaaggtgaaatcccagaaaagtacggtgaacactccatcgaagttccaggtgctgtcaagttgtgtaatgctttgaacgccttgccaaaggaaaaatgggctgtcgccacctctggtacccgtgacatggccaagaaatggttcgacattttgaagatcaagagaccagaatacttcatcaccgccaatgatgtcaagcaaggtaagcctcacccagaaccatacttaaagggtagaaacggtttgggtttcccaattaatgaacaagacccatccaaatctaaggttgttgtctttgaagacgcaccagctggtattgctgctggtaaggctgctggctgtaaaatcgttggtattgctaccactttcgatttggacttcttgaaggaaaagggttgtgacatcattgtcaagaaccacgaatctatcagagtcggtgaatacaacgctgaaaccgatgaagtcgaattgatctttgatgactacttatacgctaaggatgacttgttgaaatggtaa

SEQ ID NO: 45790 - DNA, 858 bp, Saccharomyces cerevisiae
atggagctaagttcaccatcaaaaaaaaccacaacatcgccaataaatataccaggggggaatagagataacctaataatcggaccacattctcacagcttcaagaccgatccattttcaagtaacaatagtagtttgctgtccaaaatatctactaaccccagtttggaaagccctttctcttcgaaatctttactagattgttctcctgtacaagctgtaaagaagtctttagagtcggaagcaaaaacgcatagcctggacgaggagacaaatgaacagactgatgtaaagatcttaaacatagcagactttcccacagatgaactcatactaatgataagtgcgctactcaacagaattataacagcaaacgatgaaactacagatgtctcacaacaagtgtcggatgagaccgaagacgaactcttaactccaatccttgctttctatggaaagaatgttccagagatagctgttgttcagtacttagagagaattcaaaagtactgtcccaccacaaatgatatttttctttctctccttgtatatttcgatagaatctccaaaaattatgggcattcttctgagcgtaatggttgcgcaaagcaattattcgtcatggactccgggaacattcatagattgctcataacaggtgtcacaatttgcacgaagttcttgagtgattttttttacagtaactctcgatacgccaaggttggaggtatttctttgcaagagttaaaccatttagaattacaattcctgatactatgtgatttcaagttattggtttcagtcgaagaaatgcagaaatatgcaaacttgttatataaattctggaacgaccagtag

SEQ ID NO: 45791 - DNA, 3456 bp, Saccharomyces cerevisiae
atgcctaaccctccttcatttaagtcacataagcagaatttattcaactccaacaataatcaacacgcaaacagtgtagattcttttgacttacatctcgacgattcatttgacgctgctttagacagtttacaaattaataataacccagaaccacttagtaagcataacactgttggagatagggaaagttttgaaatgagaacagtagatgatttagacaatttttctaaccattcttcggattcgcatcgtaagtcttcaaacacagatacccatcctttgatgtatgataatcgcctctcgcaggatgataatttcaaatttactaatattgcttcgtcaccaccgtcgtcttcaaacaatattttttcaaaagccctctcatatttaaaagtatctaacacaaaaaactggtccaagtttggttcacccatagaactcagtgatcaacacatcgaaagagaaatacatccagacacgactcctgtgtacgataggaatagatacgtttcgaatgaactatctaatgccaaatataatgccgttacttttgtgccaaccctattatatgaacagttcaaattcttttacaatttatactttttagtagttgcattatcgcaggccgttcctgcactaagaatagggtatttatcatcgtatattgtacctttagcatttgtgctgacagtaaccatggcaaaggaagctatagatgatattcagagaaggagacgtgatagagagtcaaacaatgaactgtatcatgtaataacgagaaatcgttccataccaagcaaagacttaaaagttggagatctcataaaagtccataaaggtgatcgtattcccgctgatttggttcttttacaatcaagtgaaccatcaggcgagtcatttatcaaaactgaccaactagatggggagactgactggaaactacgtgttgcctgtcccttgacccaaaatctatctgaaaatgacttaattaacagaattagtataacagcctctgctcctgagaaatctattcataaatttttaggtaaagttacctataaggattccacttcaaaccctttgtctgtagataatactctatgggcgaatactgttctagcttccagtggattttgtattgcttgtgtcgtctacactggcagagatactaggcaagctatgaatacaactacagctaaggttaaaactggcttattagagctagaaattaacagtatttccaagattctttgtgcatgtgtttttgccctgtcaattcttttagttgcatttgccggtttccacaatgacgactggtacattgacattttgaggtatctgatattgttttctaccatcatccctgtctctttaagagttaatttagatttagccaaaagtgtttatgcacatcagatcgaacacgataaaaccattcctgaaacaattgttagaacgagtacaattccagaggatttaggccgtattgaataccttctaagcgacaaaacagggacgcttactcagaatgatatgcaattgaagaaaatacacttgggtactgtatcatacacgtcggaaacattagacattgtatccgactatgtacaatctctggtgagctctaaaaatgactctttgaacaattctaaagttgccttatcaacaacaagaaaggatatgtcttttcgtgtacgtgatatgattttaactctagcaatttgccataacgttactcccacttttgaggatgacgaacttacatatcaagcggcatcacctgatgaaattgctattgttaaatttaccgagtcggttggcttatctcttttcaaaagagatcgccattcaatttctttattacacgaacattctggtaagactttaaattacgaaattttacaagtattcccatttaattctgattctaagcgtatgggtatcattgttcgtgatgagcaattggatgaatattggtttatgcaaaaaggggccgatactgtcatgtcaaaaattgtggaaagcaatgattggctagaggaagaaacaggtaatatggctcgtgaaggtctacgtactttggttatcggtcgtaaaaaattaaacaagaaaatttacgagcaatttcaaaaagaatacaacgatgcctctttgtcaatgctaaatcgtgatcaacagatgagtcaagttatcaccaagtatttagagcatgatcttgaattattgggtctaactggtgtagaagataagttacagaaggatgtgaagtcctctatcgagttattaagaaacgcaggtatcaagatttggatgctgacaggtgataaagttgaaactgctcgttgtgtttccataagtgcaaaattaatatctcgtggccaatatgttcatacgataacaaaagtcacaagaccggaaggtgcattcaatcagctggagtatctaaaaatcaatagaaatgcttgtcttttaatagatggtgaatccctgggaatgtttttgaaacattacgaacaggaattttttgatgtcgtggttcatttacccactgttattgcttgccgttgtacacctcaacagaaggcagacgttgctttggtaattcgtaaaatgacgggcaaaagggtatgctgtattggtgatggaggtaacgatgttagtatgattcaatgtgcagatgttggcgtagggattgtgggtaaagaaggtaaacaagcttctttagctgctgatttttctataacgcaattttgtcacctcaccgaattactattatggcatggtaggaactcttacaaaagatctgctaaattggctcaatttgtcatgcatagaggtttaatcattgcaatttgccaagcggtatattccatctgttcgttgttcgaacctattgctctttatcaaggttggttaatggtcggttatgctacctgctatacaatggctccagtcttttcattaactcttgatcacgatatcgaagagtcattgactaaaatatacccagaattgtacaaagaattgactgaaggtaagagcttatcatataagacgttctttgtttgggttctattatcgctattccaaggttctgtaattcaattattttctcaggcctttacgagtttattagatactgatttcacaaggatggttgctatcagcttcactgctttggttgtaaatgaattaataatggttgccttagaaatctacacatggaataaaacaatgctcgtcactgaaattgctactttactattttacattgtatcggttccatttcttggcgattattttgatttaggttatatgactaccgtaaattactatgctggacttttagttatattactcatctcgatctttcctgtctggacggcaaaggcaatttatagaaggctacatcctccaagttatgcaaaagtgcaagagtttgccactccataa

SEQ ID NO: 45792 - DNA, 1923 bp, Saccharomyces cerevisiae
atgaggagagagaggcaaaggatgatgagtttcgaggacaaggacaaggacgaccttgacaatagtaatagtaataacagcagtgaaatgacagatacggcgatgatgccaccattaaagagattgcttattacgggcagtagcgatgatttggcacaaggatcatcgggtaagaagaagatgacgatggcgacgaggtcgccatcgtcatcacccgatttggcgacaaacgacagcggcactagggtacagccattgccagaatataacttcaccaagttctgctatcggcataacccggacattcagttctcaccaactcatacagcgtgctacaagcaggatttgaaacgaacgcaagagattaatgctaatatcgcgaagctacccctgcaggagcaatccgacatccaccacattatctcgaagtacagcaattccaatgacaagatacggaagctgattctggatgggatcctatcgacgagttgcttcccacagctttcctacatttcgtcactcgttacacacatgatcaagatcgacttcatcagcattctgccgcaggagctgtcgctgaagatcttgagttatctggattgccaatctctttgcaacgccacgagagtgtgccgcaagtggcagaagctcgcggatgacgacagggtatggtaccacatgtgcgagcagcacatagacaggaaatgtcccaactgtggctgggggctgcctcttttgcacatgaaacgtgcgcggatacaacagaatagtacaggatctagcagcaacgcagatatccagacgcaaactacgcgaccttggaaagtcatctacagagaacggttcaaagtggagtcaaactggagaaagggccactgcaggattcaggaattcaagggccacatggatggtgtgttaacgctccagtttaactacaggcttttgttcacaggctcgtacgactccaccataggtatatgggacttattcacggggaagctaatacgaaggctcagcggccattcggacggcgtcaagacattatattttgacgatagaaagctgattacgggctcgctcgacaagacgatccgtgtttggaactacataaccggtgaatgcatttccacgtatcgaggccactcggatagcgttctgagcgtagattcataccagaaggttatcgtttccggcagtgctgacaagacggtcaaggtatggcacgtggagtccaggacatgctacaccttgagaggccacacggaatgggttaattgcgtcaaattgcatccgaaaagcttttcatgttttagttgcagtgacgataccacaatccgaatgtgggatatcaggaccaattcatgcctaaaagtgttcaggggtcatgtagggcaggtgcaaaagatcataccgcttaccattaaggatgtagagaatctagccaccgacaacacttctgatggcagctctccgcaggatgacccaacaatgactgatggtgcagacgaatcagacacaccgtcgaacgagcaagaaactgtcttagatgaaaacataccttatccaacacatctactatcttgcggactggataacacaatcaaactatgggacgtcaaaaccggtaaatgcataagaacacagtttgggcacgtggaaggtgtttgggacatcgccgctgacaacttcagaattataagtggttctcacgacggaagcattaaggtctgggacttgcaaagcgggaagtgtatgcacacgttcaacggtcgaagactacaaagagaaactcagcacacacaaacacaatccttgggtgataaagtcgcccctatcgcttgtgtttgtattggagattcagaatgctttagtggtgatgaatttgggtgcgtaaaaatgtacaaattcgatctcaatgattag

SEQ ID NO: 45793 - DNA, 969 bp, Saccharomyces cerevisiae
atgtataaatattcttattatataaggcgaaaaaatgaacgagaaaaaaaagtgttgaaagtatgcattcaactggctcttcaacaagagactcaatcaattaagcaatcgaagatggctattgatgctcaaaagcttgtggtggtcatcgtgatcgtggtcgtgcctttgctcttcaagttcattatcggaccgaagaccaagcctgtgctggatcccaaaaggaatgacttccaatcatttccgctggttgaaaaaaccatcttaacgcataatacttcgatgtacaagttcgggctacctcatgctgacgacgtactcggtttaccaattggtcagcatatcgtaattaaggccaatatcaatggtaaggatattaccagatcgtatacgcccacatcgttggatggagatacaaagggaaactttgaattactagtgaagtcttaccccacaggtaacgtttctaagatgattggagagttgaagataggtgactcgatccagatcaagggccctcgtgggaactatcattatgagagaaactgccgttcccatctagggatgattgctggtggtactggtattgcgcccatgtatcagatcatgaaagctattgccatggaccctcacgacactaccaaggtctctctagtctttgggaacgtccatgaggaggatattctgttgaagaaggaactggaagcgttggtggccatgaagccttcccaatttaagatagtttactacttagactctcctgaccgtgaagactggactggtggtgtaggatacattaccaaggatgtcatcaaggaacacttgcccgctgctacaatggacaacgttcaaattttgatctgtggtcctccagccatggttgcctcagttagaagaagtaccgtggacttggggttcagacgttccaaaccgctttccaagatggaagaccaggtgtttgtgttttaa

SEQ ID NO: 45794 - DNA, 1185 bp, Saccharomyces cerevisiae
atgtggaagattatgcgttcatggaaatgtgggggaatgcgctgggcacatcgccagcgaccctcacacgagctgctgtcgcaactgtcgttcgaccagcattacaagattaggtcgaacattgagctgctgatacaggactacgctagtaaaccaattgcgcccctaaactacgagtatttcctgcaatacaggccgccgctgaccaagaaggaggagtacatgctgacgatcaagacaatcaacctgttgctttcattgacgtgtaaacggcttaatgccattcagaggctaccgtataatgcggtaatcaaccctcatattgagagaaccaactctttgtatttgaaaagcttgcaaacgttgctatcaatcgcatacccgtacgagttgcacaatcctcccaagatacaggccaagttcacagaactgctggacgaccacgaggacgccattgtggtattggcaaaaggtcttcaggaaatccaatcgtgttacccaaagtttcaaatttcgcagttcttgaacttccacctgaaggagagaatcacgatgaagctgcttgtgacgcactatttgtcgttgatggcacagaacaaaggtgacacgaacaaaaggatgattggaatcttgcaccgggacctccccatagcacaattgatcaagcacgtttctgattatgtcaatgatatatgctttgtgaagttcaacactcagcggaccccggtcctaattcacccgccatcacaagacatcacattcacgtgcattccgcccattctggagtatattatgacagaggtattcaagaacgcttttgaagctcagatagctcttggaaaggaacatatgcccatagagatcaatcttttaaagccagacgatgacgagctgtacttacggatacgggaccatggtggtgggatcacgcccgaggtagaggccctcatgttcaactactcttactctacacatacccaacaatcagctgactctgagtctacagatctgcccggcgagcaaatcaacaacgtctccggcatgggctttggtctaccaatgtgcaagacgtacctagaactgtttgggggcaagattgacgttcaaagtttacttggctggggcacggacgtgtacatcaagctcaaaggcccttctaagactgcactactctccaaaaagtaa

SEQ ID NO: 45795 - DNA, 1119 bp, Saccharomyces cerevisiae
atgaaatgcagggtatggtcagaggctcgtgtttatacgaatatcaataaacaaagaaccgaggaatattgggattatgaaaatactgtaattgattggtccacaaatacaaaggactatgaaattgaaaataaagttgggcgaggaaaatactccgaggttttccaaggtgtcaaattagactctaaagttaaaattgttattaagatgttgaaaccagttaaaaagaagaagatcaagagagaaatcaaaatcttaacggatttgtctaacgaaaaagtgcctccaacgactttgccatttcaaaaagatcaatattacacaaatcaaaaggaggacgttttaaaattcatcaggccctatatctttgatcagccacacaatggtcatgcaaacataattcatctatttgatataataaaggatcccatctcaaaaactccggctttggtcttcgaatacgtagataatgtggacttccgtattctttaccctaaattaaccgatctcgaaattaggttttatatgtttgagttattaaaggccttagactattgtcattcaatgggaataatgcatagagatgttaaacctcataacgtaatgattgatcataagaataaaaaattgcgattgatagattgggggcttgctgaattttatcatgttaatatggaatacaatgttcgtgttgcgtcgaggttttttaagggtcctgaactactagttgactacagaatgtatgattattctttagacttgtggtcgtttgggacaatgttggcttctatgatctttaaaagagagccatttttccatggaacgagtaacacagaccagcttgtcaagatcgtcaaagtacttggtacaagcgattttgagaaatacctgttgaagtatgaaattaccttaccgagagaattttacgatatggaccaatacatcagaaagccttggcatagattcatcaatgatggtaataaacatttaagcggcaacgatgaaattattgaccttattgacaatcttttgagatatgatcatcaagaaagattaactgctaaggaagcgatgggacacccgtggtttgccccaataagggaacaaattgaaaaataa

SEQ ID NO: 45796 - DNA, 864 bp, Saccharomyces cerevisiae
atgtctgatgctcaattcgatgctgctttagatcttcttaggaggctaaatcctaccacgttacaggagaatctaaacaacttgatcgaattacaaccaaatttggcacaagatttactatcttcagtagacgttcccctatccacacagaaagattccgccgattcaaaccgggagtacttatgctgcgactataatcgtgatattgattcgttcagatcgccttggtcgaacacttattacccagaactatccccaaaggatctacaagacagcccctttccctcagcccctttaagaaaattggagatcttagccaatgactctttcgacgtttacagagatctctattatgaaggcggtatctccagcgtgtacctctgggacctcaatgaagaagatttcaatgggcacgattttgcaggggtagtgcttttcaaaaaaaaccaatcagatcacagtaattgggacagtatccatgtttttgaagttacaacatctccttcttctcccgacagtttcaactatagagtcaccactacaatcattctgcacttggacaaaacaaaaactgaccagaattctcatatgatgttatccgggaacctgacaagacagaccgaaaaggacatcgctattgatatgtcccgtccattagatgttattttcacatcacatgtcgctaatttgggttccttaattgaggacattgagtctcagatgagaaatctattggaaactgtttatttcgaaaagacaagagatatcttccaccaaacaaagaacgcagccattgcttcctctgctgaggaagcgaataaagacgcacaggcagaggtaatcagaggtttacagtctttatag

SEQ ID NO: 45797 - DNA, 1251 bp, Saccharomyces cerevisiae
atggtatcttctttgcccaaggaatcgcaagccgaattgcaactgttccagaacgaaatcaacgccgctaatccgtccgactttcttcagttctccgccaactatttcaataaaaggctggaacaacagagagcgttcctcaaggccagggagcctgaatttaaggcaaagaacattgttctatttccggaaccagaggagtcattttccagacctcaatcagctcaatctcaatcaagatccagatcgagtgttatgttcaaatccccctttgtgaacgaggacccacactccaacgtgtttaaaagtgggtttaatttagacccgcacgaacaggacactcaccagcaagcacaggaagaacaacagcatactagagaaaagacatcaactcctccactcccaatgcacttcaacgcccaaaggcgtacttctgttagtggtgagaccttacaaccaaacaattttgacgattggactccagatcactataaggaaaagtccgagcagcaattgcaaagactggaaaaatcgatccgtaataactttctgttcaacaagctggattccgactcaaaaaggctggtcataaattgtctggaggagaagtccgtccccaaaggtgctacgataatcaagcaaggtgaccaaggggactacttctatgtcgtcgaaaagggtactgttgacttctacgtcaacgacaacaaggtcaactcttccgggccaggctccagtttcggggaacttgctcttatgtacaacagccctcgtgctgccaccgttgtagcaacctccgactgtttgttgtgggctctagacaggctcaccttcagaaaaatacttttgggcagctctttcaagaagagactcatgtatgacgatcttttgaagagcatgccagttttgaagagtttgactacgtacgaccgtgccaaacttgccgatgcactggataccaagatctaccagccgggtgaaacaatcattcgcgagggtgatcaaggggagaacttttatttaattgagtacggagctgtggacgtctctaagaagggccaaggtgtcataaataaactgaaagaccatgattatttcggtgaagtggccttgctaaacgatttgcccagacaggccactgtgactgctacaaagagaaccaaagttgccacattggggaaaagtggttttcaacgtttactgggtcctgcagtagacgtattaaagctcaatgatcctacaagacattaa

SEQ ID NO: 45798 - DNA, 3105 bp, Saccharomyces cerevisiae
atgtctgccagaaaacgcaagtttaatagtctcaaaccgctagacaccttgaacagctctcgtgccagctctccaaggtcctctgcttctctaccgcccaaaagatataacacttttcgtaaggatccgaaaatcgttgatcatctaaacaatgcttctacaaaggatttcttaccagttttgagtatgaacagcgagagtaagaggcagatcgaattgtcggataatgatgttgataataatgatgaaggtgaaggcgtcaacagtggctgttcagatcaagattttgaacctttgcaaagctctcctttgaaaagacactcatcactcaaaagcacttccaatggtcttttgttccaaatgtctaataatctggggaatggttcaccggaaccggcagtagcgagcacttctccaaatggctcaattatttccactaaactaaatttgaacggccaattttcttgcgttgattcgaaaacattgcgaatttatcggcataaagcaccatgcataatgacttttgtctcagatcataatcatccgaaattttcattgtattttcaacaatcggtgatctacaattcacaagttaatctgcttgatgatgttgaattgataattttagataagaagaactcttttatggctataattttaaaagatctgaaaaaggtcaagatgatactagacgtgaataactcttcaatcaacattaacacgaacatcttgatatggtccactgcaagctccgcttcaaataaaaaaataaagtctattaaaagattcctgttgatgtcatattcttcgtcgataaaagtcgaaattttagatcataaagagcagattttggaaagactaaaacatctgattcatcctatttcttcgtcatcaccttcattgaacatggaaagggcaataaactccactaaaaatgcattcgactctttaagacttaaaaaaactaaactttctactaatgatgatgaaagtccgcaaattcatactcatttcttatcaaacaaacctcatggtttgcaatccttaacaaaaaggactcgtattgccagccttgggaaaaaagagcattcaatatctgttccaaaatcgaatatttcaccctcagatttctacaacactaacgggacagaaactttacaatcccacgcagtttcacaactaagacgttcaaatagatttaaagatgtttcggatccagcaaactcaaattcaaattcagaatttgatgatgcaactacggaatttgaaacaccagaactgtttaaacctagcctctgttacaaattcaacgatggttcaagctatactataacaaatcaagatttcaagtgtcttttcaataaggattgggttaatgatagcattttggatttttttacaaaattttacattgaatcatctattgaaaagtcaattatcaaaagagagcaagttcacttaatgtcctcttttttttacacgaaactaattagtaatccagcagattattattctaatgtaaaaaagtgggttaacaatactgatttgttttctaaaaagtacgttgttataccaattaacataagttatcattggtttagttgcattataacaaacttggatgcgatcttggattttcatcaaaacaaagataaaaacgatgccatcaactccgatgagatttctataaataatcctctggttaatattttgactttcgactcgttgaggcaaactcattcaagagaaattgatccaataaaagaatttctcatatcctatgcacttgataaatattcaattcaactggataaaacacaaatcaaaatgaaaacgtgtccagttccacaacaacctaatatgagcgattgtggtgttcatgttattttgaatattagaaaattttttgaaaatccggtggaaacaattgatgtatggaagaattctaagattaaaagtaagcacttcaccgcaaaaatgattaataaatattttgataaaaatgaaagaaatagtgcgagaaagaatttaaggcatactctaaaactcttacaactcaattacatcagctatctgaaaaaagaaaatttatatgaagaagttatgcaaatggaggagaaaaaaagcaccaatatcaacaataatgaaaattacgacgatgacgatgaagaaattcaaatcattgaaaatatagatcaaagcagtaaagataataacgcgcagttaacctcggaacctccctgctcacgatcatccagtatttcaacaacagaaagagagccgacagagttgcataattccgtagtacgacagcccaccggtgaaataataactgataatgaagatcccgttcgcgctgcttctccagaaacagcatccgtttctcctcccatacgtcacaatattttaaagagttcatctcctttcatatcagaaagtgcgaatgaaactgaacaagaagaatttacgtcaccatactttggaaggccgtctttaaagacgagggctaagcagtttgaaggcgtttcgtcaccaataaaaaacgatcaagccctgtcatccacccatgatattatgatgccgtcgcctaaacctaaaaggatttacccaagcaaaaaaatcccacaactttcctcgcatgttcaatctctatcgactgattctatggaacgccaatctagtcccaataataccaacattgtaatttcagatacagaacaagattcgaggttaggagtgaattctgaaagtaaaaatactagtggtattgttaacagggatgactcggacgtcaatttaattggtagttcactacctaatgtagcggaaaaaaatcatgacaacactcaggaaagtaatggtaataatgacagtcttggtaaaatacttcaaaatgttgacaaagaactgaacgaaaagttggttgatattgatgatgtggcatttagtagtccaactaggggtattccaagaaccagcgcgacaagcaagggatcaaatgcacaacttctctctaattatggagatgaaaataaccagtctcaagattctgtttgggatgagggcagagataatcctatactcttggaagatgaagacccttga

SEQ ID NO: 45799 - DNA, 3453 bp, Saccharomyces cerevisiae
atgactgctgtgcgtcgctcaactagaataaggactaaatctcaagttattgaggaagattacgatgacgagcaaaacaccagcgcacaacacgtagaatctgataagatcactgccaaaacgcaacatgaagaagaagaagagcaagatactggtgaaagtgaagaaagtagtagtgaggatgactatgaagaccaggatgatgatgactacgtagataccgctacggcaaagagaaagtctagaaagagaaagcccaaatcagcatcaaataccagtagtaaaaggcagaagaaaaaacctacttctgcccagaagtcggcggtatctcatgcgcctgcttatcaccgctctaaaaaagatcaggatcaatacttagaaattgcgaaggatttccaacctacagaattgtttgatatattatccacttcagaagatgtttctattgaagaactattgcgagaatggttagaaacctattctgaaaatagagataaatttttacaagaatttatcaatttgctattgaattgttgtggctccgtcgctcgcgtcgaagaccacgacgttcacagcaatgaatcttctaacgaaacgattggtgaaattcagttgctatttcaaagacagaaactgcacgaattttacctcttgattagcaaggaaaacaaaaagagaaaaaactttaaaatgggtcccctttatcaaaatttcgcggaattcatgactaaattgttggaagtggcaaatgacttacaattactatacgtggaatcggacgaagatgatacccaaatagttactggtaatcttgtgttggatttgttgacttggctgtcttctttttcagtttgcaaaatcagatgcttcagatacatttctacgctaacgctatatcttttccaggactatttgacccaacaggctgttaatttagaaaagaattatttggcgaagttatccaagcagttatcactagaagagaagaaaaaaaggcccaataacaagactttagaaaagctagagagcactatcgccgaaactcaaggcagcaaagtcgttattgatagcattatcgataacatcgtcaaactatgttttgtgcataggtataaggacgtgtctgatttgattcgttcagaatccatgttgcatctatccatctggattaaaaactatcccgaatatttcctcaaggttacatttttaaaatattttggctggctgctgagcgataactctgtatcagtcagattacaagttacgaagattttaccgcatttaataatccaaaatcataacagtaaatccactgataattccgctatacgccaagtatttgaacgcttcaaaactaagatcctggaagtggcaatccgtgacgttaatcttgatgtaaggatccatagtatccaagttctaacggaggcgtcatcattgggctatttagatgattctgagattcttatcatttctagtttaatgttcgatgaagagttcgacccatttaaaacatcctcattcaataaaagatccaaatttctatccacggtggccaaattcttagcaagagtaataaaagagaaatttgacgaattcatcaagacgcatgaagacttgcccaaagaagtcgacgggttagaagttggacccgttgttcaagtcggtatatttatcaagattctgaatgactctttaatttatcacttgaaggattgcgctgaagttgattcaaggacaaagatccgtatgctaacacaagcagcagagtttttgtctccttacatttccactcacttgaaaactatttgcaatctgctgatctctgacactgaatcaaatgaactgatccaaaagttacaaaactcggccaataataacagcgatgacgaggatgttgacgatgaggaattggacatcactccattgtttcccattgacagaaatagcactattttatatctgaacgtattccacggtctgtgtgcaggtgccaacaaccccaaaatccaaactaaggacagcgttaaggaaatagttttgcctttattctacgatttgttgaatgccgcatccatcgaatctgctgatattctgtgtcctctcctagagagctttatcacattttctctggatgattggatatctattggatatgaaactgaattaaaaaaaattaccgacaaaactattaaagcatttatggattctacaatcgggaattcaaaagttgacatgaagtacgatatatttgctaaattcattcaccatatccatcattttgaaaaaaaggaactgcaggaaaaatttttaaaccagatagctacattgaaaattcatttaaaaaaatttctacaggaaaaaatggatccaaataattctagggacgactacaaagatttaacttgttctttgtacgagctctacatcaataaactgacaattcttggcagggattacccaatcgaggttgatgaagagttgttgcaactgtttttgaacaattttgtttcccgtatccctataatgtttcaagattttgatgatagtaccgctcaagaaataaactttaaaatgctagtgttattagccacatggaatctggaaaaatggagagaaataatagagaaagtaagggattacgagaattctatttcaaaagatcttagatcagtttggaaaccaattgccgctataataggtcgtctaaacacactcgttatttcattggcggctacaaacgaaacatttgaaaacataaacagcttgttttacttaaaatggtcagcttgcacttcattaatggatataatcgttgcaataaaaatatttgagctcaaattgcctgcagacgctacaacatggagatatagtatgagtgaacaatttccattttaccttcacgataatgcttccaaagtgcttttgaaaatatttttatatttggagagtcttttcgctaagcaagttgacgtccaattagaaagggtagcagatgaagacgccaacctaaatgatttgccggaaaccgggtttttcgagaatattgaaactgaattccttttattcacagttaaattgaagggactaatgaaactgaatattttagatgaacgatttgcttcccgtgtggcactaaacaaagaaaagcttggcccgctgttcaaaaaaatcgtagatgataccataatggaaaatccagaacctaataaaaagaacatacagaaagcaaaatcaaatcaaacacagagggaaaaagcgcctttacaacccaacagtgaacgagaaaccgaccatgcaaatactgaaaataatgatccagatattcccatgacaatcgatctagaacctattgaagaaagttcgcaaaataattcagagttagcaccaattgaggaacacccaaccgtggtagatgctatagacaacagcgacgaaatcacacaagattaa

SEQ ID NO: 45800 - DNA, 1764 bp, Saccharomyces cerevisiae
atgtctgcaattaatcatctttgtttgaaacttattttggcgagtttcgcgattattaacaccattactgctttaacaaacgatggcactggtcacttagaattccttttacaacacgaagaggagatgtattacgcaacaaccttagatataggtacaccgtcccaaagtctgacagtgttgtttgataccggatctgccgatttttgggttatggattctagcaatcccttctgcttaccaaattcaaatacgtcatcctattcaaacgcaacttataatggcgaagaagttaagccttcaattgattgcaggtctatgagtacttataatgagcatagatcttccacctaccaatatctggaaaatggtaggttttacatcacatatgctgacggaacatttgctgacggtagttgggggacggaaactgtatcaattaatggaattgacatccccaatatccagttcggagttgccaagtatgctacgacacccgttagtggtgttcttggaattgggtttcctagaagagagtccgttaagggctatgaaggtgctcctaatgaatattatcctaattttcctcagattttaaaaagtgaaaaaataatcgatgtggtcgcgtattcgctgttcttaaactcacctgattcaggtactggttcgattgtttttggtgccattgatgaatcaaagttttctggtgatttgttcactttccctatggtaaatgaatatcccacaatagtcgacgctcctgcaactttagcaatgactatacaaggattaggtgcccaaaacaaaagtagttgtgaacatgaaacgtttacgacgaccaagtatccagttttgttggactcaggaacctcgctattgaatgcgcccaaggtcatagcagataaaatggcttcttttgtaaatgcgtcctatagtgaagaggaaggtatatatatattagactgtccagtatctgtaggtgacgtggaatacaattttgatttcggcgatttgcaaataagtgttccactgtctagtttgattttaagtcccgagacagaaggcagctattgtgggtttgcggtccagccaacaaacgattcgatggttctgggtgatgtgttcctgtcctctgcatacgtcgtattcgatctcgataattataagatatctttagcacaggcaaattggaacgcaagcgaagtttcgaaaaagctagtaaatattcaaacagatgggtctatttcaggtgccaaaattgctacagctgaaccctggtccaccaatgaaccatttacagtcacctctgacatttattcatctacaggctgcaagagtaggccttttcttcaatcatcgacagcctcttcgcttattgcagaaaccaacgtacaaagtcgcaactgctctacgaagatgccaggcactagatcaactactgtcttaagtaagcctactcaaaatagtgctatgcatcaaagtacaggcgctgtcacacaaacctcaaatgaaactaaattagaattatcctcgactatggcaaattcgggcagtgtctcgcttcccacttcgaattcaatagacaaagagttcgaacattcgaaatctcaaactaccagcgatccaagtgtagcagagcattctacgtttaaccaaacgtttgtacatgaaactaaatatcggcctactcataagacagtcataacagaaactgtcacgaagtattctacagtcttaataaatgtctgtaaaccaacatattaa

SEQ ID NO: 45801 - DNA, 2633 bp, Saccharomyces cerevisiae
atgtctctttccaaatattttaatccaattcctgacgcttcagtcacctttgatggggctaccgttcaattggaagaatccctcggtgctgttcagaacgatgaagagtccgcatcggaattcaaaaacgtaggccatttagaaattagtgatatcacttttcgtgctaatgaaggtgaagtcgtcttagtactgggaaacccaacatcagcgctcttcaaaggtctattccatggtcacaagcatctgaaatactcgcctgaagggtctattagattcaaagacaatgagtacaaacagtttgcttccaaatgcccccatcagatcatttataataacgaacaagatattcacttcccgtatctgacggtggagcaaaccattgattttgcgttgagttgtaagtttcacattcccaagcaagagcgtattgaaatgagagacgagttattaaaagagttcggactgtcgcacgtaaagaagacgtatgtgggtaatgactacgttcgtggtgtttctggaggtgaaaggaaacgtatctccattatagaaacgtttattgccaatgggtctgtttacttatgggacaactcgacgaagggtttggactctgccaccgccctagaatttctttccattacccaaaagatggcaaaagctacaagatcggtgaattttgttaaaatttctcaagcaagcgacaaaattgtcagcaagtttgacaagattcttatgttaggtgattccttccaggtgttttacggaaccatggaggagtgtttaacccattttcatgacaccttacagataaaaaaaaaccctaacgattgtattattgaatatttaacatcaatcttaaattttaagttcaaggaaacgtctaattccattgttggtcttgacactccatctgttgtttctgaagaaaatcaagctttaaacatcaataatgaaacagatttgcatacattatggattcagtctccatactataaacactggaaggccatcacttcaaaaacagtgcaagaatgcaccagaaaagatgttaatccggatgatatctcccccatttttagtattccgctaaagacgcaactgaaaacgtgcactgtaagagctttcgaaagaatcattggtgacagaaactacttgatttctcaatttgtttctgttgtggtgcagtctttggttattgggtcccttttttataacattcccctgacaacaattggttcgttttctagaggatctttaactttcttttccatcctattctttacatttctttctctcgccgacatgcctgcttcctttcaaaggcaacccgtcgttcgtaaacatgtccagctccatttttattataattgggtggaaactttagcaacaaattttttcgattgctgctctaaatttatactggtggttatttttacaatcatactttactttttggcccatttacagtacaatgcagctaggtttttcatctttttgcttttcctttccgtctataatttttgcatggtgtcactatttgcattaactgctttgatcgctccaactctatcaatggcaaacctattggccggtatcttactgttagccattgccatgtacgcgtcctatgttatttatatgaaagatatgcatccatggttcatatggattgcatatttgaatcctgctatgtttgccatggaagccattttgagtaacgaattgtttaacctgaaactagactgtcatgaaagtattattcccagaggtgaatattatgacaatatttcattcagtcataaagcttgtgcctggcaaggcgctaccctaggtaacgattacgtcagaggccgtgattatttaaaaagtggattgaaatacacttaccatcacgtgtggagaaatttcggtattatcattgggtttctgtgtttcttcctattttgctctttactagcagcggaatatatcacgcctctgtttactagagaaaatttattgcgctggaataactatctcaaaagatactgtccctttctgaatagccaaaaaaagaataataaaagcgctattaccaacaacgatggcgtatgtactcccaagaccccgatagccaatttttccacttcatcctcttctgttccatcagtctcgcatcaatacgatactgattacaatattaaacatccagatgaaactgttaacaatcatactaaggaatccgtagctatggaaacgcaaaagcacgtcatctcctggaaaaatatcaattataccattggagacaaaaaattgatcaacgacgcttctggatatataagttccggattaactgccctaatgggtgaatctggtgctggtaagacaactttgttgaatgtcttgtctcaaaggaccgaaagcggggttgttaccggtgaattattaatcgatggacagcccttaacgaatattgatgcattcagaagaagtatagggttcgttcaacagcaagatgttcatttagagctcttaactgtgagagagtctttggaaatttcctgcgtcctaagaggtgatggggatagagactatttaggagttgttagcaacctattaagattgccttcggaaaaactggttgctgatttatc

SEQ ID NO: 45802 - DNA, 2085 bp, Saccharomyces cerevisiae
atgtccgaacaacactctgtcgcagtcggtaaagctgctaatgagcacgagactgcccctaggagaaatgttagagtcaagaagcggcccttaattagaccattgaactcgtcagcatctacgctgtatgaatttgccctagagtgtttcaacaagggtggaaaacgagatggtatggcttggagagatgtcatcgagattcatgagacaaagaaaaccattgtgagaaaggtagacggcaaggataaatctatagaaaagacatggctgtattatgaaatgtcaccatataaaatgatgacctaccaggaactgatctgggtgatgcacgatatgggccgtgggctggcaaaaataggcatcaagcccaatggagaacacaaattccacatcttcgcatctacttcccataaatggatgaagattttccttggttgcatatcccagggtatccccgtagtaaccgcgtatgatactttgggtgagagcggtttgattcactccatggttgaaaccgagtctgctgctattttcactgataatcaattattggctaaaatgatagtgcctttgcaatctgctaaagatatcaaatttcttatccataacgaacctatcgaccccaatgacagaagacaaaacggcaaactttacaaggctgctaaggatgccattaataagatcagagaagttaggccagacataaaaatttatagttttgaagaagttgtcaagataggtaaaaaaagtaaagatgaggtcaaacttcatccacctgagccaaaagatttggcttgtatcatgtacacctcgggctcgatcagtgcaccaaaaggtgtagtattgactcattataatattgtttcgggtatcgctggtgtaggtcacaacgtctttggatggatcggctctacagaccgtgttttgtcgttcttgccattggctcatatttttgaactggtctttgaattcgaagccttttactggaacggtattcttgggtacggtagtgttaagactttgactaatacttcgactcgtaattgtaagggtgacctggttgagtttaagcctactattatgatcggtgtggctgccgtttgggaaactgtgagaaaagctattttggaaaagatcagcgatttaactcccgtactccaaaagattttttggtctgcctatagtatgaaagaaaagagtgtaccatgcaccgggtttttaagtcgtatggtcttcaagaaagtcagacaagccaccggtggtcatcttaagtatattatgaacggtgggtctgcgatcagtattgatgctcagaaattcttttctatcgtcctgtgtcctatgattatcggttacggccttactgaaacagttgcgaatgcttgtgttttggagcctgatcatttcgaatatggtatagttggtgatcttgttggatcggtcactgccaaattggtggatgttaaggacctaggttattatgcaaaaaacaatcaaggtgaattgcttctaaagggtgcgccggtctgttctgaatattataagaatccaatagaaacggcggtctctttcacttacgatggatggtttcgtactggtgatattgttgaatggactcccaagggacaacttaaaattattgatagaagaaagaatttggttaaaaccctaaatggtgaatatattgcattagaaaagttagaatctgtttacaggtcaaactcctatgtgaaaaatatctgtgtttatgccgatgaaagtagggttaaaccggtgggtattgtggtacccaacccaggacccctatctaaatttgctgtcaaattgcgtattatgaaaaagggtgaagacatcgaaaactatatccatgacaaagcattacgaaatgctgttttcaaagagatgatcgcaacagccaaatctcaaggtttggttggtattgaactattatgtggtattgttttctttgatgaagaatggacacctgaaaatggctttgtcacatctgctcaaaaattaaagagaagagaaatcttagccgctgttaaatcagaagtcgaaagggtttacaaagaaaattcttag

SEQ ID NO: 45803 - DNA, 1122 bp, Saccharomyces cerevisiae
atgacacagactgataatcctgtccccaactgcggtttactgcccgagcagcagtattgctctgcagaccatgaagagccactgttgttgcatgaagaacaattgatattccctgatcattcctcccaactgtcctcagcagatatcatcgagcccatcaagatgaacagcagtactgagtcaattatagggacaacgctgcgaaagaaatgggtaccactatcctcaactcagatcacagctctttccggcgcatttgctggattcttatcaggtgtggcagtatgtcccctcgatgttgccaaaacgcgattgcaagcacaaggactacaaactaggttcgagaacccctactatagggggataatggggacattaagtactatagtaagagacgaaggcccgcggggcctctacaaagggctggtaccgattgtcctgggctacttcccaacctggatgatatacttctccgtgtatgaattcagcaaaaagttctttcacggcatcttcccacagtttgattttgttgctcagtcatgtgctgcaatcacggcaggcgctgcatctaccaccttgaccaacccaatctgggttgtgaagacaagacttatgctgcaatcaaacctcggtgagcaccccacacattacaaaggcactttcgatgcattcagaaagctattttatcaggaagggtttaaagcattatatgcggggctggtcccctcattattagggctatttcatgtggctatccatttccctatatacgaagatttgaaggtaagatttcactgctattctcgggagaacaacaccaactccatcaacttgcaacggttgatcatggcatcgtccgtctctaagatgattgcatcagcagtaacatatccgcacgaaattttacgaaccagaatgcaactgaaatcagatataccagattccattcaacgacgtctgttccccctcattaaagcaacttatgcacaagagggactaaagggattttattctggatttactactaacctagtacgaaccattccggcctcggcaatcactctagtgtcctttgagtatttcagaaaccgcctagaaaatattagcactatggtaatttaa

SEQ ID NO: 45804 - DNA, 4443 bp, Saccharomyces cerevisiae
atgtataacccgtaccagcaacagggcatgggttaccagcagcaacagcagcaacagcagcaacaaccaaatggattctacccgcagcagcagcaaggtcagtcttcaaaccagccccaaggccagcctcaaccacaacagcaaatggcgtttaaccagcctcaggctaccggaattggtgggatgcctcaaagttttggtaattctttctcaagtatgccacagcagccccaaacgggttacaataataatggaaataatggtagtgtatatggtaatggtaattttggccaacaaccccagcagcaacaacagcaggcgaaaccgcagcatacgggatacgtaccaaattccagtatgcctatgatgaatactactggcaccatgcctccacctaatccggctcaacagcctcagctacaatccatacaaccccaaggaacaggctattaccaagctgctaatactgcaaatgtacactcagtacaacctttgcaatctcaagggacaggatattatgtgtctacacccaatttgatctcttctaatcaaacccagcagccccttcaggcccagggcactggttattatcaatctcaacctcaacaggtgccacctcctcagcaagcacagtccttgcaacctttgaagccgcagcaaacaggattttaccttcaaccgcaaaaccaagctcccttagaaccattaaagcccaccgcaactggctttgtcaactcatttgccaacaacggtctaaacaatgatatcaaaatccctgccattagattgtcgtttattactgcccaagatcaggcaaaatttgagactctattcagatcaattgttaccaatggttcgaatactgtttccggtgctaattgtaggaaaattttgatgagatccggtttgccaccttctcaactcgcaagaatttggacgctttgtgatacatcaaaagcaggtgagttactgtttcctgaatttgcattagcaatgcatttgatcaatgatgtcttacaaggtgacactatcccttacgaattggattctaagacaaaaaacgaagtttcaagttttattgacgccattaatttaagcattgcaaaccaggattcttccgcaaacgatgccccaaaaactccctttgatgaattcattacagcgggcgtacaaaatttgcaacctcaaccaacaggatatatgcctcaaactagttttggtatcccattacagtctcaaattactggaggcggtgttgcctcggcgttgaatcctcaatccacaggatttatggcaccaaccactttcaacatgtcaatgaataccggaactcccggattgaacccccaaattactggaggagcacctgcctctatgcaacccaacattactggcaatgctttgcaacctcagacaactggtatgatgccacagacaactggtatgatgccacagacaactggtatgatgccacagacttcatttggcgttaatttaggacctcagttgaccggcggtgctttgcaatctcagtataccggaggatatggttccgttatgccccagcaaagcggtcctgcaagtatgcccaatttgtcctttaatcaacaaggattacaatctcagttaaccgggttgcaaccccaaccaacgggttttctaccaccatctaactttagtgctaccatgccgttgactgcccaaaagacaggatttggtaataacgaaatttataccaaatccaactttaataataacttaattgataactcaagtcaagacaaaatttccacggaggaaaaatctttgttttataaaatttttgaaacttttgatactcaaaacaaaggtttgttagattcccccactgctgtggagatttttagaaaatctggcttaaatcgtgcagatttggagcaaatttggaacctttgtgatataaacaacaccggccaattgaataaacaagaatttgcactaggtatgcacttggtttacggtaaattaaacgggaagccaatccccaatgtcctaccttcaagtttaattccctccagcacaaaacttttagacaacttaaagaaccaattaaagacagagccaacgaccacaaaagaaaaaccttcgtttggtaaaatcgatgccttgagctacaaaaataatgatgatgatgttttgccgaactatagaaatcgtaggaaggtttactctgcgaaaaatgaagagcaatcttctttttcttcaccatctgctaaatctgttaatcattctagcagcacccttcaaaccgatgacatttcggtagataagactgttgaaaagaagacagcgaaaccaaaatatgctgggttttcaagagaaataaatctgaaaaatattgcttcactggaaaatgagatcaaaaatatcagcaatcctgaaaactgttatgacagttctattccatcagatttgacaagccgctttgatgccatcatcgccaaacttccaaacctattcaatgaaatttctacaattgataatgagattaccaatgcaaaaattcagttgtatagaaaaaaaaatccttcttcgataattggatctggtccaaatggtgaaataactgaaaatgataggaagaaagctaagagtagggctttgttgagagcaaggatgtctgctctaacaggaaaatcaacggaatcggaggattcactttccatggaagatgaacagcaaagtgctgaaatcaagagaatccagcaggaaaatggtaagaaccaagaaatcattaaagacataaggtcatctatatcagatatttctgcatccttgaagtctactatgacaggatcgaatatgatatccaatcaagaatttgaaagatgggaatttggcatagggttagaagatggtgttcgtgaatttttggatgatctgaagtcaaattcaaataaatcagtgactgagtcatctccctttgtgccttcctcaacaccaacccctgtagatgaccgttcctcgtcgccttcttattctcagttcaaaactgctgaagaaagagcagcttatctgaaagaacaggcaaaaaagagaatgaaggaaaaattagctaaatttgataagaataggcgaaatgttactcaaagttccagatcgattagcagtgaaaactctcgagaacagccacaacagattgctggttcttccaatttagttgaacctagagcaactccattccaagaagaaaaatatgtggaagtcgctcaaccaactcaacctgttcaatcaacacaacctgttcaaccaactcaacctgttcagccaactcaacctgttcagccaactcaacctgttcagccaactcaacctgttcaaccaactcaacctgttcagaatgtatataatgcaaagcaagaatccgatgatgaagatgaagatgatgaagaaaagcgtttacaagaggagctaaaacgattgaaacttaaaaaaaaggctgataaagaaaaaagacttgcagctttacgtaagcaaattgaggatgctcaaaatgaaagtgacgaagaggagacaaacggaaaagacaactttggcggccatgtgaacgttcctcaggccgctccagtggcaccatctgcagctttttcgcaaaattctactaatgctcctcgctcggtacacgctgctgttacccctgccgcaggtaagaacagtactggtctgccttccacgacaatgggccataatccatacttcaaggatgcatcagctagctctacatctactttcgatgctcgcgctgcagaaatgcaaagaagaatccaaagaggattggatgaggacgaggatgatggatggtctgatgaagacgagagtaataaccgcgtagctgtagataataaggttgaagaagcaaagattggtcatcctgatcatgcacgtgctccacctgttactgctgctcccttgccgtctgttacccctgttccacctgctgtccctgtccctcaggcgaatacctctaatgaaaagagtagtcctattccaatagctccgataccaccttctgttactcaggagccacccgtcccgttggctccccctttgcctgctgttgatggctttcaagaacctccaattccctcagcacctgcaatagctactgccgtgcaaaaatcgggttcttccaccccagctttagctggaggcgttttgcctccacccccacctttaccaactcaacaagcttccacttcagaacctattatcgctcacgttgataactacaatggtgctgaaaaaggcacgggcgcatatggatccgattctgatgatgacgttttatcgattcctgaatcagttggtacagatgaagaggaagaaggggcacaaccagtttctactgcaggtatcccatcaattccacctgcaggtattcctccacccccaccccttccatga

SEQ ID NO: 45805 - DNA, 1230 bp, Saccharomyces cerevisiae
atgaccaattcagtaaagactaatgggccaagctcctcagacatggagtactactataagtcgctctatccattcaaacacattttcaactggctgaatcattcgcccaaaccttctagggatatgattaacagagaattcgctatggcgttcaggtcaggtgcttacaaaaggtataattcttttaactctgtgcaagatttcaaagcacaaatagaaaaagccaacccagacagatttgaaatcggtgccatatataacaaaccgccaagagaacgtgatactctattaaaaagcgaattgaaagctttagagaaggagttggtgtttgatattgatatggatgattacgatgccttcagaacgtgttgctccggagcccaagtttgctctaagtgctggaaatttatatctttggcaatgaaaattacgaacacggccctaagagaggattttggttataaggacttcatctgggtattttcaggtagacgtggtgctcattgttgggtaagcgacaaacgggcacgggctttgacggatgtacaacgaagaaacgttttagattatgtcaacgtgattagagacagaaatactgacaagcgattggctttgaagaggccttatcaccctcatcttgctcgttctttggagcaattgaaacctttctttgtcagcattatgctcgaagagcaaaatccttgggaagatgaccaacatgctatccaaactttattgcctgcattatatgataaacaattgattgattcattaaagaagtattggctggacaatccaaggaggtcaagcaaagagaagtggaatgatatagatcagatagctacatcgctcttcaaaggccccaagcaagactctcacataattaagttacgtgaatgtaaggaagatctcgtattgatgactctttatccgaagctggatgtggaagttacaaagcaaacaattcatttgttaaaggcccctttttgtattcatcctgctacggggaatgtctgtgtgcctattgatgaatcctttgcacctgaaaaagcacctaagctaattgatcttcaaacagaaatggagaaaaataatgatgtttcattaacagctttacaaccttttatcaatcagttccaagcatatgtgagttctcttttgaaaaatgaactgggttcagtgaaaagagaacgtgaagatgatgatgaaccggcttctttagatttctga

SEQ ID NO: 45806 - DNA, 564 bp, Saccharomyces cerevisiae
atgagtgcgaaacaagggtgggaaaagaaatcaacaaacattgacattgcaagcaggaagggtatgaacgtgaacaatctttcggaacatctacagaacctgatatcaagcgattcagagctgggctcgcgcttgctatcattgctgctggttagcagtggcaacgcggaggagctcattagcatgataaataatggccaggatgtctcgcagtttaagaagctccgcgagccgagaaaggggaaggttgccgcaacaacagcagttgttgtaaaagaagaggaagctcccgtgagcacttctaacgaactggataagattaagcaagagcggagaagaaagaacacagaggcgtcgcagcggttccgcattcgcaagaaacaaaagaattttgagaacatgaataagctgcagaacttaaacacgcaaatcaacaaacttcgcgatcgtatagagcaattgaacaaggaaaatgagttttggaaagcaaagctcaatgacattaacgagattaagtctttgaaattgttgaatgacattaagagacggaacatgggcaggtag

SEQ ID NO: 45807 - DNA, 1095 bp, Saccharomyces cerevisiae
atggctggaaatgcaaactcagtagacgaggaagttaccaggatattaggaggcatatatcttggcggaatccgtccaattattgaccacagaccattgggtgcagaatttaacattactcatattctttctgttatcaaattccaggtcattccagagtatctaataaggaaaggttacacgctaaaaaacatacccatcgatgatgatgatgtgactgatgtgctgcaatacttcgatgaaacgaaccgattcattgatcaatgcttgttccccaatgaagttgagtattcgcccagattagtagatttcaagaagaaaccacaacgtggtgctgtttttgctcattgtcaagcaggactctcgagatctgtaaccttcatagtagcctacctaatgtatcgttatggattgtcactatcaatggctatgcacgctgtcaagaggaagaaaccgagtgttgagccaaacgagaatttcatggaacaattacatctctttgagaaaatgggtggagattttgtcgatttcgacaacccagcctataagcagtggaagctgaagcaatctatcaagttagatccatcgggcagcgaattggtctccaattctggaatgtttaaagattcggagtcgtcgcaagacttggataaattaactgaagctgagaagagcaaggtcaccgcagtgagatgtaagaagtgcagaaccaaattggcgttatctacatctttcatcgcgcatgacccaccaagtaaggaatcatcagagggacacttcatcaagagggccgccaactcccatcgtattattgatattcaagagtcacaagcaaattgctctcattttttcatcgaacctttaaaatggatgcaacctgaactacaaggcaagcaagagttagaagggaagttttcatgtccaggctgttcaagtaaagttggcggttacaactggaaaggatctaggtgcagttgtggtaagtgggtcatccccgctatccacctgcaaactagtaaagtggatcaatttcccttacaatccactgctttgcccaacatggttaattttgaatccgagaaagtaaatagataa

SEQ ID NO: 45808 - DNA, 765 bp, Saccharomyces cerevisiae
atgggtaaagttattttagttacaggtgtttccagaggtatcggtaagtccatcgtggatgttcttttcagtttggacaaggacacggttgtttacggtgtagccaggtctgaggcacccttgaagaagttgaaagagaagtatggcgacaggtttttttacgttgtcggtgatattaccgaggattccgtgttgaagcagttggttaacgctgctgttaagggccacggcaagatcgactccttggttgccaacgctggtgtcctagagcccgtgcaaaatgtcaacgagattgatgtcaacgcttggaagaagctgtatgacatcaacttcttcagcattgtttccttggttggcattgcgttacctgaattgaagaagaccaacggtaacgtggtattcgtcagttcggacgcctgtaacatgtacttcagcagttggggagcttacggttcttcaaaagccgctctgaaccacttcgccatgactctggccaacgaggaaaggcaagtgaaagccattgccgtcgccccaggtattgtggacacagatatgcaagttaacattagggagaacgtggggccttcctccatgagtgcagagcaattgaagatgtttagaggtttaaaggagaataaccagttgctggatagctctgtgccagctacagtttatgccaaattggcccttcatggtattcctgacggtgttaatggacagtacttgagctataatgaccctgccttggcggactttatgccttga

SEQ ID NO: 45809 - DNA, 792 bp, Saccharomyces cerevisiae
atgggcaaggttattttgattacaggtgcctcccgtgggattggcctgcaattggtgaaaactgttatcgaagaggacgatgaatgcatcgtctacggcgtagcaagaacggaagctggtctgcagtctttgcaaagagaatacggtgcagacaaatttgtctatcgtgtcctcgacatcacggacaggtctcgaatggaagcgttggtggaggaaatccggcaaaagcatggaaaactggacggtattgtcgcaaatgcggggatgctagaaccggtgaagtccatctcccagtccaactccgaacacgacatcaagcagtgggaacggctgttcgatgtgaactttttcagcattgtctctttggtggcactgtgtttacccctcttgaagagctcgccatttgtaggcaacattgtcttcgtcagctctggagccagtgtgaaaccatataacggatggtcggcgtacggctgctcgaaagccgcattaaaccactttgccatggacattgccagtgaagagcccagtgataaagtgcgtgccgtgtgtattgcaccgggcgtcgttgacacgcagatgcagaaagatattagggaaacattgggtcctcagggcatgacacccaaggctctcgagaggtttactcaattgtacaagacttcgtcactgctggacccaaaggtgcctgcggcggtactagcgcaactcgtcctgaaaggtattcccgactctttgaacggtcaatatctccgctacaacgatgagcgactggggccggtgcagggctag

SEQ ID NO: 45810 - DNA, 1168 bp, Saccharomyces cerevisiae
atgcaattgatttccatcctctctttgttgtcatcattgatgtgttcattgaccgttttagggtcttccgcaagttcctatgttaagtttcctgttcaaaagttggctgatattataaatatatgcacacaggatgtttctaccgtcttcaaaagaaatgaggttcttaacaccacagtgataaatggaataggagtgtatgttgtcaagatggaaatcggaacgcctccacaaacgttgtacctacagttagatactggctcttcagatatgattgtgaataatgctgacattgcctattgcaaatcgatgtctgacggatctgactacgcttcaactgataattacgagctcacagcaacgttcaatgggcttccttcgactaccatctcatcagaagcttataacactctctgctcttattggggtacattcgatgcaagcaactcatctacttttgagaataatgcgacgtttttcaataacacatacggagatggtacgtattatgcagggacttatggtacggatgttgtctctttcgaaaatattactctaaatgatttcacttttggtgtatcaaatgatacaataggcaatccaagtggcattttaggcatatcgcttcccattgcagaatttacagatggtatcgaatacgcattggcattgaacagaacacctttcatatatgataactttccaatggaattaaaaaatcagggaaagattaataaaatagcgtattctttatttttgaatggacctgatgcacacttcgggagcatcttgtttggtgcagtggacaaaagtaagtacacaggacagctttacaccctgcctatgctgcaggcattcaatacccttggctcaaatcctgggatgattattactgcacaaagtgtggcaattttggatagtgaatctggcaataaaactgtttcggatattcaatttccagtgatgttggattctggcacaactttctcctatttacccaccgaaattgcagaagcaatcggcaaaagttttgacggagagtacagctctgacgaccaaggctacatctttgattgttcaaaagtgaacgatactttactgtccgtcgactttggaggatttaatatatcggcaaacatatccaatttcgtaacatcagctaaggatc

SEQ ID NO: 45811 - DNA, 1770 bp, Saccharomyces cerevisiae; identical to SEQ ID NO: 45758

SEQ ID NO: 45812 - DNA, 1704 bp, Saccharomyces cerevisiae
atgtccggtgttaataatacatccgcaaatgatttatccactaccgagtctaactctaactcagtagcaaatgcaccatctgtaaaaactgagcataatgactctaaaaactccctcaacctggatgccactgaaccacctattgacttacctcaaaaacccctctctgcatataccaccgtcgcaatcctgtgtttgatgattgcatttggcggcttcatctttggttgggataccggtaccatttctggttttgttaacctttctgatttcatcagaaggttcggtcaaaaaaatgacaagggaacctactacttatcgaaagtaagaatgggtttgatcgtctcaatattcaacattggctgcgccataggcggaattgtcttgtcaaaagtcggtgatatatatggtcgtcgtattggattgattacagttactgccatttacgttgtaggcatcctaatccaaataacttccataaacaagtggtaccaatacttcattggaagaattatttctggcctaggagtgggaggcattgctgtcctttccccaatgttgatatctgaagttgctcccaaacaaatcagaggaaccctggtccaattgtaccagctgatgtgtacgatgggtatttttctaggatactgtaccaattacggtaccaagaactatcacaacgccactcaatggagagtcggccttggtctttgctttgcctggactacattcatggttagtggaatgatgtttgtaccagaatcaccacgttacctgattgaggttggtaaagatgaggaagcgaaacgttcactttcgaaatccaacaaagtctcagtcgacgatccagccttgttagcagaatatgacactataaaggcgggaatcgaacttgaaaagctggcaggtaacgcatcatggtctgaactactctccactaaaacaaaggtctttcagcgtgttctcatgggagtgatgatccaatcgctgcagcaattaaccggtgataactacttcttttactacggcaccaccatcttcaaatctgtcggtctaaaggactcctttcagacttcgatcattatcggtgtggttaattttttctcttcattcatagcggtatacaccattgagaggtttggacgccgtacgtgtctattgtggggtgctgcttctatgctatgctgctttgctgtgtttgcctccgtcggtgtgacaaagttgtggcctcaaggaagcagtcaccaagacattacttctcagggcgccggtaactgtatgattgtgtttactatgttcttcattttttcgttcgccaccacttgggcaggcggctgttacgttattgtctcagagacgtttcctcttagggtcaaatcaagaggaatggcaatcgcaacagctgcaaactggatgtggggtttcctgattagtttctttaccccattcattaccggggcaatcaacttttactacggttatgtattcttaggctgtctggtttttgcatacttttatgtctttttctttgtcccagaaacaaaaggcctgacgctggaggaggtgaatactatgtggctggaaggtgtgccagcatggaaatcagcctcatgggtgccaccagaaagaagaaccgcagattacgatgctgacgccatagaccatgacgatagaccaatctacaagaggttcttttccagctaa

SEQ ID NO: 45813 - DNA, 1746 bp, Saccharomyces cerevisiae
atgacgatcatccataatcctaaatggtggaaagaagccaccgtctaccaaatttatcctgctagtttcaaggactccaacaatgacggatggggtgatttagctgggattacctccaaacttgactatgtcaaagaattaggtgtcgatgcgatatgggtgtgcccattttatgactctcctcaagaagatatgggttacgatattgccaactatgagaaggtttggccacgttacggtaccaatgaggattgtttccaaatgatagaagaagctcataagagaggtatcaaggttattgttgacctggttatcaaccactgttctgaagagcatgaatggttcaaggagagtagatcttctaaggctaatccaaagcgtgactggtttttctggagacctccaaagggttacgatgagaaaggtaatccaattcctcccaacaattggagatctttctttggtggatctgcttggagatatgacgaaaaaactggtgagttctttctgcatgtgtttgctcttggccaacctgatttcaattgggaaaatgaagagtgccgtaaagccatttatgactcctcagtgggctattggctacgtcacaacgttgatggctttcgtattgacgtaggcagcatgtattctaaggttgagggcctacccgatgctcctatcactgatcctacagttccttaccaaaaaggaactgaatttttcataaatgggccacgtatccatgagtatcataaagaaatgcataactacatgctctcgcaagttccagagggtaaagaaatcatgactgttggagaagttggtatcgggaatgaagacgacttcagagtttataccagtgccaaagaaggagaactaaatatgatgttcaacttcaagcacacctcagtaggtgaaaacccaaaatgcaagtacgaacttattccctttactttaaaagactttaagctggctcttgctgaaagctttctgtttatcgaaaacacagattgctggtcgaccatctatttggagaatcatgatcaacctcgtagcgtttcgcgttttggctcagattctcctaaatggcgtgagatttcgtccaagatgttggctactctcatcatttcattgactggtactgtttttatctaccaaggacaagaattgggtatgcccaacttcaaaaacagaaaaattgagcaaatcaaatgcgttgaaggtactggtacatatgccgccattaaacgtgattatggtgaagattctgaaaagatgaaaaagttttttgaagcattagctttgatctctagagatcatgggagaacaccattcccatggagtgctgatgagccttctgcaggtttctcgaaggatgccaaaccatggattgacatgaatgaatcatttagagacggaatcaacgcagaagctgagttaaaagataaaaactcagtcttctttttctggaaaaaggccttacaagttagaaaggagcacaaagatatccttgtttatggacataactttcagttcattgatcttgataatgacaagctattcatgtttacaaaggacacagataacaaaaaaatgtttgctgttttcaatttcagtagcgataatacggacttttcagttcctgataatgaggcctcctacaccatgttttttggcaactatgcaaactcaaatggtgattcccgcaccttgcagccatgggaaggaagactttacttgttgaagtaa

SEQ ID NO: 45814 - DNA, 1710 bp, Saccharomyces cerevisiae
atgactgatcgtaaaaccaacttgccagaagaaccgattttcgaagaggcagaagatgatggctgcccttcgatagaaaattcttcacatctgtcagtacctacagtggaggaaaacaaggacttttccgagtataatggggaagaggcagaggaagttgttgttccagaaaagcctgcttcagcctatgctactgtttctatcatgtgtttatgtatggctttcggtggatttatgtccggttgggacacaggtacgatttctggtttcgtcaatcagactgattttttaagaagatttggtaattatagccattccaagaacacttactacttatctaatgtgagaactgggttgattgtgtccatcttcaatgtgggaagcgccattggctgtcttttcttgtctaaattgggtgatatttacggccgctgcatgggtttgattatagttattgtcgtttatatggttggtattgtcattcaaattgcctctatagataagtggtatcagtattttattggaagaattatcgctggtataggtgctggttccattagtgttcttgccccgatgcttatttcggaaactgcgccaaagcatatcagaggtacgttgctagcttgttggcaattgatggtgactttcgcaattttcttgggttattgtaccaattatggtaccaagacttactcgaattctgtccagtggcgtgttccgcttggtctatgttttgcatgggctattattatgattggtggtatgacgtttgttccggaatctcctcggtttttggtgcaagtcggtaagattgagcaagctaaagcttcttttgccaagtcgaacaagcttagtgttgacgatcctgctgtggttgcagagattgatcttcttgttgctggtgtggaggcagaagaagcaatgggaactgcttcatggaaggaattattttcgagaaagactaaagtttttcaacgtttaacgatgacagtcatgattaactctctgcagcaactaaccggtgacaactatttcttctactacggtactactatcttcaaatctgtcggtatgaatgactcttttgagacttcaattgtcttgggtattgtgaattttgcttcttgcttcttttcactttattctgttgataagttgggccgtcgtagatgtcttttacttggagcagccaccatgacggcgtgcatggttatttacgcctccgttggcgtcacaagactatatccgaacggtaaaagtgaaccatcatctaaaggtgctggtaattgtacgattgttttcacgtgtttttacattttctgcttttcctgcacctggggacctgtatgttatgtgattatttctgaaacatttccattaagggtgagatccaagtgtatgtccgttgcaacagcggccaacttattgtgggggttcctaatcgggtttttcactccttttattacttcggcaattaatttctactacggttacgttttcatgggttgcttagcgttttcatatttttacgtctttttctttgttccagaaacaaaaggtctaactttagaagaagttgatgagatgtggatggacggtgtattaccttggaaatctgaatcctgggtaccagcttctagaagggatggtgattatgataacgaaaaattacagcatgacgagaaacccttctacaaaagaatgttttag

SEQ ID NO: 45815 - DNA, 2400 bp, Saccharomyces cerevisiae
atgagtaccatttatagggagagcgactcgttggagtcggagccctcgccaacgccaacaaccattcctatccagatcaatatggaagaggaaaagaaagatgctttcgttaagaatattgacgaggacgtcaataatctcactgcgactactgatgaggaggaccgcgatccggaaagccaaaaattcgacaggcattccatacaggaggaaggtctcgtttggaagggcgaccctacatacttgcccaattctccatatcctgaagtgagatcggcggtgtccatcgaggatgaccccaccatccgcctcaaccactggagaacgtggttcttgaccacggtgtttgtggtagttttcgccggtgttaatcaatttttttccctgagatatccatcgctagagatcaacttccttgttgcacaagttgtttgctacccaattggtaggatactggctctcttgcccgactggaagtgttctaaagtgccatttttcgatttaaacccgggcccatttaccaaaaaggaacacgccgtggtcacaattgccgtggcgcttacttcctctactgcatacgctatgtacattttgaacgcccagggaagcttttacaacatgaaacttaatgtcggatatcagttcttgttggtttggacatctcaaatgattggttatggtgctgcaggtcttaccagaagatgggtcgtcaaccctgcaagctctatctggcctcagactttaatttcagtgtccttgtttgattcgttgcactcgagaaaagttgaaaagacagtcgcaaatggttggacgatgccccgttacaggttcttcttaatcgtccttatcggatcgttcatctggtattgggtacctggattcctctttaccggtctgtcctatttcaacgttatcctatgggggtcgaagacaagacacaatttcatcgctaacacaatctttggtactcaaagtggtctcggtgcgttgccaattacatttgactacacccaggtttcccaagccatgtccggctctgttttcgccacaccattctacgtctccgccaacacctatgcatcagtgttgatattcttcgtcatagtgctgccatgtctttattttacgaatacctggtatgccaaatacatgcccgtcatttcaggttctacttatgacaacactcaaaacaaatacaacgtaacaaagattcttaacgaggattattccattaatcttgagaaatataaggaatactcaccggtattcgttccattttcctatcttttgtcgtatgctttaaattttgccgctgttatcgccgtttttgtccactgcatcttataccacggtaaagatattgtcgccaagtttaaagaccgtaaaaatggtggcactgacattcacatgagaatctactccaagaactataaggattgtcccgattggtggtatttacttttgcagattgtcatgatcggtttaggatttgtagcagtgtgctgtttcgatactaagttcccagcttgggcatttgttattgcaatattaatttcccttgtaaatttcatcccgcaaggtatcttggaagcaatgactaaccaacacgtaggtttgaatattatcacagaattgatctgcggttatatgctgcctttaagaccaatggcaaacttattattcaagctatacggatttattgtcatgagacaaggcttgaatttgagtagagatttgaaattagccatgtacatgaaggtttcccctcgtttgatctttgccgttcaaatctatgccactatcatatcaggcatggttaacgttggtgtccaggaatggatgatgcataatatcgatggcttatgtaccaccgatcaaccaaatggcttcacttgtgctaatggtcgcacggttttcaatgcttccattatctggtctttgccaaagtatcttttctcatcagggcgcatttataatccgctgatgtggttcttcttgattggtttgctattcccactagccgtttatgctgttcaatggaaattccctaaatttaaatttgctaagcacattcatactcctgtatttttcacaggcccaggtaatattccaccaagcacaccttataactactcattattttttgcaatgtcattctgcctaaacttgataagaaaaagatggagagcttggttcaataagtacaatttcgtcatgggggccggtgttgaagcaggtgtggcaatctccgtcgtcatcatcttcttgtgtgtacagtacccaggtggtaagctcagctggtggggaaacaacgtttggaaaagaacgtatgataatgattataaaaaattttataccttaaagaaaggtgagacatttggttatgataaatggtggtaa

SEQ ID NO: 45816 - DNA, 990 bp, Saccharomyces cerevisiae
atgtgcagtaggatactcttgtccggtttagtcggactgggtgctggtactggcttaacctatcttcttttgaacaaacattctccaacgcaaatcattgagacaccttatccacctacccagaaacctaatagtaatattcaatctcactctttcaacgtcgatccttccgggttcttcaagtatggttttcctggtccgattcatgatctgcagaaccgcgaagagtttatctcatgttacaacagacaaactcaaaatccttattgggtcctcgaacatataacgccagaatcattggctgcaaggaatgctgacagaaaaaattcctttttcaaggaagatgaagtaattccagaaaagtttagaggtaaactaagagactattttaggtcgggctatgatcgaggccatcaagccccagctgcagacgcaaaattttctcaacaggccatggatgatacattctacttatccaatatgtgtcctcaagtaggagaaggttttaatagagactattgggcgcatttggagtacttttgtaggggattgactaagaaatataagagtgtaagaatcgtgactggtccattgtatctacccaaaaaggatcccatagataataaatttagggttaattatgaagttattggcaatccacccagtattgctgttccaacgcacttttttaaattgattgttgcagaagcaccaacagccaatcctgctagagaggatattgctgtcgcggcatttgtattgccaaacgaaccgatatcaaatgagacgaaattgactgactttgaagttcctatagatgctttagagagaagtactgggctagaacttctgcaaaaagtaccaccttcaaagaagaaggcattatgcaaagaggtaaattgtcaaattgtagtgagagatttctctaacgcggcgatcaaacaatcgaaagatgtgaaattgttacctcctccaaaaaaaaggaattga

SEQ ID NO: 45817 - DNA, 2370 bp, Saccharomyces cerevisiae
atgctatcttcagctaataggttttatataaagaggcatttggcaacacatgccaatatgttcccctctgtatctaaaaattttcaaacaaaagtgccaccttatgcaaaacttttgaccaacctagacaagattaaacaaataacaaacaatgctccattgacactagcagaaaaaattttatactcgcatctttgcgatcctgaagaatcgattacttcttctgatctgtccaccatccgtggtaataaatacttgaagctaaacccagaccgtgtagctatgcaggacgcttctgcccaaatggcgcttctacaattcatgaccaccggtctaaatcaaacatctgtcccagcatccatacattgtgatcatttaattgtaggtaaggacggtgaaactaaagatttaccctcttccatagctaccaaccaagaagttttcgatttcttggagagttgcgcaaagagatatggaattcaattctggggcccaggttctggtatcattcaccagattgttttggaaaatttctcagctccaggtctaatgatgctaggtactgattcccatacaccaaatgcaggcggtctgggagctattgccatcggggttggtggtgcggatgcagttgatgccctcacaggcactccatgggaattaaaagcaccaaaaattttaggtgttaaattgaccggaaagttaaacggatggtccactcctaaagatgtaatcacaaagctcgctggtttactaactgtcagaggtggtactggttatatcgtcgagtacttcggcgaaggtgtatccactctatcttgcacaggtatggcaaccatctgtaatatgggagctgaaatcggtgctacaacgtcaactttcccttaccaagaagctcacaagcgttatttgcaagcaactaatagagcagaggtcgctgaagcagctgatgttgctttaaacaagtttaacttcttaagagccgacaaagatgctcaatacgataaagttattgaaattgacttatccgcaattgaacctcacgttaatggtccatttacaccagacctttcaaccccaatatctcaatatgccgaaaaaagtttgaaggaaaactggccccaaaaagttagcgctggtttgattggatcatgtaccaattcatcttatcaagacatgagtcgtgttgtcgacttggtcaagcaagcttccaaagccggcttgaaaccacgtatccccttctttgtcacccctggttcagaacaaattagagctaccttggaaagagatggaatcatcgatattttccaagaaaatggtgccaaagttttagcaaatgcatgcggcccttgtatcggacaatggaatagggaagatgtctcgaaaacatcaaaagaaacgaacactatttttacatcattcaatagaaatttcagagctagaaacgatggtaataggaatacaatgaatttcttaacatccccagaaatagtaacagcgatgagttattctggagatgctcagttcaatccgctaactgactcaattaaattgccaaatgggaaggatttcaaattccaaccaccaaagggtgatgagttaccaaaaagaggatttgaacacggtagagacaaattttatcctgaaatggatccaaagccagatagcaatgtagagattaaggtagaccctaattctgatcgtttgcaattattagagccattcaaaccttggaacgggaaggaattgaagacaaacgtgcttttgaaagttgaaggtaaatgtacaacagatcatatttccgctgcgggcgtctggttgaaatataaaggccatctagaaaacatttcttacaatacattgattggtgcacaaaacaaagaaaccggtgaagtcaacaaggcttatgaccttgacggaactgaatatgatattcctggtttgatgatgaaatggaaatcagacggtagaccatggaccgtgatagcggaacataactatggtgaaggttccgcaagagagcatgctgctttgtcaccaagatttttaggcggagagattcttttagttaagtcttttgcaagaattcatgagacaaacttgaagaaacaaggtgtgttgccattgacttttgccaacgaatctgactatgataaaatatcaagcggagatgttttagaaacgttgaacctagttgacatgattgctaaggatggtaataacggtggtgaaattgatgttaaaattactaaaccaaacggtgaatcgttcaccatcaaggcaaaacatactatgtctaaagatcaaatcgattttttcaaagctggttcagcaatcaattatattggtaatatacgaagaaacgaataa

SEQ ID NO: 45818 - DNA, 3765 bp, Saccharomyces cerevisiae
atgggttcttcagatgtttcaagtcgtgaatgttcattggtttataatgaagatcccgatttcaccgatggcacaacaccatgtgatcggttgggagtggacttgatgaatgttctagatgacaaggatgaaataaagcaagagtctgtcccagtctcagatcgtgaaattgaggatacggaatccgatgcttccgctgtttcttcatttgctagcgctaatgagttaatagctgagccacacgctgcaagtgaaactaatcttggaactaatggtcaagatggaagaaatgtcttagaacaacaaagagacgtggttgctagactaatagaagaaaacaaggaaacgcaaaaagagggtgataaagtctgtattgtccccaaggtttggtacgataaatttttcgaccccgatgttaccgatcctgaagatataggccctattaatacacgcatgatttgcagagactttgaaaattttgtgcttgaggattacaatagatgtccgtatctgtctattgcagagcctgttttcaattttctatcagaaatttacggcatgacaagtggctcttacccagtggtaactaatttggttatcaaccaaaccacaggggagttagagacagaatacaataaatggtttttcagactacattacctgaccgaaaaacaagacgggaggaaaaggaggcatggccaggacgattcaataatgtacctctcgatgtctgcgttgaatttagtacgtgatttggttgaaaagagtatgaatctgttttttgagaaagctgatcatctagacgtgaatgcggtggattttaaaatttggtttgtgtcagagggatctgatattgccacagatagcaatgttagtacttttttgaattcttcatatgaaataactccgcttcaatttctcgaactaccgataaagaaactactaataccagacatgtttgaaaaccgtttagacaagataacttcaaatccgagtgaccttgtcatagaaattaaacctatagaagggaatcaccattggccttcaaactattttgcttataataaactcgaaccagcatcaggtactactggtttggtcaatttgggaaatacatgttacatgaattctgcgttgcaatgcctggtacacattccgcagttgcgtgattatttcctttatgatggttatgaagacgaaatcaatgaagaaaatcctcttgggtaccacggctatgtggctagggcatttagtgacttggttcagaagttgtttcaaaacaggatgagcataatgcaaagaaatgctgctttccccccttcaatgttcaaatccactatcgggcactttaattcgatgttttctggttatatgcaacaggattctcaagaatttttagccttcctgttagacagtttacatgaagatttgaacaggataataaagaaagaatacacagaaaaaccatcattatctcctggtgatgacgtgaatgattggaatgtagtcaagaaactggcagacgatacttgggagatgcatttaaagagaaattgttccgttataacggatttatttgtcgggatgtacaaatcaacgctatattgtcccgaatgtcaaaatgtttctataacgtttgacccgtataatgatgttacattgccgcttccggttgatacagtgtgggataaaactataaaaatttttcccatgaactctccaccacttcttcttgaagttgagttaagcaaatcgtccacttatatggacttgaagaattatgttggtaaaatgtcgggcctagatccaaatacactatttggctgtgagattttcagtaatcaaatctatgttaactatgagtcaacagagtcgaatgctcaatttttaaccttgcaggaattgatcaaacctgctgatgacgttattttttatgaattaccagtaacaaatgacaatgaagtaattgttcccgtattgaatactagaattgaaaaaggctacaaaaatgcaatgttatttggagtccctttctttattacgttaaaagaagatgaattgaataatccaggtgcaataagaatgaaattgcaaaacaggtttgtccatttaagtggtgggtatatcccatttcctgaacctgtaggaaatcgaaccgattttgctgatgcttttccattattagtagaaaaatatccagatgttgaatttgaacaatataaagatatactacagtatacgtctattaaggtgactgacaaggataaatcctttttttccatcaagattctgtctgtagaaaaagagcagcaatttgctagtaataaccgaacagggcctaatttctggacccctatctcccagttaaaccttgacaaagctacagatatagacgataaacttgaagatgtggtgaaggatatctacaattattcatccttagtagattgtgctgaaggggtccttatgcaagtggatgatgagggagataccgagggtagtgaagcaaagaatttttccaagcccttccaatcgggagatgatgaagaaaataaagaaactgtaacaaataatgaaaatgtaaataatactaatgatcgggatgaagatatggaactaacagatgatgttgaagaagatgcaagtacagagccagaattaacagataagccagaggcgttagataaaattaaggatagcttgacttccactccgtttgcgattctttctatgaatgatattattgtttgtgagtggagcgaattgggttcaaatgaggcattttccgatgataaaatatataactgggaaaatccagctactttgcctaacaaagagttggagaacgctaagttggaaagatctaacgctaaggaaagaaccataaccttggacgattgtctccaattattttccaaaccagaaatactaggattaaccgattcgtggtactgccctacatgcaaggaacatcgtcaggctaccaaacaaatacaactttggaatacaccagatattctgctaattcaccttaaaaggtttgaaagtcaaaggtcttttagcgataaaattgatgccacggttaatttccccattacagatttggatctgtcgaggtacgttgtctataaagatgatcccagaggtttaatctatgacctgtatgcagtagataaccactatggtggtttgggtggtgggcactataccgcgtacgtaaagaattttgccgacaataaatggtactattttgatgattctcgagtaactgaaactgcgccagaaaatagtatagctggatcggcttatttgctattttacattcgccgtcataaagatggcaatggattaggcagctctaaactacaggaaataatccaaaagtcacgccacggatatgatgagcgtatcaaaaagatatacgatgaacagatgaagttgtatgaatttaataagactgacgaggaggaagatgtttctgatgatatgatagaatgtaatgaagatgtgcaggcccctgaatatagtaatcgtagtttggaggttgggcatattgaaactcaggactgcaacgacgaagatgacaatgatgatggtgagaggacaaattcaggtaggagaaagttaagattgttgaaaaaagtctacaagaataattcaggcttgggttcatcgagtacgtctgaaatatctgagggatgcccagaaaacgaagtcgctgatttgaatttaaaaaatggtgtgacactagaatcgccagaataa

SEQ ID NO: 45819 - DNA, 933 bp, Saccharomyces cerevisiae
atggtaagtgattggaaaaatttttgcctcgagaaagcctctaggtttcgcccaacaatagataggcctttttttaatatttatttgtgggactatttcaatcgtgcggttgggtgggccactgcaggtcgcttccagccaaaggattttgagtttaccgttgggaagcagcctttgagtgaacctcgtccggtactgctttttattgccatgtattatgtggttatatttggcgggaggtccctggtaaagtcatgtaaacctctcaagttgagatttatttctcaagtccataacttgatgttgacttctgtttcctttttatggttgattttgatggtggaacagatgctacccatagtgtatcgccatgggctgtattttgctgtttgtaatgttgaatcgtggacgcaaccgatggagacattatattatctcaactatatgacaaagtttgtggagttcgcagacactgtcttgatggtgttgaaacatagaaagttgactttcctacatacataccatcatggtgctacagctttactgtgctataatcaattggttggttacacagcagttacatgggttcctgtcaccttaaacttagctgttcacgttcttatgtattggtattatttcctttctgctagcggaattcgtgtttggtggaaagcctgggttacaagactacaaattgtgcagttcatgcttgatctcattgtcgtttattacgtgctttatcagaagattgttgctgcatatttcaaaaatgcttgtactccacagtgtgaggattgcttaggttcaatgacggctattgctgctggtgcagccattcttacatcctacttgtttttgttcatctctttctatattgaggtttacaaacgtggaagtgctagtggtaagaagaagatcaacaaaaacaattaa

SEQ ID NO: 45820 - DNA, 1542 bp, Saccharomyces cerevisiae
atgtcagctataccaataactccaactaagcgtatcagaagaaatctatttgacgatgctccagcaacgcctccacgacctttgaaaagaaaaaagttgcagttcacagatgttacaccagaatcatccccagaaaaactgcagtttggctcacagtctatttttttgaggacaaaggcacttttgcagaagtcatctgagctagtcaacttgaatagcagcgatggtgcattgccagcaagaacagcagagtacgaacaagttatgaattttttggcgaaggcaatttctgaacacaggtccgattcactgtacatcacgggtccgcctggcactggcaagactgcccagcttgatatgattataagacagaagttccagtccctcccattgtcgctctccacgccacgctcgaaggacgtgctgagacatacgaatccgaacttgcagaatttgtcctggtttgaattgcccgatggaaggctagaatccgtggcggtaaccagtattaattgtatatcgttgggagagccgtcctccattttccagaagattttcgattccttccaagatctgaatggcccaacattgcaaataaaaaacatgcagcatctacagaagttcttagagccttatcataagaaaactacgtttgtggttgtgttggacgagatggacaggctattgcatgctaacacgagcgagacacaatcagttagaactattcttgaattattccttttggcgaaattgcctactgtgagttttgtgttaatcggtatggctaatagtctagatatgaaagataggtttctttccaggttaaatttggacagagggttgttaccgcaaactatagtttttcagccatacactgctgagcaaatgtatgaaatcgtcattcaaaaaatgagtagtctgcccactattatcttccaaccgatggccatcaaattcgcagcaaagaagtgtgctggaaatacgggtgaccttcgaaaactttttgatgtcttaaggggaagtatcgaaatctatgagttagaaaagcggtttctgctttcaccaacaagaggatcattgaactctgcgcaagttcctttgacgccaactacttctccggtaaagaaatcgtatccagaaccacaaggtaaaataggcttgaactacatagccaaggtcttctcaaaattcgtgaacaataattctacgagaacgaggatagccaaactaaacatccagcaaaaattaattctttgcaccataattcaatcactgaagctaaattccgatgctacaatcgacgaatcgtttgatcattatatcaaagcgataacaaaaactgatactttagcaccattgcagagaaatgaatttttggaaatctgtacaattttagaaacttgtgggctggtttcaatcaaaaagacaaagtgtaaagggaaaaccaagagatttgttgataagattgatgttgatctcgacatgcgagaattttatgatgagatgaccaaaatttcaattttgaaacctttccttcactag

SEQ ID NO: 45821 - DNA, 1209 bp, Saccharomyces cerevisiae
atgtttcaacagctgtcggcatccattaggcacaatgcacacataatttttttatgcataagttggtattttatttcatcgttggcatctcaggtaacgaagcaggtactaacggtttgcccattaccactttttttgggtgagtttcagttcatttatactgctgtgctagcatggtttacgtgttatattgcatatagtttcccaggattctatcgcatatttcctaatggtacttttccggaatattatatcgacgacagagaaactagccgtgcagctaggaaagaatcaaaactatcctccctcattataccgccctctaaaccaatcctgcaaacagttctacctttaggtcttttccaatttgtagggaaatattttgggcatacagctacctctttggtgcctgtttccacggttgcaagtataaaaacgctatcccccatgtttatccttttgctccaaaagattttgaaaatatccactttgaaaattactttaactcttatctttagtttatgcactttagttcttggagtttggattatagttcaagaagataatcgttcaccggcctcttccaatgagctgagagaattctctaaatacggcgtaatatgcgctatgatatcaatgttcatttttgtcttgcaaaatatatatggcaagaccgtgttcacgtacagatctcaaacagatgaatctcaaagtaattctggattctcacggcaagaatcacctttacccttatatgaaaagttggatgagaaacttgttgcgaaaaagaaacctaaatcatatgacaaattgactttaatgatttatatttcccttgttggattttgtttatcgtttggctggtttatcactctagaatttcctgtactatttaggtatttttttcaaattaacagctcttctacagtaataaaagcttttccagtctctttatttttactgaacgggacattccacttcattcaggcaatgattacatttcatttactgggtgaggtctcaactttaacatattcaatagcgaatctgatgaagcgctttgccattattgcggttagttgggtctttattggaagaagaattacttggctgcaagtgttcggtttggttctgaacacattagggttattcctttatgaaagatgcacatcacaatcgaaaataaaagcgaaaatacgtcctgagtag

SEQ ID NO: 45822 - DNA, 831 bp, Saccharomyces cerevisiae
atgcgtttacaaagaaattccatcatatgtgctttggtgtttttagtctcatttgtgctgggagatgtgaatattgtttcccccagctccaaggcaacattcagtccaagtggtggtactgtctctgttcccgttgaatggatggataatggggcatatccctcgttaagcaagatttcaactttcacgttcagtctttgtactggtcctaataacaacattgactgtgtggccgtacttgccagtaaaattactccaagtgagctaacacaagatgataaagtttactcttacacagctgagtttgcttcgaccttaactgggaacggtcaatattacattcaagtttttgcccaggtggacggtcaaggttacactatccattatacaccaagattccagttgacttccatgggcggtgttacggcttatacatatagtgccacaactgaacctactccccagacttctattcaaacaaccactacaaacaacgcccaagccactactattgacagtcgttcatttactgttccgtacaccaagcagactggtacgtcgcgtttcgctccaatgcaaatgcagccaaatactaaagtgaccgctaccacatggacaaggaaatttgccactagtgctgtgacatattactctacctttgggtcattgccagagcaagcaactacgataactcctggctggtcttatacgatatcatcgggagtaaactacgctactcctgcatctatgccttcagataatggtggttggtacaaaccatccaagagattgtctttgtctgcaaggaaaatcaacatgagaaaagtatga

SEQ ID NO: 45823 - DNA, 369 bp, Saccharomyces cerevisiae
atggccagcgaaacaccaagagttgaccccacagaaatctccaacgtcaatgctcctgtgtttaggataatagcgcaaatcaaatcacaacccactgaatctcagttgattttacaatcgccaaccatatcatcgaaaaacggcagcgaggttgaaatgattacgttgaacaatattcgtgtatctatgaataaaacatttgagatcgactcgtggtatgagtttgtttgcaggaacaatgatgacggcgagctaggatttttgattctagacgctgtactatgcaaattcaaggagaacgaagatttaagcttaaacggtgtggttgctttacagagactatgtaagaaatacccagaaatatactag

SEQ ID NO: 45824 - DNA, 1059 bp, Saccharomyces cerevisiae
atggcttcagaaaaagaaattaggagagagagattcttgaacgttttccctaaattagtagaggaattgaacgcatcgcttttggcttacggtatgcctaaggaagcatgtgactggtatgcccactcattgaactacaacactccaggcggtaagctaaatagaggtttgtccgttgtggacacgtatgctattctctccaacaagaccgttgaacaattggggcaagaagaatacgaaaaggttgccattctaggttggtgcattgagttgttgcaggcttacttcttggtcgccgatgatatgatggacaagtccattaccagaagaggccaaccatgttggtacaaggttcctgaagttggggaaattgccatcaatgacgcattcatgttagaggctgctatctacaagcttttgaaatctcacttcagaaacgaaaaatactacatagatatcaccgaattgttccatgaggtcaccttccaaaccgaattgggccaattgatggacttaatcactgcacctgaagacaaagtcgacttgagtaagttctccctaaagaagcactccttcatagttactttcaagactgcttactattctttctacttgcctgtcgcattggccatgtacgttgccggtatcacggatgaaaaggatttgaaacaagccagagatgtcttgattccattgggtgaatacttccaaattcaagatgactacttagactgcttcggtaccccagaacagatcggtaagatcggtacagatatccaagataacaaatgttcttgggtaatcaacaaggcattggaacttgcttccgcagaacaaagaaagactttagacgaaaattacggtaagaaggactcagtcgcagaagccaaatgcaaaaagattttcaatgacttgaaaattgaacagctataccacgaatatgaagagtctattgccaaggatttgaaggccaaaatttctcaggtcgatgagtctcgtggcttcaaagctgatgtcttaactgcgttcttgaacaaagtttacaagagaagcaaatag

SEQ ID NO: 45825 - DNA, 1194 bp, Saccharomyces cerevisiae
atgtcgactgaagaacaaaatggaggtggtcaaaagtctctagatgatagacaaggtgaggaatcacaaaaaggtgagactagtgaaagggaaacaacagccacagagagcggtaacgaaagtaagtctgtagaaaaagagggtggagaaacccaagaaaaaccgaagcagccacatgtcacttattacaatgaggagcagtataaacagtttattgcccaagcgagagttacagtgggaagtatagtttacaagaactttcagatattaaggacactgggtacgggttcttttggtagggtccatttgattagatcaagacataatggcagatactacgccatgaaagttttgaaaaaggaaatcgtggtaagattgaaacaggtggagcataccaacgacgagcgattgatgctttctatcgtaacacatccgtttattattagaatgtgggggactttccaagatgctcagcaaattttcatgattatggattatattgaaggtggagaattgttttctttgttaaggaaatcccaaagatttcccaacccagttgctaaattttacgcagcggaagtttgtttagctttggagtacttgcatagcaaggacattatttatagggatttgaaaccggaaaatatcttgcttgataaaaacgggcatataaagataacagatttcgggtttgccaaatacgttcctgacgtcacatatacattatgcggtactcccgactacatagcacccgaggtcgttagtactaaaccatataataaatctatcgattggtggagtttcggtattctgatttacgaaatgctagcaggatacacgccattttacgactctaacacgatgaaaacctatgagaaaatcttgaatgccgaattgagatttccaccatttttcaacgaagatgtaaaggacctgttgagtagattgatcacaagagacttaagtcaaagactaggtaatttacaaaatggtacagaagatgtcaaaaaccacccctggttcaaagaagttgtctgggaaaaattattatctagaaacatagaaacgccgtatgaaccgcccattcaacagggacaaggtgacacctcacagttcgataagtacccggaagaagacatcaactacggtgttcaaggtgaagacccatatgctgatcttttccgggacttctaa

SEQ ID NO: 45826 - DNA, 543 bp, Saccharomyces cerevisiae
atgcattacaagaaagcatttctagcatctctattaagtagtattgcgctaactgcgtacgctccacctgaaccctgggcaactttaactccaagctctaaaatggatggtggcacaacagagtaccggacctcattcggtctcgctgttatacctttcaccgttactgaaagtaaggtcaaaagaaacgtcatttcacaaattaatgacggtcaagtgcaagtaacgacacaaaaattacctcatccagtttcgcaaattggagacggccaaatacaagttacaacgcagaaggtgcctccagtagtgtcacatattgtgtcacaaataggcgatggtcaattacaaataactacagctaaaaatgttgtcacaaagtccacaattgctgttccaagtaaaactgtaactgcgacagcaacttcaaccgcaactgctgtttctcagattcatgatggtcaagtgcaagttactatttcttcagccagtagtagttctgtgctttccaagagtaagttaagagccaacaaagaaaccaaataa

SEQ ID NO: 45827 - DNA, 933 bp, Saccharomyces cerevisiae
atgcaatacaaaaagactttggttgcctctgctttggccgctactacattggccgcctatgctccatctgagccttggtccactttgactccaacagccacttacagcggtggtgttaccgactacgcttccaccttcggtattgccgttcaaccaatctccactacatccagcgcatcatctgcagccaccacagcctcatctaaggccaagagagctgcttcccaaattggtgatggtcaagtccaagctgctaccactactgcttctgtctctaccaagagtaccgctgccgccgtttctcagatcggtgatggtcaaatccaagctactactaagactaccgctgctgctgtctctcgtgatggtcaaattcaagctaccaccaagactacctctgctaagactaccgccgctgccgtttctcaaatcagtgatggtcaaatccaagctaccaccactactttagccccaaagagcaccgctgctgccgtttctcaaatcggtgatggtcaagttcaagctactactaagactaccgctgctgctgtctctcaaattggtgatggtcaagttcaagctaccaccaagactactgctgccgccgtttctcaaatcggtgatggtcaagttcaagctactaccaagactaccgctgctgctgtctctcaaatcggtgatggtcaagttcaagcaactaccaaaaccactgccgcagctgtttcccaaattactgacggtcaagttcaagccactacaaaaaccactcaagcagccagccaagtaagcgatggccaagtccaagctactactgcttggctattggtgacaatgatgtcttctaccaatgtttgtccggtactttctacaacttgtacgacgaacacattggtagtcaatgtactccagtccacttggaagctatcgatttga

SEQ ID NO: 45828 - DNA, 684 bp, Saccharomyces cerevisiae
atgcaattcaaaaacgtcgccctagctgcctccgttgctgctctatccgccactgcttctgctgaaggttacactccaggtgaaccatggtccaccttaaccccaaccggctccatctcttgtggtgctgccgaatacactaccacctttggtattgctgttcaagctattacctcttcaaaagctaagagagacgttatctctcaaattggtgacggtcaagtccaagccacttctgctgctactgctcaagccaccgatagtcaagcccaagctactactaccgctaccccaaccagctccgaaaagatctcttcctctgcatctaaaacatctactaatgccacatcatcttcttgtgccactccatctttgaaagatagctcatgtaagaattctggtaccttagaattgaccttgaaggacggtgttttgactgatgccaagggtagaattggttctattgttgctaacagacaattccaatttgacggtccaccaccacaagccggcgccatctacgctgccggttggtccattactgaagatggttacttggctttgggtgacagtgacgttttctaccaatgtctatccggcaatttctacaacttgtatgatcaaaacgtcgccgaacaatgtagtgccattcatttggaagctgtttctttggtcgactgttaa

SEQ ID NO: 45829 - DNA, 2493 bp, Saccharomyces cerevisiae
atgaagacaccaacaagagtttcgtttgaaaaaaaaatacacactccaccaagtggagatcgtgacgctgaaagatcaccaccgaagaaatttctaagaggtttatcgggtaaagtttttagaaagacaccagaatttaagaagcaacagatgcccacatttgggtatattgaagagagtcaatttactccaaatcttggcctaatgatgtccaaaagaggcaatattcctaaaccactgaatctttccaagcctatatctcccccaccaagtttgaagaaaacagcgggatcagtagcatctggtttttcgaaaacaggacaacttagcgctttacaatcgccagtaaatatcacaagtagcaacaaatacaacatcaaagctacaaatttaactactagtttactccgagagtcgatttctgattctacaactatgtgtgatactttgtcagacatcaatttaacggttatggatgaagattatcgcattgacggcgattcatattacgaagaagattcaccaactttcatgatcagcctggaaagaaacataaaaaaatgcaattcacaattcagtccaaaaaggtacataggtgagaaatgtttaatctgtgaggaaagtattagttccacatttaccggtgaaaaggttgtggagtctacgtgttcacacactagccactataactgttatttgatgctatttgaaactctttatttccaaggcaagtttcctgagtgtaagatatgtggcgaagtgagcaagccaaaggataaagacattgttcctgaaatggtatccaaacttctaacgggcgcaggcgctcatgatgatggtccgtcatccaatatgcaacagcaatggattgatttgaaaacggcgagaagcttcacaggtgaatttcctcagtttacaccacaggagcagctcattcgtactgctgatatttcatgtgatgggttcaggacaccacgcttatcgaatagcaatcaatttgaggccgttagctatcttgatagcccatttttaaattcaccattcgttaataaaatggcaactacagacccttttgatttaagtgatgatgaaaaactggactgtgatgatgaaatagacgaaagtgctgctgaagtgtggtttagtaaaacgggtggtgaacatgttatggtcagtgtgaagtttcaagaaatgcggaccagtgatgatttaggggtcttgcaagatgtgaatcatgtggaccacgaagaactagaggaaagggaaaaggaatggaaaaagaaaattgatcaatatatcgaaacaaatgtggataaggatagcgaatttggcagtttgatcttgtttgacaaactaatgtattctgatgatggcgaacaatgggtagacaataaccttgtaatattattctccaaatttctagttttgtttgattttgaagaaatgaagatcctgggtaagattcctagagaccagttttaccaggtaatcaagttcaatgaggacgtactactttgtagtttgaagagcactaatatacctgaaatatacttgaggttcaacgaaaactgcgaaaagtggttgcttcccaaatggaagtattgtctagaaaattcttcactggagacactaccattaagtgagattgtttctacagtgaaggaactctctcatgtgaatataataggcgctttaggagcgccgcctgatgttatatcagcacaatcccatgattctcgtctaccgtggaaaagattgcacagtgatacgccgctaaaacttattgtatgtttgaatttgtcgcatgctgatggggaactgtatcgcaagagagttctaaagagtgttcatcaaatattggatggattaaacacagacgatttactgggaatagttgttgttggaagagatggatccggtgtagtaggcccatttggcaccttcatcggaatgataaataaaaattgggacggatggacaactttcttggataatttagaagtggttaatccaaacgtcttccgcgatgaaaagcaacagtataaggtaacattacaaacttgtgaaagattagcgtcaacaagtgcatacgtggatacagatgaccatattgcaactggatacgccaagcaaatcttggtcctcaacgggagtgacgttgttgacattgagcatgatcagaaattaaaaaaggcctttgaccagttatcttaccattggagatacgaaatttcgcaacgccgcatgactccattgaacgctagcattaagcagtttttagaggagctgcacactaagcgttatctagatgtaactcttcgtctaccacaagctacattcgagcaagtatatttgggggatatggctgcgggtgaacaaaaaacgcgtctaattatggatgaacacccgcattctagtttgatagaaatagaatattttgacctggtaaagcagcaaagaattcatcagaccctggaagttcccaacctctag

SEQ ID NO: 45830 - DNA, 2424 bp, Saccharomyces cerevisiae
atgaactcatccaataataacgactcgtccagctccaatagcaacatgaataactccttgagcccgacccttgtgacccacagtgatgctagtatgggctcgggtagagcaagcccagacaatagccatatggggagaggtatatggaatccatcgtacgtaaatcaaggctctcaaaggtctccacagcagcagcatcagaatcatcaccagcagcagcagcagcagcaacaacaacaacaacagaattctcaattttgctttgttaacccttggaatgaggaaaaagtaactaattctcaacaaaacctggtgtatccccctcaatacgatgacttaaacagtaacgaaagtctagatgcgtacagacgacgtaaatctagtctcgttgtacctccagccagggcacctgccccaaatcctttccagtacgatagttatcccgcttacaccagctctaatacgagtttggcaggaaatagcagtggccagtatccttctggctatcaacaacaacaacagcaagtataccagcagggcgctatccatccttcccaatttggatccagatttgttccctccctttatgatcgtcaagatttccaaagaaggcagagtctggctgcaactaattattcgtccaatttttcttccctaaattcaaatactaatcaaggaacaaactccataccagtcatgtcaccttacaggaggcttagcgcatatcctcctagtacaagtcccccactacaaccccctttcaagcagttacgaagagatgaagtacaaggtcagaaattgtccattcctcagatgcaactttgcaactctaaaaacgatcttcaacctgtcttaaatgctactccaaagtttagacgtgcgtcgctcaattccaagacgatatctcccctagtcagtgtcacgaaaagcctgattaccacatattctttatgttctccagaatttacctaccaaacgtccaaaaaccccaagagagtacttacgaagcccagtgaagggaaatgtaacaacggattcgacaacataaacagtgactatattctttatgtaaatgacgttttgggtgtagagcagaacagaaagtaccttgtgctagacattttgggtcaaggtacatttggtcaagtggtcaaatgtcaaaatttgctgacgaaagagatattggctgtaaaagtggttaaatcgaggacagaatatttgactcaaagtataacggaggctaaaattttagagctactgaatcaaaagatagaccctactaataaacatcattttttaaggatgtatgactcctttgtccacaagaaccacttatgtttagtgtttgaattactaagcaataatttgtacgaattattaaaacaaaacaaatttcatgggctctctatacaacttatcagaacattcaccactcaaatactggattcgttatgcgttttgaaggaaagcaaactgattcattgcgatctgaagccagagaatatcttgctctgcgcacctgataagccggaattgaaaattattgattttggctcatcttgcgaagaggcaagaaccgtttatacatacatccagtccaggttttatcgtgctcctgaaattatactgggtataccgtattcaaccagtattgacatgtggtcgttaggttgtattgttgctgaattatttttgggtataccgatcttcccaggcgcttctgaatataaccaattaacaagaataatagacacgcttggatatcctccatcgtggatgatagatatgggtaaaaactctggaaaatttatgaagaaattggcaccagaagaaagttcttcttctacacaaaagcatcgtatgaaaactattgaagagttttgcagagaatacaatatagtggaaaagcccagtaaacaatattttaagtggagaaagttaccagatattattagaaactacaggtatcctaaaagcatacagaactcccaagaacttatcgaccaagaaatgcagaatagggagtgtttgatccactttttaggcggtgtgctaaatttgaacccgttagaaagatggacaccacaacaagctatgctacaccccttcataacaaagcaggagtttacaggtgagtggtttcctccaggatcgtctttaccgggtccttcagaaaaacatgacgatgcaaaaggccagcaaagtgaatatggaagtgcgaacgactctagtaacaatgcaggccacaactatgtctataatcctagctctgccactggtggtgctgatagcgtcgacattggtgctatcagtaaaaggaaggagaatacatctggcgacatctccaataattttgctgttactcattctgttcaagaagggccaacaagcgcgttcaataaacttcacattgtcgaagaataa

SEQ ID NO: 45831 - DNA, 1287 bp, Saccharomyces cerevisiae
atggcaaaaggaggctcgctatacatcgttggcatattcttaccaatatggacctttatgatctatatttttggcaaagagttattcctcatacgaaaataccaaaagattgacagtacgtatactgctctttcccaaagagtaaaagaacaatatgatacaagtcgaagaagaaactattttcctaaagtaaaactttcccgcaatagctacgacgactacactttaaattataccagacagaatgattctgattcttttcacctacgagaaaatgcaacaattttaatgctggtgagaaattcagaattagaaggggcattggattcaatgagatcattagaggacagatttaacaacaagtatcattatgattggacttttctaaatgacgttcctttcgatcaagacttcattgaagctacaacatcaatggcgagtgggaagacccaatatgctttaataccaccagaagattggaatcggccgcaatggattaacgatacactttttgaagaaagacttcgagtcatggaggatgagggtgttttatatgggggatccaagtcatatagaaatatgtgtcggtttaattctggtttttttttccggcagtcaatactggacaactatgattactactttagggtggaacccaatgtcaagtattattgcgatttcccatatgacccgttcagagttatgagattgaagggcaaaaaatacggatttgtcatatcattatatgaatatgaagaaaccataccaaccttatgggacgcggtagaggagtatttagtggccagcgaagagaccattttacgtaaagaggacagtgcctatgcatttttgaccgattcagggctagttggtaagcattatcccgttgttgaagcaaactctgactacaatttgtgccatttttggtcgaattttgagattggcgacttgaatttcttcagaagtgacgaatataagcatttttttgaaactttagatgccaagggcggattttactacgaaaggtggggtgacgcacctgtacattcaattggtgtctccctactgctgagacctgacgaaatcattcattttgacgaacttggctattttcactcaccgtttggcacctgtccagcatcttacgctgttaggctcgatcagaggtgtagatgcaaaagcgatgatgaaagtgtcatagatataaccccacatagttgtttgatgagatggtggaaaaacggtagcggcaaatatttcttaaaagaagagcaagacgagatttaa

SEQ ID NO: 45832 - DNA, 1188 bp, Saccharomyces cerevisiae
atgtctgaaggtattactgatattgaagaatcccaaattcaaaccaactatgacaaggtcgtctacaagttcgatgatatggaattggacgaaaacttgttaagaggtgttttcggttacggtttcgaagaaccatctgccattcaacaacgtgccatcatgcctattattgaaggtcacgatgtcttggctcaagctcaatctggtactggtaagaccggtactttctccattgctgctttgcaaagaattgacacctctgtcaaggctcctcaagctttgatgttggctccaactagagaattggctttgcaaatccaaaaggttgtcatggctttggctttccacatggacatcaaggtccacgcttgtatcggtggtacttcctttgttgaagacgctgaaggtttgagagatgctcaaatcgtcgttggtactccaggtcgtgtttttgacaacatccaaagacgtagattcagaactgacaagatcaagatgttcatcttagatgaagctgatgaaatgttgtcttctggtttcaaggaacaaatctaccaaattttcaccttacttccaccaaccactcaagttgttctattgtccgccaccatgccaaatgacgtcttggaagttaccaccaaatttatgagaaacccagttagaattttggttaagaaggatgaattgactttggaaggtatcaaacaattctacgttaatgttgaagaagaagaatacaaatacgagtgtttgaccgatttatacgactctatctccgttactcaagctgtcatcttctgtaacaccagaagaaaggtcgaagaattgaccactaagttaagaaacgacaaatttaccgtttctgccatctattctgatttaccacaacaagaaagagacaccatcatgaaggaattcagaagtggttcttccagaattttgatctccactgatttgttggctagaggtatcgatgtccaacaagtttctttggttattaactacgacttaccagctaacaaagaaaactatattcacagaatcggtagaggtggtcgtttcggtagaaagggtgttgccatcaactttgttactaacgaagacgttggcgctatgagagaactagaaaagttctactccactcaaattgaagaattgccatccgacattgctaccttgttgaactaa

SEQ ID NO: 45833 - DNA, 945 bp, Saccharomyces cerevisiae
atggtagaaaactcgtcgagtaataattcaacaaggccaattccagcaatacctatggatctacccgattatgaggcgctccccacccacgcgccattgtaccatcaacttatagcgggtgcatttgctggtataatggaacattcagtgatgttcccgatagatgcccttaagacgcgaatacaatcagccaacgcgaaatcgctgtctgccaagaatatgctttcgcaaatatctcacatctctacttccgaaggaactctagccctatggaagggtgttcagtctgtcatactaggtgcgggacctgcgcatgcagtgtattttggtacgtatgagttctgcaaaaaaaatcttatcgattcgagtgatacgcaaacgcaccatccttttaagacagctatcagtggtgcctgtgccaccacggcatctgacgcattaatgaacccattcgacacaataaaacagagaatccaactcaatacctcggcatcagtatggcaaaccacaaagcagatttaccaatctgaaggtttggcagcattttattattcttacccaaccaccctagtaatgaacatcccatttgcagcatttaatttcgtcatatatgaatcatccacaaaatttttaaacccatcaaatgagtacaaccccctcatacattgtctgtgtggcagtatcagcggatcgacatgtgcggcgatcacaacacctttagactgcataaagacagtactgcagataaggggcagtcaaacagtttcgttggaaattatgagaaaggcggatacttttagtaaagcagccagtgccatatatcaagtttatggctggaaagggttttggagaggttggaaaccaaggatagtggcaaacatgccggctactgctatatcatggacagcttatgaatgtgcaaaacatttcctaatgacgtattag

SEQ ID NO: 45834 - DNA, 6645 bp, Saccharomyces cerevisiae
atggccactattgctcccactgctccaatcacccctccaatggaatctacgggtgaccgtctggttacgttggaacttaaggacggcacggtcttacaaggttattcatttggtgctgagaaatccgtcgctggtgaattagttttccaaactggtatggttggttatcctgaatctgtgaccgatccatcttatgaaggccagatcttagtcatcacttacccattggtaggcaattatggtgtcccagatatgcacttgagagatgaattggtcgaagaattgccaagatattttgaaagtaatagaatccatattgccggtttagttatttctcactataccgacgagtactctcattatcttcgtaaatcttccttaggtaaatggttacaaaatgaagggatcccagctgtttatggtgttgatacaagatcattgaccaagcatttgagagatgcaggttcaatgttgggtaggttgtctttggaaaaaagcggctctgacagaaccatctccagatcttcctcttggagaagtgcgtttgatgttcctgaatgggtggatccaaatgttcaaaacctagtttctaaggtctccatcaatgaacctaaattgtacgttcctccagcagacaataagcacatcgaattgcaaaccggacccgatggtaaagttttaaggattctagccattgacgtgggtatgaaatacaatcaaattcgttgttttatcaaaaggggtgtagaattgaaagttgttccatggaactacgatttcactaaagaagattatgatggtctgtttatttcaaatggtccaggtgatccatctgttctagatgatctatctcaaagattgtcaaatgtcctggaggctaaaaagacgccagtattcggtatttgtctcggtcatcaattgatagcaagagctgccggtgcatccaccctaaaactaaaatttggtaaccgtggtcataacataccttgtacatcaactataagtggtcgttgttacataacatctcaaaaccatgggttcgctgtggatgttgacactctaacttccggatggaagccattgtttgttaacgcgaatgatgactctaacgaaggtatctatcattctgaattaccttatttttccgtccaattccatccagaatccacacctggcccaagagatacagaattcttgtttgacgtttttatccaagcagttaaagaattcaagtatacacaagtgttgaaaccaatcgctttcccaggtggcctattagaggataacgttaaggcacaccctagaatcgaagcgaagaaggttctagttctcggttctggtggtttgtccatcggtcaagctggtgaatttgactactctggttctcaagccatcaaagctttgaaagaagaaggtatctatacaattttaattaatccaaacattgctaccatccaaacttcgaaagggttggctgataaggtttattttgttcctgttactgcagagttcgtgagaaaagttattttacatgaaaggccggacgccatttatgtgacatttggtggacaaactgctttatctgttggtatagccatgaaagatgaatttgaggcgttaggagttaaagtattgggtactccaatcgatactattattaccacggaagaccgtgaactcttcagtaatgccattgacgaaattaatgaaaaatgtgcgaaatctcaagctgctaattcagtggacgaggcattggccgctgtcaaggagatcggtttcccagttattgtacgtgctgcatatgcattgggaggtttaggttccggtttcgctaataatgaaaaagaattggttgatctatgtaatgttgcattttcatcctcacctcaagttttagtcgagaaatctatgaaaggttggaaagaagtcgaatatgaagttgttcgtgatgcttttgacaactgtattactgtttgtaatatggaaaattttgatccactaggtattcacaccggtgattccatcgttgtagccccatctcaaactttatctgatgaagattacaatatgttaagaactactgctgttaatgttattagacacttaggtgttgttggtgaatgtaatatccaatatgctttaaatcccgtttctaaggattattgcatcattgaagttaatgcgcgtttgtcacgttcctctgctttagcttctaaggctactggttacccattggcctacactgcggctaagttaggtttgaatatcccattaaatgaagttaagaattccgtcacaaaatccacatgtgcttgttttgaaccttctctagactactgtgttgtcaaaatgccaagatgggatttgaagaagttcaccagagtttctaccgaattatcttcatcaatgaaatctgttggtgaagttatgagcatcggtagaaccttcgaagaagctattcaaaaagctatcagatccacagaatatgctaacctcggattcaatgagacagatctagatatcgacattgattacgagttgaacaaccctacggatatgcgtgtcttcgccattgcaaatgcttttgctaagaagggatattctgttgataaagtctgggaaatgactagaattgataagtggtttttaaacaaactgcacgatttggtccaatttgctgagaaaattagttcatttggtactaaagaggaattaccttccttagttttaagacaggctaagcagttaggttttgatgacagacagattgcaagatttttggattccaacgaagttgccatccgtagattaagaaaagaatatggaattacaccatttgtcaaacaaattgatacagttgccgctgaattccccgcttacacgaactatttatacatgacatacaatgctgactcacacgatttatcctttgatgaccacggtgttatggtcttgggttctggtgtttaccgtatcggttcttctgtcgaatttgattggtgtgctgttactgcagttagaacattacgtgccaacaatatcaaaactatcatggtcaactataatccagaaactgtttccacagattatgatgaggctgatagactatactttgaaaccatcaaccttgaaagagttttggatatttacgagattgaaaactcaagcggtgttgtcgtatcaatgggtggtcaaacttccaacaacatcgccatgactttacatcgtgaaaatgtaaagattcttggtacatcccctgacatgattgattctgctgaaaaccgttacaagttctctcgtatgttggatcaaattggtgttgaccaaccagcttggaaagaattgacatccatggacgaagctgaatcttttgccgaaaaggtgggttatccagttttggtacgtccatcttatgtgttatccggtgccgccatgaatactgtttattctaaaaacgatttggaatcctacttaaaccaagccgtcgaagtttcacgtgattatcctgttgttatcactaaatatattgaaaacgcaaaggagattgaaatggatgcagttgcaagaaatggtgaattggttatgcatgttgtctctgagcatgttgaaaatgcaggtgtccactcgggtgatgcaacattaatcgttccacctcaagatttggctcctgaaactgtggatagaattgttgtcgccactgctaaaattggtaaggctttgaaaattacaggtccatacaacatccaattcattgcaaaggacaatgaaatcaaggtcatagaatgtaatgttcgtgcttcgagatctttcccattcatttcaaaggttgttggcgtcaatctgattgaattggcaacaaaggccataatgggtttgcctttgacgccttatcctgttgaaaaattaccagatgattatgtcgccgttaaagtaccacaattctctttcccacgtttagcaggagctgatccagtcttaggtgttgaaatggcctctactggtgaagtcgctacttttggccactcgaagtatgaagcatacttaaagtctttgttggcaaccggcttcaaacttccaaagaagaatattttattgtctattggttcttacaaggaaaaacaagaattgctttcttccgtacaaaaactatacaacatgggatataaattatttgcaacatcaggtactgctgactttttatctgaacatggtattgccgtccaatatctggaggttttaaacaaggatgatgatgatcaaaaatcagaatactcacttactcaacatttggctaataatgaaattgacctttacatcaacttgccttctgccaacaggttccgtcgtcctgcatcctatgtttcaaaggggtataaaacacgtcgtttggctgtcgattattcggttccgttggttactaacgttaaatgtgcaaaattgttgattgaagccatttcaagaaatatcactttagatgtttctgaacgtgatgcacaaacttcccacagaactattaccttacctggtttaatcaatatcgcaacttatgttccgaatgcatcccatgttatcaaaggcccagctgaactgaaggagaccacacgtctatttttggaatccggttttacatactgtcaattgatgcccagatccatcagcggacctgttattactgacgttgcatccttgaaggccgcaaactctgtttcccaagattcatcttacactgacttttctttcactattgctggtacagcacacaatgctcatagtgttacgcaatctgctagcaaagtgacagcattgtttttgcccctacgtgaattaaagaacaagatcacagcagtagctgaacttctgaatcagtggccaactgaaaagcaagtgattgcagaagctaaaactgcagatttggcatcggttttattgttaacctcccttcaaaacagatctattcacattactggtgtttcgaataaggaagatttagctttgatcatgacggtcaaggcaaaagaccctagagtgacttgtgatgtcaatatttattctttgtttattgcccaagatgactatccggaggcagttttcttgcctactaaggaagatcaagagtttttctggaacaaccttgatagtatcgatgctttctctgtcggtgctcttcctgtcgccttggcaaatgtcacaggtaacaaggttgatgttggtatgggtatcaaagattcattaccactattgttggctgctgttgaagaaggtaaattaaccattgatgatatcgtccttcgtctgcatgacaatcccgctaaaattttcaacatccctactcaggactcagttgtcgaaattgatttggattattctttcagacgtaataagagatggtcaccattcaacaaagatatgaacggtggtattgagcgtgttgtctataatggcgaaacattagttttgagcggtgaattagtttcaccaggcgccaaaggaaaatgcattgttaatccaagtccagcttccataactgcttccgcagagctccaatctactagtgctaaaagaaggttctcgatcacggaagaagcaatcgctgataatttagatgccgcggaggatgcaattccagaacagcctttggaacaaaaattgatgtcttcaaggccaccaagagaacttgttgctccaggcgccatccagaatttgatccgtagtaacaatccattccgcggaagacatatattgtctatcaaacaattcaaacgttctgatttccatgtgttgtttgctgttgcacaagaactaagggcagctgtcgcaagagaaggtgtcttagatttaatgaaaggccacgttattactacaattttctttgaaccatctactcgtacttgttcttcattcattgctgctatggaacgtttgggtggtagaattgtaaatgttaatccattggtgtcttctgtcaagaaaggtgaaacccttcaagatactatcagaactttggcttgttacagtgatgccattgtcatgcgtcattcagaagaaatgtctgttcatatcgccgctaaatattctcctgttccaattattaatggtggtaatggttctcgcgagcatcctacgcaggccttcttggatttgtttacgattcgtgaagaaatcggtactgttaatggtattactgttactttcatgggtgatctcaaacatggtagaaccgtacattcattgtgtcgtttgttaatgcactatcaagtcagaattaatcttgtttctcctccggaattgaggttaccagaaggattaagagaagagctaagaaaagctggcttacttggtgttgagagcattgaattaacccctcatatcatctcaaagaccgatgttctgtattgtacaagggtccaagaagaaagattcaatagccctgaagaatatgcacgtctgaaggatacttatatcgtggacaacaagatcttggcacacgccaaagaaaatatggctatcatgcatccattgcctcgtgtaaatgaaatcaaagaggaagtggactacgatcatcgtgctgcttacttcagacaaatgaagtatggtttgttcgtcagaatggctttgttggccatggtcatgggtgttgatatgtga

SEQ ID NO: 45835 - DNA, 2007 bp, Saccharomyces cerevisiae
atggaagacaagtttgctaacctcagtctccatgagaaaactggtaagtcatctatccaattaaacgagcaaacaggctcagataatggctctgctgtcaagagaacatcttcgacgtcctcgcactacaataacatcaacgctgaccttcatgctcgtgtaaaagcttttcaagaacaacgtgcattgaaaaggtctgccagcgtgggcagtaatcaaagcgagcaagacaaaggcagttcacaatcacctaaacatattcagcagattgttaataagccattgccgcctcttcccgtagcaggaagttctaaggtttcacaaagaatgagtagccaagtcgtgcaagcgtcctccaagagcactcttaagaacgttctggacaatcaagaaacacaaaacattaccgacgtaaatattaacatcgatacaaccaaaattaccgccacaacaattggtgtaaatactggcctacctgctactgacattacgccgtcagtttctaatactgcatcagcaacacataaggcgcaattgctgaatcctaacagaagggcaccaagaaggccgctttctacccagcaccctacaagaccaaatgttgccccgcataaggcccctgctataatcaacacaccaaaacaaagtttaagtgcccgtcgagcggtcaaattaccaccaggaggaatgtcattaaaaatgcccactaaaacagctcaacagccgcagcagtttgccccaagcccttcaaacaaaaaacatatagaaaccttatcaaacagcaaagttgttgaagggaaaagatcgaatccgggttctttgataaatggtgtgcaaagcacatccacctcatcaagtaccgaaggcccacatgacactgtaggcactacacccagaactggaaacagcaacaactcttcaaattctggtagtagtggtggtggtggtcttttcgcaaatttctcgaaatacgtggatatcaaatccggctctttgaattttgcaggcaaactatcgctatcctctaaaggaatagatttcagcaatggttctagttcgagaattacattggacgaactagaatttttggatgaactgggtcatggtaactatggtaacgtctcaaaggtactgcataagcccacaaatgttattatggcgacgaaggaagtccgtttggagctagatgaggctaaatttagacaaattttaatggaactagaagttttgcataaatgcaattctccctatattgtggatttttatggtgcattctttattgagggcgccgtctacatgtgtatggaatacatggatggtggttccttggataaaatatacgacgaatcatctgaaatcggcggcattgatgaacctcagctagcgtttattgccaatgctgtcattcatggactaaaagaactcaaagagcagcataatatcatacacagagatgtcaaaccaacaaatattttatgttcagccaaccaaggcaccgtaaagctgtgcgatttcggtgtttctggtaatttggtggcatctttagcgaagactaatattggttgtcagtcatacatggcacctgaacgaatcaaatcgttgaatccagatagagccacctataccgtacagtcagacatctggtctttaggtttaagcattctggaaatggcactaggtagatatccgtatccaccagaaacatacgacaacattttctctcaattgagcgctattgttgatgggccgccaccgagattaccttcagataaattcagttctgacgcacaagattttgtttctttatgtctacaaaagattccggaaagaagacctacatacgcagctttaacagagcatccttggttagtaaaatacagaaaccaggatgtccacatgagtgagtatatcactgaacgattagaaaggcgcaacaaaatcttacgggaacgtggtgagaatggtttatctaaaaatgtaccggcattacatatgggtggtttatag

SEQ ID NO: 45836 - DNA, 1014 bp, Saccharomyces cerevisiae
atgaaaatttccgcagctttaatattgtcttccctttcttctgtcgcattttctgcccctgcacctgctccagcggacagtcaccatgaagatcatcacaaagatgaaaaaccagcggttgtcactgtcactcaatacatagattccaatgccgctactagtactgtagaatctgctgctactaccactacattgtcctcatctgagaaggatacctctgaacagaagcgtgatggcggattccaagatggtactgtcaaatgttcggacttcccttctgtaaacggtatagtttccttggactggctaggatttggtggatgggcctctgtcatggacatggatgccaacacttcgtccgaatgtaaggatggctactactgttcttatgcatgtgaacctggaatgtcaaagactcaatggccttctgaccaaccaagcgatggtaaatctgttggtggtctttactgtaaaaatggttacttgtaccgtaccaacactgataccagcgatttatgttctacggatgaaacatctgctaaggccattaacaaaaagtctgactccattgctctatgtaggacggattacccaggatcagaaaacatggtgattcccacagtggttgatggtggagattcacaaccaatttcagtcgttgatgaagacacttattatcaatggcagggtaaaaagacttctgctcagtactatattaacaacgccggtgtatctgcagaagatgggtgcatttggggtacttctggttcggatgtcggcaactgggctccactagtgttaggtgctggttccactaatggagaaacatacttgtcgttgattccaaaccccaacagtaaccaagctgccaactttaacgttaaaatagttgcatccgatggcgctaacgttcagggcagctgtgcgtatgaagatggctctttcaccggagatggttccgatggttgcacagtttctgttttatctggatctgctgaatttgttttctattaa

SEQ ID NO: 45837 - DNA, 1653 bp, Saccharomyces cerevisiae
atgaactttggaagccaaacacctacaattgtggttctaaaagagggaacagacgcatctcaaggtaaaggtcaaatcatctctaatatcaatgcctgtgttgcagtccaagaggcattgaaaccaactttaggtcccttaggttctgatattttaattgtgacatcgaatcaaaagactactatttctaacgatggtgccacgatcctaaaattattagatgtagtacatcctgctgccaaaactttagtggatatttctagagctcaggatgccgaggtgggtgatggtacaactagtgtaaccattttagctggtgagttaatgaaagaagccaagccctttttggaagaaggcatttcatctcatttgattatgaagggctacagaaaggccgtttctttagctgtggagaagattaacgaattagctgtggatattacttcagagaaaagcagtggcagagaattacttgaacgctgtgctagaactgcaatgtcgtcgaaattgattcataataatgcagatttttttgttaaaatgtgtgttgacgccgtgctatcccttgatagaaacgatttggatgacaaattaataggtattaaaaaaattccaggtggtgctatggaagaatctcttttcatcaacggtgtcgcctttaagaagacattttcgtatgctggatttgaacagcaacccaaaaagttcaacaatcctaaaattttaagtttgaatgtagaactggagttgaaagcagagaaagacaatgctgaagtacgtgtagaacatgttgaagattaccaagctattgtagatgcggagtggcaattaatctttgaaaagctaagacaagtggaagaaacaggtgccaatattgtactatcaaagttacctatcggcgatttggctactcaattttttgctgatagaaatattttctgcgctggtagagtgagcgcagatgatatgaatcgtgtcatccaagctgttggaggctctatacaatctactacttcagatataaaaccagagcatttgggtacttgtgctttgtttgaggaaatgcaaatcgggtcagaacgctacaatttattccaaggttgcccacaagctaaaacatgtacattattattaagaggaggtgctgagcaagttattgccgaggttgagagatcattgcacgatgcaatcatgatagttaagagagcgttacaaaataaactgatcgttgctggtggtggtgctacagaaatggaagtatcaaaatgcttgagagattattcaaaaaccatagctggtaagcaacaaatgataatcaatgccttcgctaaggctttagaagttattccaaggcaactctgtgaaaatgctgggtttgatgctatagaaatattaaacaaactaagattggctcacagcaaaggtgagaaatggtatggtgttgtctttgaaacagaaaatattggcgataattttgccaaattcgtatgggaacctgctttagtaaaaatcaatgctttgaacagtgccacagaggctactaacttgattttatctgttgacgagacgatcactaataaaggtagtgaaagtgccaatgctggcatgatgcctccccaaggggctggaagagggagaggtatgccaatgtaa

SEQ ID NO: 45838 - DNA, 1938 bp, Saccharomyces cerevisiae
atggttgaaaaacgtagtagacagagttccagtagtggctcagagttcagtgttccacctgatgtcgataacccgccactttctatccctttgaagactttatcagacagatatcagctgatcgaaaaactaggtgcaggatcatttggttgtgtaactttagccaaagcgcaatttcctttatcgaacatattgggtaaacaacatgatataaggggtactttaatggatcagcctaaaaatggtcaccaaaactatataacaaagacacaaggtgtagtggctataaagacaatgatgacaaaactgcatacactccaggattatacgagggtcagagaaattaagttcatactggcaatcccagcgaatgaccatctgatacaaatttttgaggtctttattgactctgaaaattaccaattacatatcgtaatggaatgtatggagcaaaacctatatcaaatgatgaaacatagaaggcgccgagttttttcgattccttctttgaaatctattctatcgcagatactggctgggttaaaacacatccacgaacataatttcttccacagagatttaaaacctgaaaatattcttatcacaccaagtacccagtattttgaaaaggagtacatgaaccagattggatatcaagataactatgtcattaaacttgcagattttggtttggcacgccatgttgaaaataaaaacccgtatacggcctacgtttccacaagatggtatagatcgcctgaaatattattaagaagtggttactattccaaacctttggatatttgggcattcgggtgcgtggcggtggaagttactgtattcagagctctcttccccggtgctaacgaaatcgatcagatatggaaaattttagaagttcttggtacacctatcaaacgttctgattttgttaatacaaaccacatcacagctccaccacctggtggattttgggatgatgccagtaatttggtccataaattaaacttgaaattgccttatgtagaaggttcatcgttggatcatctactttctagctcccaactatccgatttatctgaggttgtcaaaaagtgtttaagatgggatcctaatgaaagggcaacagcccaagagctttgtgaaatgccattttttgaaaacaccgtggcatcccaagtagacgcaagaggcaatgtgactaatacagaacaagcattgatttttgcaggtataaatccagtagcgaccaacacaaagcccatatattttaactcttcaacaaaattgcccgcagaaacagagtctaatgatattgatatcagcaacaacgatcacgattctcatgctatgtgctcaccaacattaaatcaagaaaaactaactttggtagaatttttaaacgaattcgttgaagaagataatgatgatcactcaatacctgatgttggaacagattctaccatttcagattctattgatgagactgaattatcaaaagaaattcgtaataatttggccctttgtcaactaccagatgaagaagtcttagatcattcattatcgaatattaggcagttgacaaatgatattgaaattataaataaagatgaagcagacaacatggaacagctattttttgacctggaaattcctgaaaaggatgagtttcagagaaaacaaccatttaatgaacatgcagatattgatgaagacatcgttctaccatatgtgaacaactcaaattacacacatacagataggtcacatcatagaggtgataatgttttgggtgatgcctctttaggcgattcgtttaattcaatgccagattttactccaagaaatttcttgatacctacattaaaaaaatcacgggaaaagttcgagcctcatctatccaattcaaaccaacattttggaaatgtaaccttctaa

SEQ ID NO: 45839 - DNA, 2037 bp, Saccharomyces cerevisiae
atgggactcttagctttgggcacgcctttgcagtggtttgagtctaggacgtacaatgaacacataagggatgaaggtatcgagcagttgttgtatattttccaagctgctggtaaaagagacaatgaccctcttttttggggagacgagcttgagtacatggttgtagattttgatgataaggagagaaattctatgctcgacgtttgccatgacaagatactcactgagcttaatatggaggattcgtccctttgtgaggctaacgatgtgagttttcaccctgagtatggccggtatatgttagaggcaacaccagcttctccatatttgaattacgtgggtagttacgttgaggttaacatgcaaaaaagacgtgccattgcagaatataagctatctgaatatgcgagacaagatagtaaaaataacttgcatgtgggctccaggtctgtccctttgacgctgactgtcttcccgaggatgggatgccccgactttattaacattaaggatccgtggaatcataaaaatgccgcttccaggtctctgtttttacccgatgaagtcattaacagacatgtcaggtttcctaacttgacagcatccatcaggaccaggcgtggtgaaaaagtttgcatgaatgttcccatgtataaagatatagctactccagaaacggatgactccatctacgatcgagattggtttttaccagaagacaaagaggcgaaactggcttccaaaccgggtttcatttatatggattccatgggttttggcatgggctgttcgtgcttacaagtgacctttcaggcacccaatatcaacaaggcacgttacctgtacgatgcattagtgaattttgcacctataatgctagccttctctgccgctgcgcctgcttttaaaggttggctagccgaccaagatgttcgttggaatgtgatatctggtgcggtggacgaccgtactccgaaggaaagaggtgttgcgccattactacccaaatacaacaagaacggatttggaggcattgccaaagacgtacaagataaagtccttgaaataccaaagtcaagatatagttcggttgatcttttcttgggtgggtcgaaatttttcaataggacttataacgacacaaatgtacctattaatgaaaaagtattaggacgactactagagaatgataaggcgccactggactatgatcttgctaaacattttgcgcatctctacataagagatccagtatctacattcgaagaactgttgaatcaggacaacaaaacgtcttcaaatcactttgaaaacatccaaagtacaaattggcagacattacgttttaaaccccccacacaacaagcaaccccggacaaaaaggattctcctggttggagagtggaattcagaccatttgaagtgcaactattagattttgagaacgctgcgtattccgtgctcatatacttgattgtcgatagcattttgaccttttccgataatattaacgcatatattcatatgtccaaagtatgggaaaatatgaagatagcccatcacagagatgctatcctatttgaaaaatttcattggaaaaaatcatttcgcaacgacaccgatgtggaaactgaagattattctataagcgagattttccataatccagagaatggtatatttcctcaatttgttacgccaatcctatgccaaaaagggtttgtaaccaaagattggaaagaattaaagcattcttccaaacacgagagactatactattatttaaagctaatttctgatagagcaagcggtgaattgccaacaacagcaaaattctttagaaattttgtactacaacatccagattacaaacatgattcaaaaatttcaaagtcgatcaattatgatttgctttctacgtgtgatagacttacccatttagacgattcaaaaggtgaattgacatcctttttaggagctgaaattgcagaatatgtaaaaaaaaataagccttcaatagaaagcaaatgttaa

SEQ ID NO: 45840 - DNA, 3177 bp, Saccharomyces cerevisiae
atgtcagggtccttttggaagtttggacaagattttggttcacagtctccattagctaaactgttgaacagggctttcattaagatcgatgataagcccactagtacggaagcagggaaaattgactctaatagcacagatgaaagtttagaaagcaattcttttaaatcagaagacgaagaagaagaatatgagctgcctaacagagaagaagactacaaagcttataagccaaacctgtctctactgaatgatcttttagatgatgaggagttatatacagaactgatgtgctcgaacttcaagctactagtgtacttgaagtaccctgaagttttgtccaaattgatagattatgtcagaaatagtaccatacttgagtccaatattgatagagttacttcagaagacagagatttagtacgtggtgaagacaaggacacaacggaggactttgagaatgctaaagcagataagaaaaacattgatggtacttttgaagaaaaagaacgtactcgtagtggtgaagaagaggaactggaaaatgaagaaaatgatagtgcatctgaggatactagagtcactctacctcatgaactagaggaacatgatgatacgcgaagagccagaatagcggccgaaatattgtccgctgacgtgtggcccatatcatctgctttgattgaaaacgaaggacttctcgctaagctttggtcgatcctcaggctaccttctccattgtcaattgaagcgtcaacatattttatgaaaataaacgaacgcctcttggatatgaatatggacggaataattgaattcatattaaaaaaggaacacattgttgacgattttttagcacatatagataatccgcctttgatggattttttattaaaagtaatatcgaccgataagccagaaatatcaaatggagttatacaactgtttaaaaaacagaacttggttccaaagttgattcatttactcgatcctgtttttgattcttgcacacaatctgcagccggtgattttctgaaagctctggttactattagcggtaactgtcctaatgagattacttcgagcatagggcctaatgaattaacaaggcaattagtttctccaaatatgatgaaacaacttatggatataatgctcaagggaggcaattcgttaaataatggcgttggcattatcattgagctgataaggaaaaacaattctgattatgataccatacaaacaaattatactaccatagaatctcatccgccaacagatagagacccaatttatttaggatatttggttaaaatgttttctgaacacatggccgatttcaacaaaatactaactgagaagaagattccccttttacagacgtcctatggaacgattgaaccgttgggatttgaaaggtttaagatctgtgaacttattgctgaactattacactgctcaaacatgactttattgaatgaaccgagtgcctatgacattgtaagagagcgtgatgccgaaagagagagaatcttcaattcacaaaattacgtagattctaacgatcgtagtgaattaaaagaaaatgaagacgacaatacaggtgatgctgatgatgaagtggaagatgatacaaatcaggtagaatccgctaatacctccattgatggtgaagaagttatcgataagttaaattctttacagatagaaaccaacaaagtaaaccagaacatgaataatgaagagcaacatagtttaatgccagacttcaacaatggtgattttaaggacgaggaagatgaaaatccatttgaaccccaatattcagacgtcattttggattcttctgatatagaaaaaaactttcgtgtgtctcccaacgttggagatcagctgaaaatcagtttacaagataccagagtaatagatactatgctcgaaatgttttttcacttccagtggaacaatttccttcataacgtagtgtacgatgttgttcagcagatttttaacggtcccctcaaaataggttataataggttccttttagatgatctcctaatcaacatccgtttaactgatatgattattaacggaaacaatgaatgcatagaatatgagaaaggacatgacaccaggcttggatatatgggccatttgaccctaattgcggaagaagtcaccaaatttactgcatatattgaagagatgaacatcacctttgaaaatactgaagtaatgagttctttatttgagagtaaatggattgcctatacggaggatgttctagaggatctaaaggagaaatacaacgccatattaggcgatatagctgaagaaggagacatgttgcaagatgaagaagaggatgctgtatacgacaagggagagcgcactatgggtacagtcgatgactacattaatgacataatgcaaatggacaatgtacggtgtcaagaggaggaagaggatgaaggagaagggtatgtcagctttgatgaagatgaaccccaagaatatcgtaatggtgattccgttagaagcaaagaatcgaattcatcagaaggcaaacgtgaccaagagcagctttactatgagtacgttaacgaagatggtacaaaaacaagattaaacttcaatcctgattctgacgccacggaacaagttccaggtgaagtgaatcgcgatcataagataccattgaagcttaagcgaagttttacggatgcatgcaaatctgaaacaataccaaataatacagttaatgctaaggaagaaagtgtatttcaatttagcaatgaacttagtgacggctgggagtcatcaccttctaattctatacccaagcgtgcttctccatcaaaaaatggcatgaattcacctatgtttcaacaccagtttgaacttcatagccccaccgatgaatttggaggtcataaagacgaaatattaagcgcggaaggccatgactacgacatagatgaatacgatgaactgagcgatgacagtgatgaagagtatgataactgtgaagacgaagacagtttggattatgctgattccgccgcatatgcattgtgtagatccaaaagtaaggacaagatatcatgggatgaagaagaacaggcgcgattaatgggcgttgtaaaatttaattcagagcattacagggactag

SEQ ID NO: 45841 - DNA, 4437 bp, Saccharomyces cerevisiae
atgccctttttgaggaaaatagcggggacagcacatacacattctaggtctgattcgaactcatctgtgaaattcggccatcagccgactagttcggtagcatcaaccaaaagttcaagcaaaagccctcgtgcaacatctcgcaaaagcatttatgatgatattagaagccaatttcccaacctaacccccaactctacctcttctcagttttacgaaagcacgccagttatcgaacaatcctttaattggacgacagatgaccacatctcagctggaacgcttgaaaacccaacgagctttacaaacagttcttataaaaatgacaatggacctagtagcctctctgattcgaggaaatcctccggtggcaatagcgtaaatagtttgtcctttgacaagctaattctatcgtgggatcctacagaccctgatgaatggacaatgcatcgcgtcacctcatggtttaaatttcatgattttccagaatcctggatattgtttttcaaaaagcatcaattgtttggtcacagatttataaagttgcttgcatatgataatttcgctgtttatgaaaagtatttgccgcagactaaaactgcttcatataccaggtttcagcagttattgaaaaaaacaatgaccaagaacgtaacaaatagccatattcgtcagaagagcgctagcaaacttaaaagttccaggtcttccagcgaatcgatcaaatcaaaattaaaaaatagtaaatcgcaagaggatatttcaaattctagatcaacgtcagaatctgcattgagcccaacaaaatcgggcccttccaagaccgatgaaaagaattttttacattctacttcaacacaccaaaaaaccaaaagcgcaagttcactatacagaagaagttttatatccctaagaggctcatcatcgagcaatgcttcctcagcaaaatcaccttcaaacatcaagttaagtataccggctcggccgcactcaattattgaatctaacagtacacttaccaaatcggcgagcccacctgcatctccttcgtatcctagcatatttagaagacatcacaaaagtagttcatctgagtcgtcattattaaattccctttttggtagtggaataggcgaggaagctccaacaaagcctaatccacaaggtcatagtctgtctagtgaaaatttagctaaaggaaaatctaaacactatgaaactaatgtgtcttcacctttaaaacaatcttcactacccacttcggatgataaaggtaatttatggaataaattcaaaagaaagagccaaataggggttcctagcccaaatacggtagcttatgtaacgtctcaagaaactccatccttaaaatcgaattcgagtactgctaccttaaccgtacaaacggcagatgtaaatataccatctccatcttcatcaccaccgccaatacccaaaactgcaaacagaagtttggaggtcatcagcacagaagatacacctaaaatttcttcaaccacggcgtcttttaaagaaacgtatcctgattgtattaatccagacaagacagttccagtgccggtaaataatcaaaagtatagtgtaaagaactttttactggaccaaaaattttatcctctgaagaaaacagggttaaatgatagtgagaataaatatattctggttaccaaagataatgttagttttgttccgctaaacttaaaaagtgtagcaaaattatccagtttcaaagaatctgctctcacaaaattgggaatcaatcacaaaaatgtcactttccatatgacagactttgattgcgatattggtgctgcaattccagatgatactttggaatttttgaaaaaaagcttgtttttgaacacttctggaaaaatttatatcaaagaccaaatgaagcttcaacaaaaaccgaaacctgctcctctcacctcagaaaacaatgttcctttaaaatcggtgaaaagtaagagttcaatgaggtccggaacaagcagtctgatagcatcgacagatgatgtttccattgtcacttcgtcttctgacataacatcatttgatgaacatgcatcaggaagtgggcgcaggtacccccaaaccccgagttattactatgacagagtttccaatactaatccaactgaagaattgaattattggaatattaaagaagttctttctcatgaggaaaatgcaccaaaaatggtttttaaaacaagtccaaaattagaactcaacctaccagataaaggaagtaaattaaatattcctacccccataacagaaaatgaaagcaagagtagttttcaagtgctaagaaaagatgaggggactgaaattgatttcaatcatcgtagggaatcgccttatacaaaaccagaactggcaccaaaaagagaagctcccaagcctcccgcaaatacttctcctcagaggaccttatcaacttctaaacagaataaaccgatccgcctagtgagggcaagtacaaaaatttcgagaagcaaaagatcgaaaccattgccgccacaattattatcatctcctatagaagctagcagctcgtctcctgattcgcttacttcctcatatactcctgcttcgactcatgttttgataccgcaaccttataagggtgcaaacgatgttatgcgtaggttgaaaacagaccaggactcgacgagtacttccccatctttgaaaatgaaacagaaagtgaatcgctcaaattcaactgtatcgacttcaaattcaattttctattctccttcaccattgttaaaaagaggtaactcaaaaagagttgtttcgtcgacatctgcggccgatatatttgaagagaatgacataacattcgcggatgctccgccgatgtttgacagcgatgatagtgatgacgattctagttcatccgatgacattatctggtccaagaaaaaaacagctcctgagactaataatgaaaacaaaaaggatgagaaaagcgataacagttctacgcattctgacgaaatattctatgattctcaaacgcaggacaaaatggagagaaagatgacctttagaccatctccggaggtcgtttatcaaaatttagagaaattcttcccaagggctaacttagataagccaatcactgaaggaatagcttcaccaacatctccgaaatccttagacagcctactttcaccaaagaatgtggcttcatcgagaactgagccaagcactccttcccgtcccgtccctcctgatagctcatacgagttcatacaggatggacttaacggtaaaaataaaccattgaatcaagctaagacacctaaaagaacaaaaaccataagaaccattgcacatgaagctagtttagcaagaaaaaactctgtaaaactaaaaagacagaacaccaaaatgtggggtacaagaatggtcgaagtgaccgaaaaccatatggtgtcaattaataaagccaaaaattcgaaaggtgagtataaggaattcgcctggatgaagggtgaaatgatagggaagggatctttcggtgctgtttatttatgtttaaacgttactacaggtgagatgatggccgttaagcaggttgaggtccccaagtatagctcacaaaatgaagccattctaagtaccgtggaagcattaagatctgaagtgtccacgttaaaagatttagatcatcttaatattgttcaatacttaggttttgagaataaaaacaatatttacagtttgtttttagaatatgttgctggtggctccgtgggatccttgattagaatgtatggaagattcgatgaaccgttgatcaaacatttaacaacacaagtattaaaaggattggcatacctacactcgaaaggtattctccacagggatatgaaggcagacaacttacttttggatcaagatggtatctgcaaaatcagtgacttcggaatttcaagaaaatcaaaggacatatactctaattcggatatgaccatgcgaggaacagtcttctggatggctcctgaaatggttgatacaaagcaaggctacagtgcaaaagttgatatatggtctctgggatgcatcgttctggaaatgtttgctggtaagcgcccgtggtccaacttagaagtcgtcgcagccatgttcaaaattggaaagtcaaaatcggcaccaccaattcctgaggacactttaccattgatatcgcaaatcggacgaaattttctggacgcatgcttcgagataaatccagagaaaaggccaaccgctaacgagcttctttctcatccttttagtgaagtaaatgaaacattcaatttcaaatctaccagactcgcgaagtttataaagtcaaatgataagttaaactcttcaaaattaaggataacctctcaggagaataaaactgaatag

SEQ ID NO: 45842 - DNA, 3525 bp, Saccharomyces cerevisiae
atgtcgtcgaacaatgatctttggttgcatttagtatcccagttaaatactcaacagagagcagcggccctctttgattacactagagggctgcaggtcattgccggtcccggcacagggaagactaaggttttaacttcaagagtagcgtatcttattctgcaccaccatattcatccccgcgatattatagtgactactttcactaacaaagctgctaacgaaatgaaagagcgtttgcaagaaatgttacgcggggcaggcgtgaatatttcggagctcttaattggtacttttcatagtatttgcctgaaaatactttatagatttggccacttggtggatctacagaaagactggagaattattgatgagaaggaaatagatgtcattttagatgatatgatcgaaaaagttcccgaccaaataagggattatgcttcctcaatcacaaggaaagtaaatctttgtatgccgagtaaaaatggagatgaatggactattcatccgaagctgatcaagaaacagatatcaaagctaaaatcaaacgcaatattacctgaggaatacatcttagattcgaatcatgacgccgcgcttggttacttttaccaaatataccaatcagagctaagcaagaaaaatacgttagattttgatgacttattaatgtacacctttcgtttgctgactagagtgcgtgttttatccaacataaagcatgttttagttgacgaatttcaagatactaacggcattcaattggacttgatgtttctttttgctaagggaaatcatcatctttcgagggggatgaccatcgtaggtgatcctgatcaaagcatatatgctttcagaaacgccttagcgcacaactttctagaaatgggcagaaaatgtcccatcgagtactcaactatcatacttgttgaaaattatcgttcatcacaaaaaattctaaatacaagcgaaattttaataacgcaacaaaacaaaggtcggcagaatagggctccactccgtgcccaatttgacctggattttccaccagtttacatgaatttccccgcttactttttggaagcaccttctttagttcgggaactactatatttgaaggcattgccaaacctattcacatttaatgactttgctatcctagtaagacaacgaagacaaattaaaaggatcgaaagtgcattaatagaacatcggataccctataaaattattaggggccacagtttctgggattccaaggaaacaagagcgatgttaaatttattaaaattgatattttctccgaatgacaaacatgcaattcttgcttcacttttatatccagcaaggggccttggtcctgctaccggtgagaagattaagaacgcattggacacgttagctaccgatgtgtcatgtttccaaatattgaaagacataagtagtaaaaaaataatgctagacataccgacgaaaggccgttctgtgattgctgacttcatttcaatgatagaaaattgtcaattgttgctccagagcactttactagggggtctttcagatttatttgataagctatatgaattatcaggtctgaaatacgaatacttgtacaaggatggtaagaaaaaaaatgatcagcttgaaaaatccgaacctaatttattaaacgcaagacataagaatattgaacttttgaaaaactatttcctggctcttctttccaagtcagaatcttcagataaagaaaaaaatgaagccattaaagcagcaacagatgaagccgaaccaatagagaacaaggtcatcactccaaaagaatacctccgtaatttcttcaattcactttcccttcattctgatgcagctgaggaggaagagtcggaatccaataaagatgcaaaaataaaacgtgagaagaatgggtttgtcacgatatctacaattcacggtgccaaaggtcttgagtggccggtagtttttattcctggatgcgaagaaggtataattccttgtgtgttcaacgatgataagaaagacgaatcagaggaggacgaagaagaagatcaagaaaatagtaagaaagatgcaagcccaaaaaagactagagttttatccgtggaagattctatagatgaggaaagaagaatgttttttgttgcacagactcgtgcaaaatacctgttgtacctatcaaatactgtaactgtggaagatgtcgatagaccaagaattgcaagccgatttttgactactgacttgataaaagccatgtccgatagccaaaaattatttgaaagtacgaatagtatcaaaaaactataccgaattttgaacaaaaagccgcctgctgaagatgataaactattctcccttgaccaattgcgcaaagactataaccaattcattgaaaataggagagaaaggatgatttggcaagggatacaaatgaatgatgtctatggaatacagttgtctagaaataaattattgggttctgttagtgatttcacgtcagctgcggaccagttacgactcgaaacgcaaaactctatattcccacagaagaaacttattgaaaaatcacgcccatccaaaatcaatggcaattacgctcctaaaagtagagttaaaagtccagaaaaaaggtacgctccagaaactacatcattccattctcctacaaagaaaaaggtgtatgcacctcaatacgtttcaacaactaatgtacctagtaggcaggagtttcattcttctactgggaaaaatattccttttctgagaagagaagataggtccatcacagacatatcaccacgatcatcaacgaggtcgttaaaaggagcatctccaaataagacgagccacatgtcagatgatttaatgagaccatcacctacgaggaaggacaaagttactcgtaatattcatttcgcaactgcaggaactttcagaatagaaacccagtcaaatgttgatgaactgcatcctccggaatactccaataaatcagggcagtcgcttacgtcgagtgaattttctgggttttctagcgcgtgcagtaattctgatcagccaacgaacttaatagaagatataaacaacgaattagatctatccgatgaggagttattaaatgacatatcaatagaaaggaggagagagcttttgggctcgaaaaagacgaaaaaaataaaaccaaaaactcgaaatagaaagtctaagagaggtgacaaggttaaggtggaggaagtgatagatttgaagagtgaatttgaggaagatgacagcagaaatacaacagctgctgagttattacataatccggatgacactacagttgacaatcgtccaataatctccaatgctaagtttttggctgacgcagcaatgaaaaagacacagaaattttccaaaaaggtgaagaatgaacctgcatcaagtcaaatggatatattttctcagctgtcacgtgcgaaaaaaaagtcaaaattaaacaacggtgaaatcatagtcatcgattag

SEQ ID NO: 45843 - DNA, 1323 bp, Saccharomyces cerevisiae
atgctttcttgttccgtttcgtttcgagatgacaaaaaactggtcattttttccgttaagtgcaactcacagcagtatcggccgctgagaaatgcccggacaaatttttttgagccggattggtcaccgtttctttcttcggcgcggcttcccattcccgtccatccaaaaaaatctacctatataaatcgacttttcacctctaaaggcagtttattccttgtatgtcctttaagtacagttaataacgagcaatttttttttttttttttagccatctacccatcaacttgtacactcgttaccatgtcaaccacagcatccacgccttcatctttacgtcatttgatttctataaaagatctttctgatgaagaattcagaatcttagtacaaagagctcaacatttcaagaatgtttttaaagcaaataaaacgaatgatttccaatccaaccatctgaaactattgggtagaactatagccttaatatttactaaaagatcaactagaacgagaatttcgaccgaaggtgcagccaccttctttggtgcccaaccgatgtttttaggtaaagaggatattcagcttggtgtcaatgaatcattttacgataccaccaaggttgtatcatctatggtttcatgtatttttgcccgtgtgaacaaacatgaagacatacttgctttttgcaaggattcctctgtaccgatcatcaactctctatgtgacaaattccaccctttgcaagcaatttgtgatcttttaacaataatcgaaaacttcaatatatctctagatgaagtaaataagggaatcaattcaaaattgaagatggcatggattggtgatgccaataatgtcataaatgatatgtgcatcgcatgtctgaaattcggtataagtgtcagtatttccactccccccggtattgaaatggattccgatattgtcgatgaagcaaagaaagttgctgagagaaacggtgcgacatttgaattaacacacgactctttaaaggcctccaccaatgccaatatattagtaaccgatactttcgtttccatgggtgaagaatttgcgaaacaggccaagctgaaacaattcaaaggttttcaaatcaatcaagaacttgtctctgtggctgatccaaactacaaatttatgcattgtctgccaagacatcaagaagaagttagtgatgatgtcttttatggagagcattccatagtctttgaagaagcagaaaacagattatatgcagctatgtctgccattgatatctttgttaataataaaggtaatttcaaggacttgaaataa

SEQ ID NO: 45844 - DNA, 1872 bp, Saccharomyces cerevisiae
atgcccgctgaaattgacattgatgaagctgacgtattagttttatcacaggagttacaaaagacaagtaaactcactttcgaaatcaataaatctttgaaaaaaattgcagctacatccaatcaatccagtcaactcttcactcctattcttgctagaaataatgttttaaccacattacaaagaaatattgaaagtacattgaattccgttgcctcagttaaggatctagcaaacgaagcttccaagtatgagatcattttacaaaagggtattaatcaagtcggtttaaagcaatacacccaagtagtacataagctagatgatatgttggaagacattcagtctggacaagccaatcgagaagaaaactcagaattccatgggattttaactcacttggaacaattgatcaaacgtagcgaggctcaactaagagtatattttatttcaattttgaacagtattaaaccgtttgatccacaaatcaatatcaccaaaaagatgccatttccatactacgaggaccagcagttaggcgctttatcgtggattttagattattttcatggaaattcagaaggttctattatacaggacatactcgtcggtgaaaggagtaaattaatcctcaagtgcatggcattccttgaaccttttgccaaagaaatcagcactgcaaaaaacgccccgtatgagaagggcagtagcgggatgaacagctacacggaggccttattaggcttcatcgccaatgaaaaatcactagtagacgacctctactctcaatatacagaaagtaaaccccacgtcttgtcacagatcttgtcgcctttaattagcgcatatgctaagcttttcggtgcaaatttgaaaattgtacgaagcaacctcgagaactttggattctttagttttgagctagtggaaagcataaatgatgtgaaaaaatctcttcgaggcaaggaactacaaaactataatttattgcaagattgtacgcaagaagtacgtcaagtaacacagtcattattcagagatgccattgataggattatcaaaaaggcaaattctatttctactattccttccaataatggtgtcactgaagcaactgtagataccatgtcaagactaagaaagttcagtgagtacaaaaacggatgtttaggcgccatggacaatatcacacgtgaaaattggttaccatccaattataaggagaaagaatacactttgcaaaacgaggctttaaattgggaagatcataatgtattactatcatgttttataagtgattgcatagacactttggcagttaatcttgagagaaaggcacaaatagcactgatgcctaaccaagagccagatgtggctaatcctaatagctctaaaaataagcacaagcaacgtattggattcttcattttaatgaacctgacgcttgttgagcagatcgtggaaaagtcagaattaaacttaatgttagctggagaaggtcactccagattggaacggctgaagaaacgttatattagttatatggtatcagattggagagatttaactgcaaatttgatggattctgtgtttattgatagtagcgggaagaagtcaaaagacaaagaacaaataaaggagaaatttagaaaattcaatgaaggattcgaagatttagtatcaaaaacaaaacagtataagctttcagatccatcattgaaagtaactttgaagtcagaaataatatcgttggttatgcccatgtatgaaagattctacagtagatataaagactctttcaagaatcctagaaagcatatcaaatatacccctgacgaactaactactgttcttaaccaattagtgagatag

SEQ ID NO: 45845 - DNA, 1470 bp, Saccharomyces cerevisiae
atgtccaatgctgctttgcaagtttatggcggcgacgaagtttccgcagtagtcattgatcctggctcatacacaacaaatattggctattcgggttctgacttccctcaatcaattctgccctctgtttacggtaaatacactgcagatgaaggcaataagaaaatattttctgaacaatcaattggaattccaagaaaagattatgaactgaaacctattatcgagaacggtctagtcatagactgggataccgcacaagaacagtggcaatgggcattgcagaacgaactctatttgaattccaactccggaataccagctctgttaactgagcccgtttggaatagcacagaaaacaggaaaaaatctttagaagtgctcttagaaggcatgcaatttgaagcctgttacttagcacccacatcgacatgcgtttcttttgcagcaggtagacccaattgtttggttgttgatattggacatgatacttgcagcgtcagtccaatagtggatggtatgacattatcaaagagtacaagaagaaattttattgctgggaaatttatcaatcacttgattaaaaaggcattggaacccaaagaaatcataccacttttcgcaatcaagcaaagaaaaccagagtttataaaaaaaacattcgactatgaggttgataaatcgctgtatgattacgccaataaccgagggttctttcaagagtgcaaagaaacactttgtcatatatgcccaacaaaaactttggaagaaacgaaaacagaattaagttctacggctaaaagatctattgaaagtccttggaatgaggagattgtttttgacaacgaaactcgttacggctttgctgaagagcttttccttccaaaagaagatgacatcccagcaaattggcctcgctcgaactctggagttgtgaaaacttggcggaatgattacgtgccgctaaaaagaaccaagccaagcggagtgaacaaatcagacaagaaagttacaccaactgaagaaaaggaacaggaagctgtaagcaaatctacttctccggctgcaaatagtgcagacactccaaatgaaaccggtaagagaccgttagaagaagaaaagcctcctaaagaaaataatgaattgattggtctagcggatcttgtttattcgtctataatgagcagtgatgtggatctaagagcgacactagctcataatgttgtccttacaggcggtacatcctctattcctggattaagtgataggttaatgacagaactaaacaaaatactaccatcccttaaatttagaatattaacaacagggcacactatcgaaaggcaataccagtcatggcttggcggtagtatacttacaagtctgggaacatttcaccaactgtgggttgggaaaaaggaatacgaagaggtgggcgtcgaaagattgcttaacgataggtttagatag

SEQ ID NO: 45846 - DNA, 3570 bp, Saccharomyces cerevisiae
atgtacaagctacaagtggtcttggtgcctccgagtcttcaggcgacgatgccaatacagtttggctacggaccaaccatcgccgaatcttctcaattgttgccaaacagaactaatatggcgcaaagcgccggagatgcctctttgcagtatgctaatctgagatctgccaatgtgagtttcacgccaagctatttcaaccagtctaggtttaggaagtttcttttgtttaccaagccgacaaacacgctgttgaacttgagtgatgaaatcatcgataagtgtgaaaaaatgtacccgagtttgcaagaagacattgaaattttgagtttgcaagataacagcggttgtgaccttgatccggattttttggtaaaggacgttttcaatgtaaataatatcgtaagagttatattgaagaatgagatagatctggacgattccgcaccagtgtcactttataagtcggtaaaacgatccaagttgaacaacgggtcgccccagtcggtgcagccgcaacaacaaatcccgtcctcttcaggtgttcttcggattgccaagaagaggccacctacaggaaccacgacaacaacaaccattcgtagtgccactaatggatccatgagggtttctaccccattggctaggcaaatttatcctccaccttcttcgaagatcgtctccaacaactcagatgacgaagacgaagacattggtgaaagatcctttttgccgcctccaacgcagcctcagtcacctcccataagaattagttcgggcattgacgcaggtaaaaaaataaaatcaagcatcgtcgaggaagatatcgtgtccagatcagcaaccgtggatccagataaaacaaagcagcaacgtctattgtccggaactcctataatgtccaccatgactccaaacagagttactcttaccggtcagagagtggtttctgaacacgcacataaaaacgaattggttttctctgcttcagcttcttcctcttcatttgctaatggtggcacagctgctgtcactgctcaggacattaataggaaaccacccgtaaccactccaagaataacatcaggaatgttgaaaatccccgagccaagaatctcagagattgaaaaagagttaaaagagggaccttccagtccggcctccattttacccgctaaagctgcaaagattccaatgaaaaaaccttacttggaaaatggcgagaactacgaatccgacgatagctcaagtagcgaaaaccaagaaactcctgaaacagaaccacattcaaaggcttccttgcaacgtagtcaaagctccatcgcagataataatggctctccggtgaaaaatagtcctctcggtgatgccatgccacacaatgtgcatttagcagaacttcccaaggcaagcaatacctcgatcaccaaatcttcaaatggcgaatcctggggaaagcaacaagaacatcaaccaccaagaaagagttcactggaaactatagtggaaaagaaatctcaggcggaaccttccggtattgtggaaccgaaaagaatgactaatttcctagatgataatcaggtaagagaaaaagaagatacgaatgataaacttttagaaaaggaaattttgccgacaattccacataatgatcagccaatacttgcatcatctgataagtctaatgggacgttgaaatcactagctgggaaagttagttcaaacaacaacgcttcaaaggaagatggcactatcattaacggcaccattgaggacgatggcaatgataatgatgaagttgatactacggttcgtattgttcctcaagattcagattcctctagtttcccaaagtcagatcttttcaaaatgatcgaaggtgatgatacagatctaccgcaatggtttaagggcaaaaattcgagaacttccggtaattccaaaaattcaaagccttacacaacggttttgaataaagacatagacaattctaagccagatccaagaaatattttgccccagcgaaccccaagaagtgcggctaagagggctgcccaattattggcaggtgccaagaaaaacgaagtcccacagaaaagtactgaagattctagttcggcagcgtccacagacgatgagtcagagagtgggattgaaacagatttctcatcagacgatgattttaaaaggaaaaatatgtcggtgcctaataatgggcccaaagacatttctttacattctttgaaaggcagtgttgttccagtgaaagactcaaagataatcaataaagaagttgatgaagaaagaaacgacaaaagagatagtcaaaaaaagtcagccgtgagtgaatcttcagtaacaaatagcaaaataagtgaacaaatggcgaaaagcttttatccgaattcaaacaagaagcaaaatgaagctacaaaggtggaaactaagccagcaacacaagcatcgtcttttcctgttgttggtgggtctccttctgttgctactaaaggaactacctctttcaatgaagaaggaaatcgtaaaaatgttaaaacgaaggccaagaatgagtctgcgcagattgataggcagcagaaggaaacaacttctagggttgcagatttgaaaagcgcaaacataggaggtgaagacttgaacaagaaagcagaggggtccaaggaaccagaaaaagcatctgccaatatacaggatgctaacgataaaaataactcgaaggaaaaagaagactccaaaagcaaacaggtatctcagaaaaagttaaaaatgacagatcacttaaaagaaggcaatgttcagcttcctaagcccagtgcaaatgataaattgaaggatttgaaggctaaatttactaatagtaaaacactcgtgccacctggaataatttctaatgaaaaaaataattctagtgcaaacgatgatgattctagctcctcaggttcttccacagaagacgagtctagttcatcttcctcgtcttctgatgaggaaacttcaacatccaggaaggctagaagagttgttgtaaatacaccaagagaaccagttagatcttcatctaagattgaagccccctctccatctgttaacaaaaaaatcaatgccacccctgataaaattccagttacacagctaatggacatgtcgtctcctccgtcagttaaatccaagaccacctcaaatccgtctagtatacttcatgaccttccaagaaaagttcgtccttctttgagttcattatctgatcttgtttcaagaggcatcccagatgtaaaggaaaaaacttctaaatcgaatgagaagtcacaaacaaaagccccttcaagtagtgatgatgaatctagctctgattctgactctaactccagttcggactccgtatcggattccagttcagattctaaatctgagtcagattctgatgactcaggggattcatctgatgatggaaaaagttttattagtgcgaaatccgctagtgctgctttaggtaagaagaagaagccaagtggtggatttgcatcattaataaaagatttcaagaaaaaatga

SEQ ID NO: 45847 - DNA, 3693 bp, Saccharomyces cerevisiae
atgtatatcaaaagggtgataattaagggttttaaaacctacaggaacgaaaccattattgataatttctcgccgcatcagaatgttattattggctccaatggttcaggtaaatcgaatttcttcgctgcgattagatttgttcttagtgacgattactctaatcttaagagggaagaaaggcaagggcttatccaccaaggttctggtggttcagtgatgagtgcctcggtagaaattgtgttccacgatccagatcattctatgatattgccctccggtgtactttcgagaggagatgacgaagtgaccattagaagaacagtagggctgaagaaggatgactatcaattaaatgacagaaacgtgaccaaaggggacatagtcagaatgttggaaaccgctggtttttcaatgaataatccgtataatatagtaccacaaggtaaaatagtcgccttaactaatgccaaggataaggaaagattgcagttattggaagatgttgtaggagctaagtcatttgaagtaaaattgaaagcttcattgaaaaaaatggaggaaacagagcagaaaaagattcaaattaacaaggaaatgggtgaactaaactctaaattgagtgaaatggaacaggaacgtaaggaattagagaaatacaacgagttggaacgcaacagaaagatctaccagttcacattgtatgatcgagaattaaatgaggttatcaatcaaatggaaagactggacggtgattataataacacggtatactcttccgaacaatacatccaggagttggataaaagagaggatatgattgaccaagtctccaaaaagctatcaagtattgaagcttcactgaagatcaaaaatgcgactgatttacaacaggcaaaactacgggaatctgagatttctcagaaattaacaaacgtcaacgtaaaaataaaggatgttcaacagcaaattgagtcaaatgaggagcagagaaatttggatagtgcaactttgaaagagatcaaatctataattgagcaaaggaaacaaaagttgtctaaaattttacctagatatcaagaactcacaaaggaagaagcaatgtacaaacttcaattggcctccttgcaacaaaagcagagagatcttatcttaaagaaaggagaatatgcccgttttaaatcaaaggatgaacgcgatacgtggattcattcagaaattgaagaactgaaatcttcaatacaaaacttaaatgaactggaaagtcaattgcaaatggatcgtacttctttaaggaagcagtactctgcgattgatgaagagattgaagagctaattgattctatcaatggaccagataccaagggtcaattagaagattttgattcggaattaatacacctcaaacagaagctgagtgaaagtttagacactcgtaaggaattgtggagaaaggagcaaaaattacagacagtcttggaaactttattaagtgacgtcaatcaaaatcaaagaaatgttaatgaaaccatgagtagatcattggcaaatggtataataaatgtgaaagaaattacagaaaaactaaaaatatcaccggaatctgtctttgggacattaggtgaactgattaaagtcaatgataagtacaagacatgtgctgaagtaattggaggtaactccctcttccacattgtcgtggataccgaagaaacggccactttgattatgaacgaactatatcgtatgaagggtgggagagtgacgtttattcccttgaacaggttatctttggacagtgatgttaaattcccctcaaacactactacacaaatccagtttactcccttgataaagaagataaaatatgaacccaggtttgagaaggctgtcaaacacgtttttggaaaaactattgttgtcaaagacttaggtcaaggtttaaaattagctaagaaacacaaactcaatgccatcactttagatggtgatagagcagacaaaagaggtgtacttacaggtgggtatcttgaccagcacaaacgaacacgtttggaatcattgaaaaacttaaatgaatcaagaagtcaacacaaaaaaatactggaagaattagatttcgtaagaaatgaactaaatgatattgatactaagattgatcaagtaaacgggaatataagaaaggtttctaatgacagggagtctgtcttaacaaatatcgaggtatatagaacatcgctaaacaccaaaaagaatgaaaaattaattctcgaagaatcattaaacgcaattatactaaaactagaaaagctgaatacaaatcgtacatttgctcaggaaaagctaaatacattcgaaaatgatttgcttcaggagtttgatagcgaactctcaaaagaagaaaaggaaagattagaatctttaacaaaggagattagtgcagcgcacaataagctaaatattacatcagacgccctagaaggtataactacaaccattgactcgttgaatgccgaattggagtccaaacttatcccacaagaaaatgatctagaatccaagatgtcagaagtaggtgacgcatttatttttggtctacaagatgagttgaaagaattacaattggagaaggaaagcgttgaaaagcagcatgaaaacgctgtgttggaactaggtaccgttcaaagagaaattgaaagtctcattgctgaagaaactaataataagaaactgctagaaaaagcaaacaatcaacagcgattactattaaagaagcttgacaatttccaaaaaagtgttgaaaaaacgatgattaagaaaacaactttggttactagaagagaagaattacagcaaaggattagggaaattgggcttctgccagaggatgctttagtaaatgattttagcgacatcacaagtgatcagctattacaaagactgaatgatatgaacacagagatttctggtttgaagaatgtaaacaagagagcttttgaaaacttcaaaaagtttaacgaaagacgcaaagaccttgcggagagagcttcagagctggatgaatctaaagactcaattcaagatctaattgttaagttaaaacaacaaaaggttaacgcggttgattctactttccaaaaggtttctgaaaactttgaagctgtttttgaaagattagttcccagaggtactgctaagttgattattcaccgtaagaatgataacgctaacgaccatgatgaaagtattgatgttgacatggatgcagaatccaatgaaagccaaaacggtaaagatagtgaaattatgtatacaggtgtttcaatttctgtttccttcaattctaaacaaaacgaacaactgcatgttgaacagctctcaggtggtcagaagactgtatgtgccattgctttgattctggcaatccaaatggttgaccctgcttccttctatctgtttgatgaaattgatgctgcactcgacaagcagtatagaactgcagtcgctacacttctaaaagaactgtcaaaaaatgcccagtttatttgtacgacgttcagaacagatatgttgcaagttgcagacaaatttttccgtgttaagtacgagaataagatttccacggttattgaggtcaatagagaagaagcaatcggattcattagaggtagcaataaattcgctgaagtctaa

SEQ ID NO: 45848 - DNA, 1725 bp, Saccharomyces cerevisiae
atgtggaggagaatattcgcgcatgaactcaagtatgatcaacccaatgcatcttcaaaaaacttgatcctttcagttctgaatacaaccgctacaaaacgagaggctaaggattatctctcaaaatatacaaatgatagtgggcagcataatcattgtttgttttttatcagggacctgcataaagtcgcaccagcgattttgtcccagttttcaagtgtcataaagagactaggaatgctaggtttgcgacctatgtttgtaattccgccgtcgccaactcatgtaaatatacaggcagagttacttgacagtatcgttacagaagcagatttaaagccacttcaccttaaggagggtcttactaaatcccgcactgggttatatcattctgttttttcgcaagagagtcgtttctttgatattggaaattccaattttataccaattgtgaaaccttatgtgtataatgaagagactgcttcagaattcatgacaaaggatgttgtaaaatttatggattgcctgtgccaagggaatattccacacattgacaaattcttcattctaaataatgccggaggtataccttcgggagagagaaatgataacgctcatgtattcatcaatctttctcaggaactcgagcatttgtcctcgtcattatctcacaatataagcactctaaccaaacgagagccacgctcccaaaacctgttacacagaatggaggtgtacgttaaaaaagatgagatatcttccttagaatgtgaataccatgatcatttagaaaacctgttattgatggacaaagttttatcaaatctagcggctacagcaacgggactgattacaactgtcaaagctgccgcactatcatcagataggaaaaatcctttagtatataatttattgacagaccgatcgctaatttcttcttctttaccaaggtttaaaaaaaaggacggcgagatagactcaccagccaacatgtttgatgatcacgcatggtatgaattgccttcccaacaggtaaatgcagctccttctaactcagatgcagttttagtgacaactgttctcaaaaagggcgtccatatcaaaacttatgactataagacgctgactcaattcaactcaattgggcttccaaagaagtttcacgtacctgagaaaggagcaaaaccctcgagcaatagtccaaaactagatatcaacaaatttaaatccatcatcgatcagagctttaaaagatctttggatttgcatgactacataaaaaggattaatggaaaaatagctacaattattgtgataggtgattatgaaggcattgcaattcttacctatgaaggctcggaggaaaattcctttgtttatctcgataagttcgccgttctaccacacttgaaaggctcgctgggtatatctgatataatcttcaatttgatgttcaaaaaatttcctaatgagatactttggagaagcagaaaagacaatgtggtgaacaagtggtattttcaacgtagcgttgctgtgctagatttgtcgattgacttagaccccgaacactgtgatgaaaagcaaagccaatttaaactattttactacggtaaccctcaatacgctaagagggcactacgtgacaagaaacgtttaagagaattcatgaggtctgtcagggacatcaagccaagttgggaaaatgaaaaaaatatttcatga

SEQ ID NO: 45849 - DNA, 1335 bp, Saccharomyces cerevisiae
atgaaacaacgattcattcgtcaatttacgaacctaatgtctacttcgagaccgaaagttgttgccaacaaatatttcacttctaacactgccaaagatgtttggtcgctaaccaatgaagccgctgcaaaagctgccaataactccaaaaaccaaggccgtgaacttattaatttaggccaaggctttttttcatattcccctcctcaattcgccattaaggaggctcagaaagccctagacattccaatggtcaatcaatattctccaactagaggtcgaccttcattaattaattccttgattaagttgtattctcctatttataacacagaattgaaagcggaaaatgttaccgtaacaacaggtgccaatgaaggtatactttcttgcttgatggggcttttgaacgctggcgacgaggttattgtttttgaacctttctttgaccaatatattccaaatatcgaactttgcggtggtaaagttgtttacgtccccataaatcctccaaaggaattggatcaaaggaatactagaggtgaagaatggaccattgactttgagcagttcgaaaaagcgattacatccaagacaaaagctgtcattatcaatacccctcacaacccaattggtaaagttttcacgcgcgaggaattaaccactttaggtaacatttgcgtcaagcacaacgttgtgattatatctgatgaagtctatgaacacctttacttcactgattctttcactagaattgccacactctctccagaaattgggcaactaaccttaacggtcggttctgccggtaaatcgtttgctgctactggttggagaattggttgggtcttatccttgaacgcagagttgttaagttatgcagctaaggcacatacaagaatttgttttgcatctccatcccctctacaggaagcttgtgcaaactctattaacgacgctttaaaaattgggtattttgaaaaaatgagacaggaatatatcaacaaattcaaaattttcacatcgatctttgatgaattgggactaccatatacagctccagagggtacatattttgtcctcgttgatttctctaaagtgaaaattcccgaggactatccctacccagaggagatcctgaataagggaaaagattttcgcatttctcactggttgatcaatgaattaggtgtggttgccattccaccaactgaattctatatcaaagagcacgaaaaggctgctgagaatttgttaaggtttgcagtttgtaaagatgatgcttatctagaaaatgccgtagagagattaaaactactcaaggactacttataa

SEQ ID NO: 45850 - DNA, 999 bp, Saccharomyces cerevisiae
atgatcagaattgctattaacggtttcggtagaatcggtagattggtcttgagattggctttgcaaagaaaagacattgaggttgttgctgtcaacgatccatttatctctaacgattatgctgcttacatggtcaagtacgattctactcatggtagatacaagggtactgtttcccatgacgacaagcacatcatcattgatggtgtcaagatcgctacctaccaagaaagagacccagctaacttgccatggggttctctaaagatcgatgtcgctgttgactccactggtgttttcaaggaattggacaccgctcaaaagcacattgacgctggtgccaagaaggttgtcatcactgctccatcttcttctgctccaatgtttgttgttggtgttaaccacactaaatacactccagacaagaagattgtctccaacgcttcttgtaccaccaactgtttggctccattggccaaggttatcaacgatgctttcggtattgaagaaggtttgatgaccactgttcactccatgaccgccactcaaaagactgttgatggtccatcccacaaggactggagaggtggtagaaccgcttccggtaacattatcccatcctctaccggtgctgctaaggctgtcggtaaggtcttgccagaattgcaaggtaagttgaccggtatggctttcagagtcccaaccgtcgatgtttccgttgttgacttgactgtcaagttggaaaaggaagctacttacgaccaaatcaagaaggctgttaaggctgccgctgaaggtccaatgaagggtgttttgggttacaccgaagatgccgttgtctcctctgatttcttgggtgacactcacgcttccatcttcgatgcctccgctggtatccaattgtctccaaagttcgtcaagttgatttcctggtacgataacgaatacggttactccgccagagttgttgacttgatcgaatatgttgccaaggcttaa

SEQ ID NO: 45851 - DNA, 3222 bp, Saccharomyces cerevisiae
atggattctactgatctgttcgatgttttcgaggaaacacctgttgagcttcctacagatagtaatggagaaaaaaatgctgatacaaacgtaggagatactccagatcatacccaggataagaagcatggccttgaagaagaaaaagaagagcatgaggaaaacaacagtgaaaataaaaaaatcaaatccaataagagcaaaacggaagataaaaacaaaaaagttgtagtaccagtgttggcagattcgttcgaacaagaagcctctagagaagtggatgcatcgaaaggactgacaaattcagaaaccttacaagttgagcaagacggtaaagtcagattatcgcatcaggtccgccaccaggttgcactaccaccgaactatgattatacgcctatcgctgagcataagagggtaaatgaggctcgtacatatccattcacattagaccctttccaggacactgcaatctcatgtatagatagaggcgaatctgtgttggtttctgcgcacacatcggctggtaaaacagttgtggctgaatatgccatcgcacaatctttaaaaaataagcaaagagtcatttatacctctccaattaaggctctatcaaaccaaaaatacagagaacttttagcagaatttggagatgtcggtttgatgactggtgatatcacgatcaatccggatgcaggctgtttggtcatgaccactgagattttgagaagtatgttatatagaggcagtgaagttatgagagaagttgcctgggtcatctttgatgaagtgcattacatgagggataaagaaagaggtgttgtgtgggaagaaacgattattttactgccagataaggtccgttacgtgtttttatcggccaccattccaaatgcaatggagtttgctgaatggatatgcaaaattcattctcagccatgtcatattgtctacacaaatttccgtccaactcctttacaacattacctgtttccagcccatggagatggtatttatctggtggttgacgaaaaaagtaccttcagagaggaaaatttccaaaaagcaatggcgtccataagtaaccagataggtgatgatccaaattccactgattcaagaggtaaaaagggtcaaacctataaaggtggctccgctaagggtgacgcaaaaggtgacatttataagatagtgaaaatgatttggaagaaaaagtacaatccagtgattgtattttcgttcagtaaacgtgattgtgaagaattagcattgaagatgtctaaattagattttaattctgatgatgaaaaggaggctttgacgaagatttttaacaatgccattgcactattaccagagacagacagagagctaccccaaattaaacacattttaccattattaagaagaggtatcggtattcatcattccggtttactgcccattttgaaggaagtcattgaaattctgtttcaagagggatttttgaaggtgttgtttgcaacagaaacattttcgattggattaaacatgcctgctaaaactgttgtctttacatcggtcagaaagtgggatggtcaacaattccgctgggtttcaggtggagaatatatacaaatgtctggtcgtgcaggtcgtcgtggtttagatgatcgtggtattgttattatgatgattgatgaaaaaatggaacctcaagttgctaaaggaatggttaagggccaagcagataggctagactcggcttttcacttaggatataatatgattttgaacttaatgagagttgaaggtatctctccggagtttatgttggagcattctttcttccaatttcaaaacgttatttcagtaccagttatggaaaagaaacttgctgaactgaaaaaagactttgatggcatcgaagtcgaagatgaagaaaatgttaaagaataccatgagattgagcaggctatcaaaggttaccgtgaagatgttcgtcaagttgtcacccatccggcaaacgccttaagtttcctacaaccaggcagattagttgaaatctctgtcaatggtaaggataactatggctggggtgctgttgtcgattttgctaaaagaattaacaaacgcaacccaagtgctgtctatacagaccatgaatcctatattgtcaatgtggtcgtcaataccatgtatatagactctccagtcaacttgttgaaacctttcaaccctaccttaccagaagggattcgcccagcggaagaaggtgaaaaaagcatatgtgctgttattcccataactttggattcaatcaagtcgattggtaatttgagactatatatgcccaaagatattagagccagcggtcaaaaagaaactgttgggaagtctttaagggaggttaatcggaggttcccggatggtattcccgtgctggatcctgttaaaaacatgaagatcgaagatgaggactttttaaagctaatgaagaagattgacgttttaaacacaaagttatcctccaatcccttaaccaattccatgagactagaagaactatatggtaaatatagtagaaaacacgatttacatgaagatatgaaacaattgaaacgcaaaatttcagaatcacaagccgtaatccaactggacgatcttcgtcgccgtaaaagagttttgcgccgtttaggattttgtactcctaatgacattattgaactgaaaggtagagttgcatgtgaaatatctagtggtgatgaactgttactaacagaattgatcttcaatggtaatttcaatgagttgaaaccggaacaagcagcagcattattatcatgctttgcattccaagaacgctgtaaagaagcgcctagattgaaaccagagcttgccgaacctttgaaggctatgagagaaattgcagcaaagatcgctaagataatgaaggattctaaaattgaagttgtagaaaaggactacgttgaaagcttcagacatgaactaatggaagttgtttacgaatggtgtagaggagctacttttacgcaaatctgtaaaatgaccgacgtttacgaaggttcgttgatcagaatgttcaagagattagaggaattggtgaaggagctggtagacgtcgccaataccattggtaactcttcacttaaggagaagatggaagctgtcttgaaattaattcatagagatatcgtatctgctggttctttgtatttatag

SEQ ID NO: 45852 - DNA, 1905 bp, Saccharomyces cerevisiae
atgttatctttgaaaaaaggaataacaaaatcatacatcttgcaaagaactttcacttcttcctctgttgttcgtcaaattggggaagtgaaatctgaatcgaaaccgccggccaaatatcatattatcgaccatgaatatgattgtgtggtggtaggcgctggcggtgcaggtttaagagcagctttcggtttggctgaagctggatacaagactgcttgtttatccaagttgtttccaacaaggtcacatactgtggctgctcagggtggaattaatgctgcgctgggaaatatgcatccagatgattggaaatcgcacatgtacgacactgtcaagggttctgactggctcggagaccaagatgcaatccattacatgacaagagaagcacctaagtctgtcattgaactagaacattacggtatgcccttttcgaggactgaagatggaaggatttaccagagagcatttgggggacaatccaaagattttggtaaaggtggacaggcctataggacttgtgcggtggcagatagaacaggtcacgcaatgcttcatacattgtatggacaagcgctgaaaaataatacacacttctttattgaatactttgcaatggatttgttgacccataatggcgaggttgtgggtgtcattgcctataatcaggaggacggtacaattcacagattcagagcacataagaccgtcatcgcgacaggcggatacggtagagcttacttctcttgcacttctgctcacacttgtacaggtgacggtaatgctatggtttctcgcgctggatttccactagaggatttagaatttgttcaatttcatccgtcaggaatttatgggtctggctgcctaatcactgaaggtgcccgtggtgagggtggatttttattgaattctgaaggagaaaggtttatggaacgctatgctcctactgccaaggacttggcaagcagggatgttgtttccagagcaatcaccatggaaatcagggctggcagaggtgtcgggaaaaacaaggatcatatccttttacaattaagccatctaccacctgaggtactaaaggaaaggctaccgggaatatctgaaacagctgctgtctttgcgggtgtcgatgtcacccaggagccaattcctgtcttgccaactgtccattataatatgggaggcattcccacaaaatggactggtgaagcattgaccattgacgaggaaactggagaggataaggtcatcccaggattgatggcgtgtggtgaagctgcttgcgtatcggttcatggagcgaacagattaggcgctaactcactactggatttagtcgttttcggtcgcgccgttgcaaataccattgctgacacattacagcctggcttgcctcataagccattggcttcaaacatcgggcacgagtcaattgctaatttggataaagtaagaaatgctcgcggctcactgaaaacctctcaaatcaggttgaacatgcaaaggacaatgcaaaaagatgtttctgttttcaggacgcaagacactctagatgaaggtgttagaaatattactgaagtggacaagacatttgaggatgtgcacgtttctgataagtcaatgatctggaattctgatctcgtagaaactctggaattgcaaaatttacttacttgtgccacacaaacggctgtttctgcttccaaaagaaaggagtctcgtggtgctcatgcgagagaggactatgcaaaaagagatgatgtgaattggagaaagcacacattatcatggcaaaaggggacatcaacacctgtaaaaatcaagtacaggaatgtaatcgcacatactttagatgagaatgaatgcgccccagtccctccagctgtcagatcctattaa

SEQ ID NO: 45853 - DNA, 4197 bp, Saccharomyces cerevisiae
atggactccaaggacacgcaaaagttgcttaaggagcaccgaatcccctgcatcgacgttggatggttggtcaggcccagtgcctccaccagcaagagctccagaccagggaaatccgagtccaaggccaacagtgtggctcctgacatccagatggacactgctcgcccgcccgttttcgaaacgtctgtagactcttccagcagcattctttcttcaaacgataagggacgccgtcactccgtagctgcgagcttgctaatggataatcagcgtgctaacgctgggtctacatccgttcccacaaacattcctccccctaggggtaggtcgaagtcagtggtggagactaacctgtctaacgttgaggctgactccggacatcatcaccaccaccgccaccaccatcacacggaagatgctcctgcacctaagaaggtcggattctttaagagtctgtttggccataggaagaaggatcaggaacaacaggagaaggaacgagaaaggaaagagcgctcaccctctccgactcacgtggaccgtggcgcggccataagaagagaaagaacggctaccatatctgcggaatcaccaccgcctttgcagtacaatgctccaccctcttataacgatactgtggtaccgttaacaagatccaagacggaatcagaagtgtattacgaaaatcatccgcaaagctactaccatggccgtatgcgcacataccactcaccagaagagggtaaagtcgacggaacttcccccgcagacgatcataactatggcggctctcgacctgatcctagattaatggatttcttgcgctactacaaatctaaggattacaaattagccgccttcaaagaagggaactttattaagtcatctgcgtctcccacaaccaagaaaaatagacgcgcttcgttctcattacataacgacaaaccacaacctgccaaatcacttgctcaccagaaatttgacgctaagggaagacccattccgccgcatcccgacgcacccaaattgccttccgccttcaggaagaagcatccaagcaacgcatcgatagtagacacagtggattccaattcggacgtttcctcgtcagcgcagaataataatcagacaccttcttctcataaattcggcgcctttttaaggaaagttacctcttatgggaacaacaacaacaacagcaccaatgcctcctccctttctgcaaacgtcaataatccagacacctcatcgacgtccctatggtcttctagttcaatggagttcgacccttcaaagataaccaccgtccccggcctcgagaatatacggcccttgaaacacgtctcctttgctacgaacacctatttcaacgatcctccacaacaaatatgcagtaaaaaccctcgtaaaggtgaagtggaagtgaagcctaatggatctgttgtcattcataggttgactccgcaagaacgcaaaaaaatcatggaatcgactagtttgggtgttgtcgttggggggaccgggcaattaaaactattaaatcccgaggaagacgacgcaaatgccaagagtaaagaggagatggcccctcaaaagcagaacgaagtggaggcacacgacgaggaggataacaattctcaaaggagaaacatcgttatggccgctgcagaagctgctgcagaggccagagccaaagaggcacctaacgaattgaaacgtatcgtgaccaacaatgaagaagaagtcactgtcagtaagaccgccagccatttgaccatcgataagccaatgatttcaagaaggggtgcttccacatcctctttggcctccatggtgtccagtgataccaacggtacgaacgcagatgatgaaggagaaattcttcccccaccttctttgaagatacctcacgacattgtgtatacccgttgttgtcacttgcgagaaattctgcccataccagccacattgaagcaattgaaaaagggctcgacggaccctatccccatcttacagttacgtaacccaagaccttctatggtggaaatttggtcgttcagcgatttcttgagcattgctcccgttttatgtctttcgttggacggtgtacaattaaccgtgcaaatgcttagaataattttgagttcgctggtttacaaacagcatttccaaaaactttctctaagaaacacccccttggatgaagaaggatggaaagttctgtgttattttgtctccaaggccaagtctctgcactctattgatttgacaatggtcccttccatcaagacaaatgtacaaaagccttctaaatcttctttgaagtcaaaaattctgagaatgcaatgcaacttggaaaatagatccgacatgaactgggaccttttgacagcttctattgccctcatgggcggtttggaggaaattgtcatttccggggccaagatgaattctgcacaattcaaaaacttcatcctcgttgcttgtatagcaaccgagagattgggcctcgcgtataatggattatctaagagccaatgtgatgatttggccaagtggatggttcaatcaaaagtgacaggtctagacgttggttttaacgatttgaatggcaaactttcctctttcaccgatgctgttttaggcaaaatacaaaaagctaacgagaaaaacgtcttcaaatttttatctctaaatgggacaaatttgagagtgaacgaacacgacacttttgagaataacgaggtcttaaaactgataagcgttttatgttatttggaaaatttaaaattcttggatatatcgaacaatcctgccatcttcccccactgtgttccgacgctgattgattttttacctgtttttgttaatcttgtccgtctgcatatcgactacaataatttaagttccacgagtgtagtgatgctggccgaaatattacccatgtgttcaagattgaattatttttccatgttaggaacggaattggatttggcatcgtctaaagctctagcagaggcggtgaggaaaagttcatctttgatgactttggacgtggactatgtgtatatgccagagaacattaaggaaaaaatttcattatatgctttaagaaatattcaaggggagttgaaaagggttaatagtgacgataaagatatcaaagatagccaattttcaagcctacaggaccaactatcacttttattaactgaaaaagcggataattccgaacattacaacaaaatggttgagaatttcatggccaaaatcgcgttggcacgtatcaagattagtaaagtggttcatgatctttttgatttaaaactgaatggacaattaaatttggaaggtaaggaagctttgattagattatgcttcatagaggcaagtttggaaagaggctgtgacctgctgaaacaaagacataacaacactttgaaatcaccagaggccgtctcaaaaagtcggaaagggggaaatcaagcacaacccaattccgaaagctgtcaaagaatgttactaagctcatctatattacaaaattcagatcatattgcgcttatgccattcggtagtgcaatagtcgaaaagtcaagcccagatgcagaagatgccgtcgaattcagagaaggtgacgactccaacgtaaatcacgaagacgtaccagcaaatgatcaacaatttcgagatgaagttgatatcaaaaacaaatactctatcattaaaagagaactagaacacgaaaagcttgtcggtggtggcgatttgccagtggacaaagaaatcttaaatcgtgccgcacaatccttagatagtgaccagataaaggaatttctgttgaagaatgacgtctctactatccttggcgtcattgatgaactgcatagccaagggtaccacttgcatcatattttcaaaaaacagggaaaccaagaagagaccgcgttcagaacaaaggatgaacaacagtcctcccaatccaatgattcaagtgctaatgcgtcccctaccactgatccgatatccacaggctccaatacttctagaacgaacgataatgctcatattcctccgaccgatgcgcctggatttgataaatttatgaacaatgcagaggaaaatgccattgacgctgcttatgatgatgtgctagacaaaatccaggatgcgcggaacagtagtactaaataa

SEQ ID NO: 45854 - DNA, 2049 bp, Saccharomyces cerevisiae
atgtttttcaacagactaagcgctggcaagctgctggtaccactctccgtggtcctgtacgcccttttcgtggtaatattacctttacagaattctttccactcctccaatgttttagttagaggtgccgatgatgtagaaaactacggaactgttatcggtattgacttaggtactacttattcctgtgttgctgtgatgaaaaatggtaagactgaaattcttgctaatgagcaaggtaacagaatcaccccatcttacgtggcattcaccgatgatgaaagattgattggtgatgctgcaaagaaccaagttgctgccaatcctcaaaacaccatcttcgacattaagagattgatcggtttgaaatataacgacagatctgttcagaaggatatcaagcacttgccatttaatgtggttaataaagatgggaagcccgctgtagaagtaagtgtcaaaggagaaaagaaggtttttactccagaagaaatttctggtatgatcttgggtaagatgaaacaaattgccgaagattatttaggcactaaggttacccatgctgtcgttactgttcctgcttatttcaatgacgcgcaaagacaagccaccaaggatgctggtaccatcgctggtttgaacgttttgagaattgttaatgaaccaaccgcagccgccattgcctacggtttggataaatctgataaggaacatcaaattattgtttatgatttgggtggtggtactttcgatgtctctctattgtctattgaaaacggtgttttcgaagtccaagccacttctggtgatactcatttaggtggtgaagattttgactataagatcgttcgtcaattgataaaagctttcaagaagaagcatggtattgatgtgtctgacaacaacaaggccctagctaaattgaagagagaagctgaaaaggctaaacgtgccttgtccagccaaatgtccacccgtattgaaattgactccttcgttgatggtatcgacttaagtgaaaccttgaccagagctaagtttgaggaattaaacctagatctattcaagaagaccttgaagcctgtcgagaaggttttgcaagattctggtttggaaaagaaggatgttgatgatatcgttttggttggtggttctactagaattccaaaggtccaacaattgttagaatcatactttgatggtaagaaggcctccaagggtattaacccagatgaagctgttgcatacggtgcagccgttcaagctggtgtcttatccggtgaagaaggtgtcgaagatattgttttattggatgtcaacgctttgactcttggtattgaaaccactggtggtgtcatgactccattaattaagagaaatactgctattcctacaaagaaatcccaaattttctctactgccgttgacaaccaaccaaccgttatgatcaaggtatacgagggtgaaagagccatgtctaaggacaacaatctattaggtaagtttgaattaaccggcattccaccagcaccaagaggtgtacctcaaattgaagtcacatttgcacttgacgctaatggtattctgaaggtgtctgccacagataagggaactggtaaatccgaatctatcaccatcactaacgataaaggtagattaacccaagaagagattgatagaatggttgaagaggctgaaaaattcgcttctgaagacgcttctatcaaggccaaggttgaatctagaaacaaattagaaaactacgctcactctttgaaaaaccaagttaatggtgacctaggtgaaaaattggaagaagaagacaaggaaaccttattagatgctgctaacgatgttttagaatggttagatgataactttgaaaccgccattgctgaagactttgatgaaaagttcgaatctttgtccaaggtcgcttatccaattacttctaagttgtacggaggtgctgatggttctggtgccgctgattatgacgacgaagatgaagatgacgatggtgattatttcgaacacgacgaattgtag

SEQ ID NO: 45855 - DNA, 2313 bp, Saccharomyces cerevisiae
atggccaaaaaaaatagattgaacacaactcaaagaaagactttacgtcaaaaggaagatgagtacatcgaaaacttgaaaaccaaaattgatgagtatgaccctaagataaccaaggccaagtttttcaaagatctccccattagcgatcccacattaaaaggtttaagagaatcatcctttataaaacttactgagatccaagccgattctattcccgtgtccctgcaaggtcatgatgtattggcggccgcaaagacaggttccggtaagacattagcatttttagttccagtaattgaaaagctataccgcgaaaaatggaccgaattcgatgggttaggtgcccttatcatatctccaacaagagagttggctatgcaaatatatgaggttttgacgaaaataggtagtcacacttcattttcagctgggttagttatcggtggtaaagatgttaaattcgaactagaaaggatatcaaggattaacattcttatcggtacacctggtcgtattttacaacatttagatcaagccgtaggtctaaatacttccaatttgcagatgcttgttcttgacgaagctgatagatgtttagacatggggtttaaaaaaactctggatgccatcgtaagcacattgtcaccatctagacaaacacttttattttcagcgactcaatcacaatctgttgcagacttggctaggctttccttgacagattataaaaccgttggtacacatgatgtgatggatgggtcggttaacaaagaagcatctactccagaaactttgcaacaattctacattgaagttcctttggcagataaattggatatccttttcagttttataaaatcacatttaaaatgcaaaatgatcgttttcttatcaagttccaaacaagtgcattttgtctatgagacatttaggaagatgcagcctggtatttctttaatgcatttacacggtagacagaaacaacgtgctaggacagaaactttggacaaattcaatcgtgctcaacaggtgtgtctttttgctaccgatgtcgttgctagaggtattgactttcctgcagtcgattgggttgttcaagtggattgtccagaggacgttgatacatatatccacagagtcggtagatgtgctcgttacggtaaaaagggtaaatctttaatcatgttgactccacaagagcaggaagcgttcctaaaaagacttaacgctagaaagatcgaaccaggcaaacttaatataaaacagtcaaaaaagaaatccattaaaccacaattgcagtcattattattcaaggatccagaactaaaatatctaggacaaaaggcttttatatcgtacgtgagatctatatatgtgcaaaaggacaaacaagttttcaaattcgatgagttaccaacagaagaattcgcttattctcttggtttaccaggggccccaaaaatcaaaatgaagggtatgaagaccattgagcaggccaaagaaagaaagaatgctccaagacagctagctttcttatcaaaagcaaatgaagatggtgaagtaattgaagataagtcgaaacaaccaagaacaaaatatgataaaatgtttgaacgtaaaaatcaaaccatcttaagtgaacactatttgaatataacgaaggctcaagcacaagaagacgaggatgacgatttcatttctgtcaagcgtaaagatcatgaaataaatgaagctgagttaccagctctaactcttccaacttcaaggcgagcacagaagaaagcgctttcaaagaaggcatctctggcctccaagggtaacgctagcaaattaatatttgatgatgaaggcgaagcccatccagtttatgaacttgaagatgaagaagaatttcataagagaggtgatgcggaggtacaaaagacagaatttttaactaaagaatctgcagtaatggcagacattgacaatattgataagcaggtggctaaagaaaaaaaacaagagaagaagagaaaaagactagaagccatgagaagggaaatggaggctgctatggaagaagaaatttctggagatgaagaagaagggaagacagtagcatatttaggaacaggaaacttgagcgatgatatgagcgacggtgatatgcctgactcggaaggccacttgaaaaagaaagctagaactgttgactattcccacggccacaatccatccaattcagttgatgatgacattattgaagtggaagaaccacaaactttggaggatttggaatctttgacagctaaattaatccagggttaa

SEQ ID NO: 45856 - DNA, 591 bp, Saccharomyces cerevisiae
atgtcacaatcaatatcactaaagggttcaacaaggacagttacagaatttttcgagtacagcattaattccattttgtaccaaagaggcgtatacccagcagaagatttcgtaacggtgaaaaagtacgatcttacgttactaaagacacatgatgatgaactgaaagattacattcggaaaattcttctacaagttcacaggtggcttcttggtggaaaatgcaatcaattagtattatgtattgtagacaaggatgagggagaggtggtggaaagatggtccttcaatgtgcaacacatttctggcaatagcaacgggcaggatgatgttgtagatttaaatacaacacaatcacaaatcagagctttaatcaggcaaatcacctcaagcgttacctttctgcccgaactaacaaaagaaggtgggtacacattcacagtacttgcatatacagacgcggatgctaaagttccgttagaatgggccgactccaatagtaaagagatacctgatggtgaagtagttcaattcaaaacattctctaccaacgatcataaagttggtgcgcaggtcagctataaatattaa

SEQ ID NO: 45857 - DNA, 1200 bp, Saccharomyces cerevisiae
atgcctaaagagaccccttccaaagctgctgccgatgcattgtccgacttggaaatcaaagattccaagtccaaccttaacaaggaattggagacattgagagaggaaaacagagtaaagtcagacatgcttaaggagaaattgagcaaggacgctgaaaatcacaaggcttacttgaaatctcatcaagttcaccgtcacaaacttaaggaaatggaaaaggaggaacctttgttgaatgaagacaaggagagaactgttcttttccctatcaagtaccatgaaatctggcaagcctacaagcgtgccgaagcttctttctggaccgctgaagaaattgatttgtctaaggatatccatgactggaacaacagaatgaacgaaaacgagagatttttcatttccagagttcttgcctttttcgccgcttctgacggtattgttaatgaaaacttggttgaaaacttctccaccgaagtccaaattccagaggcaaagagtttctacggtttccaaatcatgattgaaaatattcactctgaaacttactccttgttgatcgatacttacatcaaggaccctaaagaaagtgaattcttgttcaatgccattcacaccatcccagaaatcggtgagaaggccgaatgggctttaagatggattcaagacgctgacgccttgtttggtgaaagactagttgcctttgcctccattgaaggtgtctttttctccggttcctttgcctccattttctggttgaaaaagagaggtatgatgcccggtttaaccttttccaacgaattgatctgtagagacgaaggtttgcacaccgactttgcatgcttgttgttcgcccatttgaagaacaaaccagacccagccattgttgaaaaaattgtcaccgaggctgtggaaattgaacaaagatacttcttggacgccttaccagttgctttgctaggtatgaacgctgacttaatgaaccaatacgttgagttcgtcgccgacagactgttggttgctttcggtaacaagaaatactacaaggtcgaaaaccccttcgatttcatggaaaacatctccttggccggtaagaccaacttcttcgaaaagagagtttctgactaccaaaaggctggtgttatgtccaagtcgactaagcaagaagccggtgctttcaccttcaacgaagacttttaa

SEQ ID NO: 45858 - DNA, 1605 bp, Saccharomyces cerevisiae
atgcaagctccagtggtatttatgaatgcttctcaagagagaactaccggtcgtcaggcccaaatctccaatatcactgctgcaaaggcagttgccgatgtcattcgaacttgcttaggtccaaaagctatgttaaagatgttattggatcctatgggcggtcttgtgttgactaacgatggccacgctattttaagggaaattgatgttgcacatccagcagctaaatcaatgttggagttatcccgtactcaagacgaagaggttggtgacgggactacaacagttattattctagctggtgagattttagctcagtgtgcaccttatttgattgaaaaaaatattcaccctgttattattatccaagccttgaagaaagcactgactgatgcactagaagttatcaaacaagtaagtaaacctgtcgatgtggaaaatgatgccgctatgaaaaaattgattcaagcctctatcggtactaaatatgtcatacattggtcagagaaaatgtgtgaattagctctagacgctgttaagactgtccgtaaagacctgggacaaactgtggaaggtgaacctaattttgaaatcgatatcaaaagatatgtccgtgtggagaagattcctgggggggatgttctagattctcgcgtcttaaagggtgtcttattgaacaaggatgttgttcatccaaagatgtcccgtcacatagagaatccacgtgttgttcttttggattgtccactagaatataagaagggtgaatctcaaaccaacatagaaattgaaaaggaggaagattggaataggattttacaaatcgaggaagaacaagttcagctaatgtgtgaacaaattttagccgttaggccaacactagtcatcactgaaaaaggtgtttcagatctagcacagcattatttactaaagggtggatgtagtgttttaagaagagtgaagaaatcagacaataatagaattgctcgtgtaactggtgcaaccattgtcaatcgtgtagaggacttgaaggaaagtgatgtcggtacaaactgtggattattcaaagtagaaatgattggggacgaatatttctcatttttggataactgcaaggaaccaaaagcttgtaccataatgttacgtggtggttccaaagatatattaaacgaaatagatcgtaacctacaagatgctatggctgttgctcgtaatgtgatgttgagtccttccttgtccccaggtggtggtgccaccgagatggcagtttctgtcaaattagcagaaaaggcaaagcaattagaagggatccagcaatggccataccaagctgtagctgatgctatggagtgtattccacgtactttgatacaaaatgcaggtggtgatcctattagactcctatcccaactaagagccaaacacgcacagggaaattttacaacaggtattgatggtgacaaggggaaaattgtagatatggttagttacggtatttgggaacctgaagtcatcaagcagcaaagtgtcaaaaccgctattgaaagtgcatgtttactattaagggttgatgatattgttagtggtgtaagaaaacaagaataa

SEQ ID NO: 45859 - DNA, 1548 bp, Saccharomyces cerevisiae
atgaaagcgtacgcaaagaaacgtatctcttacatgccatcgtcaccatcacaaaatgttattaactttgaagaaatcgaaactcaaaaagaaaacattcttcccctgaaggaaggcagatcagcagcggcactctcgaaagcgatacatcaaccactggtggaaataaaccaagttaaatcaagcttcgaacaaagactgatagatgagctccctgcattaagcgacccaattactttgtatcttgaatacataaagtggctgaacaacgcctatccacaaggcggtaattccaaacaatctggaatgctcacccttttggagcgatgtttatctcacttaaaggatttggagagatatcgcaatgatgttaggtttcttaaaatatggttttggtacatagaactttttaccagaaattcattcatggaaagcagagacattttcatgtatatgttaagaaatggaattggttccgagttagcgtcattttatgaagaatttacgaatctattaattcagaaagaaaaatttcaatatgccgtgaaaattctacagctaggaatcaaaaataaggctaggcctaataaggttttagaagaccggttaaaccatctcctgagagaactgggggagaacaatattcagctaggaaatgaaatatcgatggactcattagagtctacagtacttgggaaaaccagatctgaatttgtcaatagactagagcttgcaaatcaaaatggcacatcaagtgacgtcaatttaacaaaaaacaacgtatttgtagatggagaagagtctgatgtagaactattcgaaactccgaatagaggtgtttatagagatggctgggaaaattttgacttaaaggcagaaaggaacaaagaaaacaaccttcgaatatcattgctagaagcaaataccaatttgggtgagcttaaacaacatgagatgttatcgcaaaaaaagagaccatatgatgaaaaactaccgatctttagagattctataggtagaagtgaccctgtttatcaaatgattaatacaaaggaccagaaaccagaaaaaattgactgtaattttaaactgatttattgtgaagatgaggaatctaaaggtggtagactagaattttcgctagaagaagtcttggcaatttctagaaacgtttataaaagggttaggacaaataggaaacatccaagagaagcaaatttagggcaagaagaaagcgcaaatcaaaaagaagctgaagcacaatcgaaaagaccaaaaataagtagaaaagccttagtctccaagtcgttgaccccctcaaaccagggaagaatgttttctggcgaagagtacataaactgccctatgacgccaaagggacgaagcactgagacgtctgatatcatctcagctgtcaagccgcggcagttaaccccaattttagaaatgagagaatcaaattctttttctcaaagcaaaaattctgagatcatttcagatgatgacaagtcgagttcgtctttcatatcgtacccaccacagcgttga

SEQ ID NO: 45860 - DNA, 1707 bp, Saccharomyces cerevisiae
atgtcacttagattgccacaaaatcccaacgcgggattgtttaaacaaggctacaatagttactctaacgccgatggccaaattattaaatcaattgcggccattcgcgaattacatcaaatgtgtttgacttctatgggaccctgcggtagaaacaagatcattgttaaccatctcggtaaaatcattattaccaacgacgcggccaccatgctaagagaactagatattgtccatcctgcagtgaaagtcctcgtaatggcgactgaacaacagaagatcgacatgggagacggtacaaatttagtcatgattttggctggcgaactattaaatgtgtccgaaaaactgatttcaatgggcttgtctgccgttgagattattcaaggttataatatggcaaggaagtttactttgaaagaactagacgaaatggttgttggtgaaattactgacaagaatgataaaaacgaacttttgaaaatgattaaaccagtcatctcctccaaaaagtacggatctgaagacatattgagtgaacttgtttctgaagctgtatctcacgttttaccagttgctcagcaagctggagaaattccttattttaatgttgattctatcagagtagtaaagattatgggtggatcgctttccaattctaccgtcatcaaaggtatggttttcaatcgtgagcctgaaggccatgtaaaatcattatccgaagataaaaagcataaagttgcagttttcacttgtccgcttgacatagccaatactgaaacgaaaggcactgttttattacataatgcacaagaaatgctcgatttttctaagggcgaggaaaagcaaatagatgccatgatgaaagagattgccgacatgggcgtagaatgcattgttgcaggtgctggtgttggtgaattggcgttacattatttgaatagatacggtatactagtcttgaaggtaccaagcaaattcgaattaagaagattatgtcgcgtttgtggggccactccattgcctagattaggtgcgccaactccagaagaattaggtttagtggaaactgttaagacaatggagataggtggtgatagagtaactgtgttcaaacaagagcaaggtgaaatttcaagaacatctactatcattttaagaggtgccacacagaataatttggatgatattgaaagagccattgatgatggtgttgcagccgtcaagggactaatgaagccatcaggcggtaagttgttgcctggtgctggtgctaccgaaattgaattgatttctaggataactaagtatggtgaacgaacacctggattgctacagttagctataaaacagtttgccgtggcttttgaagtggttcctcgtaccctagcggagaccgctggtcttgatgttaatgaggtactaccaaacttatacgctgcacataacgtaactgaacctggtgcagttaagacagatcatttatataaaggtgtggatattgatggcgaatctgatgaaggtgtaaaggacatcagagaggaaaatatttatgacatgcttgcaacgaaaaagtttgctattaacgtcgctacagaagctgcaactactgtgctttccattgaccaaattatcatggcaaagaaggcgggtggtccaagagcacctcaaggcccaaggccaggtaactgggaccaagaagactga

SEQ ID NO: 45861 - DNA, 972 bp, Saccharomyces cerevisiae
atgcctagcacgtttgaatcccagctttttttttcgagaccgtttctgtctaaaaggcaaattcaaagagcccaaaagaatacaatatcggactatcgaaattacaaccagaaaaaacttgccgtgttcaaatttctaagtgacttgtgtgttcagctgaaatttccacggaagactttagaaacagcagtatacttttaccaaagataccacctctttaatcgcttcgagaccgaggtttgctacactgtagcgacaagctgcctgactttgggctgtaaagaagttgagacaattaaaaaaacaaatgatatatgtactttgtcattacgattgaggaatgtggttaaaatcaatacggacattttggaaaattttaaaaaaagggtatttcaaatagaacttcggatattagagtcatgctcattcgattatagagtcaacaattacgttcatattgatgaatatgttataaaaattggtagggagctatcctttgattataagttgtgcaatctggcttgggtaattgcttatgatgctttgaagctagaaactattttagtcataccccaacattccattgcattggccattttgaaaatagcatatgaattactagataataagaattggtcaagtaaaaggtattctttatttgaaacagacgagaaatccgtaaatgaagcttattttgatatagtcaatttttacatcaattcattcgatatgtgcgatctacaacgtcatttaccggctgatttgctgccgattggcgttgaaaggtttatggaactgaaaaaaaacgcaggaccagaatctggattgccgcaaataccagatcacctgttgaatgccgatccttatatcactattactagagataataatgtccaagaaagaagatatgtactttcactggagctaattaatggcgagtccagcataaatagttctacaagacatgcatag

SEQ ID NO: 45862 - DNA, 6081 bp, Saccharomyces cerevisiae
atgtcatcaaaacctgatactggttcggaaatttctggccctcagcgacaggaagaacaagaacaacagatagagcagagctcacctacggaagcaaacgatagaagcattcatgatgaggtaccaaaagtcaagaagcgtcacgaacaaaatagtggtcacaaatcaagaaggaatagcgcatatagttattacagcccacggtcgctttctatgaccaaaagcagggagagtatcactccaaatggtatggatgatgtaagtatttcgaacgtggaacatccaaggccgacagaaccgaaaatcaaaaggggtccatatttactgaagaaaacattgagcagtctttcaatgacgagcgcgaatagtactcatgatgataataaagaccacggttacgctttgaattcatccaagacgcacaactacacatctactcataaccatcatgacggtcatcatgatcatcatcatgttcagttttttcccaataggaagccatcattagcggaaaccctattcaaaaggttttcagggtcaaacagtcacgatggcaataagtcaggaaaggaaagtaaagttgctaacctttccctttcaacggtaaatcctgcacctgctaataggaaaccttctaaagactccactttatctaatcacttggctgataacgtgccaagcactttacgaaggaaagtgtcctcattggtacgtggttcttccgtccatgatataaataatggtattgcagataaacagattagaccaaaggctgttgcgcaatcagaaaatacattacattcatccgatgttcccaatagcaaacgctcgcacagaaaaagctttctgctaggctccacatcttcttcaagcagtagaagaggttcaaatgtcagttcaatgactaacagtgacagtgcaagtatggcgacgtcgggtagtcatgttctccaacataacgtatctaatgtttctccaactactaaaagtaaggacagcgttaacagcgaatccgccgatcacactaataataaatccgagaaagtgactccagaatataatgagaacattccggaaaattctaactctgacaacaaacgcgaagccacaacgcctactatagaaacacccatttcatgtaaaccatcccttttcaggctagatacaaaccttgaggatgttactgatattacaaagacggtgccacccaccgctgtcaattctacactaaattctacacacgggactgagactgcctcacccaaaacggtgatcatgcctgaaggtcctaggaagtcggtgtcaatggctgatctctccgtcgctgccgcagcacctaatggtgaattcacatcaacttccaatgatagatcacaatgggtagcacctcaaagctgggatgtggaaaccaaaaggaaaaaaacaaaacctaaagggagatcgaaatcaagaaggtcaagtatagatgctgatgaacttgatcccatgtcaccggggccaccttcaaaaaaagactctcgtcatcatcacgatcgaaaggataacgaatcaatggtcactgcgggtgacagtaactcaagttttgttgatatatgtaaagaaaacgttccgaatgatagcaagaccgcactcgatactaaatctgtgaaccgcttaaaaagtaatttggctatgagtcccccaagtatacgatatgctccatcaaatttagatggggactacgacacgtcttccacttcctcatctttaccgtcctcatctattagttcagaagatacatcttcctgcagcgattcctcttcgtacactaacgcgtatatggaggccaaccgagagcaggataataaaacaccgatcctgaataaaacgaaatcgtataccaagaaatttacatcctcttcggtaaatatgaattcaccagatggtgcccagagttctggattattactacaagatgagaaggacgatgaggtcgagtgccaactggaacattactataaagatttcagtgatttagatccaaagaggcactatgctattcgtatattcaatactgatgacacttttacgactctctcatgtactccagcgactaccgtcgaagagataatacctgcacttaaaagaaaatttaacattacagcgcaagggaattttcaaatttccctgaaggtgggaaagttgtcaaaaattttgagaccaacttcgaaacctattttaattgaaagaaaacttttacttttgaatggttatcgaaagtcagacccacttcatattatgggtatagaggatttaagttttgtttttaagtttcttttccatcctgtcacaccttctcactttactcctgaacaagaacaaagaataatgagaagcgaatttgttcacgtagatttaaggaatatggatctgactacacctcccatcattttttaccagcatacgtcagaaatagaaagtttagacgtttctaataacgcaaatatattcctacctctggagttcattgaaagctcgattaaattattaagtttgagaatggttaatattagagcatctaaatttccttccaatatcactaaggcgtataaactagtatctttggaattacagagaaacttcataagaaaagtaccgaactcaatcatgaaactgagtaatttaacgatattaaaccttcaatgtaatgagcttgaaagcctaccggctggatttgttgaactgaaaaatctgcaattgctagacttgtcttcaaacaagttcatgcactacccagaagttattaactactgcaccaatcttttacaaatagacctatcatataataaaatccaaagcttaccacagtccactaagtacctagtaaagcttgcgaagatgaacctttctcataacaaactaaattttataggcgacttatcggaaatgacagatttgaggacgctgaacctaagatataacagaatatcatcaattaagacaaatgcgtctaacttgcagaacctttttttaacagataatagaatttcgaactttgaagacactttgccgaaactaagagcccttgaaattcaagagaatccaatcacttctatatccttcaaagatttttatccaaaaaacatgacaagtttgacgttgaacaaggcacagttatcgagtattcctggagaattactcaccaaactatctttcctcgagaaacttgaacttaatcagaataatttgactagactgccacaggagatatccaagttgactaaattagttttcctttcagtggcgagaaacaaactagagtatattccacccgagctatctcaactgaaaagtttgaggacattagatctacattctaacaacataagggactttgttgacggtatggaaaaccttgaactaacatcgctaaatatttcatcgaatgcattcggtaactctagcttagaaaattctttttaccataacatgtcatatgggtcaaagttatctaaaagcctgatgttttttattgctgcagacaatcaatttgatgatgctatgtggcctcttttcaattgctttgtcaatctgaaagtgctaaatctttcttacaacaatttttcagatgtatcgcacatgaaacttgagagcattaccgaattgtacctctccggtaataagctcacgacattgtcgggtgatacagttttgaaatggagctctttaaagactttaatgttgaatagtaaccaaatgttatctctgcctgcagaattatcaaatctctcacagctaagtgtatttgatgttggagcaaatcaattaaagtataatatatcaaactatcattacgattggaactggaggaataataaagaactaaaatatttgaatttttcaggaaatcgaaggtttgaaataaagtcatttataagtcacgatattgatgctgatttgtcagatctgacagtattacctcagttaaaggtactaggtttaatggacgtaactttaaatactaccaaagtaccggatgaaaatgtcaatttccgtttaaggacaactgcatcaataataaatgggatgcgctacggtgttgctgatacattaggtcaaagagactatgtgtcatctcgtgatgttacctttgaaagattccgcggaaatgacgacgaatgcttactatgtcttcatgatagtaaaaaccaaaatgcagattatggccacaatatatcaagaattgttagagatatttacgataaaatactgatcagacaactggaaaggtatggagacgaaacagatgataatataaaaactgcacttcgtttcagttttttgcaactgaataaggagattaacggaatgctaaattctgttgataatggtgccgatgttgccaatctttcatatgcagacttgctaagtggcgcttgctctactgtgatatatatcagagggaagaaactcttcgctgcaaatttaggtgactgtatggctattttatccaaaaacaatggtgactaccaaacgctaaccaaacaacatctcccaacaaagcgggaagaatacgagaggatcagaatatctggcgggtatgtcaacaatggaaaattagatggtgttgtagatgtgtctagagcagtgggtttttttgatttgcttccccacattcatgcttctcccgacatatctgtcgtgacattaacaaaagcagacgagatgcttattgtagcaacgcataagttatgggaatacatggacgtggatacagtttgtgatatcgcgcgtgagaatagtactgatccactccgtgccgcagctgagttgaaggatcatgccatggcttacggctgtacagagaatattacaattttgtgccttgctctttacgagaacattcagcaacaaaatcggttcactttaaataaaaactctttaatgactagaagaagtactttcgaggatactacattaagaagacttcaacctgagatttctccgccaacaggtaacctagcaatggtcttcactgatatcaaaagctcaaccttcttatgggagctattccctaacgcaatgaggaccgcaataaaaactcacaatgacattatgcgtcgtcaactacgaatttacggtggttacgaagtaaagacagaaggagacgcctttatggtggcatttcctacgccaactagtggtctgacatggtgcttaagtgttcaattaaaactcttggatgcacaatggccggaggaaattacctcagttcaagacggctgccaagttacggatagaaatggtaacattatctatcaaggcctatcagttagaatgggtattcattggggctgcccagttccagagcttgatttagtgactcaaagaatggactatttggggccgatggtcaataaggcagcaagggtccagggcgtcgctgacggtggtcagattgcaatgagtagtgatttttactctgaattcaacaagataatgaagtatcatgagcgagtagtgaagggcaaggaatctctcaaggaagtttatggtgaagaaattatcggagaggttcttgaaagagaaattgccatgctggaaagtattggttgggcattttttgactttggcgagcataagctaaagggactcgaaaccaaagaactcgttactattgcgtatcctaagattcttgcttccagacacgaatttgcatctgaagatgagcagtcaaaattaatcaatgaaacgatgttgtttcgtttaagagtcatttcaaacagactggaatctataatgtcagctttaagcggcggatttattgaactagactctcggacggagggaagttatattaaatttaaccctaaagttgaaaatggtattatgcaatcgatttctgagaaggatgcgttgttattttttgatcatgtaattactagaatcgaatccagtgtggcattattacatttacgacaacagaggtgttcaggactggaaatttgcagaaacgataaaacatctgctcgaagcaatattttcaatgttgttgacgaacttttacaaatggttaagaacgcaaaggatttatcaacttga

SEQ ID NO: 45863 - DNA, 582 bp, Saccharomyces cerevisiae
atggccgtgacatttaaggatggtgtgatactaggtgctgattcacgtaccaccactggtgcgtacatagctaaccgtgtgacagataaattaacgagagtacatgacaaaatttggtgttgtaggtccggttctgcagcagacacgcaggcgattgccgacattgttcagtaccatttggaattatatacttctcaatatggtaccccctccacagagactgctgcctcggtgttcaaagaattatgttacgaaaataaagataaccttactgctggtataattgtggctggttatgatgacaaaaacaaaggggaagtatatactattccattgggtggctccgtccataagctgccttatgcgatagcaggatctggctctactttcatatatgggtattgtgataaaaactttagagaaaatatgtcaaaggaagaaaccgtagatttcataaagcattcgctatcgcaagccattaaatgggacggatcttccggtggtgttataagaatggttgttttgacagctgctggtgtggaacgtttgatattctaccctgatgaatatgaacaactataa

SEQ ID NO: 45864 - DNA, 1953 bp, Saccharomyces cerevisiae
atgttcacttttctcaaaattattctgtggcttttttccttggcattggcctctgctataaatatcaacgatatcacattttccaatttagaaattactccactgactgcaaataaacaacctgatcaaggttggactgccacttttgattttagtattgcagatgcgtcttccattagggagggcgatgaattcacattatcaatgccacatgtttataggattaagctattaaactcatcgcaaacagctactatttccttagcggatggtactgaggctttcaaatgctatgtttcgcaacaggctgcatacttgtatgaaaatactactttcacatgtactgctcaaaatgacctgtcctcctataatacgattgatggatccataacattttcgctaaattttagtgatggtggttccagctatgaatatgagttagaaaacgctaagtttttcaaatctgggccaatgcttgttaaacttggtaatcaaatgtcagatgtggtgaatttcgatcctgctgcttttacagagaatgtttttcactctgggcgttcaactggttacggttcttttgaaagttatcatttgggtatgtattgtccaaacggatatttcctgggtggtactgagaagattgattacgacagttccaataacaatgtcgatttggattgttcttcagttcaggtttattcatccaatgattttaatgattggtggttcccgcaaagttacaatgataccaatgctgacgtcacttgttttggtagtaatctgtggattacacttgacgaaaaactatatgatggggaaatgttatgggttaatgcattacaatctctacccgctaatgtaaacacaatagatcatgcgttagaatttcaatacacatgccttgataccatagcaaatactacgtacgctacgcaattctcgactactagggaatttattgtttatcagggtcggaacctcggtacagctagcgccaaaagctcttttatctcaaccactactactgatttaacaagtataaacactagtgcgtattccactggatccatttccacagtagaaacaggcaatcgaactacatcagaagtgatcagccatgtggtgactaccagcacaaaactgtctccaactgctactaccagcctgacaattgcacaaaccagtatctattctactgactcaaatatcacagtaggaacagatattcacaccacatcagaagtgattagtgatgtggaaaccattagcagagaaacagcttcgaccgttgtagccgctccaacctcaacaactggatggacaggcgctatgaatacttacatctcgcaatttacatcctcttctttcgcaacaatcaacagcacaccaataatctcttcatcagcagtatttgaaacctcagatgcttcaattgtcaatgtgcacactgaaaatatcacgaatactgctgctgttccatctgaagagcccacttttgtaaatgccacgagaaactccttaaattccttctgcagcagcaaacagccatccagtccctcatcttatacgtcttccccactcgtatcgtccctctccgtaagcaaaacattactaagcaccagttttacgccttctgtgccaacatctaatacatatatcaaaacgaaaaatacgggttactttgagcacacggctttgacaacatcttcagttggccttaattcttttagtgaaacagcagtctcatctcagggaacgaaaattgacacctttttagtgtcatccttgatcgcatatccttcttctgcatcaggaagccaattgtccggtatccaacagaatttcacatcaacttctctcatgatttcaacctatgaaggtaaagcgtctatatttttctcagctgagctcggttcgatcatttttctgcttttgtcgtacctgctattctaa

SEQ ID NO: 45865 - DNA, 1464 bp, Saccharomyces cerevisiae
atggacgcattgttaacaaagttcaacgaggatagaagtctccaagatgaaaacttgtcccaaccacgaacgagagtaagaattgttgacgacaatctttacaacaaatcgaatccattccaactatgctataaaaaacgtgactacggttctcagtactaccacatttatcaataccgtctaaagactttcagagaacgcgtcttaaaagaatgtgacaagagatgggatgcgggctttaccttgaatggccaattagttctaaaaaaggacaaagtgttagatattcagggaaaccaaccatgttggtgcgtaggatccatatattgcgagatgaaatataaaccaaacgtactggacgaagtgatcaatgatacatatggtgcaccagatttaactaaaagttatactgataaagagggtggttctgatgaaattatgctcgaagatgaaagtgggagagtgcttctagtgggagattttattcggtctacacccttcatcacgggtgttgttgtaggtatactgggtatggaagctgaagccgggacatttcaagttttagacatatgctaccccactcctttaccacaaaatcctttccctgcaccaattgctacctgccccaccaggggaaaaattgctcttgtttctgggttaaacctcaataatacatcacctgataggctattgagattggagattttgagagaatttttgatggggagaatcaataacaaaattgacgacatttctctaattggtagattactgatatgcggcaactctgttgacttcgacattaaaagcgtgaacaaagacgaattgatgatttctctaactgagttcagtaaatttctacacaacattttgccatctatatctgttgatattatgcccggaaccaatgatccaagtgacaaatctctaccgcaacagcctttccacaaatcattgtttgataagtccctagaatcatacttcaacggttctaacaaagaaattttgaatttagtgaccaacccatatgagtttagctataatggcgtagacgttctagccgtttcaggcaaaaatatcaatgatatttgtaaatacgtaataccatcaaatgataacggagaaagtgaaaacaaggtcgaggagggcgagagtaatgatttcaaagacgatatagagcatcgcctggaccttatggaatgtacaatgaaatggcaaaacatcgcgcccaccgcacctgataccttatggtgttatccgtacactgataaggatccatttgtattggataagtggccccacgtttacattgtggcaaaccagccatattttggaacaagagtagtggaaataggtggtaagaacataaagataatatctgtccctgaattcagttctactgggatgataatattactggatttggaaacgttagaagcagagacggtcaagattgacatttaa

SEQ ID NO: 45866 - DNA, 915 bp, Saccharomyces cerevisiae
atgtccacttctcattgcagattttatgaaaacaaatacccagaaattgacgatatcgtcatggttaacgtccagcagattgctgaaatgggtgcttatgttaaattgttagaatatgacaacattgaaggtatgattctactaagtgaattgtcccgtagacgtattaggtcaatccaaaaattaattcgtgttggtaaaaatgatgtcgccgttgttcttcgtgtcgacaaagaaaaaggttatattgatttgtccaaacgtcgtgtttcttctgaagatatcattaaatgtgaagaaaaataccaaaaatctaagactgttcattccattttaagatactgtgccgaaaaattccaaatccctttggaagaactatataagaccattgcttggccattaagtcgaaaatttggtcacgcttacgaagctttcaaactatccatcattgacgaaactgtttgggaaggtattgaaccgccatcaaaagatgttttagatgaattaaagaactatatctccaagagattaacaccacaagctgtaaagattagagccgatgttgaagtgtcttgttttagttacgaaggtatcgatgccattaaagacgcattaaaatcagctgaagacatgtccacagaacaaatgcaagttaaagttaaattagtcgccgccccattatatgttttgaccacccaagccttggataagcaaaaaggtattgaacaactggaaagcgctattgaaaaaattacagaggttattacaaaatacggcggtgtttgcaacattaccatgccaccaaaggctgtcactgctactgaagacgctgagttacaagctctattagaaagcaaagaattagataatagatctgactctgaagacgatgaggatgagtcagacgacgagtaa

SEQ ID NO: 45867 - DNA, 999 bp, Saccharomyces cerevisiae
atggttagagttgctattaacggtttcggtagaatcggtagattggttatgagaattgctttgcaaagaaagaacgtcgaagttgttgctttgaacgatcctttcatctctaacgactactccgcttacatgttcaagtacgactctactcacggtagatacgctggtgaagtttcccacgatgacaagcacatcatcgttgatggtcacaagatcgccactttccaagaaagagacccagctaacttgccatgggcttctctaaacattgacatcgccattgactccactggtgttttcaaggaattggacactgctcaaaagcacattgacgctggtgccaagaaggttgtcatcactgctccatcttccaccgccccaatgttcgtcatgggtgttaacgaagaaaaatacacttctgacttgaagattgtttccaacgcttcttgtaccaccaactgtttggctccattggccaaggttatcaacgatgctttcggtattgaagaaggtttgatgaccactgttcactccatgaccgccacccaaaagactgttgacggtccatcccacaaggactggagaggtggtagaaccgcttccggtaacatcatcccatcctctaccggtgctgctaaggctgtcggtaaggtcttgccagaattgcaaggtaagttgaccggtatggctttcagagtcccaaccgtcgatgtttccgttgttgacttgactgtcaagttgaacaaggaaaccacctacgatgaaatcaagaaggttgtcaaggctgccgctgaaggtaagttgaagggtgtcttgggttacactgaagacgctgttgtctcctctgacttcttgggtgactctaactcttccatcttcgatgctgccgctggtatccaattgtctccaaagttcgtcaagttggtttcctggtacgacaacgaatacggttactctaccagagttgtcgacttggttgaacacgttgccaaggcttaa

SEQ ID NO: 45868 - DNA, 1536 bp, Saccharomyces cerevisiae
atgcctgctcctcacggtggtattctacaagacttgattgctagagatgcgttaaagaagaatgaattgttatctgaagcgcaatcttcggacattttagtatggaacttgactcctagacaactatgtgatattgaattgattctaaatggtgggttttctcctctgactgggtttttgaacgaaaacgattactcctctgttgttacagattcgagattagcagacggcacattgtggaccatccctattacattagatgttgatgaagcatttgctaaccaaattaaaccagacacaagaattgcccttttccaagatgatgaaattcctattgctatacttactgtccaggatgtttacaagccaaacaaaactatcgaagccgaaaaagtcttcagaggtgacccagaacatccagccattagctatttatttaacgttgccggtgattattacgtcggcggttctttagaagcgattcaattacctcaacattatgactatccaggtttgcgtaagacacctgcccaactaagacttgaattccaatcaagacaatgggaccgtgtcgtagctttccaaactcgtaatccaatgcatagagcccacagggagttgactgtgagagccgccagagaagctaatgctaaggtgctgatccatccagttgttggactaaccaaaccaggtgatatagaccatcacactcgtgttcgtgtctaccaggaaattattaagcgttatcctaatggtattgctttcttatccctgttgccattagcaatgagaatgagtggtgatagagaagccgtatggcatgctattattagaaagaattatggtgcctcccacttcattgttggtagagaccatgcgggcccaggtaagaactccaagggtgttgatttctacggtccatacgatgctcaagaattggtcgaatcctacaagcatgaactggacattgaagttgttccattcagaatggtcacttatttgccagacgaagaccgttatgctccaattgatcaaattgacaccacaaagacgagaaccttgaacatttcaggtacagagttgagacgccgtttaagagttggtggtgagattcctgaatggttctcatatcctgaagtggttaaaatcctaagagaatccaacccaccaagaccaaaacaaggtttttcaattgttttaggtaattcattaaccgtttctcgtgagcaattatccattgctttgttgtcaacattcttgcaattcggtggtggcaggtattacaagatctttgaacacaataataagacagagttactatctttgattcaagatttcattggttctggtagtggactaattattccaaatcaatgggaagatgacaaggactctgttgttggcaagcaaaacgtttacttattagatacctcaagctcagccgatattcagctagagtcagcggatgaacctatttcacatattgtacaaaaagttgtcctattcttggaagacaatggcttttttgtattttaa

SEQ ID NO: 45869 - DNA, 960 bp, Saccharomyces cerevisiae
atggtcgctagaggtagaacagacgagatatctacagatgtttcagaggctaattctgaacactcgttgatgattacagaaacatcatcaccgttcagatctatattctcccacagtgggaaagtagcgaatgcaggcgctttagaggaatcggacaagcagatactggaatgggcaggtaaactggaattggagagtatggagctgagggaaaactctgacaagctaattaaagttttaaatgaaaattctaagacattatgtaaatcgctaaacaagtttaaccagctactggaacaagatgctgctacgaacggttcgtaccaacacagtgcataccctcaagttttttattcattttcttccaaaacacatttactaacaactgtagtataggaaacgtgaaaaccttaataaaggatttggcttcccagattgaaaaccaactggacaaagtgtcaacagcaatgttatcgaaaggcgacgagaagaagacaaagtcggattccagctacaggcaggtattagtcgaagaaataagcaggtataattccaagataacgcgacacgtaactaacaagcagcatgagacggaaaagtcgatgaggtgcacccaggagatgctcttcaacgtcggcagccaactggaggacgtgcataaagtgctcctgtctctatccaaagacatgcacagtctacaaacccgccagactgctctagagatggcgtttcgagaaaaggcagatcacgcctacgatcgcccggatgtgtctctgaatggcaccacactcctgcacgatatggacgaagcccacgataagcagcgtaagaagtccgtgccgccaccaagaatgatggtcacaaggtccatgaaacgcagaagatccagctccccaaccctatccaccagccaaaaccacaatagcgaagacaatgatgacgctagccatcggctgaagc

SEQ ID NO: 45870 - DNA, 4227 bp, Saccharomyces cerevisiae
atgcacgacgtgccaatggaaactgttttggccgtgaacccagctacgatgattgtcaaagagtgcatcaatctttgttctgccatgaacaagcagtccagagataaatcacaaacaagtgtggccgcgttgctgggcggaggtagtgatatattcttgagtcaaagtgattcgtttgttgacagcttccacaatttgcctacttctagctatcatgatcctctgatatctggtttagtacagctgcggctaaaaattaacgacttgaagggtttagattcattaaacgccttggaacttttgaaaccatttttagaaatagtcagcgctagttcagtatcgggttatactacttctctggctctggactcgttgcagaaagtttttacactaaaaatcataaacaaaacatttaatgatattcaaattgccgttagggaaaccgttgttgcgcttacacattgtagatttgaagcttcaaagcaaatttcggacgactctgttttattaaaagttgtaacattactacgcgatattataacctcttcctttggagactatctctccgatactataatctacgatgttttacaaacgacactttccttggcatgtaatacgcagagaagcgaggttttgaggaaaacggctgaagttacaattgcagggataaccgttaaactatttacaaagttgaagttactagatccacctacaaaaacagaaaaatatatcaatgatgaaagttacaccgacaataatttgaaggatgacattataggtacgactacctctgataacgatttgagtagcactgatgatgacagtgctgttgcagacgataataaaaatgagaagccagtccaacaggtcataagggaacaggaaaatgatgaggaaacggctgagaaagccgaaaatgtcgagccaaattacggaataacagttataaaggattatcttggattattgttatcactggttatgccagagaatagaatgaagcacacaacttcggccatgaaattatctctacagttaatcaatgcagccattgaaatatccggtgacaaatttcctctatatccccggttattcagcttaatttctgatccaatatttaaaagtgttttattcattatacaaagttctacccagtattctcttttgcaagcaactttacaattattcacgagtttggttgtgatattgggtgattatttgcctatgcagattgaactgactttaaggagaatattcgaaattctagaggataccacaatcagtggtgacgttagtaagcaaaaaccacctgcaatcagggaattaattattgaacaactttcaatactgtggattcactctcccgctttctttttgcaactttttgtaaatttcgattgtaatttggataggtcggatctttcgattgactttataaaagagctaactaaattttctttaccagcggcggccgttaatacctctaacaacattcctccaatttgcctagaaggtgtactttcgcttattgaaaatatatacaatgatctgcagagatttgatagggcagaattcgtaaaaaatcagaaagaaattgatattttgaaacagagagacagaaagactgaattcatattatgcgttgaaacatttaatgaaaaggcaaagaaaggcattcaaatgttaattgaaaaaggattcattgattcggattctaatagagacattgcttcatttttgtttctcaataacggacgtttaaataagaaaaccatcggtctattactttgtgatccgaaaaaaacttcattgttaaaagaatttatagatctattcgattttaaagggttaagggttgatgaagcgatcagaattttgctgacgaaattcagattaccaggggaatctcaacagattgaaagaatcgttgaagcattttcatcaaaatattctgctgatcaaagcaatgataaagtggagttagaggataaaaaagcaggaaaaaatggctcagagtcaatgacagaagatgacatcattcatgtacagcctgatgcagactctgtgtttgtgttaagttattcgataatcatgttaaataccgattcacataacccgcaggttaaagaccatatgacttttgatgactactctaacaatttacgaggatgctacaatggaaaagattttcctcgttggtatttgcataaaatttacacgtccatcaaagttaaggaaatagtaatgcctgaagaacatcatggaaatgaaaggtggtttgaagatgcctggaataacttaatatcctcaacatctgtgatgacagagatgcaaagagatttcacaaaccctatttctaagttagcgcaaatagacatacttcagtatgagaaagcaattttctcaaatgttagagatattatcctgaagactttattcaaaatattcacagttgcttccagtgatcaaatatcattacgtatcttggacgccattagtaagtgtacatttatcaactattacttttcttttgaccagtcatataatgatactgtacttcatctgggagaaatgacaacattggcacaaagtagcgcaaaagcggtggagctagatgttgacagtattcctttggtcgagatattcgtcgaagacactgggtcgaagatatccgttagtaaccagagtataagacttggacaaaactttaaggctcagttatgtaccgtattgtactttcaaatcattaaagaaataagtgatcctagcattgtttctaccagactatggaaccagattgtgcaactcattttgaaattattcgagaatttattgatggaacctaatttaccattttttacaaactttcattcactcttgaaacttcctgaactaccattgccagatccagatatatcgatccgcaaggcaaagatgagcagaagccttctgtctactttcgcctcttacttgaaaggcgatgaagaaccttcggaagaagacatcgatttttccattaaagcatttgagtgcgttaaggctagccatcctctcagttcagtctttgagaacaatcaactcgtcagtcctaagatgattgaaactcttctctcttcacttgtgattgaaaaaacgagtgaaaattcgccctatttcgaacaagaacttctctttttgttggaaatatccattatattaatatcagaggcttcttatggacaagaatttggagcactaattgctgatcatatgattaatatttcgaatttagatggcctttccaaggaggctattgcaagacttgcctcgtataaaatgtttttggtttcgagatttgataatccacgggacattttaagtgatttaatagaacacgactttttggtaaaaaatgaaatcttcaatactaaatattatgaaagtgaatgggggaagcaagtaataaatgatctgtttacacatctcaatgacgtaaaatacaatgagcgggctctcaaaaatgtaaaattttggaattttttaaggatattaatatcagccaaagaccgccaatttgccgtctacacatttttggaaaaatacattcaaaatggtgatatctttgtagatgatgggaactttatgaacatattaagtctgcttgatgaaatgtcatgtgcaggtgccgttggcacaaaatgggaacaaaattatgaaaattcagtcgaggatgggtgtgaagcacctgaatccaatccataccgttctattattgatctttctagtcgttccattaatataactgcagacctactttcgactgttgggaggagtaattcagcactcaacaagaatgagattatagctgctattcaaggtctcgcccatcaatgcctcaatccctgtgacgaactaggtatgcaagcattgcaagcattagagaacattctgttatctcgagcaagtcaactacgtacggaaaaagttgcggtggataacctactagagacaggattattaccgatttttgagttggatgaaatccaagatgtcaagatgaaacgaattactagcattttatccgttctttctaaaatcttcttgggtcaacttgtggaaggcgtaacaagtaacgaaacttttttgagagtgcttaacgtatttaacaagtatgtagatgatcctacggtggaaaggcagttgcaagagttgattatttctaagagggaaatcgagaaggagtag

SEQ ID NO: 45871 - DNA, 3258 bp, Saccharomyces cerevisiae
atggaagataaagagcagcaagacaatgcgaaacttgaaaacaatgagtcactaaaagatctgggagttaacgtgctttcccaaagcagtttggaggaaaaaatagctaatgatgtaactaactttagcaacctacaatcgctgcagcaagaagagactcgtctagaacggagtaagaccgctctgcaacgttatgtcaataagaagaatcatctcacaaggaagttgaacaataccactaggatatctgttaagcagaatctccgagaccagatcaagaacttacaatcagacgatattgaacgagttctgaaggacatagacgatatccaatcaaggattaaagagttgaaagagcaggtagatcaaggtgctgaaaataaaggttccaaagaggggctgcagagacccggtgaaactgagaaggagtttttaatcaggactggtaagatcactgcatttggacacaaggctggtttcagcttggacactgcaaacagagagtatgccaagaatgacgaacaaaaagatgaggattttgaaatggcaacagaacaaatggtagaaaatttaacggatgaggatgacaatctcagcgatcaagactatcaaatgagtggtaaagagagtgaagatgacgaagaagaagaaaatgacgataaaattctcaaagaactggaagacctgcggttcagaggccaacctggtgaggcgaaggatgatggggacgagttgtattatcaagaaaggttaaaaaaatgggtgaaacaacgttcttgcggtagtcaaaggtcatcggacttgccagaatggcgaagacctcatccgaatattcccgacgcaaaacttaatagccagttcaaaatacccggtgaaatatactcgctgttatttaattaccaaaagacgtgcgttcagtggctctatgagctttaccagcagaactgtggcggtattattggtgacgaaatgggtctgggaaaaacgattcaagttatcgcatttatcgcagcgttgcatcattcaggtctattaacaggccctgtattaattgtctgtcctgcaactgtgatgaagcaatggtgtaatgagttccagcattggtggcctccattgaggacggtcatattgcactcaatgggttcaggaatggcttctgaccaaaaatttaagatggatgaaaacgatctagagaacttgataatgaattcaaagccaagtgatttttcttacgaggattggaagaactcaacaaggacaaagaaggcattggaatcaagctatcatttagataagttgatagataaagtcgttactgatgggcacattttaattaccacgtacgttgggttaagaatacattcagataagctactaaaagttaaatggcagtatgctgttttagatgagggacataagattagaaacccagattcggagatttcattgacttgcaaaaaactgaagacacataataggatcattctttcaggaacaccgatacagaataatttaaccgagctttggtcgctttttgatttcattttccctggtaaattaggaactctacctgtgtttcaacaacagtttgtcatacctataaatattggtggttatgcaaacgcaacaaacatacaagttcagaccggctacaaatgtgctgttgcattgcgtgacttgatttcaccgtacctgttacgtcgtgtgaaagctgatgttgcaaaagatctgccacaaaagaaagaaatggttctcttttgtaagcttacgaaatatcaaagaagcaaatatttggagtttctgcattcttcagatttaaaccaaatacaaaacggtaagagaaatgttctatttggtatcgacattctaaggaaaatatgtaatcaccccgatttacttgacagagatacaaagagacataatccagattacggtgatcctaaaagatccggaaaaatgcaggttgtcaagcaattattattactgtggcataagcagggctataaagccctactcttcactcaatcgagacaaatgctcgatattctagaggagtttatatcaacgaaagatcccgatttatcacatttgaactacctacgaatggatgggacaactaatatcaaagggagacagtcgttagttgaccggtttaacaatgaatctttcgatgtattcttactaaccacaagagttggggggctaggtgttaatttaaccggtgctaatagaattatcatttttgatccagactggaacccatctactgacatgcaagctcgagaaagggcatggaggattgggcagaaaagagaggtatcaatatataggttgatggtaggaggttcaatagaggagaagatttatcatagacaaatattcaaacaattcttaaccaacaggattttgactgatcctaagcagaaacgatttttcaaaattcacgaactccatgatctgttttcactggggggtgaaaacggttattctacagaagaattgaacgaagaagttcaaaaacataccgaaaatttaaaaaattccaaatcagaggaaagtgacgattttgaacaactggtcaacctatctggcgtatctaaactagaaagcttttataacggtaaggaaaaaaaagagaatagtaaaacagaggatgatagattaatcgaagggttgctaggaggagagagcaatttagaaaccgttatgagtcatgattcggttgtcaattcgcacgcgggcagttcttcttcgaatataattacaaaagaggcttccagagtagcgattgaggcggttaatgcgctaaggaaatcgagaaaaaagatcactaagcaatatgaaattgggacacctacttggacaggtaggtttggtaaagcaggtaaaattagaaagagagatccgttgaaaaataaattaactggatcagctgccattttaggcaatattacaaaatcacaaaaagaggcatccaaggaagctcgccaagaaaattacgacgatggtataaccttcgcaagatccaaggaaatcaattccaataccaaaacgctagaaaatattcgggcatatttacagaaacagaataactttttctcatctagtgttagcatacttaacagcattggcgtcagtctttctgataaagaagacgttattaaggttagagcattattaaaaaccatagcacagtttgataaagagcgtaaagggtgggtgcttgatgaagaatttaggaataacaatgcttcatga

SEQ ID NO: 45872 - DNA, 1965 bp, Saccharomyces cerevisiae
atgcttgctgctaaaaacatactaaacaggtcaagcttgtctagctctttccgtattgccacacgtttgcagtcaaccaaggttcaaggttccgtcatcggtatcgatttgggtaccaccaactctgcggttgccattatggaaggtaaagttccaaaaattattgaaaacgccgaaggttccagaactactccttctgtagtagctttcactaaagagggagaacgtttggttggtattccagccaagcgtcaagccgtagtgaacccagaaaacaccctatttgctaccaagcgtttgattggtcgtcgtttcgaagacgctgaagtgcaaagagatatcaagcaagttccatacaagatcgtcaagcactccaacggggatgcttgggttgaggccagaggtcaaacttactcaccagcccaaatcggtgggttcgtcttgaacaagatgaaggaaacagctgaggcctacttgggtaagccagttaagaatgctgttgtcactgtcccagcttatttcaacgactctcaaagacaagctactaaagacgcaggccaaattgttggtttgaacgttttacgtgtcgtcaatgaaccaaccgccgctgccttagcttacggtttggaaaaatccgactctaaagttgttgccgttttcgatttgggtggtggtactttcgatatctccatcttagatattgacaacggtgtttttgaagttaagtccactaacggtgacactcatttgggtggtgaagatttcgacatctatttgttgagagagattgtttctcgtttcaagaccgaaactggtattgatttggaaaatgaccgtatggctatccaaagaattagagaagctgctgaaaaggctaagattgagctatcttctaccgtttccactgaaatcaacctgccatttatcactgctgatgcctcaggtccaaagcatatcaacatgaagttctccagggctcaattcgagactttgacagccccactagttaagagaactgtcgacccagtcaagaaggctttgaaagacgccggtttgtctacttcagacatatctgaagtcttattggtcggtggtatgtccagaatgcctaaggttgtcgaaaccgttaaatctttgtttggtaaggacccatctaaggccgtcaacccagatgaagctgttgccattggtgctgctgtgcaaggtgctgtcttgtccggtgaggttactgacgtcttattattagatgttaccccattgtctctaggtatcgaaactttaggtggtgttttcacaagattgattccaagaaacactactattccaacaaagaaatctcaaatcttctccactgccgctgctggtcaaacttctgttgaaatcagagttttccaaggtgaaagagaattggttagagacaacaaattgattggtaacttcactttagccggtatcccacctgctccaaagggtgtcccacaaatcgaagtcacttttgacatcgatgccgatggtattattaacgtttctgctagagacaaagctacaaacaaagattcttctattactgttgccggttcttctggtttgtccgaaaacgaaattgaacaaatggttaacgacgctgaaaaattcaagtctcaagatgaagctagaaaacaagccatcgaaactgccaacaaggctgaccaattggccaacgatactgaaaactccttgaaagaatttgaaggtaaggttgacaaggctgaagcccaaaaggttagggatcaaatcacttccttgaaggagttggttgctagagtacaaggtggcgaagaggttaacgctgaggagttaaagaccaagaccgaagaattgcaaacttcctcgatgaaattgtttgaacaattatacaagaacgactctaacaacaacaacaacaacaacggcaacaatgccgaatctggtgaaactaagcagtaa

SEQ ID NO: 45873 - DNA, 1506 bp, Saccharomyces cerevisiae
atgattagatctgtgagaagggttttcatttacgtctcaatattcgtattgataatagttttgaaaagaacattaagtggcacagatcaaacgtcaatgaaacaaccagtggtggtcattggctctggtttggcaggcttaaccacaagtaatcgtctcattagtaaatacagaattcctgttgtgcttttggataaggcggcttctattggtgggaattctataaaggcttctagtggtattaatggtgctcacacagacactcaacaaaatttaaaggtaatggacactcccgaattgtttttgaaagatactttgcattcggctaaaggcagaggggttccatcactgatggataagttgactaaggaatccaagagtgctatcaggtggttgcaaacagaattcgatttgaaattagacctccttgcgcaattgggcggtcactctgttccaaggacccatagatcttctggcaaattaccaccaggttttgaaatcgtgcaagcgttatcaaaaaaactaaaggatatctcttccaaagattccaatctcgtgcagattatgctaaacagtgaagtagtggatatcgagcttgataatcaaggtcatgttactggtgtagtatatatggacgagaacggaaaccgtaaaatcatgaagtcacaccatgtcgtgttttgctcaggtggatttggttactctaaggaaatgttgaaagagtactcaccaaatttgattcacttgccaactactaatggcaaacagactacaggtgatggtcaaaaaatcctttcaaagttgggtgccgaattgattgatatggatcaagtgcaggtacaccctaccggcttcattgatccaaatgaccgtgaaaataactggaagtttttggctgcagaggcattgaggggtttaggcggcatcttattgcatcccaccactggaagaaggtttacaaatgaattgagcaccagagatacagtaaccatggaaatacagtctaaatgtccgaaaaatgataatagagcacttttggtaatgagcgacaaagtctacgagaactatacgaataacataaacttttatatgtccaaaaacttaatcaaaaaagtgtcaatcaacgatctgatccgacaatatgacctacaaactacagcttctgaactggtaactgaactgaagagctattccgatgttaatactaaggatacgtttgataggccattgattatcaatgcctttgataaagatatttcgactgaatcaactgtttatgttggggaagttacaccagttgttcatttcacaatgggtggtgtgaaaattaatgagaaatctcaggtaattaagaaaaattcggaaagcgttctatctaatgggatatttgctgctggtgaagtttcgggtggtgttcatggagccaacagattgggtggatctagtttgttagagtgtgttgtctttggaaagacagctgcggataacatagcaaaattgtactga

SEQ ID NO: 45874 - DNA, 1698 bp, Saccharomyces cerevisiae
atgtatcgcagtagaaaccgaccaaaaagaggtggagaaaatgaagttaagggaccaaattctgccttgactcaatttttaagagaagaagggatcagtgctgaaaatatcaaacaaaaatggtaccagcgacagtcgaagaagcaagaagatgcaacagacgaaaaaaaaggtaaagcggaggatgatagctttactgccgagatatctcgagtagttgaagatgaagaaattgatgaaattggaacaggtagtggtaccgagacagaaagagctcaggtttcctacgatgccaggatgaaattagtccctgctgatagtgatgaagaagaatatgaaactagccacatttctgacacgccagtcagtttaagttcggctaatgaccgggaatcattgactaaaaaaaggcaaaatactgcaaaaattatccaaaatcgtcgcagaaagcgtaaaagagcagctgacctattggatagacgcgtcaacaaagtatccagcttacaaagtctttgtattacgaaaattagtgaaaatatatccaagtggcaaaaagaggctgatgaatcatcaaagttggtatttaacaaattgagagatgtccttggtggcgtatcaaccgctaatttgaataatttggcaaaagcactatcgaagaatagggccctgaatgatcatactctgcaacttttcttgaagacagatctaaaaaggttaactttcagcgattgttctaaaatttcatttgatggttacaaaacgctagccattttttcgccacacctaaccgaattatccctacaaatgtgtgggcagttgaaccatgaatcattgctttacattgctgaaaagcttccgaacttgaaatcactgaatttagatggaccatttctgatcaacgaggacacatgggagaagttctttgtaataatgaaaggtagattagaagagttccacatttctaatacgcaccgcttcaccgacaaatcattatctaatttattgatcaactgcggttctaccttggtatccttagggttatccagactagattctatatcaaattacgctttattaccgcagtacctagtcaacgacgaatttcacagtctctgtattgaatatccattcaatgaagaggatgttaacgatgagatcatcataaatctgctaggtcaaatcgggcgcacgttacgtaaattggttttgaatggctgtattgacttgacagattcaatgataatcaatggtctgactgcattcattcctgagaaatgtccattggaggtattgagcttggaagaatcagatcagatcactacagattcactgtcgtactttttcagcaaagtagaactgaataatttgattgaatgcagctttagaagatgtctacaattgggcgatatggcaattatagagctattgcttaacggagcaagagatagtctgagaagcttaaatctcaattcattaaaagagctaactaaggaggcatttgtggcgttagcctgtcctaatctgacgtatcttgatcttggttttgtacgttgtgttgatgactcggtgattcaaatgttgggtgagcaaaatccgaatttaactgtaattgatgttttcggagacaatttggttactgaaaaggccacaatgaggcctggacttacgttgatagggagacagagtgacagtatataa

SEQ ID NO: 45875 - DNA, 651 bp, Saccharomyces cerevisiae
atgatgggtcgtggcaaattaatactgatagaaggattggataggactggtaaaaccacgcaatgtaatattctttacaaaaaattgcaaccaaactgtaaactattgaagttccccgaaaggtctacccgaatcggaggactcataaacgaatatttgacggatgatagtttccaattatcagatcaggcaattcacctcttgttttcggcaaatagatgggaaatagttgacaagataaagaaagatttactagaaggcaagaacattgtcatggacagatatgtttattctggagtggcatattctgccgctaaggggacaaatggaatggatttggattggtgcttgcaacccgatgtagggttgctgaaaccggatttgacattatttttaagcactcaagatgtcgacaataacgccgaaaaatctggatttggtgacgaaagatacgaaactgttaagtttcaagaaaaagtgaagcaaacttttatgaagctattggataaagagataaggaaaggcgatgagtcaatcacgattgtagacgttactaataagggcattcaggaagttgaagcgcttatttggcaaatcgttgagcctgttttgagtacgcatattgatcatgataaattttcgttcttctag

SEQ ID NO: 45876 - DNA, 1689 bp, Saccharomyces cerevisiae
atggctgctcgtccacaacaacctcctatggaaatgccggatctgtcgaacgccattgtggcacaagacgagatgggtagaccctttattatcgtgaaggatcaaggtaacaagaagagacagcacggattagaggccaagaaatcacatatattggctgctagatcagtagcttctattatcaaaacttcgttgggtccccgtgggttagataagatcttgatttcacctgacggtgaaatcaccatcactaacgatggtgctacaattttgtcccaaatggagctagataatgagattgcaaagttgttagtacaactttccaaatctcaagatgatgaaattggtgatggtactactggtgttgttgttctggcaagtgcgctacttgaccaagcattggagttaattcaaaagggtatacatccaatcaaaatcgctaatggatttgatgaagccgccaaattagccatttccaagttagaagaaacatgtgacgacatttctgcgtcaaacgatgaattgttcagggactttttattgagggccgccaaaacttctttgggctccaaaattgtttccaaggatcatgatagatttgctgaaatggctgtggaagccgtcataaatgtcatggacaaagatcgtaaagacgtggatttcgatttaatcaaaatgcaaggacgggttggcggatctataagcgattcaaaattgattaatggtgtcattttggataaagatttttctcatccacaaatgcctaaatgtgttttaccaaaagagggctctgatggtgttaagttagctatattaacgtgtccatttgaacctcctaaaccaaagaccaagcataaattagacatttcttcagtagaagaataccaaaaattacagacttatgaacaagataagttcaaagaaatgatagacgatgtgaagaaagcgggcgcagatgttgttatatgccaatgggggtttgacgatgaggccaatcatctacttctacagaatgatttacctgccgtaagatgggtaggtggccaagaactagaacacattgccatttccacaaacggtcgcattgttccaagatttcaagacttgtctaaggataaattaggtacatgttccagaatttacgagcaggagtttggtactactaaggatcgtatgctgattatcgagcaaagtaaagaaacaaaaactgtaacatgttttgttcgcggttccaataaaatgatcgtggatgaagctgaacgtgcattgcatgactcactatgtgtggtacgtaacttggttaaagactcacgtgtagtttacggtgggggagcagccgaagtgactatgtccctggctgtctctgaggaagctgataagcaacgtggtattgatcagtatgcattccgtggattcgcccaagcgttagacaccattccaatgactttggctgaaaattctggtcttgatccaatcggaactttgtctacattgaaaagtaaacaactgaaagaaaagatttccaacattggtgtcgattgcttaggttacgggtctaatgacatgaaggaactatttgtcgttgatccatttattggcaaaaagcagcaaattcttttagctactcaattatgtagaatgattttaaagattgataacgtcatcattagtggtaaagatgagtattga

SEQ ID NO: 45877 - DNA, 1350 bp, Saccharomyces cerevisiae
atgtcatacttaaacaatcccgctgttgtcatggacaatggtaccgggctgaccaagctcggtttcgccggtaatgattctccctcctgggtcttccctactgcaatagccacagctgcaccttcaaatacaaagaagtcctcgggcgttggtgcgccctcagcagttagtaatgaagcatcatactttggaaattccacctctgcaaccaatttcaatggtgcaacaggtggtttgctgtctaataatttatccggtaaaagaggtacagaagatttggatttctatattggaaatgaggctttagtagcatcccaaggaccctcttactctttgagctatccaatcagacacggtcaagtggaaaattgggatcacatggaaagattctgggaaaattccatcttcaagtatttaagaacagagcctgaagatcattttttcctattgaccgaaccaccactgaatcctccagaaaacagagagcaagtggcggagattttttttgaatcatttaattgtgctggtctatatattgctgtgcaagcagttttggctctggctgcgtcatggacctcttcaaaagtcacggatagatcattaactggtactgttatagattctggtgatggtgtcacccacgtcatcccagtggcggaaggttacgtcattggctcagcaattaaaaacattccaatagccggtagagacatcacattgttcatccaatccttgctaagagaacgtggtgaagcagacacttccttgagaactgccgaaaagattaagcaagaatactgttacgtctgtccagatattgtaaaggagtttaacaaattcgataaagatccttctaaatttgcccaatttgtggtggaaaaccaagaaaagacaaggagaaaagtcgtagatattggttacgaaagattcttagcacctgaaatcttcttcaatccagaaattgcatcctcagacttcttgactcctttacccacggtagtggatcaaactatccaggcttgccctattgacgtccgtaaaggtttatacaacaatattgtactatcaggtgggtctaccatgttcaaagattttggacgtcgtttacaaagagatctaaagtctatcgtaaataacagaatcgcacaaagtgagctgttaagtggaactaaatcgactggtgtagatgtttccgtgatttctcatcggaagcagagaaacgctgtctggtttggtggctcgctgctggcacaaacagccgaattcaaaggctactgtcacactaagaaagattatgaggaatatggtccggaaattgttagaaatttcagccttttcaacatggtttga

SEQ ID NO: 45878 - DNA, 7413 bp, Saccharomyces cerevisiae
atggaaccgcatgaggagcagatttggaagagtaaacttttgaaagcggctaacaacgatatggacatggatagaaatgtgccgttggcaccgaatctgaatgtgaatatgaacatgaaaatgaatgcgagcaggaacggggatgaattcggtctgacttctagtaggtttgatggagtggtgattggcagtaatggggatgtaaattttaagcccattttggagaaaattttccgcgaattaaccagtgattacaaggaggaacgaaaattggccagtatttcattatttgatctactagtatccttggaacatgaattgtcgatagaagagttccaagcagtttcaaatgacataaacaataagattttggagctggtccatacaaaaaaaacgagcactagggtaggggctgttctatccatagacactttgatttcattctacgcatatactgaaaggttgcctaacgaaacttcacgactggctggttaccttcgagggctaataccttctaatgatgtagaggtcatgagactcgctgcaaagactctgggcaagttagccgttccaggaggtacatatacctctgatttcgtggaatttgagataaagtcttgcttagaatggcttactgcctccacggaaaagaattcattctcgagttcgaagccagaccatgctaaacatgctgcgcttctgattataacagcgttggcagagaattgtccttatttactctaccaatacttgaattccatactagataacatttggagagcactaagagacccacatttggtgatcagaattgatgcgtccattacattggccaaatgtctttccaccctacgaaatagggatcctcagttaactagccagtgggtgcagagattggctacaagttgtgaatacggatttcaagtaaacacattagaatgcatccatgcaagtttgttggtttataaggaaatcttgtttttgaaggatccctttttgaatcaagtgttcgaccaaatgtgtctaaattgcatagcttatgaaaatcataaagcgaaaatgattagagaaaagatttaccagattgttcccctattagcatcgttcaatcctcaattatttgctggcaaatatttgcaccaaattatggacaactatttagagattttaaccaatgctccagcaaataaaataccacatctcaaagatgacaaaccacagattttaatatcgattggtgatattgcatatgaagtcgggcccgatatcgcaccttatgtgaaacaaattcttgattatattgaacatgatttacagacgaaattcaaattcagaaagaaatttgaaaatgaaattttctactgcatcggaagattggcagttcccttgggccccgttctaggtaaattattaaacagaaatatactggacctgatgttcaaatgccctctttccgactatatgcaggaaacgtttcaaattctgactgagagaataccatcactaggccccaaaataaatgacgagttgcttaacctagtctgttcaaccttatctggaacaccatttatccagccagggtcaccaatggagataccatcgttttcgagagaaagagcaagagaatggagaaataaaaacatcctacagaaaactggtgaaagtaacgatgataataatgatataaaaatcattatacaagcttttagaatgttaaaaaatatcaaaagcagattttcgttggtggaattcgtgagaattgttgcactttcttacattgagcatacagatcccagagtaaggaaactagctgcgttgacatcttgtgaaatttacgtcaaggataacatctgcaaacaaacatcactacactctctgaacactgtatctgaagtgttatcaaagcttctagccattacgattgcggaccctttacaagatatccgtttagaagttttaaagaatcttaatccatgtttcgatccccagttggcacaaccagataatttgagactcttgtttactgcactgcacgatgagtcgttcaatattcagtcagtagcaatggagcttgtcggtaggttgtcttccgtaaaccctgcatacgtcatcccatcgataagaaaaatactactggaactgctaacaaaattaaaattctcaacttcttctcgagaaaaggaagaaactgccagtttgttatgtactcttatcaggtcgagtaaagatgttgcgaaaccttatatcgaacctcttttaaatgttcttttaccaaaattccaagatacctcttcaacggttgcatcaactgcactgagaactataggtgagctatctgttgtagggggcgaagatatgaagatatatcttaaggatttgtttcctttaattatcaaaacatttcaggatcaatcaaactctttcaagagagaagctgcacttaaggcccttggtcaacttgcagcctcatctggttacgtgatagatcctttactcgactatcccgaattattgggtatattggtgaatatattgaagacagaaaactctcaaaatattaggagacaaacagtcactttgataggtatactgggagctatcgacccatatcgccaaaaagaacgtgaggttacctctactaccgatatatctacagaacagaacgccccgcctatcgacattgctcttctcatgcagggcatgtctccttcgaatgatgagtattataccactgttgtcattcactgcctgctaaaaatcctaaaagatccatccctatcatcttaccacactgccgtgatccaagcgattatgcatatttttcaaacccttggtctaaaatgtgtttcattcttggaccagatcatcccaactattttggacgtaatgcgtacatgctctcagtcactattagaattttacttccaacagctttgctctttgattattatcgtaaggcaacacataagacctcatgtcgattctatattccaggctatcaaagatttttcttcggttgctaagctacaaataacgcttgtaagtgttattgaagcaatatcaaaggctctggagggtgaattcaaaagattggtccctcttactctgaccttgttccttgtaattttggagaatgacaagtctagtgacaaggtcctctccagaagggtattgagactgttagaatcgtttggtcctaacttagaaggttattcgcatttgattacacccaagatagttcaaatggcagaattcaccagcgggaacctacaaaggtctgcaataattactattggcaaactggccaaggatgttgacctttttgagatgtcctcaagaattgttcactctttacttagggtactaagttcaacaacgagtgacgaactctcaaaagtcattatgaatactttaagtctactgctaatacaaatgggcacatcctttgctatcttcatccctgtcattaatgaagttttaatgaagaaacatattcaacacacaatatatgatgacttgacaaacagaatattaaacaatgatgttttacccacaaaaattcttgaagcaaatacaacggattataagcccgcggaacaaatggaggcagcagatgctggggtcgcaaaattacctataaaccaatcagttttgaaaagtgcatggaattctagccaacaaagaactaaagaagattggcaggaatggagcaaacgtctatccattcaattattaaaagagtcaccctcccatgctctaagagcttgttcaaatcttgcaagcatgtattatccactagccaaagaactttttaataccgcattcgcatgtgtttggaccgaactttatagccaatatcaagaagatttaattgggtcattatgtatagccttatcttctcccttaaatccaccagaaatacatcaaacattgttaaacctggtagaatttatggaacacgatgacaaggcattaccaataccaactcaaagcctgggcgagtatgctgaaagatgtcacgcctatgccaaagcgctacattataaagagattaaatttattaaagagcctgagaactcaactattgaatcattgatcagcattaacaaccagctgaatcaaacggatgctgcaattggtatattaaagcatgcccaacaacatcattcacttcaattaaaggagacatggtttgaaaaattagagcgttgggaagatgcactacatgcttataatgaacgtgaaaaggcaggtgatacttccgtgagcgttacactcggtaagatgagatcccttcatgcccttggcgaatgggaacagttgtcgcaattggcagctagaaagtggaaagtttcgaagctacaaactaagaagctaatagctcccttggcagctggtgctgcgtgggggttgggagagtgggatatgcttgagcaatatatcagcgttatgaaacctaaatctccagataaggaattttttgatgcaattttatacttgcacaagaatgattacgacaatgctagtaagcatatattaaacgccagagatttgcttgtgactgaaatttccgcgttgatcaatgaaagttataatagagcatatagcgttattgttagaactcaaataataacagagtttgaggaaatcatcaagtataaacaattgccacctaattccgagaaaaaacttcactatcaaaatctttggacaaaaagactgctgggctgccaaaaaaatgtcgatttatggcaaagagtgcttagagtaagatcattggtaataaagcccaagcaagacctgcaaatatggataaaatttgcaaatttgtgcagaaaatctggtagaatgaggctagcaaataaggcattgaatatgctactagaaggaggcaacgatcctagtttaccaaatacgttcaaagctcctcccccagttgtttacgcgcaactaaaatatatttgggctacaggagcttataaagaagcattaaaccacttgataggatttacatccaggttagcgcatgatcttggtttggatccgaataatatgatcgcgcaaagtgtcaaactctcaagtgcaagtactgctccgtatgttgaggaatacacaaaattattagctcgatgttttttaaagcaaggtgagtggagaatagcaacacaaccgaactggagaaacacaaatccggatgcaattcttggttcttatctattggctacacatttcgataaaaattggtacaaggcatggcataattgggccttagctaattttgaagtaatatccatggttcaggaagagactaagctcaacggaggtaagaatgatgatgatgatgacacggcagttaataatgataatgtgcggattgacggtagtatcctaggaagtggttctttgactattaatggcaacagatacccgctagagcttattcaaagacatgttgttccagcgatcaagggcttttttcattcaatatctctattagaaacaagttgtttgcaagacacgttgaggttattgactcttttatttaactttggtggtattaaagaagtctcacaagccatgtatgaaggcttcaatttgatgaaaatagagaactggcttgaagtcttaccacagttgatctctcgtatacatcagccagatcctacggtgagtaattcccttttgtcgttgctttctgatttagggaaagctcatccacaagctctcgtgtatcctttaactgtcgcgatcaagtctgaatctgtttcaagacaaaaagcggctctttcaataatagagaaaattaggattcatagtccagtcctggtaaaccaggcagaattagttagtcacgagttgatcagagtagccgttctatggcacgaattatggtatgaaggactggaagatgcgagccgccaatttttcgttgaacataacatagaaaaaatgttttctactttagaacctttacataaacacttaggcaatgagcctcaaacgttaagtgaggtatcgtttcagaaatcatttggtagagatttgaacgatgcctacgaatggttgaataactacaaaaagtcaaaagacatcaataatttgaaccaagcttgggatatttattataacgtcttcagaaaaataacacgtcaaataccacagttacaaaccttagacttacagcatgtttctccccagcttctggctactcatgatctcgaattggctgttcctgggacatatttcccaggaaaacctaccattagaatagcgaagtttgagccattattttctgtgatctcttcgaagcaaaggccaagaaaattctccatcaagggtagcgacggtaaagattataaatacgttttaaagggacatgaagatataagacaagatagccttgttatgcaattatttggtctagttaacactttgttgaagaatgattcagagtgtttcaagagacatttggatatccaacaatacccggctattccattgtcgcctaaatctggtttactaggatgggtaccaaatagtgacacattccacgttttgatcagagaacaccgtgatgccaaaaaaattccgttgaacattgaacattgggttatgttacaaatggcccccgattatgagaatttgactcttttacaaaaaattgaagtattcacgtacgctttagataatacaaaaggccaagacctttataaaatattatggttaaagagtaggtcgtcagagacatggctagaacgtagaacaacttatacgagatctttagcagttatgtccatgactggttatattctgggactaggtgatcgccatccaagcaacctgatgctagatagaatcaccggtaaagttatccacattgatttcggcgattgttttgaagctgccatcttaagagaaaagtatccagaaaaagtgccatttagactaactaggatgttaacatacgcaatggaagttagtggaattgaaggcagtttccgaattacttgtgaaaatgtcatgagagtcttaagagataataaagaatcattaatggcgatcttggaagcttttgcgcttgatcctttgatccattggggatttgatttaccgccacaaaaacttactgagcaaactggaattcctttgccgttgattaatcctagtgaattattaaggaagggggcaattactgtcgaagaagcggcaaatatggaagcagaacaacaaaatgagaccaaaaacgccagagcaatgcttgttttgagacgtattacagataaattaacgggcaatgatatcaagaggttcaatgaattagacgtccctgagcaggttgataaactgatccaacaagccacttctattgaaaggttatgtcaacattatattggatggtgcccattctggtga

SEQ ID NO: 45879 - DNA, 1062 bp, Saccharomyces cerevisiae
atgtttgaagggtttggtccaaataaaaagcgtaagatatcaaagttagccgcagagcaatcattggcacaacaaccctgggttgagaaatacaggcccaaaaacctagatgaagtgacagctcaagatcatgccgttactgttttgaagaaaaccttaaagtcagctaatctaccacatatgttgttttatggtcccccaggaactggtaaaacgtctaccattttagcgctaacaaaagaattatatggacccgacttgatgaaatcaagaatattggagttgaacgcttctgacgaacgtggtatctctattgtaagagaaaaggtaaaaaattttgcaagattgactgtatccaagcctagcaaacatgacttggagaactatccgtgcccaccgtataagatcattattctcgatgaggccgattcaatgactgccgatgcacagagtgcattacgtagaacaatggaaacctattcaggagtaacaagattctgtttgatttgtaattatgtgacaagaattattgacccgctagcgtcccgttgttccaaatttagattcaaagccctagacgcaagtaatgccattgaccgtttgaggtttatcagcgaacaagaaaatgttaaatgtgatgatggagttttggaaaggatcttggacatttcggcaggtgacttgagaagaggcattacattattacaatccgcttccaagggggcgcaatacttgggtgatggtaaaaacataacttctacccaagtggaagaattagctggtgtggtacctcatgacattctaatagaaattgttgaaaaagtcaaaagtggtgattttgatgagattaagaaatacgtcaatacgtttatgaaaagcggttggtctgctgcgtcagtagttaaccaactacatgaatattacatcaccaacgataactttgatacgaacttcaaaaatcaaatatcttggttgctgtttactacggattccagattaaacaacggaacgaacgagcacatccaattattaaacttattggttaaaatatcccaactctaa

SEQ ID NO: 45880 - DNA, 621 bp, Saccharomyces cerevisiae
atgaaggagtcagtccaagagatcatccagcaactcatccacagtgtcgatttacagtcttccaagttccagctggccattgtgtgcacgatgttcaatcctatcttttggaacatcgttgcaagaatggaataccacaagcattctctcaccaagatgtgtggtggggccagaaagggctgttacatgttggcggcgaccatattttcgctaggtatcgtcagagacatggtgtacgagtctgcattgcgtgaacagcctacgtgttctctgatcacgggcgagaactggaccaagctgggtgtggctctctttggtttggggcaagtgcttgttttgagttccatgtacaagctgggtatcacagggacgtacttgggtgactatttcggcatcctgatggatgagagagtcaccggcttccccttcaacgtttccaacaaccccatgtaccagggttccactttgtccttcttgggcatagccctttacaaaggaaagcctgcggggctggttgtttctgccgtagtttacttcatgtacaagatcgctcttcgttgggaagaaccttttactgccatgatctacgctaaccgtgataaggccaaaaagaatatgtaa

SEQ ID NO: 45881 - DNA, 1191 bp, Saccharomyces cerevisiae
atggccaaaacaacaaaaagagcctccagtttcaggaggttgatgatattcgccataatagccctcatctcattagcatttggagttagatacctatttcacaattctaatgctactgatttacaaaaaattctgcagaacttgcccaaagagatttcccaaagcattaatagtgccaacaatattcagagttcggattctgatctagttcaacattttgagagtttggctcaggagatcagacaccaacaggaagttcaagcaaagcaatttgataaacaacgtaagatcctggaaaaaaaaatccaagacttgaaacaaacacctccggaggccaccctaagagaacgcatagctatgactttcccctacgattcccatgtcaagttcccagcatttatttggcaaacttggtccaatgatgaaggtcccgagcgtgttcaagatataaagggcatgtgggaaagcaagaatccgggctttgcgcacgaagtgttgaaccatgacgtgataaacgcactagtacaccactacttctactccataccggaaatcctagagacttacgaagctctgccctccatcatcctaaagatagattttttcaaatacttaatactgttagttcatggaggtgtttatgctgacatcgacacgttccctgttcagccaattccaaactggattcctgaagagttgtcgccatccgacattgggttgatagttggagttgaggaagacgctcaaagagctgactggagaaccaagtatatcagaagacttcagtttggtacttggattatacaagcaaaacctggtcaccctgttttgagggaaatcatttctcgaattattgagaccactttacagagaaagagggacgaccaactaaacgtcaatctaaggaatgatctgaatattatgagttggacgggttctgggttgtggactgacactattttcacgtatttcaatgactttatgagaagtggtgtcagggagaaggttacatggaaattattccataacctaaatcaaccaaaattgctaagtgatgttctggtctttccaaaattctcctttaactgtccaaaccaaatcgataatgacgatccacacaagaaattctatttcattactcatttggcatcacaattttggaaaaatactccaaaggtggagcagaaataa

SEQ ID NO: 45882 - DNA, 1248 bp, Saccharomyces cerevisiae
atgtccggaataattgacgcatcttctgcattaagaaaaagaaagcatttgaaaagaggtataaccttcactgtgatgatcgtgggccagtccggatctggtagatcgacttttataaatactttgtgcggtcagcaagttgtagacacttcgacgacaatcttgttacccacagatacgtccacagaaatagacttacaattgagagaggagacggtcgaattagaagatgatgaaggtgtcaagattcaacttaatatcatcgatactccgggattcggtgattctctcgacaattctccatctttcgaaatcatttccgactacattcgccaccaatatgatgaaatcttattggaagaaagtcgtgtgagaagaaacccaagatttaaggacggcagagttcattgttgtctttacttaatcaacccaactggccacggtttaaaagagattgatgtggaattcatcagacagttgggatccttagttaacatcatccctgtgatcagcaaatcagattccttgacaagagatgaactgaaactgaataaaaaattgatcatggaggatatcgacagatggaacttgccaatttataatttccctttcgatgaagatgaaatatcagacgaagattacgaaaccaatatgtacctacgtacacttctaccttttgctattattggatccaatgaagtttacgaaatgggcggcgatgttgggacaattcgtggcagaaagtatccatggggcatactggacgtggaagattcatcgatctctgattttgttatcttaaggaatgcgttattgatctctcatttacatgacttgaaaaactacacacatgagatattatatgaaagatatagaaccgaggcattatcaggtgaatctgtcgcggcagaatccatacgtccaaatctgacaaaattgaatggttcgtcgtcatcgtccaccacaacaaggagaaacacaaatcccttcaagcaaagtaataatattaataacgatgttctcaacccagcatccgatatgcacgggcaaagcactggcgaaaataacgaaacctacatgacacgtgaggagcaaatacggttagaagaagagcgactaaaggcatttgaggagagagttcagcaagaactgctgttgaaaagacaagaactgttgcaaagagaaaaggaattaagagaaattgaagccaggttggaaaaagaggcgaaaatcaaacaggaagaatga

SEQ ID NO: 45883 - DNA, 936 bp, Saccharomyces cerevisiae
atgtctgtgtctgctgctcctgctattccacagtactctgtctctgactacatgaaattcgccctagccggcgccatagggtgcgggtcgactcactccagtatggtcccgatcgatgtcgttaagacgagaatccaactggaacctaccgtgtacaacaagggtatggtcggctctttcaagcaaatcatcgccggagaaggtgctggtgcgttgttgaccgggtttggtcctactttgttgggttactctatccaaggtgccttcaagttcggtggttacgaagtgttcaagaagttcttcattgacaacttgggttacgataccgcctctcgctacaagaactctgtttacatgggttctgctgccatggccgaattcttggcagacattgccttgtgtcccctagaagccactagaatcagattggtctcccaaccacagttcgctaatggactcgtcggagggttttccagaattttgaaagaagaaggtatcggctctttctacagtgggttcactccaattttgttcaagcaaattccttacaacattgctaaattcttggtctttgaacgtgcctccgagttctactacgggttcgccggtccaaaagaaaaattgtcctctacttccactactttgttgaatttgctttccggtttgactgctggtttggccgctgccattgtttcccagccagcagacactctgttgtccaaggtcaacaagactaagaaggctcctggccaatccacagtcggtttgttggctcagttggccaaacagttaggatttttcggttcctttgctgggttgcctactcgtttggtcatggttggtaccttgacctccttgcaatttggtatttatggttctttaaagagcactttgggttgcccaccaaccattgaaattggtggtggtggtcattag

SEQ ID NO: 45884 - DNA, 1362 bp, Saccharomyces cerevisiae
atgaacaacacttccataaccggaccacaagtactacatagaacaaaaatgagaccactaccagtgctagaaaaatactgtatctcgccacatcatgggtttttggacgaccggttacccttgaccagactgagcagcaagaaatatatgaaatgggaagaaatcgttgctgacctgccctctcttttgcaagaggataacaaggtgcggagcgtcatcgatgggctggatgtcttggacttggatgagacgatcttgggcgacgtcagggagctcagaagagcatattccattttggggtttatggcgcacgcttatatttgggccagcggaactccccgggatgtattaccggagtgtattgcaaggccactgttggagacagcacatattttgggtgtgccaccgttagctacgtactcctcgttggtgttatggaacttcaaagtgaccgacgagtgcaagaaaacggaaaccgggtgtttggacttggaaaatattacaacgataaacacatttacgggaaccgttgacgaaagttggttttatctggtcagcgtgcggtttgaaaaaatcggcagcgcttgtttaaaccatgggttgcagatattgagagccattagaagcggtgataaaggagacgctaacgtgatagacgggttggagggcttggctgcaacgatcgaaaggttatcgaaagccttgatggaaatggagcttaagtgtgaacccaatgtattttatttcaagataagaccatttttggccgggtggacgaatatgtcgcatatggggttaccacagggtgttaggtatggagcggaaggacagtatcggatcttttctggcgggtccaatgcgcaaagctcgttgatacagacactggacatccttttgggtgtgaaacacactgcgaatgctgcgcattcttcccaaggagacagcaagatcaattatctggacgaaatgaaaaaatacatgccaagagaacatcgtgaatttctttaccatttggaatcggtatgtaatattcgcgaatacgtttctcgtaacgcttctaaccgtgcattgcaagaggcctatggacgttgcatttccatgctgaaaatatttagagataaccacattcaaattgttaccaagtacattattttgccctccaattcaaagcaacacggctccaataagccgaacgtactaagtccaatcgagcccaataccaaagcaagtggttgtttagggcataaagttgcctcatctaagactatcggaaccggtggtacaagattaatgcccttcttaaagcagtgcagggacgagactgtcgccactgcggacattaaaaatgaagataaaaattga

SEQ ID NO: 45885 - DNA, 333 bp, Saccharomyces cerevisiae
atgacatcagttcaaaactctccacgcttacaacaacctcaggaacagcaacagcaacagcaacagctttccttaaagataaaacaattgaagttaaaaagaatcaacgaacttaacaataaactgaggaaagaactcagccgtgaaagaattactgcttcaaatgcatgtcttacaataataaactatacctcgaatacaaaagattatacattaccagaactatggggctaccccgtagcaggatcaaatcattttatagagggtttgaaaaatgctcaaaaaaatagccaaatgtcaaactcaaatagtgtttgttgtacgcttatgtaa

SEQ ID NO: 45886 - DNA, 3456 bp, Saccharomyces cerevisiae
atggatcaggataacaacaaccacaatgacagcaataggctgcacccacctgatatacatccaaatttgggccctcaattgtggctgaatagtagcggtgattttgacgacaacaacaacaacaacaacaacaacaacaataataatagcacaagaccacaaatgccatcacgaactagagaaacggcaacttcggaaagaaatgcaagtgaggttagggatgcaacgctaaataatatctttaggttcgatagtattcaacgggaaacgcttttgccaaccaacaacggacaaccgctaaatcaaaacttttcgctgacatttcaaccacaacagcaaacaaatgcgctgaacgggattgacataaacactgtgaacacaaaccttatgaatggtgtcaatgttcaaatagatcaacttaatcgattgttaccgaacctaccagaggaagaacggaagcaaatccacgaattcaagctaatagtgggcaaaaaaatccaagagtttctggttgttatagagaaacgtagaaaaaaaatactgaacgaaattgagctagacaaccttaaactaaaggagctacgtattgataactccccacaagcaattagttatttgcataaattacaaagaatgaggcttagggcgctagagacagaaaacatggaaattagaaatttaaggctaaaaatattaacaattatagaagagtacaaaaagtcattatatgcatactgccattccaagctaagaggtcaacaagtggaaaatccaacagataatttcatcatttggataaactccatagatactactgaatcatctgacttgaaagaagggctacaagatctttcgagatattcaaggcagttcataaataatgtgctttcgaatccatcaaatcaaaacatatgtacgagtgtcacccgaagatcacctgtgtttgccctaaacatgctaccctcggaaatattacacttaatattagataaacttaaccaaaaatatgatattgtaaaattccttaccgtttccaaactctgggctgaaataattgtgaagatactttattacagaccgcacatcaacaaaaagagtcaattagacttgtttttaaggactatgaagttaacttctgaagaaactgtattcaactatcgtttaatgatcaaaagattaaatttttcatttgttggtgactacatgcacgatacagagcttaactattttgtcggatgtaagaatttggagcgactaactttagtattttgcaagcatataaccagtgttccaatatcggctgttttgagaggatgtaaatttctccaaagtgtggatatcactggaataagagacgtttccgatgacgtatttgataccttagcgacatattgtcccagagtacagggcttttatgttcctcaggcaaggaatgtaacattcgattcactgcggaatttcatagtccattccccgatgttgaaaagaataaaaatcacagcaaacaataacatgaatgacgaattagtagaactattagccaacaaatgccctttgcttgtagaggtcgatataacattaagtccaaatgtcactgattctagtttgttaaaactcctcactaggttagttcagctgagggaattcagaataactcataatacgaatattacggataatcttttccaggagctttctaaagtagttgacgatatgccctctttaagattgattgatctttctggatgtgaaaatattacagataaaactatagaaagtatagtcaatttagcccctaaattacgtaatgtttttctaggcaagtgtagccgaattacagatgcatcgttgttccaattatcgaagctgggcaaaaacttgcaaacagtgcattttgggcactgtttcaatataactgataacggggtaagagcactctttcattcatgtacaagaatacagtatgtggactttgcgtgctgtacgaatttaaccaatagaactctttatgaactagcagacttaccaaaattaaagagaattggccttgtcaaatgtacgcaaatgactgacgagggtttgttgaatatggtttccttgcgaggccgaaatgatactttagaaagggtacatttatcttactgttctaatttaacaatatatccgatatatgagcttctaatgtcttgcccaaggctctcacatttgtctttgactgctgttccgtcatttttacgccccgatataacgatgtattgcaggcctgcaccctcagactttagtgaaaatcaacgtcaaatattctgcgtattttcagggaaaggtgttcataaacttcgccattatttagtaaatttaacgtcgcccgcttttggaccacatgtcgatgtaaatgatgttttgacaaaatatattagatccaagaatttgatatttaacggtgaaacacttgaagatgctcttaggagaatcataactgatttaaatcaagattccgctgcaattatagctgctacaggattaaatcaaatcaacggtctaaataacgattttcttttccagaatatcaattttgaacgaatagatgaagtattcagttggtatctcaatacttttgatggcattaggatgagctcggaggaagttaactcactattattgcaagtaaacaagacgttttgtgaagatccatttagtgatgtggacgatgatcaagattatgtcgtagcacctggtgtaaaccgggaaattaacagtgaaatgtgtcatattgttagaaaattccatgagttaaatgatcatattgatgatttcgaggtgaatgttgctagtttggtaagagttcagtttcagtttactggttttttacttcatgaaatgactcaaacctatatgcaaatgattgaattaaacagacaaatttgtttagtacaaaaaacggttcaggaatcgggcaacatagattaccaaaaagggcttttaatatggcgacttttattcattgacaaattcattatggtggttcagaagtacaagctctccaccgttgttttgagactatatttaaaagataacataacattgttaaccagacaaagagaactattaatagcccaccaaagatcagcatggaataacaataatgacaatgacgccaaccggaacgccaacaacatagtgaatattgtatcggatgctggggcaaacgatacaagtaacaatgaaactaacaatggtaatgatgacaatgaaacagaaaatccaaatttctggcgtcagtttggcaatagaatgcaaatatcacctgaccagatgaggaatctccaaatgggacttcgtaatcagaacatggttaggaacaataacaacaacacaattgacgaatcaatgcctgacactgccattgattctcaaatggatgaagcatcaggaacgcccgatgaagatatgttataa

SEQ ID NO: 45887 - DNA, 969 bp, Saccharomyces cerevisiae
atgtctcaaaaaaagaaggcttcccatccagccatcaatctcatggctggcggcacagcaggtttatttgaagcattgtgttgtcatcctttagatacaattaaggtgagaatgcaaatatacagacgggtagctggtattgaacatgttaaacccccaggatttattaaaactgggcgtaccatttatcaaaaagaaggtttcttggctctgtataaaggtctaggtgctgtggtcatcggtattatacctaagatggcaatccgtttctcgtcttatgaattctatagaaccttattggttaacaaggaatcaggaattgtgtctaccggtaatacttttgttgctggtgttggggctggtatcaccgaagctgttcttgtcgtgaacccgatggaagttgtaaagattaggttacaagctcagcatttaactccgagtgagccaaatgctggtcctaaatataacaacgccattcatgcagcctacactattgtcaaagaagaaggtgtttctgccttatatagaggcgtttccttaactgcggcaaggcaagcaactaatcagggtgctaacttcacagtttattctaaactgaaggagtttttgcagaattaccatcagatggatgtcctaccttcatgggaaacttcttgcataggtttgatttcgggtgctattgggccgttttccaacgctccattggatactataaagacaaggctgcaaaaggataagtccatctcattggaaaaacagtccggtatgaagaaaatcataaccattggtgctcaactactgaaagaagaaggttttagagctttgtacaagggtattaccccaagagtgatgagggtggctccaggtcaggctgtcacctttaccgtttatgaatatgtaagggagcatttagaaaatttgggtatattcaagaagaatgacacaccaaagccaaagccattaaagtag

SEQ ID NO: 45888 - DNA, 849 bp, Saccharomyces cerevisiae
atggttcctaagttttacaaactttcaaacggcttcaaaatcccaagcattgctttgggaacctacgatattccaagatcgcaaacagccgaaattgtgtatgaaggtgtcaagtgcggctaccgtcatttcgatactgctgttctttatggtaatgagaaggaagttggcgatggtatcattaaatggttgaacgaagatccagggaaccataaacgtgaggaaatcttctacactactaaattatggaattcgcaaaacggatataaaagagctaaagctgccattcggcaatgtttgaatgaagtctcgggcttgcaatacatcgatcttcttttgattcattcgccactggaaggttctaaattaaggttggaaacttggcgcgccatgcaagaagcggttgatgaaggattggttaagtctataggggtttccaactatgggaaaaagcacattgatgaacttttgaactggccagaactgaagcacaagccagtggtcaaccaaatcgagatatcaccttggattatgagacaagaattagcagattactgtaaatctaaaggtctcgtcgtcgaagcctttgccccattgtgtcacggctacaaaatgactaatccagatttattaaaagtttgcaaagaggtggaccgtaatccaggtcaagttttgattcgttggtctttacaacacggttatttaccactaccgaagactaaaactgtgaagaggttagaaggtaaccttgcagcctacaactttgaactgtcagacgaacagatgaaatttcttgatcatcctgatgcttatgagcctaccgattgggaatgcacagacgcgccataa

SEQ ID NO: 45889 - DNA, 711 bp, Saccharomyces cerevisiae
atgagcggagaaaatcgtgctgtggtgccgattgaatcaaaccctgaagtttttacaaattttgcacataaattaggtttaaaaaatgaatgggcgtatttcgatatctatagcttaacagagccagagttactagcattcttaccaaggccagtgaaggccattgtgctgctatttccgataaacgaggatagaaaatcgagtaccagtcaacaaattacaagttcttatgatgttatatggtttaagcaatcagtcaaaaatgcgtgcggattgtatgcaattcttcattctttgagcaataaccagtcattgttggagcccggctccgacttggacaattttttaaaatctcaaagtgatacttcaagctcgaagaataggtttgatgatgttactaccgaccaattcgtcttgaatgtaataaaagagaatgtacaaacattttctactggccagtcagaagcaccagaagcaactgcagatactaatctacactatatcacatatgtggaagagaacggagggatatttgaactggatggaaggaatttgagcggacccctctatttgggaaagagtgacccaactgccaccgatttgattgaacaggaattagttagagtgagagtcgcctcatatatggaaaatgcaaatgaagaagatgtattaaactttgctatgctaggattgggccctaattgggaataa

SEQ ID NO: 45890 - DNA, 1023 bp, Saccharomyces cerevisiae
atgaccgcaccattggtagtattgggtaacccacttttagatttccaagccgacgtcacggctgaatacctggccaagtattctctaaaggaaaacgacgcaattttggtcgatgccaaatcaggcgatgctaagatggctatttttgacgagctcttacagatgccagaaacaaagcttgttgcaggtggtgctgctcaaaacactgctagaggggcagcatacgttttgggcgccggccaggtggtgtacttcggttccgtcggtaaggacaagttcagcgagagattgcttaacgaaaacgaaaaagctggtgtcaagtctatgtaccaagttcaaaatgatattggtaccggtaagtgtgccgcattaatcactggccataaccggtccttggtcactgacttgggtgctgccaatttctttactccagaccacttggacaagcattgggacttggtcgaagcagctaagctcttctacatcggtggtttccacttgaccgtgtctccagacgctatcgttaagttgggccaacatgctaaagagaacagcaaacctttcgtgttgaactttagtgctcctttcattcctcatgtcttcaaagacgcattggccagagttttgccttatgctaccgtcatcatcgctaacgaatcggaggccgaagccttttgcgacgccttccaattagactgtgccaacactgatttggaagctattgctcaaagaattgtcaaggactctccagttgaaaagactgtcatcttcacccacggtgtcgaaccaacagtggtcgtgtcctccaagggtaccagcacatatccagtcaaacctttggactcttctaagatcgtcgacaccaacggtgctggtgacgccttcgctggtggctttatggctgggttgactaaaggtgaagatttggaaacctctattgacatgggtcaatggctagctgctttgtctattcaagaagttggtccctcttacccttccgaaaaaatatcttactctaaatag

SEQ ID NO: 45891 - DNA, 3357 bp, Saccharomyces cerevisiae
atgacatcgatttatacatcaacagagcctacgaattctgcttttactaccgaggactacaaacctcaattagttgaaggagtaaattctgtacttgtcattggatcaggagggctctctattggtcaagctggtgaattcgattacagtggttctcaagctatcaaagctctgaaggaagataacaagtttactatattggttaacccaaatatcgctactaaccagacttctcattccctggcggacaagatttattacttgcccgttacaccagaatacatcacatatatcattgaacttgaaaggccggatgctatacttttaaccttcggtggtcaaacaggtctaaattgtggggtggctctggatgaatctggtgttttggctaaatacaacgtcaaagttttaggtactcctatcaaaactttgatcacttctgaagatagggatcttttcgcatctgcgttaaaggatatcaacattcccatcgcagaatcatttgcttgtgaaaccgtggatgaagctttggaggctgctgaaagggtcaaatacccagttattgtcagatctgcatacgctttgggtgggttaggctcaggtttcgctaacaatgcaagtgaaatgaaggaacttgccgcacagtccttgtcgttggccccacaaattcttgttgaaaaatctttgaaaggttggaaagaagttgaatatgaagtggtcagagatagggttggtaactgtattacagtatgtaatatggaaaatttcgacccacttggtgttcatactggtgattctatggtttttgctccttcgcagaccctatcagatgaagagtttcatatgttaagatccgccgcaattaaaatcattagacaccttggtgttattggtgaatgtaatgtccaatacgctttgcaacctgatgggctagactatagagttattgaagtgaacgcacgtttatctcgttcctctgcattggcgtctaaggccactggttatcccttagcatacactgccgccaaaattgggctaggctatactttgccagaattgccaaacccaatcacaaaaactacagtggctaactttgagccatctttggattatattgtggcaaaaatacctaagtgggatctttctaagttccaatacgtggacagatccattggttcctctatgaaatcagttggagaagttatggctattggtagaaactatgaagaagcctttcaaaaagcattaagacaggtggatccatcattattgggattccaaggttctactgaattcggcgatcaacttgatgaagccttgagaactccaactgatagaagagtccttgccattggtcaggccttaatccatgaaaactatactgttgagagagttaatgaattgagtaaaattgataaatggtttctttacaagtgcatgaacattgttaatatctataaagagcttgaatcagttaaatctttaagtgacttgagtaaagatctcttgcagagagccaagaaattagggttttcagataagcagattgcggttactataaataaacacgcctccacaaacattaacgaactggaaatcagaagtttaagaaaaacgttaggtataatcccttttgtcaagagaatcgatactttggccgcagaatttccagcacaaaccaattatttgtataccacttacaatgctacaaagaacgatgtggagttcaacgaaaatggtatgctggttttaggctctggtgtctatcgtattggttcatctgtagaatttgattggtgtgccgtgaacaccgcgaagacattaagagatcaaggcaagaaaactatcatgataaattataacccagaaacagtttccacagatttcgatgaagttgatagattatactttgaagaattatcgtatgaaagagtgatggacatttatgagttggagcaatctgagggttgcattatttctgtcggtggtcaattacctcaaaacattgccttgaaactttacgataacggctgtaatataatgggtaccaatccaaacgatattgatagagctgagaacagacacaaattctcatctattttggattctattgatgttgaccaacctgaatggagtgaattaacatcagtagaagaagcaaaattatttgcttctaaagttaactaccctgtgttgattcgtccctcatatgttctttccggtgcggcaatgagtgttgttaataatgaggaggaactgaaggctaaattaactttggcatctgacgtttctccagaccacccagtcgtcatgtctaaatttattgaaggtgctcaagaaattgatgtggacgccgttgcttataatggtaatgtcttggtacatgccatttccgagcatgttgaaaatgcgggtgtgcactccggtgatgcttctttagtcttaccgccacaacatctttctgacgatgtgaagattgccctaaaagacattgctgataaggtcgcaaaagcttggaagatcactggccccttcaatatgcaaatcatcaaggatggggagcatacattgaaagtgattgaatgtaacattagagcttctagatcatttccattcgtttcaaaagttttaggcgttaattttattgaaattgctgtcaaggcatttttgggcggtgacattgtaccaaaacctgttgatttgatgctcaacaaaaagtacgactatgttgctactaaagttcctcaattttcctttacaaggttggctggtgcagatcctttcttaggggttgaaatggcatcaactggtgaagttgcttcatttggtagagatttaattgaaagctattggactgctattcaaagtaccatgaacttccatgtaccactacctccaagtggtatattatttggaggtgatacatctcgagaatacttgggccaagtggcttccatagtggccactattggttacagaatatacacaactaatgagaccactaaaacgtatctacaggaacacatcaaagaaaagaacgcaaaggtttctttgattaaatttccaaagaatgataagagaaaattgcgtgaactatttcaagaatatgacataaaagctgttttcaatttagcctccaagagagctgagagcactgacgatgttgactatattatgagaaggaatgctattgattttgctatcccattgttcaatgaacctcaaacggctttgttatttgcaaagtgtttgaaggcaaaaattgcagaaaagatcaaaattttggaatctcatgacgttatagttccaccagaagtccgttcctgggatgaatttattggtttcaaagcatattga

SEQ ID NO: 45892 - DNA, 1536 bp, Saccharomyces cerevisiae
atggttttgccaagactatatactgctacatcccgtgctgcttttaaagcagccaaacaatccgctccgcttctatccacttcgtggaaaagatgtatggcctcagctgctcaatctactccaatcaccggtaaagttaccgctgtcattggtgccattgttgacgttcattttgaacaatcagagttgcccgctattttgaacgctttagaaattaaaacacctcaaggtaagttggttttggaagttgctcaacatttgggtgaaaacactgtcagaaccattgctatggatggtaccgaaggtttggtccgtggtgaaaaggttcttgacactggtggccctatctccgtcccagttgggagagaaactttagggagaatcatcaacgttatcggtgaacctattgatgaaagaggtccaattaagtccaaactaagaaagccaattcacgcagaccctcctagttttgcagaacaatctacttcggctgaaattttggaaacaggtatcaaagtcgtcgatctattagctccttatgccagaggtggtaagattggtcttttcggtggtgcaggtgtcggtaagactgtgttcattcaagaattgattaacaatatcgccaaggcccatggtggtttttccgttttcaccggtgttggtgaaagaacaagagaaggtaatgacttgtaccgtgaaatgaaggaaactggtgtcattaacttggaaggtgaatccaaggtcgccttagtgttcggtcaaatgaacgaacctccaggagccagagccagagtcgctttaactggtttgacgatcgctgaatatttcagagatgaagaaggtcaagatgtcttgttgtttatcgacaatatctttagatttactcaagctggttcagaagtctctgcccttttgggtcgtattccatctgccgtcggttatcaaccaactttggccactgatatgggtctcttacaagaaagaattaccaccacaaagaagggttctgtcacttctgtgcaagccgtttatgttccagccgatgatttaacagatcctgctcctgccactacttttgcccatttggacgctactaccgtcttgtcaagaggtatttcagaattaggtatttaccctgcagtggatccattggattctaaatcaaggttattggatgccgccgttgtcggtcaagaacattatgacgtcgcctccaaggttcaagaaactttacagacctataaatctttacaagatatcattgctattttgggtatggatgaattgtccgaacaagataaactaactgtcgaaagggcaagaaagattcaaagattcttatctcaaccatttgctgtcgccgaagtctttactggtatcccaggtaaattagtgagattaaaggacaccgttgcctcgttcaaagccgttttggaaggtaaatacgataatataccagaacatgctttctatatggttggtggtattgaagatgttgttgctaaagctgaaaagttagccgctgaagccaactag

SEQ ID NO: 45893 - DNA, 1650 bp, Saccharomyces cerevisiae
atgaagaactctgtcggtatttcaattgcaaccattgttgctatcatagcagctatatactatgtgccatggtacgaacactttgagagaaagtcaccgggggccggagaaatgagagatcggattgaaagcatgttcttggaatcgtggagagactattccaagcatggctggggatacgatgtgtatggacctattgagcacacttcccataatatgcctcgtggcaaccagccgttaggctggattatcgtagattcagtggataccttgatgttaatgtataactcctccacactatacaaaagtgagttcgaggcagaaattcagagatcggagcattggataaacgatgttttggattttgatattgatgccgaagtgaatgtttttgaaactactattagaatgctaggtggtttattatccgcatatcatctatctgatgttttagaagtaggtaataagactgtctacttgaacaaagcaatagatttgggggataggcttgctttggcgttcttatccactcagaccggaattccatactcaagtataaaccttcatagtggccaagcggttaagaaccatgcagatgggggggcatcttctaccgcagaattcactacgctacaaatggaattcaaatatctggcgtatttgacaggaaatcgtacttattgggagctggtggagcgtgtttacgagccattatacaaaaataacgatcttctaaatacctacgatggattggttccaatttatacatttccagatactgggaagtttggtgcttcgactatccggttcggatcaagaggtgattctttttatgagtatttactaaaacaatatttattgacgcacgaaacactttattatgatctgtacagaaaatccatggaaggtatgaaaaagcatttattagcacaatccaaaccctcttctctgtggtacattggggaaagagaacaaggtctacatggacaactttctcctaagatggaccacctcgtgtgctttatggggggattgttagcatcaggctctactgagggcctttctattcatgaagcccgaagacgtccgtttttctctctttcccttgaaagaaaaagtgactgggatttggctaaagggataactgacacatgttatcaaatgtacaagcagtcttcctcggggcttgcgcctgaaatcgttgtcttcaatgatggaaacataaaacaggatggttggtggcggtcgtctgtgggtgatttttttgttaaaccactcgataggcacaacctacaaagaccagaaacggtggaatcgattatgttcatgtatcatttatctcatgatcacaaatatcgtgaatggggggcggaaatcgcaactagcttctttgaaaatacctgtgttgattgtaatgacccaaaattaaggcggttcaccagtttaagtgattgtatcacgttacctacaaagaaatctaacaatatggaaagtttctggttggcagagactttaaagtatttatatatattgtttttagacgagtttgatttgaccaaagttgttttcaacacagaagctcatccttttccagtattagacgaagaaatattaaaatcgcagtctctgaccacaggttggtcgttgtag

SEQ ID NO: 45894 - DNA, 4329 bp, Saccharomyces cerevisiae
atgactgcttctgacctcttgacgctcccacaattgttggcgcaatattcctctagtgctccccaaaataaagtgttctacactactagcacaaaaaatagtcattcatccttcaaagggctagaatctgttgccacagatgctactcatctattgaacaatcaagatccattgaataccatcaaagatcaactctctaaggacattttaactaccgtttttacagatgaaactactttggtcaaatccatccaccatctatattctcttcctaataaacttccattggtgattacagtggatttgaatttgcaagattattccgcaattcctgcgttaaaggatctttctttccccatcttaatatcttctgatttgcaaactgcaatttcaaacgcggactcttcttataagattgctacaagttctctgaccccagttttccattttcttaacttggagaaaattggcacgagtacagctattgaacaagacatcgactttcctaccttggagattgctaacgaagagactaaagtagcattatcagaagctactgattcattgacaaattttgaactggttaaaggtaaagagtcaattaccactgtcattgttaacctgtcaccatatgacgcggaattcagtagcgtattgccttcaaacgtaggattgatcaagattagagtatacagaccatggaatttttccaagttcttggaaatactgccatcttctgttaccaaaatcgccgttttacagggtgtctctaagaaatcgcaatcaaacgaatttcaaccatttcttttggacttctttggcaattttaatgaattagtttctaggaacatcgagcaggtagtgttgactaatattggtaatgtgaatgattatggcaacgttatcaacaccgtcatatcgaatattaacaagaaggaaccagataataacttatttttaggtgaatccaatgaaaaggctgaggaacaagctgaagttactcaacttatttcttctgtcaaaaaagttgtgaacttagaagacgcctatatcaaagtgctaaaacagttattttcatcaaatctacaaattttgaatcaattttccagtgagacaattgaaccaagtaatccagaatttggttttggacgctttttaaaacaagaagcccagcgtgaagaattgatcagcttagcaaaaacctctcttgatccaagtctttacttgtccgaggatgcaaataaaattgttcaactattatctaaatggttgtcattcaatggacgcgatcttgacgaagctcaattacaagaggccaatgcgacaggtttggaaatatttcagttattacaatctaatcaagattcctctactgtcttaaaattcttaaagatagctccaacaagcgattcttttattttcaaatcaagctggctaattggctccgatgcctggtcttatgatttgggtcactcaggtattcaacaggttttatcctcccgtaaaaacattaatgttttattgattgattcagagccatatgaccatagaaagcaaaaccaggatagaaagaaagatgttggtttgtacgccatgaattattacagtgcctatgttgcctctgtagcagtatatgcttcttacacccaactattgactgcaataatagaggcatctaaatacaatggtccttctattgtcttggcttatttgccgtataattccgaaaatgatactccattagaagtcttaaaggaaaccaaaaacgccgttgaatctggttactggccattgtataggtttaatcctgtttatgacgatccatcaacagataaggaggcatttagcttggattcttcggttatcagaaaacaattacaggacttcttagaccgtgagaataagcttaccctattaaccagaaaagatccatctttgtcaagaaatctaaagcaatctgctggtgatgcgttgacaaggaaacaagaaaaaagaagcaaggctgccttcgatcagttattggagggtttgtccggcccaccgctacacgtctattatgcttctgacggtggtaatgctgcaaacttggcaaagagactagcagcaagggcatctgcaagaggtttaaaggctactgttctgtccatggatgacattattttggaagaattacctggtgaagagaatgtagttttcattacttccacggctgggcaaggtgaattcccccaagacggtaagtctttctgggaagctctgaaaaatgacaccgacttggatttagctagtttgaatgttgctgtttttggtctcggtgattctgagtattggccacgtaaagaagataaacattattttaacaagccttcacaggatttatttaagcgcttggaattattgagtgccaaagccctaattcccttgggactgggtgatgatcaagatgctgatggtttccaaactgcttattctgagtgggaacctaaattatgggaagctcttggtgtttccggcgctgctgttgatgatgagccaaaacctgttacaaacgaggatattaagagagaatctaatttcttgagaggtactatcagtgagaacttaaaggatacttcttcaggtggtgttactcacgctaatgaacaattaatgaaatttcacggtatttacacccaagacgatcgtgacattagagaaatacgtaagtcacaaggcttagagccatactatatgtttatggcaagagctcgtttaccaggtggtaagaccactccacaacaatggcttgctctggatcacttatctgatacttcaggcaatggtaccctgaaattaacaacaagggcaaccttccagattcatggtgtgctaaagaagaacttgaaacacacattgagaggaatgaatgcagttcttatggatacattagctgctgcaggtgacgtgaacagaaatgtcatggtttctgctctaccaaccaatgccaaggttcaccaacaaatcgctgatatgggaaaattgatttctgatcatttcttaccaaagactacggcctaccacgaagtttggctggagggcccagaagaacaggacgatgatccatcctggccatctatttttgaaaacagaaaagatggtccaagaaaaaagaagactctagttagcggtaacgctttggtcgatattgaaccaatttacggtccaacttatctgccaagaaagtttaaattcaacatcgccgttcctccatataacgatgtggatgtattatctatcgatgtcggtttagttgctatagttaacccagaaactcaaatcgtggagggttataatgtttttgttggtggtggtatgggtaccactcataacaacaagaaaacttacccaagattagggtcatgcttaggttttgttaaaactgaagacattattccaccacttgaaggtatcgttattgtccaaagagatcacggtgaccgtaaagaccgtaagcatgctcgtttaaagtatactgtagatgatatgggtgtcgaaggcttcaagcaaaaagtggaggaatactggggtaagaaattcgagcctgagagaccatttgagtttaaatctaatattgattactttggatggattaaagatgaaactgggttaaaccactttaccgcatttattgaaaatggtagggttgaagatacaccagatttgcctcaaaagacaggtattagaaaggttgctgaatacatgcttaagactaattctggtcatttcagattgactggtaatcaacatttggttatctctaatattacagatgaacatgttgctggaataaaatctattttaaagacctataaattggataacaccgatttcagcggtttgagattatcttcatcttcctgtgttggtttgccaacatgtggtttagcgtttgccgaatctgaacgtttcctacctgacattattactcagttggaagattgtttagaagagtatggtttacgccatgattccattattatgagaatgactggttgccctaacggttgttctcgtccatggctaggtgaattagctcttgttggtaaagctccacatacttataacttgatgcttggtggtggttacctcggccaaaggctaaacaaattgtataaggccaatgtgaaggatgaggaaattgtcgactacatcaaaccattgtttaaaaggtatgctttagaaagagaagaaggggaacactttggtgatttctgtataagagtaggtatcattaaaccaaccaccgagggtaaatacttccatgaagatgtgtctgaagatgcctattaa

SEQ ID NO: 45895 - DNA, 1080 bp, Saccharomyces cerevisiae
atgagcactaaagttgttaatgttgccgttatcggtgccggtgttgttggttcagctttcttggatcaattgttagccatgaagtctaccattacttacaatctagttcttttggctgaagctgagcgttctttaatctccaaggacttttctccattaaatgttggttctgattggaaggctgctttagcagcctccactactaaaacgttgcctttggatgatttaattgctcatttgaagacttcacctaagccagtcattttggttgataacacttccagcgcttacattgctggtttttacactaagtttgtcgaaaatggtatttccattgctactccaaacaagaaggccttttcctctgatttggctacctggaaggctcttttctcaaataagccaactaacggttttgtctatcatgaagctaccgtcggtgctggtttgcctatcatcagtttcttaagagaaattattcaaaccggtgacgaagttgaaaaaattgaaggtatcttctctggtactctatcttatattttcaacgagttctccactagtcaagctaacgacgtcaaattctctgatgttgtcaaagttgctaaaaaattgggttatactgaaccagatccaagagatgatttgaatgggttggatgttgctagaaaggttaccattgttggtaggatatctggtgtggaagttgaatctccaacttccttccctgtccagtctttgattccaaaaccattggaatctgtcaagtctgctgatgaattcttggaaaaattatctgattacgataaagatttgactcaattgaagaaggaagctgccactgaaaataaggtattgagattcattggtaaagtcgatgttgccaccaaatctgtgtctgtaggaattgaaaagtacgattactcacacccattcgcatcattgaagggatcagataacgttatttccatcaagactaagcgttacaccaatcctgttgtcattcaaggtgccggtgccggtgctgccgttactgccgctggtgttttgggtgatgttatcaagattgctcaaagactttag

SEQ ID NO: 45896 - DNA, 1086 bp, Saccharomyces cerevisiae
atgatttctgctaattcattacttatttccactttgtgcgcttttgcgatcgcaacacctttgtcaaaaagagattcctgtaccctaacaggatcttctttgtcttcactctcaaccgtgaaaaaatgtagcagcatcgttattaaagacttaactgtcccagctggacagactttagatttaactgggttaagcagtggtactactgttacgtttgaaggcacaaccacatttcagtacaaggaatggagcggccctttaatttcaatctcagggtctaaaatcagcgttgttggtgcttcgggacataccattgatggtcaaggagcaaaatggtgggatggcttaggtgatagcggtaaagtcaaaccgaagtttgtaaagttggcgttgacgggaacatctaaggtcaccggattgaatattaaaaatgctccacaccaagtcttcagcatcaataaatgttcagatttaaccatcagcgacataacaattgatatcagagacggtgattcggctggtggtcataatacggatgggtttgatgttggtagttctagtaacgtcttaattcaaggatgtactgtttataatcaggatgactgtattgctgtgaattccggttcaactattaaatttatgaacaactactgctacaatggccatggtatttctgtaggttctgttggtggccgttctgataatacagtcaatggtttctgggctgaaaataaccatgttatcaactctgacaacgggttgagaataaaaaccgtagaaggtgcgacaggcacagtcactaatgtcaactttatcagtaataaaattagcggcataaaaagttatggtattgttatcgaaggcgattatttgaatagtaagactactggaactgctacaggtggcgttcccatttcgaatttagtaatgaaggatatcaccgggagcgtgaactccacagcgaagagggttaaaattttggtgaaaaacgctactaactggcaatggtctggggtgtcaattaccggtggttcttcctattctggatgttctggaatcccatctggatctggtgcaagctgttaa

SEQ ID NO: 45897 - DNA, 1704 bp, Saccharomyces cerevisiae
atggcaagcgaacagtcctcaccagaaattaatgcagataatctaaacagtagtgcagctgacgttcatgtacagccacccggagagaaagaatggtcagacgggttttatgacaaagaagtcattaatggaaatacgccagacgcaccgaagagaggctttttaggttaccttattatctacttactatgctatcctgtatcctttggcggttttttacctggttgggatagtggtattactgcaggcttcatcaatatggataactttaaaatgaattttggttcttacaagcacagtactggtgagtattatttgagcaacgtgcgtatgggtcttctcgtggccatgttcagtgtaggatgttccattggcggtgttgcttttgcgagacttgctgatactttaggtagaaggctagcaattgtaatcgtggttttggtatatatggttggtgcaattattcagatcagttcgaatcacaaatggtaccaatactttgtcggtaagatcatctacggtcttggtgctggtggctgttcggtgttgtgtccaatgcttttatctgaaatagcccccacagatttgagaggtggacttgtctcattgtaccaacttaacatgaccttcggtattttcttgggttattgtagcgtttatggaacaaggaagtatagtaatactgcgcaatggaggattcctgtgggactatgctttctgtgggctctaattatcatcgttggcatgttattagttccagagtccccaagatatctgattgaatgtgagagacatgaagaggcctgtgtctccatcgccaagatcgacaaggtttcaccagaggatccatgggtactcaaacaggctgatgaaatcaacgccggtgtccttgcccaaagagaactaggggaagcctcatggaaagaacttttctccgtcaaaacaaaagtccttcaacgtttgatcacaggtattcttgtgcaaacctttttgcaacttactggtgaaaactacttcttcttctacggaactaccattttcaaatcagttgggcttactgatgggtttgagacttcgatcgtcctaggtacagtgaatttcttctccactattattgctgttatggtcgtagacaaaataggccgtcgtaaatgtctgttattcggagcggcttcaatgatggcttgtatggtcatatttgcaagtatcggggtaaaatgtctttaccctcatggccaggatggtccatcctcgaaaggtgcaggtaatgccatgattgtgttcacatgcttctatatattctgctttgcaacgacatgggcccctgttgcttatattgtggttgccgagtcattcccttcgaaggtcaaatctaaagcaatgtcaatttcgactgcattcaactggttatggcaattcttgattggttttttcacaccattcattactgggtctatccacttctattatggttatgtgttcgtaggttgtttggttgctatgtttttgtacgttttcttctttttaccagaaacaattggtctatctttggaggaaacccagttactatatgaagaaggtataaaaccatggaaatctgcatcttgggtaccaccctcaaggagaggagcttcttccagggaaactgaggctaagaagaaaagctggaaagaagttttgaagttcccaaagagttttaattga

SEQ ID NO: 45898 - DNA, 1074 bp, Saccharomyces cerevisiae
atgtctcaaaatagtaaccctgcagtagttctagagaaagtcggcgatattgccatcgagcaaagaccaatccctaccattaaggacccccattatgtcaagttagctattaaagccactggtatctgcggctctgatattcattattatagaagcggtggtattggtaagtacatattgaaggcgccaatggttttaggtcatgaatcaagcggacaggttgtggaagttggtgatgccgtcacaagggtcaaagttggtgaccgtgttgctattgaacctggtgttcctagccgttactctgatgagaccaaagaagggaggtataacctttgcccacatatggcatttgctgcaactcctccaattgatggtactcttgtgaagtactatttatctccagaagatttccttgtgaaattgccagaaggcgtcagttatgaagagggcgcttgtgtcgaacccttatcagtcggtgtacactctaataaattggctggggtccgctttggtaccaaagttgttgtatttggtgcaggtcctgtggggcttttaactggcgcagtcgcccgcgcttttggtgccaccgacgtcattttcgtcgatgtattcgacaacaagctacagagagcaaaagatttcggagccacaaacactttcaattcttcccagttttccaccgataaagcccaagacttggccgatggggtccaaaagcttttgggcggaaatcacgcagatgtggtgtttgagtgttcaggtgctgatgtttgcattgatgccgctgtcaaaacaactaaggttggaggtaccatggtgcaagtcggtatgggtaaaaactacactaattttccaattgctgaagttagtggaaaggaaatgaaattgattggatgtttccgttattcattcggtgattatcgtgacgctgtgaacttggttgccacaggaaaagtcaatgtcaagccattgataacccacaaatttaaatttgaagatgcagccaaggcttacgactacaacattgcccatggtggagaggtagtcaagactattatctttggtcctgaatga

SEQ ID NO: 45899 - DNA, 1809 bp, Saccharomyces cerevisiae
atgaaaaacttatcttttctcataaacagaagaaaggaaaatacaagtgactcgaatgtatacccaggaaaggctaagtcgcatgaacccagctggatagaaatggatgatcaaactaagaaggacggcttagatattgttcatgttgagttcagtccggatacaagagcgccaagcgatagcaataaagtaataacagagatatttgacgctactgaggatgccaaggaggcagacgaaagtgaaagaggaatgccacttgcgacagcattgaatacatatcccaaggcagcagcttggtcactattggtctctacaactttaatcatggaagggtacgacacagctattcttggagctttctacgccttgcctatttttcagagaaagtttggctcacaaaatgacaaaactggagaatgggaaatttcagcgtcatggcaaatcgggctgaccttatgttatatggcaggtgaaattgtggggctacagctaacggggccctccgtggatcttgttggaaatcgttacacattgattattgcattgttttttttagctgccttcacttttatactgtacttttgcaatagtttaggcatgattgctgtgggacaagcattgtgcgggatgccatggggttgttttcagtgtttgacggtgtcttacgcttctgaaatatgcccattggctctgagatattaccttacaacctattcaaacttgtgctggttatttggacaactttttgcagctggaatcatgaaaaattctcaaaaaaaatatgcggattcagaattaggatataaactaccatttgccctacagtggattttgccagttcctttagcactgggaattttttttgcacctgaatctccatggtggctagttaaaaaaggaaggtttgatgaggcaaggagatcacttagaagaactttaagcggcaagggacctgaaaaagaaatactagtaactctggaggtggacaaaataaaagtgactatagataaggaaaagagactcacaagtaaagaaggctcctatagtgattgttttgaagacaagattaatcgaagaagaacgagaattacttgtctctgctgggctggtcaagccacttgtggttcaatactaataggttattcaacttacttttacgaaaaggctggcgttagtactgaaatgtccttcacttttagtattattcaatactgtctcggtatttgtgctacatttctatcttggtgggcgtcaaagtattttggtagatatgacctttacgcttttggactagccttccaaaccattgtttttttcattattggcggtttggggtgctcaagtacgcacggttccaaaatgggaagtggttctcttttaatggctgtagcatttttttacaatttaggaattgccccggtcgttttttgcctagtctctgaaatgccatcttcaagactaagaacgaaaacaatcattctagcacgtaacacttataatgtggtcagtatcatatgtagcgttctcatcttataccaactgaactctaagaagtggaactggggcgctaagtcaggctttttctggggtgtcttatgcttttgtactttaatctgggctgtggttgacctaccagaaactgccggaaagactttcgtggaaataaatgagttatttaaacttggagtttctgcaagaaagttcaaatcgacgaaagtagatccgtttgttgtcaaaaccccccctaaagacgtctctcataacgaccccaagggagatatcgaagcttccattgcagaggaatag

SEQ ID NO: 45900 - DNA, 1422 bp, Saccharomyces cerevisiae
atgtccgaagaacggcatgaagatcatcatagggatgttgaaaataaattgaatttaaatggtaaagacgatattaacgggaatacctcaatctcgatcgaggtgcctgatggaggatatgggtggtttattcttcttgcttttattctgtacaacttttctacttggggggcaaattctggttatgctatttatttagcgcattatttagagaataatacttttgctggtgggagtaaattagactatgcttctataggtgggttagcattcagttgtggacttttttttgccccagttataacatggctttatcatatattttcaattcaattcattataggcttagggatactgtttcaaggggcagcgctactgcttgcagctttttctgtcacactctgggaaatttatctcacgcaaggcgttttaattggattcggtttagcatttattttcatacccagtgtcacactcatcccactatggttcagaaataaaagatctttagcctctggtataggaactgctggaagcgggttaggtggtattgtctttaacttgggaatgcaaagtattctacaaaagaggggcgttaaatgggcgctcattgctcagtgcataatatgcacatcacttagcaccattgcgcttatgttgaccagaacaacacatcaaggcctacgtcaacataagagatcttacaaatttgaattgctagattatgatgtgctttcaaatttcgcggtctggttactttttggatttgtatcatttgctatgttaggatatgttgtccttttgtattccttgtctgattttaccgttagtttaggttatactagtaagcaaggctcatacgtatcgtgcatggtgagtgtcggctctctgctgggacgaccaattgtgggtcacattgctgataaatatggatcactaacagttggcatgatattgcaccttgtcatggccatcctttgttgggccatgtggataccttgtaaaaatttggccactgcgatacgttttggattattggttggttctattatgggaacaatttggccaacaattgcttcaattgttacacgcattgttggtcttcaaaagcttcctggtacctttggtagtacctggatttttatggcggcttttgccttagttgcccccataatcggtctggaacttcgttcaactgatacgaatggaaacgattattatcgtacagcaatattcgtgggttttgcgtactttggtgttagtttatgccaatggctattgagagggtttataatagctcgagatgagattgctgtgcgtgaagcctattcagctgaccaaaatgaattgcatttaaacgttaagttatcacatatgagtaaatgtctttttcgttataaacaattacctaggagagtctaa

SEQ ID NO: 45901 - DNA, 945 bp, Saccharomyces cerevisiae
atgacagccagtttaactaccaagttcttgaacaatacctatgaaaacccatttatgaatgcatccggtgttcattgcatgactacacaagaattagatgaattagcaaactctaaagctggcgcattcattacaaagagtgctacaaccttagaaagagaaggtaaccctgaaccacgttacatttctgtccctctaggcagtatcaactccatgggtttaccaaacgaaggtatcgactactatttgtcctatgtattaaaccgtcaaaagaattatcctgatgcacctgctattttcttctcagttgctggtatgagcattgatgaaaatttaaatttgttgaggaaaatccaagatagcgaattcaacggtattaccgagttaaacttgtcttgtcctaatgtgcctgggaaaccacaagttgcttatgactttgacttgacaaaggaaaccttggaaaaggtttttgcctttttcaaaaaacctcttggtgtcaagttgcctccttattttgattttgcccattttgatatcatggcaaaaatattgaacgagttcccattagcttatgtcaactctatcaatagtataggaaatggtcttttcattgatgtggagaaggagagtgtagtagtgaagccaaagaatggtttcgggggtattggaggtgaatatgttaagccaaccgcgctcgccaatgttcgtgcattttacactcgtttgagacctgaaatcaaagttatcggtacaggtggaattaagtccggtaaggatgcatttgaacatcttctatgtggtgcctctatgctacagattggtacagaattacaaaaagagggcgtcaagatttttgaacgtatcgaaaaagaattaaaagacataatggaagctaagggttatacatccatagatcagttccgtgggaagttgaacagcatttaa

SEQ ID NO: 45902 - DNA, 2148 bp, Saccharomyces cerevisiae
atgggatatcaattgagtgcaacacttaaagggcacgatcaggacgtcagggatgtggtagctgtggatgattcaaaggttgctagtgtttcgagggatggaacagttcgcttgtggtctaaagatgaccaatggctcggtacggtagtttatacaggacaaggatttttaaatagtgtgtgttatgattccgagaaggagttgttgctttttggaggtaaggatactatgatcaacggtgtgcccttgtttgccacctcaggagaggatcccttgtataccttgattggccaccaagggaacgtttgtagtttatccttccaagatggtgttgtgataagcggtagttgggacaaaaccgcaaaggtttggaaagaaggatcgttggtttacaatttgcaagcacacaatgcctctgtatgggatgccaaagtcgtatccttctcagaaaataaattcttgacagcttccgccgataagacgattaaactgtggcaaaacgataaagtgatcaaaactttcagtgggattcacaatgatgtagtaagacatttagctgtggtggatgatggccattttatcagttgttcaaacgatggcctcatcaagttggttgatatgcatacaggtgacgtactaagaacatatgaaggccatgaaagctttgtttattgcattaaactgctgcccaatggagatattgtaagctgcggcgaagaccgaacagtccgtatatggtcaaaggaaaatggttcgttaaagcaggtaattacacttcctgccatctctatttggtccgttgattgtatgtctaatggtgatattattgtgggaagtagtgataatcttgtgagaatattttcgcaagagaagtcaagatgggcttccgaggatgaaataaatgaactatctacgcaagtggaaaaatccactataagttccaagacaatagaatttgatgagtctaaactatcaccttatgaaattttacaatcgccggggcgcaaagagggtcaaattgtggtagtcaaatcacctcaaggtactatagaagctcatcaattttcaaattcttcatggaaaaaggttggtgatgttgtcggtgcaggtgctactggaaacgacaaaaaaatagaattcgagggtaaaacgtatgactacgtatttgatgtggatattgaagatggaaaacctcccttgaaattgccgattaatgtcagcgacaacccatatacagcagccgacaattttttggctcgttatgaactgccaatgagttatagggatcaagtagtacagttcatactgaagaacactaatggcatatcgctagaccagcccaacgataatgcatcatcttctgcagtatcaccttcaaaaacgagcgtaatgaaggttcttcctgtcaagcagtatcttatcatggaaaattataacccagatactattttcaatggaatagtaaaaataaattcaaatgagaagacctttgatgatgaaattctggcgcaaattggtggcgcactacatgacatagatgaaagctgggagttgctactttcatttgctaacactataagatctaactgggaaattaagactcctgcatacgacatagtacgattgattgtaaaaaaattaccttattcttcagatataaaagattacatcgaagaaggcttgggcaataagaatatcactctaaccatgttaactgtgcgtattttggtaaattgcttcaataatgaaaactggggtgtgaaattactggaatcaaatcaagtttataaatcaatttttgagactatagatactgaattttctcaggcatctgctaaacagtcacagaatttggctattgcagtttccacactaattttcaactattcagctctcgtcacgaaagggaactctgatttagaacttttgcctatcgtagctgacgccatcaacaccaagtatgggccattggaagagtatcaagaatgcgaagaagccgcatataggctaaccgtagcttacggaaatttggctactgttgaacctacattaagacaatttgccaactccgtaacttggcttgcaaacatcaaaaggagctatgggaacgtgccaaggtttaaggatattttcgacgatctctcctaa

SEQ ID NO: 45903 - DNA, 3873 bp, Saccharomyces cerevisiae
atgaactttttaagttttaagactacaaaacactatcacattttcaggtacgtgaacatacggaatgactacaggctgttaatgataatgataataggtaccgtggcaacaggcctagtgccggcaattacttctatcctgacgggcagagtgttcgatctactatcagttttcgtggctaatgggtcacatcaaggtttgtattcccaactagtacagaggtcaatggcagtaatggcacttggtgcggcttctgtgccagtaatgtggctttctctaacaagttggatgcacatcggcgagagacaaggctttagaatacggtcacagatattggaggcatatttggaggaaaagccaatggaatggtacgacaataatgaaaaattgttaggagattttactcaaatcaacagatgtgtggaagagctaagatcaagctccgcagaggcatcagccataactttccagaatttagttgcaatatgtgcgcttctggggacgtcattctactattcttggtcattaactttaattattctttgcagctctccaataatcacattttttgcagtggtgttttccagaatgattcatgtatattcagagaaggagaattctgaaacgagtaaagcagcccaattacttacatggtcgatgaatgccgctcaattagtgagattatattgtacacaacgtctagaaaggaaaaaattcaaggaaatcatactaaattgtaacactttcttcatcaagagttgcttttttgttgctgcaaacgctgggatcttgagatttttgacgttgactatgtttgtacagggattctggtttggttccgcaatgatcaaaaagggcaagctgaacattaacgatgtaatcacttgcttccattcatgcattatgctgggctcgactttaaataatacattacaccaaatagttgttcttcaaaaaggcggagtggctatggaaaaaatcatgactctattaaaagatggatccaagcgaaatcctttaaataaaactgtagcccaccaatttccactagattatgccaccagtgatctaacatttgctaatgtttcgttttcttatccaagcagaccttcggaagcagttttaaagaacgttagtttaaatttctctgcaggacaatttactttcatagtaggaaaatcaggctcaggtaaatctacattatccaacttattattaaggttctacgatggctataatggatcgatatctatcaatggccacaatatccaaacaatcgaccaaaaattgctaattgaaaatatcaccgtcgtagaacagcgttgtaccctatttaatgatactcttagaaaaaatattcttttaggttcaacagattcggtaagaaatgccgattgcagcaccaatgaaaatagacatttaatcaaagatgcctgtcaaatggctcttctggatagatttattctagaccttcccgatggactggaaacattaattgggactgggggtgtcacactaagtggcgggcaacaacaaagagttgctatagcacgtgcattcatcagagatactccaatattattcttagacgaagctgtatcggctctagatattgttcatcgcaacctgttgatgaaggcaattaggcattggaggaaaggaaagactacaatcatattgacgcatgagttgagccaaattgaatctgatgactatttatatttaatgaaggaaggtgaagttgttgaaagcggcacccagtctgaacttctagccgatccgaccactacatttagcacatggtatcacctacagaatgactactctgatgcgaaaactattgtagatacagagactgaagaaaaatctatacacactgtggaaagttttaactctcaattggaaacaccaaaacttggatcatgcttaagtaatctgggatatgatgagacagatcagttgtccttttacgaagcaatctatcaaaaaagatcgaacgttagaacaagaagggttaaagttgaagaggaaaatattgggtatgcactaaaacaacaaaagaacaccgaaagttcaacagggccacaacttctgagcattattcagattatcaaaagaatgattaaaagcataagatacaaaaaaattctaatcttgggactgctatgttctcttatcgcaggcgccacaaatcccgtcttttcatacacattcagtttcttactagaaggaattgtcccatccacggatggaaaaactggctcttcacattatttggcgaaatggtcgcttcttgttcttggtgtggctgcggcagatggtattttcaattttgctaaaggattcctattagattgctgcagtgaatactgggttatggatcttagaaatgaagttatggaaaaactgacgagaaagaatatggactggttttctggtgaaaacaacaaggcttctgaaatttctgctctagtcttgaatgatttgcgagatttgaggtctttggtctctgaatttttgagtgcaatgactagtttcgttaccgtatcaacgattggactaatttgggcgttagtatcgggctggaagttaagtttggtttgtatttcgatgtttccactcataattatattttcagcaatatatggaggcattttacaaaaatgcgaaacagattataagacatctgttgctcagttagaaaactgcctgtaccagattgtcactaacattaaaaccattaagtgcttacaagctgaatttcattttcaattgacctaccatgacttgaagataaaaatgcaacaaattgcctccaaacgcgccattgccacaggatttggtatatctatgacaaacatgattgtcatgtgtatccaagctattatttactactatggcctaaagctggttatgattcacgagtacacctcaaaggaaatgtttacgactttcactttgttattattcactattatgtcatgcactagcctagtaagtcagatacccgatataagtagaggccaacgtgctgccagttggatctataggattcttgatgaaaagcataataccctagaggttgaaaacaataatgctagaacagtgggaatagctggtcacacctaccatggcaaagaaaaaaaaccaatcgtttcaattcaaaatttgacatttgcctatccatctgcacctaccgcctttgtttacaaaaacatgaattttgacatgttttgcggacagacgttaggtatcattggtgaatcaggcacaggaaagtctacacttgtgcttttattaacaaaactttataattgtgaagtaggcaaaattaaaatagacggtacggacgtaaatgactggaatttgacaagtttaagaaaagaaatttcagtggttgagcaaaaacctttattattcaatggaaccatcagagataacctaacttatggtttacaagatgaaatacttgaaattgaaatgtatgatgcattaaaatacgtaggaatccatgactttgtaatttcatcacctcagggcttggatacacgtattgatacaactttactgtcaggtggacaagcgcaaaggctttgcatagccagagcacttctgagaaaatcaaaaattctgattttagatgagtgtacttcagccttggattctgtcagctcctctatcatcaatgagatcgtcaaaaaaggtccacctgctctactaacaatggttataacgcatagtgaacaaatgatgaggtcttgtaactcgattgcagttcttaaagatggtaaagtggttgagcgaggtaacttcgacactttatataataatcgcggggaattattccaaattgtttccaaccaaagcagttaa

SEQ ID NO: 45904 - DNA, 7422 bp, Saccharomyces cerevisiae
atgaataaatacattaacaaatacaccacgccacctaacttattgtctttacgacaaagggccgaaggcaaacacagaacaagaaagaaacttacacacaaatcgcactcccacgatgatgagatgtcaactacttcaaacacagattccaatcacaatgggcccaatgactctggtagagtgatcactggttctgctggtcatattggtaaaatatcctttgtagattcagaactagatacaacattttctactttaaatttgatttttgataaacttaaaagcgatgtgccacaagaacgagcctctggcgctaatgaattaagcactactttgacctcattagcaagggaagtatctgctgagcaatttcaaaggtttagcaacagtttaaacaataagatatttgaacttattcacgggtttacttcaagtgagaagataggtggtattcttgctgttgatactctgatctcattctacctgagtacagaggagctgccaaaccaaacttcaagactggcgaactatttacgtgttttaattccatccagtgacattgaagttatgagattagcggctaacaccttaggtagattgaccgtgccaggtggtacattaacatcagatttcgtcgaatttgaggtcagaacttgcattgattggcttactctgacagcagataataactcatcgagctctaagttggaatacaggagacatgctgcgctattaatcataaaggcattagcagacaattcaccctatcttttatacccttacgttaactctatcttagacaatatttgggtgccattaagggatgcaaagttaattatacgattagatgccgcagtggcattgggtaaatgtcttactattattcaggatagagaccctgctttgggaaaacagtggtttcaaagattatttcaaggttgtacacatggcttaagtctcaatacgaatgattcagtgcatgctactctgttggtatttcgagaattactcagcttgaaagcaccttatctcagggataaatatgatgatatttacaaatctactatgaagtacaaggaatataaatttgatgttataaggagagaagtttatgctattttacctcttttagctgcttttgaccctgccattttcacaaagaaatatctcgataggataatggttcattatttaagatatttgaagaacatcgatatgaatgctgcaaataattcggataaaccttttatattagtttctataggtgatattgcatttgaagttggttcgagcatttcaccctatatgacacttattctggataatattagggaaggcttaagaacgaaattcaaagttagaaaacaattcgagaaggatttattttattgcattggtaaattagcttgtgctttgggcccagcttttgctaagcacttgaacaaagatcttcttaatttgatgttaaactgtccaatgtccgaccatatgcaggagactttaatgatccttaacgagaaaataccctctttggaatctaccgttaattcgaggatactaaatttactgtcgatatccttatctggtgaaaaatttattcaatcaaaccaatacgattttaataatcaattttccattgaaaaggctcgtaaatcaagaaaccaaagtttcatgaaaaaaactggtgaatctaatgacgatattacagatgcccaaattttgattcagtgttttaaaatgctgcaactaattcatcatcaatattccttgacggagtttgttaggcttataaccatttcttacattgagcatgaggattcgtctgtcagaaaattggcagcattaacgtcgtgtgatttatttatcaaagacgatatatgtaaacaaacatcagttcatgctttacactcggtttctgaagtgctaagtaagctattaatgatcgcaataactgatccggttgcagaaattagattggaaattcttcagcatttggggtcaaattttgatcctcaattggcccaaccagacaatttacgcctacttttcatggcgctgaacgatgagatttttggtattcaattggaagctatcaaaataataggcagattgagttctgtcaaccccgcttatgtagttccttctttgaggaaaactttactggaactattaacgcaattgaagttctcaaatatgccaaaaaaaaaggaggaaagtgcaactctattatgtacgctgataaattccagcgatgaagtagcgaaaccttatattgatcctattctagacgtcattcttcctaaatgccaggatgcttcatctgccgtagcatccaccgctttaaaggttttgggtgaactatctgttgttggaggaaaagaaatgacgcgttacttaaaggaattgatgccattgatcattaacacatttcaggaccaatcaaactcttttaaaagagatgccgccttaacaacattaggacagctggctgcttcctctggttatgttgttggccctttactagactacccagagttacttggcattttgataaatattcttaagactgaaaacaaccctcatatcaggcgtggaactgttcgtttgattggtatattaggcgctcttgatccatataagcacagagaaatagaagtcacatcaaactcaaagagttcagtagagcaaaatgctccttcaatcgacatcgcattgctaatgcaaggggtatctccatccaacgatgaatattaccccactgtagttatccacaatctgatgaagatattgaatgatccatcgttgtcaatccatcacacggctgctattcaagctattatgcatatttttcaaaaccttggtttacgatgtgtctcctttttggatcaaattattccaggtatcattttagtcatgcgttcatgcccgccgtcccaacttgacttttattttcagcaactgggatctctcatctcaattgtcaagcaacatattaggccccatgtcgagaaaatttatggtgtgatcagggagtttttcccgatcattaaactacaaatcacaattatttctgtcatagaatcgatatctaaggctctggaaggtgagtttaaaagatttgttcccgagactctaacctttttccttgatattcttgagaacgaccagtctaataaaaggatcgttccgattcgtatattaaaatctttggttacttttgggccgaatctagaagactattcccatttgattatgcctatcgttgttagaatgactgagtattctgctggaagtctaaagaaaatctccattataactttgggtagattagcaaagaatatcaacctctctgaaatgtcatcaagaattgttcaggcgttggtaagaattttgaataatggggatagagaactaacaaaagcaaccatgaatacgctaagtttgctccttttacaactaggtaccgactttgtggtctttgtgccagtgattaacaaggcgttattgaggaataggattcagcattcagtgtacgatcaactggttaataaattactgaacaatgaatgcttgccaacaaatatcatatttgacaaggagaacgaagtacctgaaaggaaaaattatgaagacgaaatgcaagtaacgaaattaccggtaaaccaaaatatcctaaagaatgcatggtattgttctcaacagaagaccaaagaagattggcaagaatggataagaaggctatctattcagcttctaaaggaatcaccttcagcttgtctacgatcctgttcgagtttagtcagcgtttattatccgttggcgagagaattgtttaatgcttcattctcaagttgctgggttgagcttcaaacgtcataccaagaggatttgattcaagcattatgcaaggctttatcatcctctgaaaacccacccgagatttatcaaatgttgttaaatttagtggaatttatggagcacgatgacaaaccattgcctatcccaatccatacattaggtaagtatgcccaaaaatgtcatgcttttgcgaaggcactacattacaaagaggtagaattcttagaagagccgaaaaattcaacaatcgaggcattgattagcattaataatcaacttcaccaaactgattctgctattggtattttgaagcatgcgcaacaacacaatgaattgcagctgaaggaaacttggtatgaaaaacttcaacgttgggaggatgctcttgcagcatataatgagaaggaggcagcaggagaagattcggttgaagtgatgatgggaaaattaagatcgttatatgcccttggagagtgggaagagctttctaaattggcatctgaaaagtggggcacggcaaaacccgaagtgaagaaggcaatggcgcctttggctgccgctgcctggggtttggagcaatgggatgaaatagcccagtatactagcgtcatgaaatcgcagtctccagataaagaattctatgatgcaattttatgtttgcataggaataattttaagaaggcggaagttcacatctttaatgcaagggatcttctagttactgaattgtcagctcttgttaatgaaagctacaatagagcatataatgttgttgttagagcgcagattatagcagagttggaggaaatcatcaaatataagaagttgccacaaaattcagataaacgtctaactatgagagaaacttggaataccagattactgggctgtcaaaaaaatattgatgtgtggcaaagaattctgcgtgtcagatcattggtgataaagccaaaggaggatgctcaagtgaggattaagtttgccaacttatgcagaaaatcgggtaggatggcgctagctaaaaaagtcttaaatacattgcttgaagaaacagatgacccagatcatcctaatactgctaaggcatcccctccagttgtttatgcacaactgaagtacttgtgggctacggggttgcaagatgaggctttgaagcaattaattaatttcacatctagaatggctcatgatttaggtttggatccaaataatatgatagctcaaagcgttcctcaacaaagcaaaagagtccctcgtcacgttgaagattatactaagcttttagctcgttgtttcttgaagcaaggagaatggagagtttgcttacagcctaaatggagattgagcaatccagattcgatcctaggctcctatttgctcgctacacattttgacaacacatggtacaaagcgtggcataactgggcactggccaattttgaagtcatttctatgctaacatctgtctctaaaaagaaacaggaaggaagtgatgcttcctcggtaactgatattaatgagtttgataatggcatgatcggcgtcaatacatttgatgctaaggaagttcattactcttctaatttaatacacaggcacgtaattccagcaattaagggtttttttcattccatttctttatcagaatcaagctctcttcaagatgcattaaggttattaactttatggtttacttttggtggtattccagaagcaacccaagctatgcacgagggtttcaacctaatccaaataggcacatggttagaagtgttgccacagttaatttctagaattcatcaacccaatcaaattgttagtaggtcattactctccctattatctgatctaggtaaggctcatccgcaggcattagtgtaccccttaatggttgcgattaaatccgaatctctctcacgacagaaagcagctttgtccatcatagaaaagatgagaatacatagtccagttttggtcgaccaggctgaacttgtcagccacgaattgatacgtatggcggtgctttggcatgagcaatggtatgagggtctggatgacgccagtaggcagttttttggagaacataataccgaaaaaatgtttgctgctttagagcctctgtacgaaatgctgaagagaggaccggaaactttgagggaaatatcgttccaaaattcttttggtagggacttgaatgacgcttacgaatggctgatgaattacaaaaaatctaaagatgttagtaatttaaaccaagcgtgggacatttactataatgttttcaggaaaattggtaaacagttgccacaattacaaactcttgaactacaacatgtgtcgccaaaactactatctgcgcatgatttggaattggctgtccccgggacccgtgcaagtggtggaaaaccaattgttaaaatatctaaattcgagccagtattttcagtaatctcatccaaacaaagaccgagaaagttttgtatcaagggtagtgatggtaaagattataagtatgtgttgaaaggacatgaagacattagacaggatagcttggtcatgcaattattcggactagttaacacgcttttgcaaaatgacgctgagtgctttagaaggcatctagatatccagcaatatccagcaatcccattatctccgaagtctgggttactgggttgggtaccgaatagtgacacgttccatgtattaattagggagcatagagaagccaaaaaaattcctttaaacattgagcattgggtcatgttacaaatggcacctgattatgacaatttaacgttgttgcagaaagtagaagtcttcacttacgccctaaataatacggagggacaagatctttataaggtgttatggctgaagagtaggtcatcggaaacgtggttggagcgtagaactacttacactcgatcgctagccgtgatgtccatgaccggttatatattggggttaggtgaccgccaccctagtaatttgatgttggatagaatcactgggaaagtcattcatattgattttggtgattgtttcgaggctgctatattaagagaaaaattccccgaaaaagtaccttttagattaactagaatgttaacatatgcaatggaagtgagtggaattgaaggtagcttccgtattacttgtgagaatgttatgaaggtacttagagataacaagggttcattaatggcaatccttgaagcttttgctttcgatcctttgatcaattggggttttgacttaccaacaaagaaaattgaggaagaaacgggcattcaacttcccgtgatgaatgccaatgagctattgagtaatggggctattaccgaagaagaagttcaaagggtggaaaacgagcacaagaatgccattcgaaatgcaagggccatgttggtattgaagcgcattactgacaaattaacggggaacgatataagaaggtttaatgacttggacgttccagaacaagtggataaactaatccaacaagccacatcagtggaaaacctatgccaacattatatcggttggtgtccattctggtag

SEQ ID NO: 45905 - DNA, 3132 bp, Saccharomyces cerevisiae
atgacgacgaccaagaggttgaagtttgagaatctgagaatccaattctccaatgccatagtaggaaactttttaaggttaccgcattcaattataaacgtgttagagtcaaccaactacgctatccaggaattcggtatagcagtccattctcataattcagatatacctattgttcatcttggatgggatggccatgattctggatcgagtgagaatgttgttcttatcaatcctgttttggccacagtatatgatttaaatcaaaagtctccattggtggacttatacatccagcgatatgaccacacacacctggctacggaggtgtatgtcacgccagaaacgagtgatgattgggaaattatcgatgccaatgcgatgaggttccaaaatggtgagattttgcaccaaacccgtatagttaccccaggtgagactttgatttgttatttggaaggaattgttacaaagttcaaaattgacagggtggagccatcaatgaagtctgcgaggatcacagatggttccttggttgttgtggcaccaaaagtcaataaaacacgtttggtgaaggctgagtatggtcatagtaataagacaatactaaaaaatggggctatccaacttttaaagaaggtaatattgaggagtactgtgtgcaaaatggacttccctaaagataacctttttgtcgtatatatcagtgacggggcacaattgccttctcagaagggctacgcttctatcgtaaaatgtagcttaaggcagtccaagaaaagcgattcagataataaatcagttggtatcccttcgaagaagattggggtttttataaaatgtgatagtcagatacccgaaaatcacattgcattaagctctcatctttgggatgcattctttacgcacccaatgaacggagcaaaaatcaaactagagtttctacaaatgaatcaagcaaatataatatccggaagaaatgcaacagtcaatatcaaatattttggcaaggacgttcctaccaagagtggggatcagtattctaagttgttgggcgggagcttattgaccaataacttaatacttccaacagagcaaattataatcgaaataaaaaaaggtgaatccgagcagcagttgtgtaatttgaatgaaatttccaatgaatccgttcaatggaaagtaacccaaatgggtaaagaagaagttaaagatattatcgaaaggcatttgcctaaacattaccacgtcaaagaaactggcgaagtttcgcgcactagtaaagatgaagatgatttcattacggtaaatagtatcaagaaagaaatggtcaattatttgacatcgcctattattgccacaccagctattatattagatggtaagcaagggatcggtaaaacaaggttattaaaagagcttataaatgaagtggaaaaagatcatcacatcttcgttaaatatgcggattgtgaaacattgcacgagacatcaaatttagataaaacccaaaaattaattatggaatggtgttctttttgttattggtatggtccttctttgattgtgttggataacgttgaggctctatttggaaaacctcaagccaatgacggagatccttctaataatggccaatgggataatgcaagcaaacttttgaattttttcatcaatcaggtgacaaagatatttaacaaggataataaacgaatcagagttttattttcaggcaagcagaaaactcaaattaatccgctattgtttgataagcattttgtttcagagacgtggtctttgagagcacctgacaaacatgcaagagcgaagttactggagtattttttctcgaaaaaccagatcatgaaactaaatcgagatttgcaattcagtgatttgtcgttggagacagaaggattttcgccactagatttggaaatattcacagaaaagattttctacgacttgcagttggaaagagattgtgataatgttgtaacaagggaacttttttcgaagtcgcttagtgcgtttacaccatctgcgttgcgtggagtaaagctaacaaaagaaacgaacatcaaatggggggatattggtgctttagcaaatgccaaagatgtccttctagaaaccttagagtggcccacaaaatatgagcctattttcgttaattgtcccctaagattgagatcaggaatcttgctttacggttatcctggttgtggtaaaacgcttctggcgagcgccgtggcacaacaatgtgggttaaactttatctccgttaagggaccagagattttaaacaagtttataggtgccagcgaacaaaacataagagaattgtttgaaagggcacagtccgtcaaaccctgtattctattttttgacgagttcgattctattgcgccaaagagagggcatgactccactggtgtcacagaccgtgtagtcaatcaattattgacccaaatggatggtgccgagggccttgatggtgtatatatactagcagctacaagtagacctgatttgattgatagcgcattgttaagaccgggaagattagacaaaagtgtgatctgtaatataccgactgaatcagagaggttagatatcttgcaagctatcgtcaattcaaaagacaaggatacgggacaaaaaaaatttgcattggagaaaaatgcagacttgaagttgatcgctgaaaagacagctggtttttcgggtgctgatttacaggggctctgctacaatgcttatttgaaatctgtacataggtggctgtctgctgcagaccaatcggaagtggtacccggcaatgataatatagaatacttcagtatcaatgagcacgggcgtagagaagaaaatagactacggctaaagactctattgcagcaagatgtggtgcacgagacaaagacaagcacttcagctgcttctgagctgacagctgtggtcacaataaacgatttattggaagcctgtcaagagacaaaacctagtatttcaacaagtgagttggtcaaattaagggggatttacgataggttccagaaggataggaacggtgagatgcccaatggtgagaattccatcgacattggtagccgactctcccttatgtga

SEQ ID NO: 45906 - DNA, 378 bp, Saccharomyces cerevisiae
atgtttagatccgtttgccgcatttcttcccgcgtggcaccttctgcgtaccgcactataatgggccgttccgttatgtccaacaccatactcgcacaaagattttattctgcaaacttgagcaaagatcaggtttctcaaagggtcattgatgttatcaaggcgtttgataagaactctcccaacattgccaacaagcaaatctccagcgatacccaatttcacaaggatttggggttggactccttggacactgtcgagctgctcgtagctattgaagaagaatttgatattgaaatccctgacaaagtggctgatgagttgagaagtgttggtgaaacggtcgattatatcgcttccaatcccgacgcaaactaa

SEQ ID NO: 45907 - DNA, 604 bp, Saccharomyces cerevisiae
atgggtgctgctccttccaaaattgtggatggtcttttagaagatacaaattgtatgtacacttcggagtgaggaaaagaaagaaaggggaaattaaccgattttactaacactgacactttgaacagttgatagagatgaaattgaaaggttaaggaagagattcatgaaattagatagagatagctcagggtctattgataaaaatgaatttatgagcattcctggcgtttcgtcaaaccctcttgctggacgtataatggaggttttcgatgctgataatagtggggacgtggattttcaagagttcatcacaggattatccattttcagtgggcgtgggtccaaggacgaaaagttaagattcgccttcaaaatctacgacattgacaaggacggtttcatatccaatggtgagttgttcatcgtgttgaagattatggtaggttctaatctggacgatgaacagctgcaacagatagtagataggacgatagtggaaaacgatagcgacggcgacggacgtttaagtttcgaggagtttaagaatgctatcgaaaccacagaagtggccaagagtctgacattgcaatacgatgtgtaa

SEQ ID NO: 45908 - DNA, 1401 bp, Saccharomyces cerevisiae
atgtctagtactcaagtaggaaatgctctatctagttccactactactttagtggacttgtctaattctacggttacccaaaagaagcaatattataaagatggcgagacgctgcacaatcttttgcttgaactaaagaataaccaagatttggaacttttaccgcatgaacaagcgcatcctaaaatatttcaagcgctcaaggctcgtattggtagaattaataatgaaacgtgcgaccccggtgaggagaactcgtttttcatatgcgatttgggagaagtcaagagattattcaacaactgggtgaaggagcttcctagaattaagccattttatgccgtcaaatgtaatcctgataccaaggttttgtcattattagcagagttgggcgttaatttcgattgcgcttccaaagtggaaattgacagagtattatcgatgaacatctcgccggatagaattgtttacgctaatccttgtaaagtagcatctttcattagatatgcagcttcaaaaaatgtaatgaagtctacttttgacaatgtagaagaattgcataaaatcaaaaagtttcatcctgagtctcagttgttattaagaatcgctaccgatgactctaccgctcaatgtcgactttccaccaaatatggctgtgaaatggaaaacgtagacgttttattaaaggctataaaggaactaggtttaaacctggctggtgtttctttccacgtcggttcaggcgcttctgattttacaagcttatacaaagccgttagagatgcaagaacggtatttgacaaagctgctaacgaatacgggttgccccctttgaagattttggatgtaggtggtggatttcaatttgaatccttcaaagaatcaactgctgttttgcgtctagcgctagaggaatttttccctgtaggttgtggtgttgatataattgcagagcctggcagatactttgtagctacagcgttcactttggcatctcatgtgattgcgaagagaaaactgtctgagaatgaagcaatgatttacactaacgatggtgtatacgggaacatgaattgtattttattcgatcatcaagagccccatccaagaaccctttatcataatttggaatttcattacgacgattttgaatccactactgcggtcctcgactctatcaacaaaacaagatctgagtatccatataaagtttccatctggggacccacatgtgatggtttggattgtattgccaaagagtattacatgaagcatgatgttatagtcggtgattggttttattttcctgccctgggtgcctacacatcatcggcggctactcaattcaacggctttgagcagactgcggatatagtatacatagactctgaactcgattga

SEQ ID NO: 45909 - DNA, 6156 bp, Saccharomyces cerevisiae
atggacgcttactccacaagaccattaaccctatctcacggttctttagagcacgtgcttctggtaccaaccgcttcatttttcattgcttcgcaattacaagaacaatttaataaaattttgcccgaacccactgaagggtttgctgcagatgacgagcctaccacacctgctgaactagtggggaaattccttggctacgtatcttctctagtcgaaccttccaaggtcggtcaattcgatcaggtcttgaacctttgcttaacagaatttgaaaactgttatttagaaggcaatgacattcacgccttggctgctaaactattacaggaaaacgacacaactttagtgaagactaaagaactaattaaaaattatattaccgccagaataatggctaagagaccatttgacaaaaaatccaactctgctctttttagggccgtcggcgagggtaacgcacaattggtagccattttcggtggtcaaggtaacaccgacgactactttgaagaattgcgtgatctatatcaaacttatcatgtcttagtgggagatttaatcaagttctccgctgaaactttaagtgaactgattagaactactttagatgctgaaaaagtctttactcaaggtttaaacatattggaatggttggagaacccttcaaataccccagacaaggactatttactttccattccaatttcatgccccttaattggtgtcattcaattggctcactacgtagttactgccaagcttttgggtttcactccaggtgagttaagatcttacttaaaaggtgctacaggtcactctcaaggtttggttactgctgtcgccatagctgagacggattcctgggaatccttcttcgtctccgtaagaaaagcaattactgtattattcttcatcggtgttcgttgttacgaagcatacccaaacacttccctaccaccatccatcttggaagattccttggaaaacaatgaaggtgttccatctccaatgttgtccatttccaatctaactcaagaacaagttcaagactatgtaaataagactaactctcatttgccagctggtaaacaagttgaaatttctctagtcaatggtgcgaagaatctagtcgtatcgggcccaccacaatcattatatggtttaaacttgactttaagaaaggccaaggccccatctggactggatcaatcaagaatcccattcagcgaaagaaaattgaagttctccaataggttcttacctgttgcatcaccattccattcccatctattggttccagcttcagatttgattaacaaagacttagtcaaaaacaatgtcagctttaacgctaaagatattcaaatccccgtttacgacacttttgatggttcagatctaagagtcctttcaggttccatttccgagagaatcgtcgactgcatcattagattacctgtcaaatgggaaactactacacaattcaaagccacccacatattagactttggtccaggtggagcttccggtttaggtgttttaacccatcgtaataaagatggtactggtgttcgtgttatcgttgccggtactctcgacattaacccagatgatgattacggattcaagcaagaaatctttgatgttactagtaatggtttgaagaaaaatccaaactggttggaagaataccatccaaaattaattaagaacaaatcaggcaaaatttttgtcgaaacaaaattttctaaattaatcggtagaccacctttattggttcctggtatgacaccatgtactgtttctccagatttcgtagctgctaccacaaatgctggttataccattgagttggccggtggtggttacttttccgcagcaggtatgaccgccgctattgattctgtggtttctcagatagaaaagggtagtaccttcggtatcaacttgatctacgtcaatccatttatgttacaatggggtattccattaatcaaggaactaagaagcaaaggttatccaattcaattcttgaccattggtgctggtgtcccatcattggaagttgctagtgaatacatagagacattaggtttgaagtacttgggtttgaaaccaggttccattgatgctatttcgcaagttataaacattgctaaagcacatccaaacttcccaatagctttacaatggaccggtggtagaggtggtggtcatcattctttcgaagatgcccacactccaatgttacaaatgtactccaagattagaagacatccaaacattatgttgatattcggttctggtttcggttctgctgatgacacttacccatacttaaccggtgaatggtccacaaaattcgattatccaccaatgccattcgatggtttcctatttggttcgagggtcatgattgctaaggaagttaaaacttctcctgatgctaagaagtgtattgctgcttgtactggtgttcctgatgataaatgggaacaaacctacaagaagccaactggtggtattgtcactgttcgctctgaaatgggtgaaccaattcacaaaattgccactcgtggtgttatgctatggaaggaattcgacgaaaccatcttcaacttaccaaagaataagttggtaccaactttggaagcaaagagagattacattatctcaagattgaacgccgatttccaaaaaccatggtttgctaccgtcaacggtcaagcccgtgacctagccacaatgacatacgaagaagttgcaaagagattggtggaattaatgttcatcagatctaccaactcttggtttgatgtcacatggagaacctttactggtgatttcctacgtcgtgtcgaagaacgtttcactaaaagtaagacattgtctttaatccaatcctattctctactagacaagcctgatgaagctattgaaaaagtatttaatgcttatcctgccgctagggaacagttcttgaatgcgcaagatattgatcactttttgagcatgtgtcaaaatccaatgcaaaaaccagtgccttttgttccagttttggatcgtagattcgagatttttttcaaaaaagattcgttatggcaatctgagcacttggaagccgtcgtcgaccaagacgttcaaagaacatgtatcctacatggacctgttgcagcacaattcactaaagtcatcgatgaaccaattaagagcattatggatggtattcacgatggtcacatcaaaaagttactacatcaatattacggtgacgatgagtcaaagattccagcagttgagtactttggtggtgaaagccctgtagacgtacaaagtcaagttgattcttcctctgtatctgaagactcagctgtttttaaggcaacatcctctactgatgaagaaagctggtttaaggctttggcgggatccgaaattaactggagacatgcaagtttcttatgttcctttatcactcaagataaaatgtttgtttctaacccaattagaaaagttttcaagccaagccaaggaatggttgttgagatttccaacggcaatacttcttcaaagactgttgtcactctttcagaacctgttcaaggtgaattgaaaccaactgttattttgaagttgttgaaggagaacataatccaaatggaaatgattgagaacagaactatggatggtaagcccgtcagcttgccattgttgtacaacttcaacccagataatggttttgctccaatctctgaagttatggaggacagaaaccaaagaattaaggaaatgtactggaaattatggattgatgagcctttcaatttggactttgacccaagagatgtcattaagggcaaagatttcgagatcaccgctaaagaagtttatgactttacacacgctgttggaaacaattgtgaagacttcgtttctagacctgatagaacgatgttggccccaatggactttgctattgttgtcggatggagagccatcatcaaggccattttccctaatacggtcgatggtgacttattgaagttggttcatttgtctaacggctacaagatgattcctggcgctaagccactgcaagttggtgatgttgtttcaactactgctgttattgaatctgtcgtcaaccaacctacaggaaagattgtcgatgtggtaggtacattatcgagaaatggcaagcctgtcatggaagtcacctcctcattcttctacagaggcaactatactgactttgaaaacactttccaaaagactgttgaacctgtttatcaaatgcacatcaaaacttctaaagatatagctgtcttgcgctctaaggagtggttccaattggacgatgaagacttcgatctgttaaacaaaactttgactttcgaaactgaaactgaagttactttcaagaatgctaacatcttctcttcagtgaaatgttttggcccaattaaagttgaattgccaaccaaagaaaccgtggagatcggtattgtcgattacgaagccggtgcctctcacggtaaccctgttgttgatttcttgaagagaaacggttccacattggaacaaaaggtcaatctagaaaatcctattccaattgcagtacttgattcgtacactccaagtaccaacgaaccatacgctagagtttctggtgatttgaatccaattcacgtttcacgtcattttgcctcttacgcaaacttgccaggtactatcacgcacggtatgttttcttctgcttccgtccgtgctttgattgaaaactgggctgctgacagtgtttcatccagggtacgtggctacacttgtcaatttgttgacatggttttgcctaacactgctttgaaaacatcgattcaacatgttggtatgatcaatggtagaaaattgataaagtttgaaactagaaatgaagatgacgttgtagttttgactggtgaagccgaaattgaacaacctgttactaccttcgttttcactggtcaaggttcacaagaacaaggtatgggtatggacttatacaaaacttctaaagctgctcaagatgtttggaatagagctgacaaccatttcaaggacacttatggtttctctatcttagacattgtcattaacaacccagttaacttaacaattcacttcggtggtgaaaagggtaagaggatcagagaaaactattctgctatgatctttgagactatcgtggatggaaaattgaagactgaaaaaattttcaaggaaattaatgagcacagtacttcttacacatttagatctgaaaaaggtttattgtctgctactcaatttacacaaccagctttaactttgatggaaaaagctgctttcgaagacttgaaatctaaaggtttgatcccagccgatgctacttttgctggtcactctttaggtgagtatgctgctttggcctctttggctgatgttatgtctatcgaatctttagttgaagttgtgttctacagaggtatgactatgcaagttgctgttccaagagatgagttgggcagatccaactatggtatgattgccattaacccaggtagagtcgctgcatcattctctcaagaagctttgcaatatgttgttgagagagttggtaagagaaccggctggttggttgaaatcgtcaactacaacgttgaaaaccaacaatatgttgcagctggtgatctaagagctttagacaccgttaccaatgttctaaacttcatcaaattacaaaaaattgatattattgaactacaaaagtccttatctttggaagaagttgaaggtcatttgtttgagatcattgacgaagcttccaagaaatctgctgtcaagcctcgcccacttaaattggagagaggttttgcttgtatcccattagttggtatttctgttcctttccattccacctacttgatgaatggtgttaaaccattcaagagtttcttgaagaagaatatcataaaagaaaatgtgaaggttgctagattggccggaaagtacattccaaacttgactgcaaaaccattccaggttactaaggaatatttccaggacgtttatgatttgactggctccgaacctatcaaggaaatcatcgacaactgggaaaagtatgaacaatcctaa

SEQ ID NO: 45910 - DNA, 1284 bp, Saccharomyces cerevisiae
atgcgtaagtgtaaaatttttgttggtaactctcacccagagttgggtaatatggtttgccaaagattaggtatcgaaccagctccatgtacattaaaaaaatttgcaaatggtgaaacgtcagttcaaatcggtgtatctgttcgtgacgaagatgtgtatgtcattcaatctggttctccatccataaatgatgacattatggaactgttgattttagtttctgcctgtaggggcggatctgctaggaaaattacagcagtcattcctcaatttccttactctaaacaatgtaaaatgaagagacacagaggcgctattactgcaaggatgttggccaatctgttggtcatggctggcgctgatcatgttgtgtctatggaccttcatgcttctcaaatgcaggggtttttcaccaaaccagtcgataacctatacgggggccctagtttagcgaaatggattagagaaaatgttgaagactatgaagatgcagtagttgtctctaagaatccaggtggtactaaaagagttacagccctggcggattctttgaagatcaactttgctatgatccatactgatcgtcgtcgttctaaggatctgtattctcaaaacaaggatttgcaacaactaaagttgagaaagcaatcaatgttgaggaaaaatagaccgatcatcagacaaggtgaccatccaaatgaggaggaaaacattattttaagtaacggtattcaaactgctaggatccgtaacggccacgttatcggtgacgatgaggcagacgatgatgaagacgctatcttagaatctgacagcgaattgcattctattgatggcttagactcgcatggcttgggcggtacatatgatgctgtcgactccgaagacgaagaggaaatcccagttctctatagggaacaactgattacattggtcggaaacgtccgtggtcgctctgccatcattctagatgatatgattgatagacctgggtcatttattagcgctgctgaacatttggtgcaaaattgtggtgccaaaaaggtttatgttgttgctactcacggtatattcactggagactgtttggaagaacttgaaaagtccgatgccattgacacaattgtggtcacaaatacatatccgatttctggcgaacgcatagctgggtccaagaaattggttactatcgatgtttctccaattttcgcagaatgtatccgtcgtgatcattatggtgagagtatttccgttttatttgactctttggcagctctgtaa

SEQ ID NO: 45911 - DNA, 1413 bp, Saccharomyces cerevisiae
atgtcatacaagtcagcaataatagggctttgtttgctagctgtgatactattagctccccctttagcatggcattcacataccaagaatattccagcaatcattttgataacatggcttcttacaatgaatttaacgtgtattgtagatgcggcaatatggagtgacgacgatttcctcacgagatgggatggtaaaggttggtgtgatattgtcatcaagttgcaggttggtgcgaatattggcatatcatgtgccgttaccaacatcatttacaacttgcatacaattttgaaggcagatagtgttttaccggatctttcatcatggacgaaaatcgtcaaggaccttgtgattagcttgttcacacctgtcatggtcatgggattttcatatctgttacaagtatttagatatggtatcgctcgttacaacggttgccaaaacttattgtctccgacatggattaccactgttttgtataccatgtggatgcttatatggtcatttgtgggcgctgtttatgccaccttagtactgttcgtgttttataaaaaacgcaaggacgttagggatattttacactgtaccaattcaggtttaaacctgacaaggttcgcaaggctgttgatattctgtttcattattattttagtcatgttccctttttctgtttacacctttgttcaagatttacagcaggtagaaggacactatacttttaaaaatacccattccagcaccatctggaataccattattaaatttgaccctggcagaccaatttataatatatggctttatgttttgatgtcttacctagtatttctaatctttggcttaggttctgatgctttgcatatgtactctaaattcctgcgttccatcaaactaggatttgtacttgacatgtggaaaagattcattgataagaataaggaaaaacgagtaggcatattgctaaacaagctgtcctcacgcaaagagagccgtaacccattttctacagactctgagaactatatctccacgtgtacagaaaactattctccctgtgtaggtacaccaatatcacaagcgcatttctatgtcgactataggattccagatgatcctagaaaatctcaaaataaaagcaaaaaatatttgtttgctgataaagaaacagatgatattcttgatgaaatagacctaaaagaaagtaggcacatcccttacgtcacgcaaggacagagctttgacgacgaaatatcacttggaggattctcaaaagttactctcgattattcagaaaagcttcataattctgcaagctccaattttgaaggggaaagtctttgctactctccagcttcaaaagaagagaattcaagctcaaacgaacatagttcagaaaatactgcaggcccttaa

SEQ ID NO: 45912 - DNA, 1197 bp, Saccharomyces cerevisiae
atgtatgttgatccgatgaacaacaatgaaatcaggaaattaagcattactgccaagacagaaacaactccagataacgttggacaagacattcctgtaaacgcacattcggtgcatgaggaatgttcttccaacacacccgtggagataaatggaagaaacagcggaaagttgaaagaagaagcgtctgcaggtatttgtttggttaaaaaaccaatgctacaatatagagatacctcaggaaagtattccctaagtgactttcagattttaagaactttgggaactggctcatttgggagagttcacctaattcgttccaatcacaatgggaggttttacgctttgaagacattgaaaaagcacactatagtgaagctgaagcaggttgaacacaccaatgacgaacgccgaatgctttcaattgtttcacatccattcatcattcgaatgtggggaacgttccaagattctcagcaagttttcatggtaatggactacattgaaggtggtgaattattttctttactacgtaaatctcaaagatttcccaacccagtagccaaattttatgccgcagaggtatgcttagcgttggaatatttgcacagtaaggatataatatatagagacttgaaaccagaaaatatccttctagataaaaacggccatatcaagataaccgactttggcttcgcaaaatacgttcccgatgtcacatacacattatgtggcacaccagattacatagcgccggaagtggtcagtacaaaaccgtataataaatcagtggattggtggagttttggtgtgctaatctatgaaatgcttgccggatacactccattttacaattcgaacaccatgaaaacttacgaaaatatactgaacgccgaattgaagttcccaccatttttccatccagacgcgcaggacttattgaagaagctaattaccagagacttaagtgaaaggttgggtaacttacaaaatggaagtgaagatgtcaagaaccatccgtggtttaacgaagtgatatgggagaaattgttagcaagatacatagaaacgccgtacgaaccaccaatccaacagggccaaggtgacacttctcaatttgacagataccctgaagaggaattcaactatggaattcaaggggaggatccatatatggatttaatgaaagaattttaa

SEQ ID NO: 45913 - DNA, 1026 bp, Saccharomyces cerevisiae
atgcaatacaaaaaatcattagttgcctccgccttagttgctacatctttagctgcctatgctccaaaggacccgtggtccactttaactccatcagctacttacaagggtggtataactgattactcttctactttcggtattgctgttgaaccaattgccactactgcttcctccaaggctaagagagccgctgctatctctcaaattggtgacggtcaaatccaagccactaccaaaaccactgctgctgctgtttctcaaattggtgacggtcaaatccaagccactactaaaaccaaagctgctgctgtctctcaaattggtgacggccaaatccaagccaccaccaagactacctcagctaagactaccgctgcagccgtctcccaaattggtgacggtcaaattcaagccactactaaaaccaaagctgctgctgtctctcaaattggtgacggtcaaatccaagccactaccaaaacaactgctgcagctgtctctcaaattggtgacggtcaaatccaagccactactaaaaccactgctgctgctgtttctcaaattggtgacggtcaaatccaagccaccaccaatactactgttgctccagtctcccaaatcactgatggccaaatccaagccacaactttaacttctgcaaccattataccatctccagctccagctccaattactaatggcactgacccagtaactgctgaaacatgtaaaagcagtggcactttagaaatgaacttaaagggtggtatcctgactgacggtaaaggtagaattggttctatcgttgccaacagacaattccaattcgatggtcctccaccacaagctggtgctatctatgctgctggttggtccatcaccccagaaggtaacttggccatcggtgaccaggatactttttaccaatgtttgtcaggaaacttctacaacttatacgatgagcacattggaactcaatgtaatgcagtccacctacaagctatcgatttgctcaactgttaa

SEQ ID NO: 45914 - DNA, 978 bp, Saccharomyces cerevisiae
atgcaatataaaaagccattagtcgtctccgctttagctgctacatctttagctgcctatgctccaaaggacccgtggtccactttaactccatcagctacttacaagggtggtataacagattactcttcgagtttcggtattgctattgaagccgtggctaccagtgcttcctccgtcgcctcatctaaagcaaagagagccgcctctcagataggtgatggtcaagtacaggctgccactactactgctgctgtttctaagaaatccaccgctgctgctgtttctcaaataactgacggtcaagttcaagctgctaagtctactgccgctgctgtttcccaaataactgacggtcaagttcaagctgctaagtctactgccgctgccgtttctcaaataactgacggtcaagttcaagctgctaagtctactgccgctgccgtttctcaaataactgatggtcaagttcaagctgccaagtctactgctgccgctgcctctcagatttctgacggccaagttcaggccactacctctactaaggctgctgcatcccaaattacagatgggcagatacaagcatctaaaactaccagtggcgctagtcaagtaagtgatggccaagtccaggctactgctgaagtgaaagacgctaacgatccagtcgatgttgtttcctgtaataacaatagtaccttgtcaatgagtttaagcaagggtatcttaaccgataggaagggtagaattggctctatcgttgccaacagacagttccaattcgatggtcctccaccacaagctggtgctatctatgctgctggttggtccatcaccccagaaggtaacttagctcttggtgaccaggatactttttaccaatgtttgtctggtgacttctataacttgtatgataagcacattggttctcagtgccatgaagtttatttgcaagctatagatttaattgactgttga

SEQ ID NO: 45915 - DNA, 1302 bp, Saccharomyces cerevisiae
atggcgactgacaccgagaggtgtattttccgtgcattcggccaagattttatcctaaataaacattttcatttgacaggtaagattggtcggggctcacacagccttatttgttcttcaacttacacagaatcgaacgaggaaactcacgtggctatcagaaaaataccaaacgcgtttggcaataaactatcttgcaagagaactcttcgtgaattgaaactactaagacatttaagagggcacccaaatatagtgtggctcttcgatactgatatagtattttacccaaatggggcactaaatggcgtttatttatatgaagaactaatggaatgtgacctttctcaaattataaggtccgaacaacgcctggaagacgcacactttcaaagcttcatatatcagatactgtgtgctctgaaatacatacattctgctaatgttttacattgtgacctgaaaccaaaaaacttacttgttaatagtgattgccaactaaaaatttgtaattttgggctatcgtgtagttattcagaaaaccacaaggttaacgacggcttcattaagggttatataacctcgatatggtataaagcaccagaaattttgctgaattatcaagaatgcacaaaagctgtcgatatttggtcaacaggctgtatcttggccgaactacttggtaggaaaccaatgtttgaagggaaggattatgtagatcatttgaatcatattctacaaatacttggaacaccacctgaggaaacattgcaggaaattgcctctcaaaaggtgtataattatatctttcagttcggtaatatcccgggaagatcgtttgaaagcatactacctggtgctaatccagaagcgcttgaattgctaaagaaaatgctagaatttgatcctaaaaaaaggattactgtagaggatgcactagagcatccatatttgtcaatgtggcatgatatagatgaggaattctcatgtcaaaagacctttagattcgaattcgagcatatcgaaagtatggcggaattaggaaacgaagttataaaggaagtatttgatttcaggaaagttgttagaaaacatcctattagcggtgattccccatcatcatcactatctttagaggatgccattcctcaagaagttgtacaggtccatccttctaggaaagttttacccagttatagtcctgaattttcctatgtaagccaacttccatcactaactacaacccagccatatcaaaaccttatgggaataagctctaattcatttcagggtgttaactaa

SEQ ID NO: 45916 - DNA, 2535 bp, Saccharomyces cerevisiae
atgaccagtaaaaccccaaatcgtgaaattcttcctgataatgtcgttcctttacactacgatttaaccgtggaacctgatttcaaaacattcaaatttgaaggctcagtcaaaattgagctaaaaattaataatcctgcaattgatacggtaacattgaacaccgtcgataccgacatccattctgcaaaaatcggtgatgtcacatcttccgagattatctctgaagaggagcaacaagtcaccacatttgcgtttcctaaagggaccatgtcttctttcaagggtaatgcatttttggatataaaatttactggtattttaaatgataatatggctggcttttacagagccaaatatgaggacaagttaacaggtgagacaaaatacatggctactactcagatggaacctactgatgctagaagggccttcccatgttttgatgagcctaacttgaaagcctcttttgctattactttagtttcagacccatctttgacacacctatccaatatggacgtcaagaacgaatacgtaaaggatggaaaaaaggtcactttgttcaatacgacccctaaaatgtcaacttaccttgttgcttttattgttgctgaattgaagtacgttgaatccaagaactttcgtattcctgtcagagtttacgccaccccaggtaacgaaaaacatggtcagtttgccgcggatttgactgccaagactttggcattttttgaaaaaacttttggcatccaatatcctctacctaaaatggacaatgttgctgttcacgaattttctgcaggagctatggaaaattgggggttagtcacttatagagtggttgatctactactagacaaagataactctacattagatcgtattcaaagagtggctgaggtagttcaacatgaattagctcaccaatggtttggtaacttagttactatggactggtgggaaggcttatggctaaatgaaggttttgctacttggatgtcatggtattcatgtaatgagtttcaaccagaatggaaagtttgggaacagtatgttactgataccttacaacatgcattaagccttgactctttaaggtcctctcatccgatcgaagtacctgtaaaaaaagctgacgaaattaaccaaatctttgatgccatctcttactcaaagggtgcttctttattaaggatgatttcgaaatggttaggtgaagaaacttttattaaaggtgtatcccaatacctgaataaatttaaatacggtaatgcgaagactgaagacctatgggatgctttagcggacgcctccggtaaagacgttcgttctgtgatgaacatctggactaaaaaagttggtttcccagtcatttcagttagcgaagatggtaacggtaaaataacatttcgccaaaaccgttacttaagcacagctgatgtcaagcccgacgaggacaaaaccatctatcctgtatttttggctttgaagactaaaaatggagttgacagttccgttgtattgagtgaaagaagcaaaactattgaattagaagatcctacctttttcaaagttaacagcgaacaatccggaatttatataacatcctacaccgatgaaagatgggcaaaactgggtcaacaagctgacttattgtctgttgaggaccgtgtcggtctggttgctgatgtcaagacactatctgcttctggctacacttcaactactaattttttgaacttagtctccaaatggaataatgaaaagtcatttgtcgtctgggaccaaataatcaacagcatatcttcaatgaaatctacttggttattcgaaccaaaggaaacccaggatgcgcttgataacttcacgaagcaactaataagcggtatgacacaccacttgggttgggaattcaaatcttctgattcgttctccactcaacgtttgaaagtgaccatgtttggtgctgcttgtgccgcaagggacgcagacgttgaaaaagctgctctaaaaatgtttactgattattgcagcggtaataaggaagccatcccagcattgattaaaccaattgtatttaacactgtggcaagagttggtggtgcagaaaactatgaaaaagtttacaaaatctacttagatccaatctctaacgatgaaaaattagccgcattaagatctttaggcagatttaaagaacctaaattattagaaagaaccttaggatatttgtttgatggcactgtcttaaaccaagacatttatattccaatgcaaggaatgagagctcatcaagaaggtgtagaggctttgtggaattgggttaaaaagaactgggacgaactcgtaaagagactacctcctggtctttcaatgctaggctccgtcgtcacattaggtacctctggctttacatcaatgcaaaaaatagatgagattaagaaattctttgccactaaatccacgaaaggtttcgatcaaagtttggctcaatcactggacactattacttcgaaagcgcagtggggttaa

SEQ ID NO: 45917 - DNA, 744 bp, Saccharomyces cerevisiae
atgccaaagttagttttagttagacacggtcaatccgaatggaacgaaaagaacttattcaccggttgggttgatgttaaattgtctgccaagggtcaacaagaagccgctagagccggtgaattgttgaaggaaaagaaggtctacccagacgtcttgtacacttccaagttgtccagagctatccaaactgctaacattgctttggaaaaggctgacagattatggattccagtcaacagatcctggagattgaacgaaagacattacggtgacttacaaggtaaggacaaggctgaaactttgaagaagttcggtgaagaaaaattcaacacctacagaagatccttcgatgttccacctcccccaatcgacgcttcttctccattctctcaaaagggtgatgaaagatacaagtacgttgacccaaatgtcttgccagaaactgaatctttggctttggtcattgacagattgttgccatactggcaagatgtcattgccaaggacttgttgagtggtaagaccgtcatgatcgccgctcacggtaactccttgagaggtttggttaagcacttggaaggtatctctgatgctgacattgctaagttgaacatcccaactggtattccattggtcttcgaattggacgaaaacttgaagccatctaagccatcttactacttggacccagaagctgccgctgctggtgccgctgctgttgccaaccaaggtaagaaataa

SEQ ID NO: 45918 - DNA, 909 bp, Saccharomyces cerevisiae
atgttttccagattatccagatctcactcaaaagcattaccgattgctctaggtacagttgctatagcagctgctaccgcattctattttgcaaaccgtaaccaacattcctttgtcttcaatgaatctaataaagtgttcaaaggtgatgacaaatggatcgacttgccaatatctaaaatagaggaggaatcccacgacaccagaaggtttacttttaagctgcctaccgaagactcagaaatggggttggtcctagcatctgctctgtttgctaaatttgtcacaccaaagggatccaatgtggtgagaccatacactcctgtgagtgatctttcccagaagggtcacttccagctggtcgtcaagcattatgaaggtggtaaaatgacctcacatttatttggtcttaaaccaaatgacaccgtttctttcaagggtcctattatgaaatggaagtggcaacctaatcagttcaagtcaatcaccttgttaggtgccggtaccggtatcaaccctctgtaccaattagctcatcatatagttgaaaacccaaacgacaagaccaaagttaacttgctatatgggaacaagactcctcaggacattttactaaggaaggaactggatgcgttgaaggaaaagtatcctgacaagttcaatgttacttactttgttgacgacaagcaagatgaccaagactttgatggtgaaattagtttcatctccaaagattttattcaggagcatgttccaggtccaaaggaaagcacacatttgtttgtctgcggtcccccaccatttatgaacgcttactcaggtgagaagaagtcacctaaggaccaaggtgaattgatcggtatcttgaacaatttgggctactccaaggaccaagttttcaaattttaa

SEQ ID NO: 45919 - DNA, 1923 bp, Saccharomyces cerevisiae
atgctatcgctaaaaaaatcagcgctctccaagttgactttgctcagaaacacaagaacatttacatcgtcagctttggtgcgccaaacgcagggctctgtaaacggttccgcgtccagatctgcagacgggaagtaccacataatagatcacgagtatgactgtgtggtaatcggtgccggtggtgccggccttagagcggcctttggtcttgccgaggcgggctacaagactgcttgtatatccaagcttttccccaccagatcccacactgttgctgctcagggtggtatcaatgccgctctgggaaatatgcacaaggataactggaaatggcatatgtacgatactgtgaaaggatctgattggctaggtgaccaggactccatccattacatgaccagggaagcgcccaaatcgatcattgaactggaacactatggtgttcctttttcaagaactgaaaacggtaagatctaccaaagagcctttggtggtcagaccaaggagtacggtaagggtgctcaggcctatagaacatgcgctgtcgcagacaggacaggacatgctcttttacacacgctttatggccaagctttaagacatgacacacatttctttattgagtactttgccctcgatctgttgacccataatggcgaggtcgttggtgtcatcgcttataatcaggaagacggtaccatccacagattcagagcacacaagaccattattgccactggtggctatggtagagcatacttctcttgtacctctgctcacacatgtacgggtgacggtaatgccatggtttcgcgtgctggtttccccttgcaagatttagagtttgttcaattccatccttcaggtatatatgggtctggttgcttaatcactgaaggtgctcgtggtgaaggtggttttttggttaattctgaaggtgaaagattcatggaacgttacgctcctacggccaaggatctagcttgtagagatgtcgtttccagagcaatcaccatggagatcagagaaggcagaggtgttggtaagaaaaaggaccacatgtacttacaattgagccatctacctccggaagttctaaaggaaagattgccaggtatctctgaaacagcagccatttttgctggtgtagacgtcaccaaggaacctattcccattattcctaccgtccactataacatgggtggtattcccacgaagtggaatggtgaggcattaaccattgatgaagaaactggcgaagacaaggttattcccggtttaatggcttgtggtgaagccgcttgtgtttctgtccatggtgccaatagattaggtgccaattccttgttggatcttgttgtctttggtcgtgctgttgcccatacggttgctgacactttacagcctgggttgccacacaaaccactaccttctgatttgggtaaagaatccatcgcaaacttggataaactaagaaatgctaatggttcaagatctacggcagaaattagaatgaatatgaaacaaactatgcaaaaggatgtttccgtctttagaacacaatcatctttagatgaaggtgttcggaacattactgcagtagagaagacctttgatgatgtgaagacgaccgatagatcaatgatctggaattctgacttggttgaaactctggagctacagaacttattaacctgtgcctcccaaacagctgtttccgctgctaatagaaaggaatcccgtggtgctcatgcaagagaggattatccaaatagagatgacgaacattggatgaagcatacattatcctggcaaaaggacgtcgctgccccagtgactttgaaatacagaagggttatcgatcacactttggacgaaaaggaatgtccttccgtacctccaactgtaagagcctactaa

SEQ ID NO: 45920 - DNA, 1404 bp, Saccharomyces cerevisiae
atgccaccaaaagaagactgggaaaaatacaaggcacctttggaagacgatgataaaaaacctgatgatgacaagatcgtacccttaacagaaggtgacattcaagtcttaaaatcatacggtgcagctccatacgcagccaaattaaagcaaactgagaatgacttaaaagacattgaagcgagaatcaaagaaaaggccggtgtgaaagaaagcgatacagggttagcaccctcccatctatgggatattatgggtgataggcagagactgggcgaagaacatcccttacaagtcgctcgttgcacgaagatcattaaggggaatggtgaaagtgacgaaactacgacagataataataacagcggcaatagcaatagtaatagcaatcaacagtctactgatgcagacgaagacgatgaagatgccaagtacgtgataaatcttaagcaaattgccaaatttgtcgtcggattaggtgaacgtgtttctccaacagatatagaagaaggtatgcgtgtaggtgtcgataggtcgaaatataatattgaacttccattgcctccaaggattgacccatcagttactatgatgaccgttgaagaaaagcctgacgttacttatagcgatgtcggtggctgtaaagaccaaattgaaaagctgagagaagttgtcgagctgcccttattatctccagaaagatttgctactcttggtattgatccaccaaagggtatcttattatatgggccacctggtactggtaagacattatgtgctcgtgctgttgctaatagaactgatgcaacttttattagggtcattgggtctgagctagtgcaaaaatatgtcggtgaaggtgctcgtatggttagagaattatttgaaatggctcgtaccaaaaaggcttgcattatattcttcgatgaaatcgacgctgttggtggtgctcgttttgatgatggtgctggtggtgataatgaagttcaaagaactatgttagaactgattacacagttagacgggtttgaccctcgtggtaacattaaagtgatgtttgccaccaataggcccaacactttagatccagctttattgagacccggtagaattgatcgtaaggtagagttttcattacctgacttggaaggtcgtgcaaatatcttccgtattcactctaaatcaatgagtgtggaacgtggcatcagatgggaacttatctccagactgtgtccaaactctaccggtgcagaattaagatctgtttgcacagaagccggtatgtttgccattagagcaagaagaaaggtggctactgaaaaggatttcctgaaggctgttgataaagttattagcggatacaagaagtttagttccacatcgcgttatatgcaatataattga

SEQ ID NO: 45921 - DNA, 597 bp, Saccharomyces cerevisiae
atgtctgcaatgatggtcaagttaggactgaataagtcggctctattactgaaaccctccgccttttcaagagcagctgccttgagctcctcgaggaggctgctttttaatacagctagaacaaacttcctttctacctcaccattgaagaatgtggccagtgaaatgaacaccaaagcggcaattgctgaagaacaaatattaaacaagcaaagagcaaagagacctatttctccacatctgaccatttaccagccacaattaacttggtacctgtcttctcttcaccgtatttcgttggtgcttatgggactaggtttctacttgtttactatactcttcggagtctctggtttattaggtcttggattgactaccgaaaaggtttctaattggtaccatcagaagttttccaagattaccgaatggtccatcaagggttcctttgcttacttatttgcaattcactatggtggcgccattagacacttgatctgggataccgctaaggaattgacattgaaaggcgtttacagaactggttacgctctcattggtttcaccgccgttctcggtacttatttattaactttatga

SEQ ID NO: 45922 - DNA, 1587 bp, Saccharomyces cerevisiae
atgtcctacaataatggcaatacttattcaaagagttatagcagaaataataagagacccttgttcggaaagaggtcgccaaatcctcagtccctagcgagaccaccgccaccaaagagaatacggactgatagtggttaccagtcgaatatggacaatatatcttctcatagggtaaattcaaatgaccaaccaggccacacgaaaagtcgtggtaacaataatttatctcgctataacgatacatcctttcaaacaagttccagatatcaaggttcaagatacaacaataataatacgtcgtatgaaaataggcctaaaagcataaaaagggatgaaacaaaggctgaattcctgtctcatttgccaaaggggcccaaatctgttgagaaatcaagatataataattcatccaatactagtaatgatataaaaaatggctatcatgcttcaaaatactataaccacaaaggccaggaagggcggtctgtcatagctaagaaagttccagtttcggttctaacgcagcaaaggagcacgtcagtttacctaaggataatgcaagtcggagaaggaacatatggtaaagtttacaaggcaaaaaacacgaatacagagaagttagtagcgctgaaaaaattgagattacaaggagagagggaaggctttcccataacctctatacgagagattaaactactacaaagttttgatcatccaaatgtctctactataaaagaaataatggtcgaatctcaaaaaactgtatatatgatatttgaatatgctgacaacgacttaagtggattactattaaataaggaagtccaaatttctcactcacaatgcaaacatctcttcaaacaattgctattaggaatggaatatttacatgataataagattttacaccgtgatgttaaaggctcaaacatcttaatcgataaccaggggaatctaaaaataacagattttggactagcgaggaaaatgaattcgcgagctgattacactaaccgtgtcattacgttgtggtacagaccaccagaactattgttgggaactacaaattatggaacagaagttgacatgtggggttgtggctgcctcctggtggaattattcaataaaactgcaattttccagggctctaatgaattagagcaaatagaatcaattttcaagattatgggaactcctacaataaatagctggccaacgctttacgatatgccgtggttttttatgattatgccacagcaaactaccaagtatgtcaacaatttttctgagaaatttaaaagcgttttaccatcttcaaaatgtctgcaattggcgattaatttgttatgttatgatcagacgaaaaggtttagtgcaaccgaagctttacaaagcgactatttcaaggaagaaccaaagcctgaacctttagttcttgatggattggtaagttgccacgaatatgaagtcaaattggcaagaaaacaaaagcgtcctaacatactatccaccaacacaaacaataagggtaatggtaatagtaataataataataataataataatgacgatgatgataaataa

SEQ ID NO: 45923 - DNA, 2313 bp, Saccharomyces cerevisiae
atgcttcgcacgataatattgaaagccgggtccaatgcctccataccgtcaccttcccgccaaaataagttactcaggttcttcgccacagccggcgcagtctctaggaccagtccaggaagcattaagaagattttcgacgacaattcatattggagaaatattaatggtcaggatgctaataatagcaagatctcacaatatctttttaaaaaaaataaaaccggacttttcaagaacccttatttgacttctccagatggtttgcgtaagtttagccaggtttctttgcagcaagcacaagaacttctcgacaaaatgaggaatgattttagcgagagtggtaaattaacctatattatgaacctggacagattaagcgatacgctatgtcgagttattgatttgtgcgagtttattaggtcaacacatccagatgatgcatttgttagggcagcacaagattgccatgaacaaatgtttgaattcatgaatgtcttgaacactgatgtttccttatgtaacatactaaagtcggttttaaacaatccagaagtgtcttcgaagttaagcgcagaagaacttaaagttggtaaaatattattggatgattttgaaaagtcaggaatctatatgaatccagatgttagagaaaagtttatccagttatctcaggaaatcagtttagtaggtcaagaattcatcaaccatacagactatcctggttcaaattctgtgaagataccatgtaaagatctggataatagtaaagtgagtacatttctattgaagcaattaaataaagatgtaaaagggcaaaattataaagtacctacatttgggtatgcagcttatgcattattaaaaagttgtgaaaatgagatggtaagaaaaaagttgtggaccgctcttcacagttgttctgacaaacaggttaaaagattgagtcacttaatcaaactaagggcaatcttggctaatttaatgcacaaaacaagttacgcagagtatcaattggaaggtaaatggcaagatcgaagatgtcaagattttattttgacgttaatgaacaatactatagagaagacagcaaatgaattgaaatttatagctgaactcaaggccaaagatcttaagaagccgttgactacaaacacggacgaaatattgaagctcgtgagaccatgggatagggattactatactggcaaatatttccagctcaacccgtcaaactctcccaatgccaaagaaataagctattattttacattaggaaatgtcattcagggcttgtcagatttgtttcagcaaatatatggtattagattagagccagcaattactgatgagggagaaacatggtccccagacgtgagaagattgaatgtgatatctgaagaggaaggaatcatcggcataatttattgtgatttattcgaacgaaatggcaagacttcaaatccggctcatttcacagtttgttgctctaggcaaatatatcccagtgaaactgatttctcaaccatccaagtcggtgagaatccagacggtacctactttcaattacctgttatttctttggtgtgtaatttttctccaatactaatcgcttctaaaaaaagtctttgttttttgcagcttagtgaagttgaaacgctcttccatgaaatgggacatgcaatgcactcaatgttagggagaactcatatgcaaaacataagtggtacaagatgtgctactgattttgtagagttaccaagtatcctgatggagcacttcgctaaggatatacgaattctgacaaagattggcaaacattacgggactggagaaacaattcaggctgatatgttacagcgcttcatgaaaagcactaacttccttcaaaattgtgaaacatactctcaagcaaagatggctatgctggatcaatcatttcatgatgaaaaaatcatttctgatattgataactttgacgttgtggaaaactatcaagcactagaacgacgtttaaaggtcctagtggacgatcagagtaattggtgtggaagattcggccatttatttggatcggggcaacttattacagctacttattttgataggacgatagcttctaaaatctggtacgcccttttcgaggatgatccgtacagtcgaaaaaatggtgataaatttaaaaagcatttactaaaatggggagggctaaaagacccttggaaatgtatcgctgatgttttagaatgccccatgctagagaaaggcggtagcgatgcgatggaatttatagcacagtctcacaagtcttag

SEQ ID NO: 45924 - DNA, 3816 bp, Saccharomyces cerevisiae
atggctgtcataaaaaagggagcacgcagaaaggacgttaaggagcccaagaagagatctgcaaaaatcaaaaaggctacatttgatgcaaataaaaagaaagaagtaggtatttctgatttgacacttttgtcaaaaatatctgatgaatctatcaatgaaaatttgaaaaaaagatttaagaatggaattatttatacctatattggccatgtgttaattagtgtaaatccgttccgcgatttgggaatatatacaaatgccgttttagagtcatataaaggaaaaaatagacttgaagttccaccacacgtgtttgctattgcggaatctatgtactacaatctcaaatcatacaatgaaaatcagtgtgttattatttctggtgagtctggtgccggtaagacagaagcagccaaacgtattatgcaatatattgcagctgcatctaatagccattcagaatcgattgggaagatcaaagatatggttcttgctactaatccacttctcgagtcattcggttgtgctaaaactctgcggaacaacaattcttcaaggcacgggaagtatctagaaattaaattcaactcacaatttgaaccttgcgcaggtaatatcacaaattatttgctagagaaacaaagagttgttggtcaaattaagaacgaaagaaactttcatattttttaccaattcactaagggagcatctgatacatataaacagatgttcggtgtgcaaatgcctgagcaatatatttacactgctgcggctggctgtacatctgcagatcaattgatgcgtaaagattacgaaggcacgttagaggctatgagaaccattggtttagtccaggaagaacaagaccaaatttttaggatgctggcggcaattctgtggattggtaacatttcctttatagaaaatgaagagggcaatgctcaggtaggagatacctcagtgactgattttgtcgcttatttgttgcaggttgatgcttcgttactggtaaaatgtttagtggaaagaatcatgcaaaccagtcatggaatgaagagaggctcagtttatcatgtacctttgaacccagtccaagcaactgcggtgagagacgcccttgctaaggcaatttataataatttattcgactggattgtcgatagggttaacgtatctttgcaggcatttcctggtgctgataaatcaattgggattctagacatttacggcttcgaaatttttgaacacaactcttttgagcaaatatgtatcaattatgttaatgaaaagttacaacagatttttatccaattgactttgaaggctgagcaagaaacttatgaaagagaaaaaatcaaatggacccccatcaaatactttgacaataaagttgtctgtgatttaatcgaggcgaaaaatccaccgggcattcttgctgcaatgaatgactctattgcaactgctcatgcagactccaatgccgctgaccaggcgtttgctcaacgacttaacttatttaattcaaatccatacttcgaattaagggccaacaaatttgttattaaacattacgctggagatgtcacctatgacatcaatggtatcaccgataaaaataaagaccaacttcaaaaggacctaattgaattaattggaacaacgacaaatacattcctttccacaatttttcctgatgatgttgacaaagattcaaagagacggcctccaacagcaggtgacaaaattattaaaagtgcaaatgaactggtggaaactttgtcaaaagctgagccttcctatatcagaacaatcaagcctaatcaaactaaatcaccaaatgattatgatgatcaccaagtgctacatcaagtaaaatatttgggtttgcaagaaaatgttcgtatcaggagagccggtttcgcttacagacaaactttcgaaaaattcgtcgaaagattttatttactatctccagattgttcatatgctggtgattacacttgggatggggacacccttgaggcagtcaagcttattttaagagatgccatgataccagaaaaagaatttcaacttggagtgacaagcgtattcattaaaactccagaatctctatttgctctagaagacatgcgtgataaatactggtacaacatggctgctagaatccagagagcatggagaaggtttcttcaaaggcgtattgatgctgcgataaaaattcagcgtactatcagagagaaaaagggtggaaacaagtacgtcaagcttcgtgattatggaaccaaacttttagcgggtaaaaaagagagaagatccatgtctttacttggatacagggcttttatgggtgattacttatcctgcaatgagtctaaaacgaaaggatcgtacatcagaagacaggtaggaattaaggataaagttgttttttcgataaagggggaatgcctgcactctaaatttggcagatcagctcaaagattgaaaaaagtgtttatcttaacaaaaaagacattttatattattggacaaacacgggaacagaatgctatgaaatatacacaagattataaaattgatgtcggtaaaattaaacaagtgagcttaacaaacctccaagacgattggatgggcgttatccttgttaatagtacacaatccgatccactcattaacacgcctttcaagacggaattaatgacacgtttgaaaaaattaaatgaaaagataatgataaaagttggtcccacgattgagtatcacaaacaaccaaacaagttgcacactgtccgctcaaagataagcgattcagcaccgaaatacggtgacatctacaagtcaagtacaatatacgtgcgtcgtggacaccctgctaactccaaatcgaataaaaaacctaagaatccaggtgggttgagcgggaaacctatcaaaagcaaaaagagtaaacacaaatctactcataagcatacacatagccatagaagtcatagggatgctgcaaaaaagcaacctctcccttcgcaaaaacctgtgaatccgttatctttgcgagctaccgctgcacaggcagcatacaatcctaaaccggataagaccgtaccaataaagtcatctgcaatccctgctgcaaaagtaagctcgaaacacagctcaaaaccctcatcgaaggaaaaagtcgcagtaaagaaagcctcctcaagccacaaatcctcatccgccaagcaaaaccaggtatcgatgccaccttcaaaaggggttgaaaaaaataaagaaccgttaaaggagacaactgcaactgcaactgcaaacataccaataccaccaccccctccccccatgggccaaccaaaggatccgaaattcgaagctgcatacgactttccaggttccggatcatcttcggagttgccattaaaaaagggcgatattgtatttataagcagagatgaacctagtggttggtctttagcaaagcttctcgatggaagcaaagaaggttgggttcctactgcttatatgactccttataaagacacaagaaatacggtgcctgttgcagcgacaggggcagtgaatgacgttacaaatcagaaatcaagccaaatcgacaataccatttcaagtgcacaagaaggtgtacagtttggaagtgcaacagttggacccactagtgataatcagagtaatccggtggggacgtttagcgacggtttagcttctgcattggcagcaagagcaaacaaaatgcgggcggaaagtgctgacgatgatgataatgacgatggcgatgatgatgatgactggtaa

SEQ ID NO: 45925 - DNA, 1713 bp, Saccharomyces cerevisiae
atgtcacttctaatagattctgtaccaacagttgcttataaggaccaaaaaccgggtacttcaggtttacgtaagaagaccaaggttttcatggatgagcctcattatactgagaacttcattcaagcaacaatgcaatctatccctaatggctcagagggaaccactttagttgttggaggagatggtcgtttctacaacgatgttatcatgaacaagattgccgcagtaggtgctgcaaacggtgtcagaaagttagtcattggtcaaggcggtttactttcaacaccagctgcttctcatataattagaacatacgaggaaaagtgtaccggtggtggtatcatattaactgcctcacacaacccaggcggtccagagaatgatttaggtatcaagtataatttacctaatggtgggccagctccagagagtgtcactaacgctatctgggaagcgtctaaaaaattaactcactataaaattataaagaacttccccaagttgaatttgaacaagcttggtaaaaaccaaaaatatggcccattgttagtggacataattgatcctgccaaagcatacgttcaatttctgaaggaaatttttgattttgacttaattaaaagcttcttagcgaaacagcgcaaagacaaagggtggaagttgttgtttgactccttaaatggtattacaggaccatatggtaaggctatatttgttgatgaatttggtttaccggcagaggaagttcttcaaaattggcaccctttacctgatttcggcggtttacatcccgatccgaatctaacctatgcacgaactcttgttgacagggttgaccgcgaaaaaattgcctttggagcagcctccgatggtgatggtgataggaatatgatttacggttatggccctgctttcgtttcgccaggtgattctgttgccattattgccgaatatgcacccgaaattccatacttcgccaaacaaggtatttatggcttggcacgttcatttcctacatcctcagccattgatcgtgttgcagcaaaaaagggattaagatgttacgaagttccaaccggctggaaattcttctgtgccttatttgatgctaaaaagctatcaatctgtggtgaagaatccttcggtacaggttccaatcatatcagagaaaaggacggtctatgggccattattgcttggttaaatatcttggctatctaccataggcgtaaccctgaaaaggaagcttcgatcaaaactattcaggacgaattttggaacgagtatggccgtactttcttcacaagatacgattacgaacatatcgaatgcgagcaggccgaaaaagttgtagctcttttgagtgaatttgtatcaaggccaaacgtttgtggctcccacttcccagctgatgagtctttaaccgttatcgattgtggtgatttttcgtatagagatctagatggctccatctctgaaaatcaaggccttttcgtaaagttttcgaatgggactaaatttgttttgaggttatccggcacaggcagttctggtgcaacaataagattatacgtagaaaagtatactgataaaaaggagaactatggccaaacagctgacgtcttcttgaaacccgtcatcaactccattgtaaaattcttaagatttaaagaaattttaggaacagacgaaccaacagtccgcacatag

SEQ ID NO: 45926 - DNA, 2043 bp, Saccharomyces cerevisiae
atgtattcttggaagtcaaagtttaagtttggaaaatctaaagaagaaaaagaagccaaacatagtgggttttttcactcctctaaaaaggaagaacagcagaataatcaagcaactgcgggggaacatgatgcttcaattactcgttcatctttagacaggaagggcacgataaatccatcaaattcatcagtggtcccggttcgtgtttcatacgatgcatcctcatcgacctctactgtacgagattcaaatggtggtaattcagaaaacacgaactcatctcaaaatttagatgaaacagcaaatattggttctacagggacacccaatgatgccacctcaagttcaggaatgatgactatcaaagtatataatggtgatgactttattttaccttttccgattacctcaagcgagcaaatattgaataaactattggcctcgggtgttccaccgccacataaggagattagtaaagaagtagatgctttaattgcacaactgtcccgtgttcaaataaagaaccaaggtccagctgatgaagatttgatctctagcgagtcagcagcaaagttcatcccatctactatcatgttaccagggtcttcgaccttaaatcccttactatatttcaccattgaatttgataatacagttgcaactattgaagcagagtatggtacgatcgctaaacctggtttcaataagatatctacctttgatgtgacaaggaaattaccttatttaaagattgatgtatttgcaagaattccgtccattcttttgccctcgaagacatggcaacaggagatgggtttgcaagacgagaagctacagaccatttttgataaaataaattccaatcaagatatacatttagattctttccatttgcccatcaacttaagttttgactctgcagctagtattagactatataatcaccactggatcacattggataatggcttgggtaagatcaatattagtattgattataaaccttccagaaataaacctttgtccatcgatgatttcgatcttttgaaagttatcggtaagggttcgtttggtaaagtgatgcaagtcagaaagaaagatacacaaaaagtatacgctttgaaggcaatcagaaaatcatacattgtctctaaatccgaagtcacgcatactttggcagaaagaaccgttctagcacgtgttgattgtccatttattgtacctttgaagttttctttccaatcaccggaaaaattatactttgttttagcgtttatcaatggtggtgagttgttttatcatctacaaaaggaaggaaggtttgatttatcacgtgccagattttataccgcagaattgttatgtgcgctagacaacttgcataaactagatgttgtctatcgtgatttgaaaccagagaatattttattggattatcaaggccacattgccctttgtgatttcgggctatgcaaattgaatatgaaggatgatgataagacagatactttttgtgggaccccagaatacttggcaccagaactattgctaggtttaggctatacaaaggcagtagattggtggacattgggagtcttgttatacgagatgctcacaggtcttcctccttattatgatgaagatgttccaaaaatgtataagaagattctacaggagccactagttttcccagatggatttgatagagatgcaaaggatctattgattggattattgagccgtgatccgacaagaagattgggctacaatggtgccgacgaaattcggaaccatccttttttcagccaattatcatggaagcgcctgttgatgaagggttatattccaccatataaaccagctgttagtaattccatggatactagtaatttcgatgaggaattcactagggagaagccaattgatagtgtggtagatgaatacttgagtgaaagtgttcaaaagcaatttggtggctggacatacgttggaaatgaacagctaggtagctcaatggtgcaaggtagaagcattagatag

SEQ ID NO: 45927 - DNA, 975 bp, Saccharomyces cerevisiae
atgtcatctgacaactctaaacaagataaacaaattgaaaaaacagccgcccagaagatatcgaagtttggttcgtttgtggctggtgggctagcagcatgtatagctgttacagttactaatccgatcgaattgattaaaatcagaatgcagcttcaaggtgaaatgtcagcatcagctgcaaaagtttataaaaatccaatccaaggtatggcggtaattttcaaaaacgaaggtataaaaggtctgcaaaaagggttaaatgctgcttatatctatcaaattgggctaaatggttccagattagggttttatgagccaatcagatcatcattaaatcagcttttcttcccagatcaagagccacataaggtacagagcgtcggagttaacgtcttttctggtgccgcatctggtataattggtgcagtcattggctctccattattcttggtgaaaacaagacttcaatcatattccgagtttataaaaattggtgaacaaacgcactacaccggtgtttggaacgggttagtaaccatttttaaaaccgaaggtgttaagggtctattcagaggtattgatgcggcaattttaaggacaggtgctggttcctctgttcaactacctatctacaacacagcaaagaacattttggtcaaaaatgatctgatgaaagatggcccagcattacatttaactgctagtactatctctgggttaggtgttgccgtcgttatgaacccatgggatgtcattttgacaagaatctataatcaaaaaggtgacttgtacaagggacctatagattgtttggtcaaaactgttagaatcgaaggtgtaaccgctttgtataagggttttgcagctcaagtgttcagaatcgcacctcatacaatcatgtgtttgaccttcatggaacagacaatgaaactagtttattcgatagagtcgagagttttaggccataattaa

SEQ ID NO: 45928 - DNA, 1356 bp, Saccharomyces cerevisiae
atgttgaggacgaggcttactaattgcagtctatggaggccctactacacgtcatcgcttagtagagtaccaagagcacctccagataaagtcttggggttatctgaacacttcaaaaaggtaaaaaatgttaacaaaattgacctgaccgtaggaatatataaagatggttggggcaaagtgacgacgtttccctccgttgcaaaagctcaaaaattgattgaatctcatttagagttgaataagaatctttcatatttaccaataacaggttccaaagaatttcaggaaaacgttatgaaatttttgttcaaggaatcatgtccgcagtttgggccattttatttagcccatgatagaatcagctttgttcagactttgagtggtacaggcgccctagctgtagcagctaaattcttggcattatttatttcaagagatatttggatacctgacccatcatgggcaaatcataagaacatttttcagaacaatggttttgaaaatatttaccggtattcctattataaggacggtcagatagacatcgacggatggattgagcaattgaaaacctttgcatataacaaccagcaagaaaacaataagaacccaccttgcataatcttgcatgcgtgttgtcacaaccctacaggtctcgacccaactaaagagcaatgggaaaagattatagatactatatatgagctaaaaatggtacccattgttgatatggcttatcagggtttagagtctggtaacttactaaaggacgcatatttattgaggctatgtctcaatgtaaataaatatccaaattggagtaacggtatctttctttgtcaatcttttgccaagaacatgggcctttatggtgaacgagttggttccttaagcgttatcacgccggcaactgcgaacaatggaaagttcaaccctctacaacagaaaaactcattgcagcaaaatattgactcccaattaaaaaagattgtcagaggtatgtattcttctccaccaggatacggttctcgtgtggtaaatgtagtattatcagatttcaaattgaaacagcaatggttcaaggatgttgatttcatggttcagagattgcatcacgtcagacaggagatgtttgaccgtctagggtggccggatcttgtaaatttcgcacaacagcacggtatgttttactatacaaggtttagtccaaagcaagtcgaaatattgagaaacaattacttcgtctatttaacaggtgatggtagattgtcgcttagcggagtcaatgattcgaacgttgattacttatgtgaatctcttgaagcagtctcgaaaatggacaaactcgcataa

SEQ ID NO: 45929 - DNA, 2154 bp, Saccharomyces cerevisiae
atgtgtggtatctttggttactgcaattatctagtggaaagatccagaggagaaattatcgacaccttagtggatggtttacaaagattagaatatagaggctatgattccaccggtattgctatcgatggtgacgaagctgattctactttcatctataagcaaatcggtaaagtgagtgctttgaaagaggagattactaagcaaaatccgaacagagacgttacttttgtctctcattgtggtattgcgcatactagatgggctactcacggtcgaccagaacaagttaactgtcaccctcaaagatctgacccagaagaccaatttgtggtcgttcataatggtatcatcacaaattttagagaactgaagactcttttaattaacaaaggttataaattcgaaagtgataccgataccgagtgtattgctaaactatatttgcatttatacaatacaaatttacaaaatgggcatgacttagatttccacgaattaaccaagctagttcttttagaactagaaggttcatacgggttattatgtaaatcttgtcactatcctaatgaggttatcgccactagaaaagggtcccctttactgattggtgtcaaatctgaaaaaaaactaaaagtcgacttcgtggatgtggaatttcccgaagaaaacgctggtcaaccggaaattccattgaaatctaacaacaaatcatttggcttgggcccaaagaaagctcgtgaatttgaagctggttcccaaaatgccaatttactaccaattgccgccaatgaatttaacttgagacattctcaatccagggctttcctatcagaagatggatctccaacaccggtggaattttttgtttcttcggatgcggcatctgttgttaaacataccaagaaggtgctatttttagaagatgacgatttggctcatatttacgatggtgagttacatattcatagatctagaagagaagtaggcgcatcaatgacaaggtccattcaaactttagagatggagttagctcagatcatgaagggcccttacgaccattttatgcaaaaggaaatctatgagcaaccagaatctactttcaatactatgagaggtagaatcgactatgaaaataataaagtgatattgggtggtttaaaggcatggttaccagttgtcagaagagcacggagactgatcatgatcgcatgcggtacttcttatcattcatgtttggctactcgtgctatcttcgaagaattatcagatatcccagttagtgtggaattagcgtctgactttctggacagaaaatgccctgtcttcagagacgatgtatgcgtgtttgtttcacaaagtggtgaaactgcggataccatgctggctctaaattattgtttagaaagaggagccttaactgtcggaattgttaacagtgttggttcttctatctctcgtgtcacccactgtggtgttcatattaacgctggtcctgaaattggtgttgcctctacaaaagcttatacttcccagtatattgccttagtgatgtttgctctatcgctgtcagatgaccgtgtatcgaaaatagacagaagaattgaaatcattcaaggcttgaagttaatcccgggccaaattaagcaggtattaaagctggaaccaagaataaaaaagctctgtgcgactgaattaaaggatcaaaaatctctattgttattgggtagaggttaccaatttgctgctgctctggaaggtgctttgaagatcaaagaaatttcttatatgcattctgaaggtgttttggcaggtgagttgaagcacggtgtcttggccttggtggacgaaaacttgccaatcattgcttttggtaccagagactctctattccctaaagtagtttcctctattgagcaagttactgcaagaaagggccatccaattattatttgtaacgaaaatgatgaagtgtgggcgcaaaaatctaaatcaatcgacctgcaaaccttagaagttccacaaactgttgattgtttacaaggtctaattaatattattccattacaactaatgtcatattggttggctgttaataaagggattgatgttgattttccaagaaacttggctaaatctgttaccgtcgaataa

SEQ ID NO: 45930 - DNA, 4557 bp, Saccharomyces cerevisiae
atgactggtcacgtttcaaaaacgagccacgtacccaaaggtcgcccgtcttcattggccaagaaggcagctaaaagggccatggccaaagtaaattcgaatccaaaaagggcgtcggggcatttggagcgtgttgtacaatctgtgaacgacgctaccaaaagattatctcagcccgactctaccgtaagtgttgctacaaaatcatcaaagagaaaatccagagacacggtgggtccttggaaacttggcaaaacattggggaagggatcttctggtagggttcgcttggctaaaaatatggaaacaggacaattagctgccattaaaattgtccccaagaagaaagcctttgttcattgttctaataatggaactgttcctaattcttactcttcttccatggtcacttccaatgtatcttctccatcaatagcatctagagaacatagtaaccattctcaaacgaacccatatggcatagagagagaaatagtaatcatgaaattgatatctcacacaaacgttatggcattgtttgaagtttgggagaacaaatcagagctgtacctagttttggaatatgttgatggtggcgaattattcgattatctggtctcgaagggaaagctacctgaaagggaggctatccattacttcaagcagatagttgaaggtgtttcctattgtcattcttttaatatatgccatcgtgatctgaagcctgaaaatttattattagataaaaagaataggagaatcaaaattgctgatttcggcatggcagcattagagcttcctaataaacttttaaaaacttcatgtggctctccacactatgcgtctcctgaaattgttatgggtagaccatatcatggcggtcctagcgatgtctggtcctgcggtatcgttttatttgcattactcaccggtcatttaccatttaatgatgacaacatcaaaaagctgttgttgaaagttcaatcgggcaaatatcaaatgccctcaaatttatcttctgaggctcgtgatttgatatcaaaaatattggtaattgatccagaaaaaagaattaccactcaagagatattgaagcatcctctgatcaaaaaatatgatgatctcccagttaataaagtgctgaggaaaatgagaaaggataacatggcgaggggaaaatctaactcggatttgcatttgctaaataatgtctcgccctctattgtaactttacattcaaaaggggaaattgatgaatccatcttgaggagtttgcaaattttgtggcatggagtttctcgtgaactaatcactgccaagttgcttcaaaagccaatgtcggaggaaaaactattctactcactgttattacaatataaacaacgtcactcaatatcattgtcctcgtcaagcgaaaacaagaaatcagcaacagaaagtagcgtaaatgaacctaggattgaatacgcatccaaaactgccaataatacaggcctaaggagcgagaacaatgatgtgaagactttacattctctagaaattcattcagaagatacttcaacagtgaatcagaacaacgcaattacaggggttaatacagaaattaatgcccctgtattggcacaaaaatcgcaatttagtatcaatacgctcagtcaacctgaaagtgataaggctgaagcagaagctgtaacattaccacccgctattcccatattcaatgcttcttcatcaaggattttccgtaactcatacacctctatttcatcacgttcgagaagatcgctacgcttatcgaattccagattatcattgtccgcttcaacttctagagaaactgtgcatgataatgagatgcctctacctcaactgccgaagtcgccttcaagatattcattgtcaagaagggcaatccacgcctccccatctactaaatcaatacataaatcactttcgaggaagaatatagctgcaactgttgccgctagaagaacactacaaaactcggcttcaaagagatccttatactcattacagtcaatttcaaaacgttccttgaacctgaatgatttattagtctttgacgatcctctccctagtaagaaaccagcatccgaaaatgtgaataaatcagaaccccattcgttggaatcagactctgattttgagatcttatgcgatcagatcttatttggaaacgccttagataggatactcgaagaggaagaggacaatgaaaaagaacgcgacacccaaagacagaggcaaaacgatacaaaatcttcggcagacacttttacgatctctggggtgtctacaaataaggaaaatgagggcccggagtatccaaccaaaattgagaaaaatcaattcaatatgtcatataaaccatctgagaatatgtcagggctctcttcatttcctatctttgaaaaagaaaacacgttaagctcaagttatttggaagaacagaagccaaagagagcggccctttcagatatcacgaactcattcaataaaatgaataaacaggaaggtatgaggatagaaaaaaagattcaaagagaacaacttcaaaaaaaaaatgaccgcccgtcaccactcaaacctattcagcaccaagaacttcgtgtaaattctttgcctaatgatcaaggtaaaccgtccttatctctagatccccgccgtaacatctcccagccagtgaattcaaaagtggaatcactattgcagggactgaaattcaaaaaggagccagcctctcactggacccatgagagaggttccttgttcatgagtgaacatgtggaagacgaaaaaccagtcaaagcctcagatgtttcaatcgaaagttcatatgtacctttaacaacagtagcaacatcttcgagagatcccagtgttttagcagaatctagtacaattcaaaaaccaatgctgtctttaccttctagttttttgaacacatctatgacgttcaaaaatcttagccagatactcgctgatgacggtgatgataagcatctaagtgtgccacagaaccaatctagaagtgtagccatgtcacaccctttgcgaaaacaatctgccaaaatatctctaactccacggtctaatttgaacgccaatttatccgttaaacgtaatcagggctcacctggctcctatttgagtaatgatctggatggaatctctgatatgacatttgcgatggaaataccaacaaacacctttaccgctcaggcgattcaactgatgaacaacgacacggacaataataaaatcaatacttcgcccaaagcatcttcttttacaaaagaaaaagtaatcaaatcggcagcctatatctcgaaggaaaaagaaccagataatagcgatactaattatattccagattatactataccaaacacatatgatgaaaaagccattaatatttttgaagatgcgccctccgatgagggttcattaaatacatcttcttcagaaagcgattcacgagcaagtgtgcataggaaagcggtatctattgacactatggcgacaacaaacgttcttactcccgcgacaaatgttagagtaagtctttattggaataataacagttctggtatacccagagagactactgaagagatactttctaaacttagattgtcaccagaaaatccttctaatacacatatgcaaaagaggttttcttccacgcgtggtagtcgtgatagtaatgcattaggcatttctcaaagtttacagtcaatgttcaaagatttggaggaagatcaagatgggcatacttctcaagctgatattcttgaatcaagtatgagctattcaaagcgaagaccatctgaggaaagcgttaatccaaaacaacgagtgacaatgcttttcgatgaggaggaggaagaatctaaaaaagtaggtgggggaaaaattaaagaagagcataccaagctagacaataaaatatccgaggaatcttctcaacttgtgttgccggtggttgaaaaaaaggaaaatgcaaataatacagaaaataactactctaaaataccaaaaccctcaacgattaaagttacgaaggataccgctatggaatcaaatacacaaacccatacaaaaaagccaattctaaaaagtgtccaaaatgttgaagttgaagaagcgccttccagtgataaaaagaattggttcgtcaaactatttcaaaacttttcttctcataataatgctactaaggcatccaagaatcatgtaacgaatatatcatttgatgatgcgcatatgctaacattaaatgaattcaacaagaatagtatcgactatcaattaaagaacctagatcacaaatttgggagaaaggtggtggaatacgattgtaaatttgtaaaaggcaacttcaaattcaaaatcaagattactagcacacccaatgcatcatcggtaattactgtaaaaaaaagaagcaaacattcaaacacaagttccaataaagcctttgaaaagtttaatgatgatgtggagagagtaattcgaaatgccggacgttcataa

SEQ ID NO: 45931 - DNA, 720 bp, Saccharomyces cerevisiae
atgaaattctccactgctttgtctgtcgctttattcgccttggctaagatggtcattgccgattccgaagaattcggcctggtgagtatccgttccggctcggatttacaatacttgagtgtttacagtgataacggcactttgaaacttggcagcggtagtggctcatttgaggcaactattaccgatgacggtaaactgaaatttgacgacgataagtatgctgttgtcaatgaggatggctcattcaaagaaggttctgagagcgatgctgccactggtttttctattaaagatggccatctaaactacaagagctcttctggtttctacgctatcaaggacgggtcgtcttacattttctcttctaagcaatccgacgacgctaccggtgttgcgattagaccaactagtaagagcggatctgttgcagcagatttttctccaagcgactctagttcctcttcatctgcttctgcttcgtctgcttccgcatcatcttctacaaagcatagttcgagtatagaatctgtcgagacctctactactgtggaaacttcctctgctagctccccaactgcttcagttatctctcaaattactgatggacaaatccaagctccaaacacagtttacgaacaaacagaaaatgcaggtgccaaggctgccgtcggcatgggtgctggtgctctagcggtcgcagctgcttacttgttgtaa

SEQ ID NO: 45932 - DNA, 942 bp, Saccharomyces cerevisiae
atggctccgtatccatacaaagtgcagacgacagtacctgaacttcaatacgaaaactttgatggtgctaagttcgggtacatgttctggcctgttcaaaatggcaccaatgaggtcagaggtagagttttactgattcatgggtttggcgagtacacaaagattcaattccggcttatggaccacttatcactcaatggttacgagtcatttacgtttgatcaaaggggtgctggtgttacatcgccgggcagatcgaaaggtgtaactgatgagtaccatgtgtttaacgatcttgagcattttgtggagaagaacttgagtgaatgtaaggccaaaggcatacccttgttcatgtgggggcattcaatgggcggtggtatctgcctaaactatgcctgccaaggtaagcacaaaaacgaaataagcggatatatcgggtcaggcccattaataattttacatccgcatacaatgtataacaagccgacccaaattattgctccattattggcgaaatttttaccaagggtaaggatcgacactggtttagatcttaaaggaatcacatctgataaagcctatcgtgctttcctcggaagcgatcctatgtctgttccactatatgggtcgtttaggcaaatacacgactttatgcaacgtggtgccaagctctacaagaatgaaaacaattatattcagaagaacttcgctaaagacaaacccgttattattatgcatggacaagacgacacaatcaacgatcctaagggctctgaaaagttcattcaggactgtccttctgctgacaaagaattaaagctgtatccgggcgcaagacattcgattttctcactagagacagataaagtcttcaacacggtgttcaatgatatgaagcaatggttggacaaacacaccacgaccgaagctaaaccataa

SEQ ID NO: 45933 - DNA, 3315 bp, Saccharomyces cerevisiae
atgagctccaacaatgaaccggcccaaagtcgaacatcatatttcaaattgaatgaatttttgtccaacgttaagcattacaagaatacctttaagggtgagattcagtggtgtaataacctgtccttaaacgactggaagacacactatctgcaaattaccagtacaggtgcactaacccactcaatcgatgagttaacagcagactctactaatattcagccaattatcaaacatctacagcaatgtagaatcgagattattaaggataagcattcctcttttaaggatattaatgcaaattgtaattttataatccaagtaaacacctcaggtaaagataataaagtttacctgcgagttaaaagttggagtgatttcaagaaattgctaacatgtctgatctggtggagctcaatgaagacaaatggtatatttaataagtttcaagtatcgcgacctctagaatttaaaagcaaaaaaatggcgaaaccagaaagtttgctggtttacaaattgaatgtttttgggcccatcgttaagaacatcgtccttccgccagcaacaaatattttagaaagccctgatataattaataatgatgacaacagcgtaggttggttttccgctatgggggtgcttaaatcaaacggcatgctagatcttcttttacagagtgacggctctctgatttactcattgaatattagccagcttttaagatcagagataagaattctggattcatctgttttacaaagtgaaaacagtttgtttttaggtgaattgccattactaaggagccagttgggcctcgaaaagtttcgcatagaaaatattgccagtgctgccaccaactctagtgatatttctcaagaaattattgtagagtttcccttaagaatagacctggaggattgttttatagcgttacaatcgttcgctaggtcggaatacttatctattactggctcagataaatcaaatgatatgaagatatcgaatagctttaaaatttccatactggaagctaattttcagtcaatcaatttaaatgacaagaataatacgccatggtcaatattcacagacataacggcctggggccatacatgggctagaacatccatggtttcaaactcctctaatccattttggagagaagagtttcagttcaatgaacttttaagacttactaattcttatctggaaatcaagcagttattccacgatctcaataataaaaaacggttacgattgataggcaaaataaaaatcacacaagaaataataaatgatacaagatataataaggaaacaagactacccatcatggacgttgataacaaaaattttcaaataggaacaatctgtattaaaatttcttcaaatttgaacttcattttaccgtcaaccaatttcgttaaattggaaaaacttttgatgaacgcaaacttgtccatggtttccaatctaatttacaaatcttcttcatcaatggagaatgataacaaattgacgcaaacatccataatttttctcgatatattccaatctttgtcaagaatagaagaatggttccacgtccttatagacaaagaattggctaaaattgatggaacggtttcaagaataaaccagaaaaatttagactcaaagcatgttttcaacagtttattccgtggtaactctatcttaacaaagtcgattgaacagtactttttcagagtgggtaatgaatatttgagtaaagcgcttagtgcaatactaaaagagatcattgagtcaaacaaatcatgtgaattggatcctgctagagtaaaagaaaaagatgaagtaaaaaagaggaaaataattgccgacaactacaaacgattgtattcttgggttacgaagatttggaaaaggctgtatgcaacgagtaatgacctgccgattgaaataagaaatgttttaaaaatctttaggcaaaaactagagataatttgtatcgatgacactttgcaaataattttgaatggtatatcaggattattgtttttaaggtttttttgtccagtcatattaaaccctaagctattcaaatatgtttctcaaaatttaaacgaaacagcaagaaggaatcttaccctaataagtaaagttttacttaatctgtccactttgacgcagtttgcaaacaaagagccctggctaatgaagatgaataactttatcgataaaagacacaatgacttattagattacattgataaaatgacgcaaaagaaactagattttaattcaaagatattgaacctaagttctactatttcgagacccaaattggccattgaacaaacgatgttggatgatttgcctcagattccttatctgcttgataagaatttgagagaaactgagtttgttaacttgattgttaatttcagtcaggaagatatgaccaagatggaaaaatacaatcacatggataatggtgggaagggagaattaatcgaagaggagggcctgttaagcggtagcagcctaaatttgtctgtggataaaaaagatttggattcaccaattgaggttaagccagaaattggagagttagaatttgagaaaataactgaaaacaacacggagatcttcggagatgatttaatgaacctactgaaaagcgatgatgtaggttccagaagcagagatttggataatggcgctaattcaggcatcaaatttaattctataatcccgaaagcagaagaggaaaagcatgcaatgaaagaattggagcaagagtcatgtttactctataataggattaatcatattagaaaacggttgtcaggttatgaatgtgcttccagcactttgtttgaagacaaaaaatactccatttcactctcacataaaattttttatgaagaaataaaggagggaaaagaaattgttcttaaactactaaataaaccaacaaatgaaaactcttccgcaagattgcagaaattcttcacaaaaggtgtctctagtaaatccaataacacagttggagatagttactgtaaatttttgactattgatgtaagtgatgagaatcccaagagtagcaacaaaacatcggtacatggaacatcatcggaaaatggagccaaggatgattacttgacgcttccaaactcgcaaggtaaaggtaacttggggaatagattttccccgacaaagttatctaggataatgaggaaacctcctaacgcagatgttcctaaagaacaaaattcccgtaagctgacaagatggttcaaaaagaaaaaagaaacagggggatcttaa

SEQ ID NO: 45934 - DNA, 675 bp, Saccharomyces cerevisiae
atgatgtcttcagaccaacaggggaaatgccccgtagatgaggaaaccaaaaagttatggctacgagaacatggcaacgaagcgcatcctggtgctactgccccaggcaatcaactagagtgctctgcaaacccacaagataacgataaaacgcctgaatatcacaccacggtggatctctctcagtccagagaggtttccaccataccaaggacgaattctgacagaaactggatatacccgtcggagaaacaattttacgaggcaatgatgaaaaaaaattgggatccgaactcagatgacatgaaggtggttgtgcctttacataactccatcaatgagcgggtttggaactacattaaaagctgggaagacaagcagggtggtgaagcgtgtggcggtatcaaattaacaaattttaaaggtgattccaaaaaactgacaccaagggcctggttcaggtcccgtatcttgcacctggccaaaccttttgatagacatgattggcagatagatagatgcggtaaaaccgtcgactacgtaatcgatttctattccaccgatctgaacgatgcaaactcgcagcaacaaccacttatttatctcgatgttagaccaaaattaaacagttttgagggctttagattacggttctggaaatctttaggcttttga

SEQ ID NO: 45935 - DNA, 1005 bp, Saccharomyces cerevisiae
atgttgtcaagagtagctaaacgtgcgttttcctctacagttgccaacccttataaagtgactgttttgggtgcaggcggtggtattggacaaccattgtctttgcttctaaagcttaaccataaagtcacggacttaagactgtacgacctaaagggcgcaaaaggtgttgccaccgatttgtctcatattccaacaaactccgtggtcaaggggtttactccagaagagccagacggattgaacaacgctttaaaggacacagacatggttttaattcctgctggtgtgcccagaaagcctggtatgacacgtgatgacttgttcgccatcaacgcaagcatcgttcgcgatttggcagcagcaaccgccgaatccgctcccaatgctgccattctggtcatttccaacccagtcaattctaccgttccaattgtcgcccaagtcttgaaaaacaagggtgtttacaacccaaagaaattgttcggtgtgactaccttggactctattagagccgccagattcatctcagaagtcgagaacaccgatccaactcaggaaagggttaacgtcatcggtggacattctggtattaccatcatcccattgatttcgcaaacaaaccataagttgatgtctgatgacaagagacacgaattgattcacagaatacagtttggtggtgacgaagtcgtcaaagcaaagaatggtgctggctctgctacgttgtcaatggcccatgctggtgctaaattcgctaacgctgttttgtccggtttcaaaggcgaaagagacgtcatcgagccttccttcgtggactctcccttgttcaaatccgaaggcatcgaattctttgcatctccggtcactttgggcccagatggtattgaaaagatccatccaataggtgagttatcttcagaagaagaagaaatgctacaaaaatgtaaagaaaccttgaagaagaatatcgaaaagggtgtcaactttgttgctagtaaatag

SEQ ID NO: 45936 - DNA, 1179 bp, Saccharomyces cerevisiae
atggctactgcgttatatactgcaaacgatttcatattaatctcgttgcctcaaaatgctcaacctgttaccgcccctggctccaaaactgattcatggttcaatgagaccttaatcgggggtagggcatttgtttctgatttcaaaattcccgaattcaaaattggctctttagacacattgatagttgaatcggaagaactgtctaaagtagataaccaaattggggcttctattggcaaaatcattgaaattcttcaaggcctcaacgagaccagcaccaatgcttacaggactttacctatcaataatatgccagttcctgaatacttggaaaattttcaatggcaaaccagaaagttcaagttagataagtctatcaaagatttgataacattgatttctaatgaatcttctcaattagacgccgacgtcagagctacttatgcaaattacaacagcgctaaaactaacttggctgctgctgagagaaagaagacgggtgacctttctgtcagatccttgcatgatattgtcaagcccgaagacttcgttcttaattctgaacatttaactactgttctagtagcagttcccaaaagtttaaaatccgatttcgaaaaatcgtacgaaactttatccaagaacgttgtaccagcatctgccagcgtgattgcagaggatgctgagtatgttttgttcaatgttcatttgttcaagaaaaacgttcaagaattcacaacagctgctagagagaagaaattcattcctcgtgaatttaactactcggaggaattaattgaccagttgaaaaaagagcatgactctgctgccagtttagaacaatctttgcgcgtccagttggtaagattggccaagacagcttatgtcgatgtttttataaattggttccacatcaaggccttgagagtttacgtggaatctgttttgcgttacgggttgccacctcactttaacatcaagattatagctgtcccaccaaagaatctctctaaatgcaagtctgaattaattgatgcttttggatttcttggtggcaatgccttcatgaaggataaaaaagggaaaattaacaagcaagatacttctcttcaccaatatgcttctcttgtcgacacagagtatgaaccatttgtgatgtatataatcaatttataa

SEQ ID NO: 45937 - DNA, 1971 bp, Saccharomyces cerevisiae
atgcactggaatataatttcgaaagagcaaagtagctcttctgtatcgttaccaactctagacagcagtgaaccctgtcacatcgaagttatcctcagggcgatacccgaaaaaggattacaaaacaatgagtcgaccttcaaaatagacccatatgaaaatactgtgctatttcgcacaaacaatccgttacatgagacaaccaaggagacccattcaacatttcaattcgataaggtattcgatgctaacgccactcaagaagatgttcagaaatttctggtgcatccaataataaatgatgttttgaatggttataacggtactgtaataacatatggaccaagtttcagcggaaagtcctattcccttattggatcaaaagaaagcgaaggaattctaccgaacatatgcaagaccttgtttgatacgctagaaaaaaatgaagaaacaaagggagatagttttagcgtaagtgttttggcattcgaaatatatatggagaaaacgtatgacttattggtacctttacctgaaagaaaaccattaaagcttcaccgttcttcaagcaaaatggacttagaaatcaaagatatttgtccggcacatgtcggatcgtatgaagacttaagaagctacattcaggcagtccaaaacgtcggcaataggatggcatgtggcgacaagacagagagatcaagatcacacctagtttttcaattacacgtagaacaaaggaatagaaaagatgatatattaaaaaatagttctttatatctggttgatttacacggggcagagaagttcgataaaagaactgaaagtacgctatcacaagatgcgttaaaaaaattaaaccaatctattgaggcgttgaaaaacactgtgcggtccttgtcaatgaaagagcgtgattcagcctacagcgcaaaaggatcacatagttctgcttaccgtgaatcgcaattaactgaagtgttaaaagattcccttgggggaaataggaaaacaaaggtgatattgacatgtttcttaagtaatgttccaactaccctatcaacactagaatttggtgacagtattagacagatcaataacaaggttacagataacaccacaggtttaaatctgaaaaaaaaaatggatctatttattcaggacatgaaaattaaggatgataattatgttgcccaaattaatatactaaaggctgaaatagactctttaaaaagccttcacaataaatctcttcccgaagacgacgagaaaaaaatgttagaaaatacaaagaaagaaaatatcaaactaaagcttcaattagacagtattacccaattattgagtagttctaccaatgaagatcctaacaatcgtattgacgaagaagtttctgaaatattaacgaaaagatgcgaacagattgctcagcttgagttatcttttgatcgacagatgaattccaattctaagttgcagcaagagttagaatacaaaaagtcaaaagaggaagccttagagtctatgaacgttaggctactagaacaaattcagcttcaggaaagagagattcaagagcttttaactactaacgccatcttaaagggtgaactagaaactcacactaaacttactgaaacacgcagtgaaaggataaaatctttggaaagttctgtcaaagagctttctcttaataaatctgcaatcccatctcctagaagagggtctatgagctcgtcatcaggaaatactatgttgcatatcgaggagggttctgaaatatcaaatagcccttggtcagccaatacttcctcaaaacctttagtatggggcgcgagaaaggtttcttctagcagtatagcaaccactggatcacaggagtcttttgtggcaagaccgttcaagaagggattaaacctccattcgataaaagtcacttcgagtactccaaaaagtccctcttctggaagctga

SEQ ID NO: 45938 - DNA, 2208 bp, Saccharomyces cerevisiae
atggcagcaaatagcaatagtagagttgcatcaaaccatacttctaaaaaacaaaaggttaggaggaatatacatccattcacgaataacactcggattaaaagagctagtaaaatcgtaaagtttaatgattcaggcgagggcgaccatgtttcagaccaacgttcgaacaaggaaaatgtccttacttataaatctttgaaaagtcgggcaagcgatttactcaaaatgagagaaacacttcccgtttaccaacacaagcgagaaataatgtcatatattgaaagcaatcccgttaccgtccttattggtgaaacaggttctggtaaatcaacacaaattccgcaattcgtattagaaaaattatatgatacgaagaagcatgggtcgattgctgtaactcaaccccgtcgtgttgcggccatcaatttggctacacgtgttgctcaagaacatggttgcaaactgggtgaacaagtaggttattctgtcagatttgacaatacgactactacaagaacaagacttaagtatctgactgacggtatgttacttagagaacttatgatgaatagtgaccttagagaatacagcgtcatcgttatcgatgaagcgcatgaaagaactgtgcttacagatttgatattggggttcttaaaatccttgatacaagggccaagacctgatttgagaataattgttatgtctgcaacattgcaagccgaaaaatttagtgagttcttcaataatgccccaatcttatttgtagaaggaagaaaatttgatgtcaaacaatactacttgaaggcgccaacagatgatatagtagacgctgtcatcaggtgttgtatacaaataaaccaaggtgaagaactgggagatatcttatgttttttaccgggccaagaagagattgacaaagcagtgactataatggagaaaattgcaaagtatgtttcagatgaggccccagtaccattaatagttccttatcctttatatgcagctcttcccgcggtccaacagtccttggtcttcgctccgataaagggtttcaagagaaaagtcgtctttagtaccaatattgcagaaacatctgttaccatatccggtgttaaatttgtcgttgattctggtcttcgaaaagtcaaagtttggagacatcagctgggattagccactctacttaccgtacccatttctcaggcaagtgcgatgcagagaagtggtcgtgctggtagagaaagtgaaggaaagagtttcaggctttattgtgagtctgattatgtgaaattacctaaacaaagtgaacctgaaatagccagaagtgacgtcacatctcctgtgttaatgttgaagagatatggtgttgatgacctgctaaactggacctggtttgagaaccctggaaaggaagctatagtaatggggcttcaggaactttatgaattgggtgctcttgacactcgtggaaagataactaaacggggtcaacaaatggctctgttaccgctacaaccgcatttaagtagtgtcttaattaaagccagtgaagtcggatgtttgagtcaggtcattgatatcgtctcttgccttagtgtggaaaatttactgttgaatccgtcaccagaagaaagagatgaggtgaacgagcgtcgtttgtccttatgcaacgctggtaaaaggtatggtgaccttatcatgctgaaagagctttttgatatctatttctacgaactagggaaaagtcaagatgcaagctctgaaagaaatgattggtgtaaaggattgtgtatttcgatacgtgggtttaaaaatgtaattcgtgtcagagaccagttaagagtttattgtaagcgtttgttttcttcaatcagtgaagaggatgaagaatccaaaaagattggtgaagatggcgagctaatttcgaaaattttaaagtgtttcttaactgggtttatcaagaatacagctatagggatgccagacaggtcttatagaactgtttccactggagagccgataagcattcatccatcatctatgctatttatgaataaaagctgccccggtataatgtacacggagtatgtctttactacgaagggatatgccagaaatgttagtaggattgaactttcatggttacaagaagttgtcactaatgcagccgctgtagcaaagcaaaaagtttctgattcaaaataa

SEQ ID NO: 45939 - DNA, 2646 bp, Saccharomyces cerevisiae
atgcgaaacgttttaaggcttttatttttaacagcttttgttgctatagggtctttagcagccgttttaggtgttgattacggtcagcaaaatatcaaggccattgtggtttctccgcaagccccattagaacttgtgctcacaccagaggcaaaacggaaggagatatctggtctttcgataaaaagattaccaggttatggaaaggatgatccgaatgggattgaaagaatctacggttccgctgttggcagtttagcaacaaggtttccccaaaacacattgttgcatttgaaaccgctacttgggaaatcactagaagatgaaaccactgtaactttgtattcaaaacaacaccccggtttagaaatggtatcaacaaatagaagtaccatagcctttttagttgataatgtggaatatccattggaagagttagtggcaatgaatgtccaagagattgccaatagagccaattcactgttgaaggatagagatgcaagaactgaggactttgtaaacaagatgagttttacaattcctgacttttttgaccaacatcaaaggaaagcacttttagatgccagttcaataaccacaggaatcgaagagacatatctggttagtgaagggatgtctgttgcagttaactttgtattaaagcagcgccaatttccaccaggtgaacagcagcattatatcgtatatgacatggggagcggttctattaaggcctcaatgttctctatattgcagccggaggacactactcagcccgttacaatagaatttgaaggatatgggtataatccacatctaggtggtgcaaagtttacaatggatattggcagtttgatagagaataagtttttggaaacacacccagccataagaactgatgaattgcacgctaatcccaaggccttagcaaaaatcaaccaagcagcagagaaggcaaagttaattttaagcgccaattctgaggcaagtattaacatagaatcactgatcaacgatattgatttccgtacttctataactagacaggaattcgaagaatttattgcagactcgttattggacattgtcaaacccataaatgacgctgttacaaaacaattcggtggctatggaacaaatttacctgagataaatggggtcattttggcgggaggctcttcccgaattcccattgtgcaggatcaattaatcaaactcgtatccgaagaaaaagtgttgagaaatgtcaatgctgatgaatcagctgtgaatggtgttgttatgagagggatcaagttatctaattcgtttaagaccaagccgttaaatgttgttgaccgttctgtaaatacttattcattcaaattatcaaacgaatctgaactgtatgatgtgttcacgcgcggaagtgcttatccaaacaaaacatctattttgacaaacacgactgattcgattcctaataattttaccattgacttatttgagaatggtaaattgttcgaaactatcacagttaattcaggagctataaagaattcatattcctctgataagtgctcgtcaggagttgcgtataacattactttcgacttgtccagtgatagattattctctattcaagaggttaactgcatttgtcagagcgaaaatgacataggtaactccaagcaaattaagaacaaaggcagccgtttggcttttacttctgaggatgttgagatcaaaaggctttctccttcagaacgttcgcgtttgcatgagcatatcaagttgctcgataaacaggataaggaaagatttcaattccaagaaaatttaaacgttcttgaaagtaacttgtatgatgctagaaacctgctaatggatgatgaagttatgcaaaatggaccaaaatcccaagtagaagagttatcggagatggttaaagtatatttggattggctcgaagatgcatcctttgatactgaccctgaggatatagttagcagaattagagaaattggaatattaaaaaagaaaatagaactttacatggattctgcaaaggaacctttgaactctcaacaatttaaaggaatgcttgaagaaggccataagttacttcaggctatagaaacccataagaataccgttgaagaatttttgagtcaatttgaaaccgagtttgcggataccatagataatgttagagaagaatttaaaaagattaagcaaccagcgtatgtgtcgaaggcgttatctacatgggaggaaaccttaacctcttttaaaaattccattagcgaaatagagaagttcctggcaaaaaacctatttggcgaagaccttcgtgaacatttatttgaaatcaaattacaatttgatatgtatcgtacgaaactagaggaaaaactgcgtttaataaaaagcggtgatgaaagtcgcttaaatgaaataaagaagttacatttaagaaacttccgcctacaaaagagaaaggaggaaaagttgaaaagaaagcttgaacaggaaaaaagcagaaacaacaatgaaacagaatcgacagtaatcaactcggctgacgataaaactactattgtcaatgacaagaccaccgagtcgaatccaagttctgaggaagacattttgcatgatgaattatag

SEQ ID NO: 45940 - DNA, 462 bp, Saccharomyces cerevisiae
atgtctagtcaaacagaaagaacttttattgcggtaaaaccagatggtgtccagaggggcttagtatctcaaattctatctcgttttgaaaaaaaaggttacaaactagttgctattaaattagttaaagcggatgataaattactagagcaacattacgcagagcatgttggtaaaccatttttcccaaagatggtatcctttatgaagtctggtcccattttggccacggtctgggagggaaaagatgtggttagacaaggaagaactattcttggtgctactaatcctttgggcagtgcaccaggtaccattagaggtgatttcggtattgacctaggcagaaacgtctgtcacggcagtgattctgttgatagcgctgaacgtgaaatcaatttgtggtttaagaaggaagagttagttgattgggaatctaatcaagctaagtggatttatgaatga

SEQ ID NO: 45941 - DNA, 1080 bp, Saccharomyces cerevisiae
atgggtgttgaacaaatcttaaagagaaagaccggtgtcatcgttggtgaagatgtccacaacttattcacttacgctaaggaacacaagttcgctattccagctattaacgtcacctcttcttctactgccgtcgctgctttagaagctgctagagacagcaagtccccaatcattttgcaaacctctaacggtggtgctgcttacttcgctggtaagggtatctctaacgaaggtcaaaatgcttccatcaagggtgctattgccgctgcccactacatcagatccattgctccagcttacggtatcccagttgtcttacactctgaccactgtgccaagaagttgttgccatggttcgatggtatgttggaagctgatgaagcttacttcaaggaacacggtgaaccattattctcctcccacatgttggatttgtctgaagaaaccgatgaagaaaacatctctacttgtgtcaagtacttcaagagaatggccgctatggaccaatggttagaaatggaaatcggtattaccggtggtgaagaagatggtgttaacaacgaaaacgctgacaaggaagacttgtacaccaagccagaacaagtttacaacgtctacaaggctttgcacccaatctctccaaacttctccattgctgctgctttcggtaactgtcacggtttgtacgctggtgacatcgctttgagaccagaaatcttggctgaacaccaaaagtacaccagagaacaagttggttgcaaggaagaaaagccattgttcttggtcttccacggtggttccggttctactgtccaagaattccacactggtattgacaacggtgttgtcaaggtcaacttggacactgactgtcaatacgcttacttgactggtatcagagactacgtcttgaacaagaaggactacataatgtccccagtcggtaacccagaaggtccagaaaagccaaacaagaagttcttcgacccaagagtctgggttagagaaggtgaaaagaccatgggtgctaagatcaccaagtctttggaaactttccgtaccactaacactttataa

SEQ ID NO: 45942 - DNA, 1923 bp, Saccharomyces cerevisiae
atgtcacctcgacagcttataccgacattaattccggaatgggcaccattatcccagcaatcgtgcataagagaggatgagttagatagtcccccgataacgcctacgagccagacatcttcatttggttcttctttttctcaacagaaaccaacctatagtacaattataggagaaaatatacacacgatcctggatgaaattcgaccatatgtgaaaaaaataactgttagtgaccaagataagaaaactataaaccaatatacgctaggagtctctgcaggaagtggacaatttggttatgtacgaaaagcgtacagttctactttaggcaaggttgttgctgtcaagattataccaaaaaaaccttggaatgcccagcaatattcagtaaatcaagtaatgaggcaaatccagctttggaagagtaaaggaaaaataacgacaaatatgagtggtaatgaggctatgagacttatgaatatcgaaaaatgtaggtgggaaatttttgcggcttcaagacttcgaaataatgttcatattgtgcgactaatagaatgcttggactctcctttcagcgaatctatctggatagtcactaattggtgcagccttggtgaactacagtggaaacgtgacgatgatgaagatattttaccgcaatggaaaaaaattgtgatttcaaattgtagtgtttctacatttgccaaaaaaatcctggaggatatgacaaaagggttggaatatttgcattctcagggttgtattcatcgtgatatcaaaccgtccaatattttattggatgaagaagaaaaagtagcgaaactttctgattttggaagttgtattttcactccccaatcattacctttcagcgatgctaattttgaagattgttttcagagggaattgaacaaaattgttggtactccggcatttattgcaccagagctatgtcatttgggcaattccaaaagagattttgtgacggatggctttaagttggatatttggtcattgggagtgacactatactgcttactgtacaacgagctgccatttttcggggaaaatgaattcgaaacctaccacaaaatcatcgaagtatcattgagttccaaaataaatggtaatactttaaacgatttagtcattaaaaggttattggagaaagacgttactttacgcataagtattcaggatttagtaaaggttttgtcgcgtgaccagcccatagattctaggaatcacagtcaaatttcatcgtccagtgtgaaccccgtaagaaacgaaggtcctgtaagaagattttttggtaggctactgactaaaaaaggaaagaaaaagacctcaggaaaagggaaagacaaggtattggtatctgcaactagtaaagtaacaccttcgatacatatcgacgaggaaccggataaagaatgtttttcgactacggtccttagatcttcgccagactcgagcgattattgttcatcgttaggggaggaagccattcaggttacggatttcttagatactttttgtaggtcaaatgaaagcttacctaatttgactgtgaataatgataagcagaattcggacatgaaaactgacagaagcgagtcatcctctcattcgtcattgaaaatcccaacacctatcaaagccatgataagactaaagagttcccctaaagagaacgggaacagaacccatattaattgctcacaggacaaaccgagttccccactaatggataggactgttggaaagcgcacggttaacaattcaggggctagaaagcttgctcattcaagtaatattctcaactttaaagcatacataaattcggaagatagtgacattcgagaaacagtagaagatgtaaaaacgtatctgaactttgcagataatggtcaaatatag

SEQ ID NO: 45943 - DNA, 1587 bp, Saccharomyces cerevisiae
atgttcaggcagtcaaaaagaagaattgcctcaaggaagaattttagttcatacgatgatattgtcaaaagcgaattggacgtaggcaacacaaatgcagctaaccagatcatcttaagttcaagttcatctgaagaagagaaaaaactttacgctaggctgtatgagtctaaattatcattttacgatttaccaccacagggagaaataacgttggaacaatttgagatctgggcaatcgatcgtctcaaaattctgttagagatcgaatcttgcctttcaagaaacaaatcgatcaaagaaattgaaaccattatcaagccgcagttccaaaaactactgcctttcaacacagagagtttagaagacagaaaaaaggattactactctcatttcattttaagattgtgcttttgtcgttcaaaagaactgcgggaaaaattcgtcagggctgaaacgtttttgttcaaaattagatttaacatgctaacctccaccgatcaaacaaaatttgttcaatcattggacttacccttactacagtttatctcaaatgaagaaaaggccgaattatctcatcagttgtatcaaacagtttctgcgtctctacagttccaattgaatttaaacgaggaacatcaaagaaaacagtatttccaacaggaaaaattcataaaattacctttcgaaaatgtgatagaactggtaggaaaccgtttagtgtttttgaaggacgggtacgcatatttaccacaattccagcaattgaatttactttctaatgagtttgctagcaaattgaaccaggagttaataaaaacgtaccagtacttaccaagactgaatgaggatgaccggttgttaccaattctaaatcatctttcgtcggggtacactatcgcggatttcaaccagcaaaaggcaaaccaattcagtgagaacgtagatgatgagattaatgcgcaaagtgtctggtctgaagagattagctcaaactatccgctatgtatcaaaaacctgatggagggtcttaaaaagaaccatcatttgaggtattatgggagacaacaactgagtctgtttttgaaaggtatcggcctgagcgctgatgaagcgttaaaattttggtctgaggcatttacaagaaatgggaacatgacaatggagaagttcaataaagaataccgttacagcttcaggcataattacggtcttgaaggtaacagaatcaactacaaaccatgggactgtcacactatcctttccaagcccagacctgggcgcggagattatcatggatgccctttccgtgattggagtcacgagagactatctgcagaattgcgctctatgaagttgacccaagcgcagatcatcagtgttctggattcctgccagaaaggtgaatacacaattgcttgcactaaagtgtttgaaatgacacacaactctgcatcagcggatttggaaattggcgagcaaacgcatatcgcgcatcctaacctatacttcgaaagatcaaggcaactgcaaaagaaacagcagaagctggaaaaggaaaaactattcaataatggtaatcattag

SEQ ID NO: 45944 - DNA, 1101 bp, Saccharomyces cerevisiae
atgtaccatgttcctgaaatgaggctacattaccccctggtgaacactcaatctaacgccgcaataacacccaccagaagttacgacaatacccttccttcgtttaacgagctatcacaccagagtacaatcaatcttccattcgtccaacgcgaaactccaaacgcatatgctaatgttgcccaattagctacgtcgccaactcaggctaaatcagggtattattgtcgctattatgctgtgccttttcccacatatccacaacaaccacaatctccatatcaacaagctgtacttccttatgccaccattcccaacagcaatttccaaccatcttctttccctgtgatggcagtgatgcctccagaggttcaatttgatggatcattcttgaacaccttacatcctcacacagagttgcctccaatcattcaaaacactaatgatactagcgtcgcacgtccaaataaccttaaatcaatagcagcagcgtcaccaacagtgacagcaacaacaagaacacctggcgtcagttcaacgtcagttctcaaaccacgcgttataactacgatgtgggaagatgagaatactatctgctaccaagtagaggcgaacggtatatcagtcgtgcgtagggctgacaacaacatgattaacggcaccaagttgttgaatgtcacgaagatgacaagggggagaagggatggaatattaagatccgagaaggttagggaagtcgtgaagattggctccatgcacctcaagggtgtttggattcctttcgaaagggcttatatcctggctcaacgtgaacagattctagatcatctgtacccgctcttcgtcaaagatatagaatccattgttgatgccagaaagcccagcaacaaggcatctttgacccccaaatctagccctgcccccatcaagcaagaaccatctgataataaacacgaaattgctactgaaattaagccgaagagtattgatgctttatcgaatggagcatctactcagggtgctggcgaactgccccacttaaaaatcaaccatatcgatactgaggcccaaacaagtagagcaaaaaatgaattatcataa

SEQ ID NO: 45945 - DNA, 1092 bp, Saccharomyces cerevisiae
atgaacggatctcccactcctaagcgatattcatccaaatcttcaaggctttacgacgactactataacatcccgtatcaatattccaatccgactccaatgaatagagactataatgacgtggggtcacgtatcaatgcagataaactggtaccagaggaatacaaacggaatacagaatttatcaacaaagctgtccaacaaaataaagaacttaacttcaaactgagagaaaagcagaacgaaatattcgaactcaagaagattgcagaaactctgcgctcaaagctcgaaaaatatgttgacattaccaaaaagcttgaagaccaaaacctcaacctacagataaaaataagcgacctagaaaagaaactttctgacgctaattctactttcaaagaaatgagattccccaaggtcaaggaccccatggtagatgacgaccctgtctccgaaaattatgatcagataaatgtaccaaaacacagagcaccggatgctacaggtaatcctcgtacaactaacaaagtctccaatacttcagaccaagatagcagactaaaagccattgaaagaaccctctcggtcctcacaaattatgttatgaggtcagaagacggtaataacgacaggatgtcacccttaccttctcctttaaatacgatattgccaataaataatcgtctgaattttcaagagccaaagagatataatccaaccgttaaggtaaatccgtctgatgacgatatcatgatgtatgaaagtgcagagctgaagcgtgtcgaagaagaaatagaggagctaaagagaaaaatacttgttaggaaaaaacatgacttaagaaaattgtctttaaataaccaactccaagagctgcaaagcatgatggacggtgatgacaatataaaacttgacaatgtttcgaagcataatcatgctacgcatcgtcattcttcccaatccagtcgcgattactcaccctcttcggatgcttgcttggagtgttctaatgatttatacgagaaaaatagagtcaagcctgaaaataatatgtcagaaacattcgcaactcccactcccaataatcgatga

SEQ ID NO: 45946 - DNA, 3513 bp, Saccharomyces cerevisiae
atgaacgagctgaacactgtttcgactaactccagtgactccaccaagaacggtggtacatccaatagtcccgacgatatggactccgcagcagcagcaagtcacgcaataaagaaaagaacaaaggcctcccgggcctgcgatcagtgtcgtaaaaagaagattaaatgtgactacaaagatgaaaagggggtctgctcaaactgccaaaggaatggagaccgttgtagttttgatagggttcctttgaaaaggggaccctcgaaaggctatacgaggagcaccagccatccaaggactaacgaaatacaagaccacaataactcaaggtcgtataatacgtttgataatagtaacaataccctgaataataatacgggcaatagcggcgacaacggtataaacagtaacacagttccaagtaccccttcgagatctaattcagttttattgcccccactgacacagtacattccccaggctggtggcattcctcctagtttccaaaatccagcgatacaatcaactatgcccgcgggtaatattggccaacagcagttttggaaagtgccctaccatgagtttcaacaccaaagaaaaggatctatcgattctttgcaaagtgatatatcggtaagaacattaaatcccaacgagcagttgtcttataacaccgttcaacagtctcccataacgaataaacatactaatgattctggaaatgcaaacggaagtgtcaccggctcaggcagtgcctctggtagtggtggttattggtcctttataagaacttctggtttactagctcctactgatgatcataatggggaacagacaagaagatcaagttccataccttctttgctacgaaatacttcaaattctcttttactaggtggccagcctcagcttcccccacctcagcaacaatcgcagccacaagcacaccaacaaaagttgcaacaaggacagaacctatactcgtattctcaattttcccagcagcaaccgtacaacccatcgatatcatcttttggccagttcgctgctaatggttttcattctagacaaggatcagtcgccagcgaggctatgtctcccagtgcacctgccatgtttactagcacatctacaaaccccgtaaatgttgcacagcaaacacaaagacctcaaggacagcaggtaccgcaattttcatctgagttggatggaaataaaaggcgacaatcagcccccgtatcagtaacattatccacggacaggctgaatggtaatgagaataataatggtgaaattaacaacaataatggcagcaataatagcggttcttctaaggatacatctcaacattcccaagaatctgtaactacaccagcggctttggaagcatccagccctggatcaacgccacagagaagtacaaaaaaacgcagaaaaagttacgtatctaagaagacaaaaccaaagagagattcatctatatctataacatcgaaagattctgctcacccaatgaccacttcatcaactatcgcgtatggacagatatccgatgtagatctaatagacacctactatgagttcatacatgtaggatttccgatcatacctttaaacaaaacgaccttgaccagtgacttattgttagttaacacacagccaatttccaatatacacgaagtcaattcatatgttattttgtggtttagaaattcattggaattgttagttcgtgttgctctgaaacaaaagccaggtggcaagtttttcgataatattgttggcgtggctttgtcgccaagtaatgacaacaacaaagctgggttcactacagccacggcaagggatgatgctgaaaaaacaagacgtgattcacataatgaagtacaggatactttggaagtgcaaagcgtttttattgccgccctcaatgaatgtttccaaaaaatcgtggatattcatcccaaattcagagaaaacaacgaccaaatttcgccgaagatcaaagtcatttatttatctacttttattcttttaaattacattttggcatttgttggatacgataactcatttgtacttggaatgtcggtgacaatttttaacgaatttaaattatacaaacttctattatttccggagccggatataaatgatgtgaagcctccagttgatgaagaggtcagcactggtaatgggaatacaaaaacgtccgaatttgaaattggatctgaaagtgctgggcatatgaatccatccaattcaccaaattccatggacgaaaacattagtcactattcagtgttgtttaaaagattatacgttttgctttcagtgtttgattctttacaaagctgtgcattcggtggtcccaagctattaaacatttccatccaaggttctacagaaagatttttttctaatgatttgggctcaaaatggtgcctggaacaaagccaattgagactgaaaagcgtcttgcaaagcttgaaattgggtgaattgatgagtgagcttaccaggaatagaatatcaatgaacggcaataggaagcctgggttcgatattacgaactcgtcttcactcttatcggaatatgtggaaactcaacctctatccgtagcacagttattttgcaagctattaattggcaaacacaatttcatcaattgcttattatcattatacgattcagaagcaggagtctattcagatttgacattggatttgagttcgaaaatagcagactctctgtgctcattgatatcaataattttgcaagtattgacgttgatattaagactgaatcctacgaacagtattgattttaattatagaccaccgaacccacccgctaataatccgacagtgcaagagggcccatctgctatgggctcgtctccagtcgctgggaaccttagcgctgcacctccatcggaggggaatccagatttttacaagaaattactaggcctgaaacaagacactggcactatcctttcagacctttgccgggggataatttccccctttgctattgctatcctgcacgaggtctacaacatcactgaactggtcaagcagatgcctacatcactcattagcattatgatgacggcaactacaacgcagaatactcaggacaccaagaagtcgcaggacctggtcatgaagctgtcaaactcgatgaatgaagtagttcaaatcaccagcgtgctgacaatgatcaagccattcaagatcttcgagcacgagcttaataagcccataatgtccctgacaggaggactttcgtccacgaccagaaacgacgtcatgtggccaaagtcgggccaaggcctccgcgagtcatcagtcatgaagacattgcttgatgaacgccgtacttctggtacacaaccgacaacggcgccagtagccgcagaggaacccaggcttgagaacgttgccctggaaaatttcgttagtatcggctggaagctgttggacgattccgagttaggctggtattga

SEQ ID NO: 45947 - DNA, 1500 bp, Saccharomyces cerevisiae
atgtccactaagaagcacaccaaaacacattccacttatgcattcgagagcaacacaaacagcgttgctgcctcacaaatgagaaacgccttaaacaagttggcggactctagtaaacttgacgatgctgctcgcgctaagtttgagaacgaactggattcgtttttcacgcttttcaggagatatttggtagagaagtcttctagaaccaccttggaatgggacaagatcaagtctcccaacccggatgaagtggttaagtatgaaattatttctcagcagcccgagaatgtctcaaacctttccaaattggctgttttgaagttgaacggtgggctgggtacctccatgggctgcgttggccctaaatctgttattgaagtgagagagggaaacacctttttggatttgtctgttcgtcaaattgaatacttgaacagacagtacgatagcgacgtgccattgttattgatgaattctttcaacactgacaaggatacggaacacttgattaagaagtattccgctaacagaatcagaatcagatctttcaatcaatccaggttcccaagagtctacaaggattctttattgcctgtccccaccgaatacgattctccactggatgcttggtatccaccaggtcacggtgatttgtttgaatctttacacgtatctggtgaactggatgccttaattgcccaaggaagagaaatattatttgtttctaacggtgacaacttgggtgctaccgtcgacttaaaaattttaaaccacatgatcgagactggtgccgaatatataatggaattgactgataagaccagagccgatgttaaaggtggtactttgatttcttacgatggtcaagtccgtttattggaagtcgcccaagttccaaaagaacacattgacgaattcaaaaatatcagaaagtttaccaacttcaacacgaataacttatggatcaatctgaaagcagtaaagaggttgatcgaatcgagcaatttggagatggaaatcattccaaaccaaaaaactataacaagagacggtcatgaaattaatgtcttacaattagaaaccgcttgtggtgctgctatcaggcattttgatggtgctcacggtgttgtcgttccaagatcaagattcttgcctgtcaagacctgttccgatttgttgctggttaaatcagatctattccgtctggaacacggttctttgaagttagacccatcccgttttggtccaaacccattaatcaagttgggctcgcatttcaaaaaggtttctggttttaacgcaagaatccctcacatcccaaaaatcgtcgagctagatcatttgaccatcactggtaacgtctttttaggtaaagatgtcactttgaggggtactgtcatcatcgtttgctccgacggtcataaaatcgatattccaaacggctccatattggaaaatgttgtcgttactggtaatttgcaaatcttggaacattga

SEQ ID NO: 45948 - DNA, 2010 bp, Saccharomyces cerevisiae
atgcttagaaccagactatccgtttccgttgctgctagatcgcaactaaccagatccttgacagcatcaaggacagcaccattaagaagatggcctattcagcaatcgcgtttatattcttctaacactagatcgcataaagctaccacaacaagagaaaatactttccaaaagccatacagcgacgaggaggtcactaaaacacccgtcggttctcgcgccagaaagatcttcgaagctcctcacccacatgccactcgtttgactgtagaaggtgccatagaatgtcccttggagagctttcaacttttaaactctcctttatttaacaagggttctgcatttacacaagaagaaagggaagcgtttaatttagaagcattgctaccaccacaagtgaacactttggacgaacaactggaaagaagctacaagcagttatgctatttgaagacgcccttggccaaaaacgacttcatgacgtctttgagagtacagaacaaagtcctatattttgcattaataaggagacatatcaaggaattagttcctatcatttacaccccaaccgaaggtgatgctattgctgcctattcccacaggttcagaaagccagaaggtgtgtttttagacattaccgaacctgattccatcgaatgtagattggctacatacggtggagacaaagatgtagactacatcgttgtgtcggattcggaaggtattctgggaattggtgaccaaggtatcggtggtgtacgtattgctatctccaaattggcattgatgacgctgtgcggtggtattcatcccggccgtgtgctacctgtgtgtttggacgtcggtactaacaacaagaaactagcccgtgacgaattgtacatgggtaacaagttctccagaatcaggggtaagcaatatgacgacttcttggaaaaattcatcaaggccgttaagaaagtgtatccaagcgccgttctgcatttcgaagatttcggtgttaagaacgctagaagattactagaaaagtacaggtacgaattgccatcattcaacgatgacattcagggcaccggtgccgtcgtgatggcctcgttgattgctgctttgaaacataccaacagagacttgaaagacaccagagtgcttatttacggtgccgggtctgcgggcctcggtatcgcagatcaaattgtgaatcatatggtcacgcacggcgttgacaaggaagaagcgcgcaagaaaatcttcttgatggacagacgtgggttaattctacaatcttacgaggctaactccactcccgcccaacacgtatacgctaagagtgatgcggaatgggctggtatcaacacccgctctttacatgatgtggtggagaacgtcaaaccaacgtgtttggttggctgctccacacaagcaggcgcattcactcaagatgtcgtagaagaaatgcacaagcacaatcctagaccgatcattttcccattatccaaccctactagactacacgaagccgttcctgccgatttaatgaagtggaccaacaacaacgctcttgtagctaccggatctcctttcccacctgttgatggttaccgtatctcggagaacaacaattgttactctttcccaggtatcggtttaggtgccgtactatcgcgtgccaccaccatcacagacaagatgatctccgctgcagtggaccaactagccgaattgtcgccactaagagagggcgactcgagacctgggttgctacccggcctggacaccatcaccaacacttctgcgcgtctagctaccgctgtgatcttgcaagcactcgaggagggaaccgcccgtatcgagcaagaacaagtaccgggaggagctcccggcgaaactgtcaaggttcctcgtgactttgacgaatgtttacagtgggtcaaagcccaaatgtgggagcctgtgtacagacctatgatcaaggtccaacatgacccatcggtgcacaccaaccaattgtag

SEQ ID NO: 45949 - DNA, 2523 bp, Saccharomyces cerevisiae
atgaagttttgtctttattgctgtcattgttatatcgttatttgtggaaaggctacacattattacaagtcatcaaaagccacatcaaacttgaaatcgtcaaacagggtacttatgagaaaccccatgtcgccttcggagcaacattcacaacataattctacattggccgcctcgccatttgtttctaacgtatctgcagcaagaacacaacagagtttaccaaccgatgctcagaatgatcgtttgcagcaaccctggaacagaaccaatacggctacgagtccctaccagtcgttagcaaatagccctttaatacagaagttgcaagcgaatattatgactccgcaccagccatctgctaattctaattctaattccaattccattacgggcaatgttgtgaacgacaataatttgttagcttctatgtctaagaatagtatgttcggttctaccataccgtccacattaaggaaggtgagcttacagcgtgaatataaggattcagttgatggtgtggttcgtgatgaagataatgatgaggatgttcataacaatggcgatgcagctgcgaatgctaataatgatcgggagagtaaactagggcataatgggccattgacgacaacaacattaacgacaacaactacagcaactcaactagatgtttctgaattgtcagctatagaaagattgagactttggaggttcgacgcattgatgcagcatatgtataggaccgcagaatatattgctgataaagtgtataacatatccaatgatcctgatgatgccttctggctcggccaagtatattacaataataatcagtacgtaagggctgtagaacttattaccaggaacaacttggatggcgttaatatcctgtgtcgatatctgttgggactctcctttgttaaattacagagatttgatgacgctctagatgttataggcgaatacaatccattcagcgaggacccatctacgacggcagcaaacaccatgagcaataatggcaataacagcaatacgtcacagccagttactgacggcggtataaaaatggagtcatcattatgttttctgagagggaaaatatattttgcacaaaataattttaacaaggcaagggatgcatttcgtgaagcgattttggtagatataaaaaattttgaagctttcgaaatgctcctgtccaagaacctgttaactccacaagaggaatgggacctgtttgactctttggatttcaaagaatttggggaagataaagagattatgaagaatctttataagatcaacctatctaaatacatcaacacggaagatataacgaagtccaatgagattttagcgaaagattataaattagctgacaatgtagatgtcgtaagaagtaaggtggatatctgctatacgcaatgcaaattcaacgaatgcttagagttgtgcgagaccgttttggaaaacgacgaatttaatacgaatatcttgccagcatacattggatgtctatatgaactatcaaataaaaataagcttttccttctgtcgcatcgattagcggaaactttcccgaagtctgcgataacatggtttagcgttgcgacctattatatgagcttggacagaattagtgaagcacagaaatactattccaaatcctcaatactggatccaagctttgctgccgcatggctgggatttgcacacacgtatgccctagaaggtgaacaagaccaagcattaacagcatactctacagcctccagattctttcctggaatgcacttaccaaaactgtttctcgggatgcagtttatggcgatgaattcattaaatttagcagaatcgtattttgttctggcatatgacatttgtccaaacgatccattagtactcaatgaaatgggtgtaatgtattttaagaagaacgaatttgtcaaagccaagaaatacctgaagaaggcgttggaagtggtgaaagatcttgatccaagttcaagaacgacaatatcaattcaattaaatctaggacacacttacagaaagttaaatgagaacgaaattgccattaaatgttttagatgcgttttggagaaaaatgataaaaactctgaaattcattgttccttaggttacttatatttgaagacgaagaaattacaaaaggccattgatcatttgcacaaatcattgtacctaaagcctaataattcatctgcaacagcgcttttgaaaaatgccctagagctaaacgtgacgttatcattggatgccagccacccacttattgacaagtcgaatttaatgagtcaggcaagtaaggacaaggcttcgctcaataaaaaaagatcttcattgacttatgaccctgtcaacatggctaaaaggttgagaacacaaaaggagatctttgatcagaataacaaagctctaagaaagggaggtcatgacagcaaaactggaagtaataatgccgacgatgattttgacgcagatatggaactggaataa

SEQ ID NO: 45950 - DNA, 951 bp, Saccharomyces cerevisiae
atggaggagtacgattattcagacgttaaacctttgcccattgagacagacttgcaggatgaactgtgcaggattatgtataccgaggattataagcggttgatgggactcgcaagggctctgatcagccttaacgaactgtcacccagggcactacagctaacagccgaaattatcgacgtggcgccagccttctacaccatatggaactaccgattcaatatcgtcaggcacatgatgagtgaatccgaagacactgtcttgtacctgaacaaggaattagactggctagatgaagttacgctgaataatccaaagaactatcagatctggtcctatagacagtctcttttgaagctacatccgtctccttccttcaaaagagagctgcctatcttaaaactgatgattgatgatgattccaagaattatcacgtttggtcgtacagaaagtggtgctgtttgttcttcagtgactttcaacatgagctcgcctacgccagcgacctcatcgagacagacatttataacaacagcgcatggactcataggatgttttactgggtgaacgctaaagatgtcatttcaaaagtggaattggccgacgagctccagttcattatggacaagattcaattggttccgcagaacatcagtccgtggacctacctccgtggtttccaagagctattccatgataggctacagtgggatagcaaagtagtcgacttcgccacaaccttcatcggtgacgtattgtcacttccaattggctcaccagaggatttgcccgagatcgagtcctcatatgccctggaattcctggcatatcactggggggcagacccttgtacccgagacaacgctgttaaggcctatagcttgctagcaatcaaatacgatcctattagaaaaaacttgtggcaccacaaaataaataatctgaactga

SEQ ID NO: 45951 - DNA, 2052 bp, Saccharomyces cerevisiae
atgaacaaagaattggcttctaagtttttatcaagcatcaagcatgaacgtgaacaagacattcaaacaacttctaggctattaacaacgctatctatccaacaattggtgcaaaatggcttggcaataaacaacatacatctagaaaacataagatccggtctcattggcaaattatatatggaactgggacctaacttggcggttaacgacaaaattcaaaggggtgatattaaggttggtgatattgttttggtacgccctgcaaaaaccaaagtaaataccaagactaagcccaaagtcaaaaaggtgtctgaagactccaatggcgagcaagcggaatgctcaggcgttgtctacaaaatgagtgatactcaaatcaccatagctctagaagaatctcaagatgttattgctaccacattttattcttatagcaaactttacattttaaagactaccaatgtcgtcacgtataatagaatggaatccacaatgagaaaactgtctgaaattagttcacccatacaagacaaaattatacaatacttggtaaacgaacgccccttcatccccaatacaaacagctttcaaaacattaaatcttttttaaacccgaatctgaatgactcccagaaaactgccattaattttgccattaacaatgacttgaccattatacatggtcctcctggtacgggtaaaacattcacattaattgaattgatccagcaattgctaattaaaaatcctgaggagagaatcttaatttgtgggccttccaatatttctgtggatacgattctggagaggctaacgcctcttgtgccgaataatttattattaagaatcggtcatcctgctaggctattagactctaataaaagacactctcttgatatacttagtaaaaagaatactattgtgaaggacatttcccaggagattgacaaattaattcaggagaataaaaaactaaaaaactataagcaacgtaaagaaaactggaacgaaattaaactgctgcgcaaagatttaaagaaaagagagttcaaaaccattaaggacttaataatacaatcgagaatagtcgtcaccactttacacggttcatcatcgagagaactatgctccctttatagagatgatccaaatttccagcttttcgataccttgatcatcgatgaagtctcacaggccatggaaccacaatgctggatcccactaattgcacatcaaaatcagttccacaaactagtccttgctggtgacaataaacaattgccacccacaatcaaaacagaagacgacaaaaatgtcattcacaatttggaaaccacactatttgacagaataatcaaaatattcccgaaaagggatatggtaaaatttcttaacgttcaatacaggatgaatcaaaaaattatggaatttccatcgcactcaatgtataatgggaaactattggccgatgcaacggtcgcgaacagacttttgatagacctaccgaccgtcgatgctacgccatctgaggatgatgacgatacaaaaattcctttaatttggtatgatacgcaaggtgatgaatttcaagagactgcagatgaagctactatccttggatctaagtataatgagggcgaaattgccattgtaaaagaacacattgagaatttaaggtcattcaacgtcccggagaactctataggtgttatttctccatacaatgcacaagtttctcatctgaaaaaattgatccatgatgaattaaaattaactgatattgaaatatcaactgtagatgggttccagggccgtgaaaaagatgttatcatattgagtttagttcgtagcaatgaaaaatttgaagttggtttccttaaggaagaacgaagactgaacgtcgccatgacaagacccagaaggcaactagttgttgttggcaatatagaagttctgcaaaggtgcggtaacaagtacctaaaaagttggtcagaatggtgtgaagagaacgctgacgtaaggtaccccaacattgacgattatttgtaa

SEQ ID NO: 45952 - DNA, 525 bp, Saccharomyces cerevisiae
atgtctttggccaaatccgctgctaacaaacttgactgggcaaaagtcatctcttctctacgtataacagggtcgactgccactcaattatcgagttttaaaaagagaaacgatgaggcacgtagacaattactagagctgcaaagtcaacccaccgaagtagatttcagtcattatagatctgtgttgaaaaacacttcagtcattgacaagatagaatcatacgttaagcaatataagccggtcaaaatcgatgcctccaaacaattacaagtgattgagtcttttgaaaagcacgcaatgaccaacgccaaggagacagaatccttagtttccaaggagttaaaggatttgcaaagcaccttagataatattcaatctgcaagacctttcgatgaattaactgttgacgacctgacaaagatcaaacctgaaattgatgctaaggtagaagagatggtcaagaagggtaaatgggacgtacctggttacaaggacagattcggcaatttgaatgtgatgtag

SEQ ID NO: 45953 - DNA, 807 bp, Saccharomyces cerevisiae
atgtctagtagtaaattcgaagaggtcatcaacaagatcatcaatgacagccctccaggagaattaagggaagtatacgacgatctaatcaagatcacaagtgaaaactccaaaaatactattttggatgctattgagaattacaacgtgcagaattgcatccctatagaagtcaacgggaactctgtaattatttccaaatacaacaaggaaggagcaaagttttttgatcccgtaaattccgtaatattttcagttaaccatttagagcgcaagggccttgacattgaaccatatgagttcacgcatgcaaagatagagaaagggcaattgaaagaactgcacgataaattgcacgaatatcttcttcagagctttccaggtgatgtcagttttgctgtttacccagtccctgaggaaataagtaaaatttctattattattgttagcaccaaatataatccaaacaatttctggaacggccattggagatcaagctacatctacgatttggagaccagggagttatccggtcaaatctctacgcaagtccactattacgaagacggtaacgttagtttccaatctgggaaggatatcaatcaatctaacgttgatgacgttgtttgcacaataagggatattgagacgaatttcgaaaatgatctagatctttcatttttcgacttgaacgaaaaacagtttaaggccttaagaagaagattaccagtcacgagatccaaaattaactggggtagtgcgattggcagttatagattgggtaagaatgcggcagaaggcaaatga

SEQ ID NO: 45954 - DNA, 609 bp, Saccharomyces cerevisiae
atggctactaatattacttggcatccaaatcttacttacgacgaacgcaaggcattgagaaaacaggacggttgtactatttggttaacaggtctaagtgcgtcaggtaaaagtacaatcgcctgtgcgctagaacagttactgctccaaaaaaacttgtctgcatatagattggatggtgacaacattcgttttggattgaacaaggatttgggtttctcagaaaaggacagaaatgaaaacattcgtagaattagcgaagtttctaagctatttgctgattcatgtgctatttcaatcacctcatttatctctccatacagagttgacagagatagagctcgtgaactacataaggaggctggtttgaagttcattgaaatatttgttgatgttccattagaagtcgctgagcaaagggaccctaagggtttatacaagaaagctagggagggtgtaatcaaggagtttacaggtatttctgccccatatgaagcgccaaaagctccagagctacatttgagaaccgaccagaagacggttgaagaatgtgctaccattatttatgagtacttaatcagtgaaaaaatcatccgtaagcatttgtaa

SEQ ID NO: 45955 - DNA, 2115 bp, Saccharomyces cerevisiae
atggatgagcatttaatttctactattaacaagcttcaggacgctttggcgcccttaggaggaggatctcaatctcctattgatttaccacagatcactgttgtcggttcccagtcgtcaggaaagtcgtccgttttggagaacattgttggtagggatttcttgccaagaggtactggtattgtcaccaggagacctttagtgttacaattgattaataggagaccaaaaaagtcagaacatgctaaagtaaaccaaactgctaatgaattgattgacttgaacatcaacgatgatgacaagaaaaaggatgaatcaggaaagcaccagaacgagggacaatctgaagacaataaagaggaatggggtgaatttttgcatttacctggtaagaagttttataattttgacgaaattagaaaggaaatcgtcaaagaaactgacaaagtgacaggtgccaattcaggtatttcttctgtgcccattaacttgagaatttattctccgcatgttcttactttgacgttagtggatttgcctgggttgacgaaggttcccgtaggtgaccaacctcctgatattgaaagacaaattaaggacatgttgttaaagtatatttcgaaaccaaacgctatcatattatctgttaatgccgctaacaccgatttagccaacagcgatggtttgaagctggctagagaggtcgatccagaaggaacgagaactattggtgtcttgacaaaagtcgatttgatggatcaaggtacagatgtcatagatattttggctggaagagtcattcctttgagatatggttatatcccagttatcaatagaggtcaaaaggatattgaacacaaaaaaacaatcagagaagcccttgaaaacgaaagaaaattttttgagaaccatccctcttacagttctaaagctcattactgtggtacaccatatttggctaaaaagttaaactcaatcttattacaccacattaggcaaactctgccagaaatcaaagcgaaaatcgaagccacattgaaaaaatatcaaaacgaacttataaacttgggcccagaaactatggattcagctagttcggttgttttgagcatgattactgatttttccaatgaatatgccggtatcttggacggtgaggcgaaggagctttccagtcaggaactttctggtggtgctagaatttcttacgtattccatgaaactttcaaaaatggtgtagactctttggatccattcgaccagatcaaagattctgatatcagaaccattatgtacaatagttcaggttctgccccatctttgtttgtcggtaccgaagcttttgaagttttagttaaacagcaaattagaagatttgaagaaccatctctacgtttagttactctggtgtttgatgaacttgttcgtatgctaaaacagattatttcacaaccaaagtactcaaggtatcctgctctaagagaagcgatttctaatcagttcattcagttcttaaaggatgctactattcctacgaatgagtttgttgtcgatatcatcaaagctgaacaaacttacatcaatacagcccatcccgaccttttgaagggttctcaagcaatggttatggtggaagaaaaattacatcctcgccaagtcgctgttgacccaaagacgggtaaaccattaccaacccaaccatcgtctagtaaggcgccagttatggaagagaaatcaggattttttggtgggttcttctccactaaaaacaagaagaaattggcagctttggaatccccacctcctgttttaaaagctactggccaaatgacagagagggaaacaatggaaacagaagtaatcaagttgttgattagtagttatttctctattgtcaaaagaaccattgccgatattataccaaaggctttgatgcttaaattgattgtgaaaagtaaaactgatattcagaaagttttactcgaaaaactttacggaaagcaagatattgaagaattaacgaaagaaaacgacataaccattcaaagaagaaaagaatgtaagaagatggtcgagatattgagaaacgctagtcaaatcgtctcctctgtttag

SEQ ID NO: 45956 - DNA, 2703 bp, Saccharomyces cerevisiae
atgcctggaaatttatccttcaaagatagagttgttgtaatcacgggcgctggagggggcttaggtaaggtgtatgcactagcttacgcaagcagaggtgcaaaagtggtcgtcaatgatctaggtggcactttgggtggttcaggacataactccaaagctgcagacttagtggtggatgagataaaaaaagccggaggtatagctgtggcaaattacgactctgttaatgaaaatggagagaaaataattgaaacggctataaaagaattcggcagggttgatgtactaattaacaacgctggaatattaagggatgtttcatttgcaaagatgacagaacgtgagtttgcatctgtggtagatgttcatttgacaggtggctataagctatcgcgtgctgcttggccttatatgcgctctcagaaatttggtagaatcattaacaccgcttcccctgccggtctatttggaaattttggtcaagctaattattcagcagctaaaatgggcttagttggtttggcggaaaccctcgcgaaggagggtgccaaatacaacattaatgttaattcaattgcgccattggctagatcacgtatgacagaaaacgtgttaccaccacatatcttgaaacagttaggaccggaaaaaattgttcccttagtactctatttgacacacgaaagtacgaaagtgtcaaactccatttttgaactcgctgctggattctttggacagctcagatgggagaggtcttctggacaaattttcaatccagaccccaagacatatactcctgaagcaattttaaataagtggaaggaaatcacagactatagggacaagccatttaacaaaactcagcatccatatcaactctcggattataatgatttaatcaccaaagcaaaaaaattacctcccaatgaacaaggctcagtgaaaatcaagtcgctttgcaacaaagtcgtagtagttacgggtgcaggaggtggtcttgggaagtctcatgcaatctggtttgcacggtacggtgcgaaggtagttgtaaatgacatcaaggatcctttttcagttgttgaagaaataaataaactatatggtgaaggcacagccattccagattcccatgatgtggtcaccgaagctcctctcattatccaaactgcaataagtaagtttcagagagtagacatcttggtcaataacgctggtattttgcgtgacaaatcttttttaaaaatgaaagatgaggaatggtttgctgtcctgaaagtccaccttttttccacattttcattgtcaaaagcagtatggccaatatttaccaaacaaaagtctggatttattatcaatactacttctacctcaggaatttatggtaattttggacaggccaattatgccgctgcaaaagccgccattttaggattcagtaaaactattgcactggaaggtgccaagagaggaattattgttaatgttatcgctcctcatgcagaaacggctatgacaaagactatattctcggagaaggaattatcaaaccactttgatgcatctcaagtctccccacttgttgttttgttggcatctgaagaactacaaaagtattctggaagaagggttattggccaattattcgaagttggcggtggttggtgtgggcaaaccagatggcaaagaagttccggttatgtttctattaaagagactattgaaccggaagaaattaaagaaaattggaaccacatcactgatttcagtcgcaacactatcaacccgagctccacagaggagtcttctatggcaaccttgcaagccgtgcaaaaagcgcactcttcaaaggagttggatgatggattattcaagtacactaccaaggattgtatcttgtacaatttaggacttggatgcacaagcaaagagcttaagtacacctacgagaatgatccagacttccaagttttgcccacgttcgccgtcattccatttatgcaagctactgccacactagctatggacaatttagtcgataacttcaattatgcaatgttactgcatggagaacaatattttaagctctgcacgccgacaatgccaagtaatggaactctaaagacacttgctaaacctttacaagtacttgacaagaatggtaaagccgctttagttgttggtggcttcgaaacttatgacattaaaactaagaaactcatagcttataacgaaggatcgttcttcatcaggggcgcacatgtacctccagaaaaggaagtgagggatgggaaaagagccaagtttgctgtccaaaattttgaagtgccacatggaaaggtaccagattttgaggcggagatttctacgaataaagatcaagccgcattgtacaggttatctggcgatttcaatcctttacatatcgatcccacgctagccaaagcagttaaatttcctacgccaattctgcatgggctttgtacattaggtattagtgcgaaagcattgtttgaacattatggtccatatgaggagttgaaagtgagatttaccaatgttgttttcccaggtgatactctaaaggttaaagcttggaagcaaggctcggttgtcgtttttcaaacaattgatacgaccagaaacgtcattgtattggataacgccgctgtaaaactatcgcaggcaaaatctaaactataa

SEQ ID NO: 45957 - DNA, 705 bp, Saccharomyces cerevisiae
atgttgcaatttaaactagttttattgggtgactcatccgtgggtaaatcttccattgttcatcgttttgttaaggatacattcgatgaactacgtgaaagtacgattggtgctgcttttttatctcaatcaatcactattcacccaaacgatggtaatgaaacaaaggatgtcgttataaaatttgaaatctgggatactgctggtcaagaaagatacaagtcattggcaccaatgtattatagaaacgctaatgcagcattagttgtttatgacattacgcaggaagattcactacaaaaggcaaggaactgggttgatgagctgaaaaataaggtaggcgacgacgacttggttatttatttactgggaaacaaagtggatttatgtcaagaaacgcctagcactgagacaagcccagattcaaacgaaggtggagatgaagaacaaaaagtaagagcaattagcactgaagaagcgaaacagtacgcacaagaacaagggttgctgttccgagaagttagtgctaagacaggtgaaggggttaaggaaatttttcaagatattggtgaaaaattatacgatttaaagaaagacgaaattctctctaagcaaaatagacaaatcggtggaggcaataacggacaagtagacattaatttgcaaaggccatccacaaatgatccaacatcttgttgcagttga

SEQ ID NO: 45958 - DNA, 2229 bp, Saccharomyces cerevisiae
atgagcgatgaagattctatgctgttaaacttcactaccaatgaggacactgcaggaagttcctataagcaagctgccaaggtgacaggcggtagatggaaggatagaagaagaatgaaaatgaagcttgagggcaagacagtctcgaggaaaagaaaggcgaacactacaggggacgaagggataattccgggtagaggcgagaattctattaaaaaattgcataaggagagttcctatagttctgaagagcaggaaaaatataagggtagaaatgctcataacactcaagggagaactctaccagccgattctcagtttgtttcatccctgtttacatctaacagagagattacaactgcggtaaacactaatattcatgatgaaaacgttgccatcaatccgtctaacgcgcccttgaaaggtgatcagtttgcgtctttaggtgtctctagtcttcttgtttctcatctggagcaaaaaatgcgtattaaaaagcctacgagcatccagaagcaggccatacctcaaataataggtaacgcggggaagaacgattttttcattcacgcccaaacaggctcaggtaagactttatcgtatcttttacctataatatctactattttgaacatggatactcatgttgatcgtacttctggtgcatttgcattggttattgctcctacacgagaactagcatcacaaatatatcatgtttgttccacgcttgtgtcatgttgtcactacttggtcccatgtttattgattggtggagaacgtaagaaatcagaaaaagctagattgcgtaagggttgcaatttcataatcggtacaccaggtcgtgttttggatcatttacaaaatacaaaagttatcaaggagcaattgagtcaatctctaaggtatatcgtattggatgaaggagataagttaatggaattgggttttgatgagacgatcagtgaaattattaaaattgttcacgatattcccatcaactccgaaaaatttcccaagctaccgcataagttagtgcacatgttatgtagtgctacacttactgatggtgttaataggttaagaaacgtggcgttgaaagattacaaattgattagcaacggtaccaagaaagattctgatatagtaacggttgcgcccgatcaactattgcagaggattactattgtcccaccaaagttgcgtcttgtaacattagctgctactttgaacaacattaccaaagatttcatcgcttccggtcaacagtccaaaacgctgcgtacaatcgtattcgtatcatgttcagacagcgtggagtttcattatgacgcattttcaggaagtgacgggcaccataaaaatctaacgggtgattctgtaagactattgacaaaaggaaacactatgtttccttgtttttcagattctagggacccagatgtagtgatttataaattgcacggttctttatcccaacaaatgagaacctctacattgcagcattttgctcgtgataatgaagccaccaagggaaaacatcttattatgttctgtacagatgtcgcaagtagaggcctagaccttccccacgttggatctgttattgagttggatccaccatttgctgttgaagaccatttacatagagttggtcgtacagcaagggccggtgagaagggtgaaagtttgttatttttacttcctggcgaagaagaaaaatatatggactatatccagccgtatcatccgatgggttgggaattactgaaattcgataaagaaatactaatgccggctttcaaagatgtgaatgtcaacagaaatgataaattcattagaaaagatgagaaatcgtccaaaaataaagacgtgggcgataaagaatatgagtgggataccaatgctacgacatggcatttgaatatagaaagacgagtagtgggagattccgcattcaaaaatttggccgttaaaggtttcattagtcatgtgagggcttacgcaacgcatatctctcaagaaaagaagtttttcaacgtgaagttcttacatctaggccatttagctaaaagttttgggttacgtgaaaggccaaaggctatgggattgcaaagtagtaaggatggtaatagtgaaaagaagccaactaaggaaaactctaaaaataaaatgtttcgtatggctcgtatggcagagaagcaaatagcaagtgagtttaactactaa

SEQ ID NO: 45959 - DNA, 3297 bp, Saccharomyces cerevisiae
atgtcaggttctttctggaagtttggtcaggattactcgatagagtcaccggtttctaagattctaaatagtgcctttattaaaatcaataaggaccaagatgacgacgtacctaccggcacatgtgaagaaaatattgctgatgacgaagataactcttcacatgactacgctgcttctgaagataatgtagttaacgagaacgaagagaaggaagaagaaaatactctgcccactacagaatcggaatatgaaaattatagacctaatttggacgtcttagacgatttgctggatgatgacgaactgtatacggaattaatgtgttcaaatttcaagctactaatattcttgaagtatcctgatgttttatcaaaattgatagaatatgttaccaacgagaagattctcgacgaagaaacagatagcgctaaaaagccagagattattgaaggtgtaaacgatcatcctattttgatagaaagagacagaaaggataaaaaggaggacgctgaagaaggaggcgactcagaagaaactacaaatgatagcgatcatgactctggggacgaaagaagtgttgattctgaagagacaagcattactttgccaccggaatctgaggaacaagtggagactagaagggcaaggatagctgctgaaattttatcggctgatgtatggcctatatccgcagcaataatgcaaaataaggatcttcttggtagattgtggtcgatactagatcacccagctcccttaccgataccagcttccacctacttcatgaaaataaatgaaagacttctcgatatggatataacggggatgttagagtttatattaagccgagacagcttggttgcaaggttcttgacacatgttgacaatccgtctttgatggacttccttttgaaagttatctcgacggataaacctgactctcccacgggtgtcataaagatactaaaatcacaggaattaatacctaaacttttagatcatcttaatccagaatacggtatttccactcagtctgcggcaggcgattttattaaggcattcgtcacgttaagcactaactcaagcaatgaacttgcttcgggaataggtcctaatgaattgacaaggcaattagtatcagaagaaatgatagaaaagttgattaagataatgctaaagggcggtacatccttaagtaatggtgttggaattatcatagagttgatcaggaagaataactcagattatgatttcatccaactagtctacactaccctagaaagtcaccctcccactgatcgagatccaattcacttgatacatttagtcaaactttttgctaagcatatgcctgattttgctgatatgctggataaaaccaagttgccactaatggaaatgccattcggtaatattgaacctctgggatttgagaggtttaaaatctgtgaacttattgcagaactattgcactgttctaatatgacgctgctaaatgagcccaatggtgagatgattgcccaagaacgtgatatagaaagggccaaagaattagaaacttcaaccgaaaaggaaaatataacagctattgtggacaataaatcatcatattatgataaggattgcgtagagaaggatatcacagaaaatttaggcgctcttcaaataaataatcaaggaagtgaagaagatgaattaaatgatactggggtatcaagtgtaaaactagatgtgaaatcagacgcaaaggtagttgaggggctagaaaatgatgcttctggagtagagttgtatgatgaaaccttgtctgacacagaatccgtgagagaatgcctaagggaaaaaccgctagttggagacaggctgaagattgctctagaagacactaagatactgattagtatccttgatatgttcactgagttcccttggaataattttttgcataatgtaatttttgatattgcccagcaaatattcaatggtcccctcaaaactggttataataggttcctcttgaaagattatttggttgatgcatacctaactaaaaagatagtagatgcggataaggcatgtcaagactatgaaaaaaagaccggtttacgttatggttatatgggtcatttgacattagttgccgaagaaatatcgaagttcaaagagtatattgatgaaatgaagctaactttttgcaataccgctgtttcagatcgacttgaggaaccattttggaaagaatatagtgaaacgatcttggctgatacaagagagaagtataacaccgttttgggagattttggcaatgaccaagaaagcgatgacgatgttattaggaattctgattctgaggatataattggtgatacagagggcaacgaaaactacggaaatggagaaaacgatgaacttcttagtaacgggcatgattctgggaacatggatttatattataacttcaataataacgagaatgaagaaaatgaagaagattacgcagagtatagtgatgtggataataaaaattactataataacgtcgagactaacgacgatgattatgatagtgatgatggtaaatccaaaagtgccgaatcagagtttaccgataaaatatctgaacatagggatggcaatagtctctataatgaggacaatgatgaaaacgggagtgacaaatggacatcgggtacttcattgttccctccagaccattttcctagtaggtcacaaccttcagatcctaaactgcaagaccagaatatttttcaccatcagtttgactttgaaggtgttggcgatgacgatgactatatggatcctaatgatgatggccagtcatatgccagacctggtaatccattgtatactaccccgaaaacaccaccaagaccgaagactattcttttcaattctttatccgcattggataataatggcgaagacgaagaagtggcactaggcaccagtgttgatgatcgaatggataacgagatatcaagcgatgaagaagactccgaaatgaagatgaagagaatgatatgggcaatgaggagggctactcattatataggtcaagaagtaaagaagctttctgaactaaaacattcacattgtcacattttcaccctttattcatcaattttttattgctccacttttttcgcatataggtcatttataattcatcaaatatatacttttttaattgaggcttgtaatttaatattaaccgaatataatcttataaagaataatgaatattcacttttgaatatacttaagtttatatag

SEQ ID NO: 45960 - DNA, 5052 bp, Saccharomyces cerevisiae
atgtctaacgtgtcaacagcgtctggaactcacttcgctccacctcaggcagatagatcggtgactgaagaagtagatagagtaaattcgagaccagatgagttagaaaaccaagaagtattgcggcaattacctgagaatggcaatctgactagcagtttacaaagagaaaaacgaagaactcccaacggcaaggaggcggagaggaagcatgcattgcccaaatcctttgtagatagaaacctgagtgatgtgtcaccgaaccactcattagaccatattatgcactctaatgaacatgatcctcgtcgaggttctgatgaggaaaatatgcaccggctctacaacaatctccatagcagtaacaataatgttcattctaagcggaattctaaaagagaggaagaaagagcccctcaaaggcgttcttcttctgtagcttacacccaacagcagttcaatggctggaagaaagagtttggccacgcttttaagaaaatctctgctattggtagactgaaatccagcgtaaattctcctacaccggctggaagcggccatcgtcataaccagcaccagcatcaacaagtaaacgaagaagatttgtacacacaaagactagcctctgatttattagattcgttattggcaggatgcccggcctcattgttcgcaagcacgcaatttctgagagacgaacatgggaagagaagggctcctctgctattagctaaactagatgtaagagtgtctcccttgaaaaatgacaacaacattttggatattaccaatagcaaccataaccatcgtggtaacaacaacaacaatactggcgagaattctgataggagaccctctattccaaggagctccagcattataagcatttcttcgaatgtggcggaatttatgtatagcaggaacgaaaactctttatttagaatacacttggaatatgggattgatgaagacaggctcaaatggtctattataagaagttataaagatatcaaatcactacatcacaaattgaaaatcgtcgcgttccaacaactcactataagcaagctttatagtgataacaacagatatcattcgttacaacttccgcatttcccccattataaagaaatggttaaagaaagaaatgtaatggagaaaaaagcagaaaataaaccatcctctgcagcctcagctcctcatacatcggaaaataacaataacgataatggcagcaacattacatcgttagaaactttatcatcttctgaaatatctgagtttaatatagataacgtcaaaatgaaacatttacaagacttaattgacgaacctgacgatttctcccaaccgatacatttgaggctagaaaggtatttgagactactgaacattgcattatgtttgagacctcatgcaaatagattgtttgaattttacgaattatctcccttaggcaatttattaagtcgtgaaagtgggttccagggcaaacaggggtatttagtaattagatctactgccaaggcccaaggttggagagtttctcattttggtaaacatgcgtttaaagacatgatcgacagacatactaccaaatggttcctggtaagaaattcttacctaacttacgtgtcggatctttcttcgacaactcctttagacgtattcttaatagattggaaatttaaggttagattttctgggaacaagaataacatacttgataacgaaaacgagatcaactggatcattcatgatcccaatttagaaataaatgacgaactagaagagttcggtattgaaaatgatgccaataatatcctagacaagaatggaaaatcgaaaacacaccaaaagaagtccaatatatcttcaaaactattattattgaccctagaaaacagtgaaaggaaactgaaaattatttgcaaatcagagagttcgttaaagcaatggatgagttcaattatcaaaatgtctacctcaacaccttggtcgaaaccaaatagatttggtagtttcgcacctgtaagaacaaattcgttttgcaaatttttggtagatgggcgtgattatttttggtcgttaagcgaggccctcttaatggcaaaggatgtcatatatatccatgattggtggctatcccctgaattatacttgcgacgtccggtgaaaggcaaccagggatttagaattgatcgtatgctgaaaagttgtgcagaaaaaggtatcaaaatttttattgtgatttataggaatgtggggaatattgttgggacagatagtctttggaccaagcattctatgctaaatttacatccaaatatacatatcataaggtctcccaatcaatggctacaaaatacatatttttgggcacaccacgagaagtttgtcgttattgatgaaacatttgcatttattggtggtacagatttatgttatggtagatatgatacttttgaacacgttctacgagatgatgcagaatctttattagatcaaaattttcctggtaaggattattcaaatgccagaattgctgattttcatgatttagataaaccattcgaatcaatgtatgatagaaaagtcattccgaggatgccatggcatgatgtgcaaatgatgactttgggtgagccagcaagagacttagcccgacattttgttcaaagatggaattacttattgagagctaagagacctagtaggttaactccattactaaccccgccttcagatttaactgctgaagaattgaagagtttgccgatgttcgaaattctacgcgaaaaatcgacttgtgaaactcaaatacttagaagtgctgggaactggtctcttgggctaaaggaaacggaatgctcaattcaaaatgcttacctgaagttaattgaacaaagtgaacactttatttatattgagaatcaattcttcattacatcaactgtctggaacgggacttgcgttttgaataaaattggtgatgctctcgttgataggatagtcaaagctaatcaggagaaaaaaccttggaaagcctttattcttatcccactaatgccaggattcgattctccagtagatactgcagaagcctcaagtcttcgtttaattatgcaattccaatatcaatcaatttcaagaggtgaacattctacatttagtaaactgaagaaactaaatattgacccagctcaatatattcagttcttttcactaagaaaatggtcgacttttgcgcctaatgaaagattaatcaccgagcagctctacgttcatgctaaaattctgattgctgatgacagaagatgtattatagggtctgctaatattaacgaaagatcacaactgggtaatagagatagtgaggtggcaattcttattagagacaccgacttgataaagaccaaaatgaatggtgacgattactacgcgggaaaatttccttgggaattaaggcagcgattaatgagggaacatttaggttgtgatgtagatcttgttgagtttgttgaaaagaaatttgaaaggtttgaaaagtttgctgcaaagaattatgaaaaacttcataccctaagtaaggagggagatagtggtaacaattggagcgatcgagaaatgatcgattccgctatgattgagctaggttatcgtgaaatatttggttgtaaatttagccctcaatggaagagtggtcatggaaacagtgttgatgatggaagcactcagtgtggcataaatgaaaaagaagtgggaagagaagatgaaaacgtttatgaaaaattcttcaattctgtggactacggtaaatcatcacgtaagagaacgcctctgcccaaacataattttgcatctttagggctaacattcaaccacagggcaggaattgaaaatgtcggtatacgagaccacaaagtcttaagtactgatccaagattaagaaagaatgatgaacataaaaaagaggttgatggctacggtcccgattgttggaaaaaggaatccaacaaaaaattcaaggccgatgcaactgaacagctaaaggagtgggcattgaactcattggcctcgaaagttcttgacgataaagaaatgataaaatcagaaattccagaaggattttcaaattatttgcccaatgagaaagatctagaaatgtatctcacggataaaactgttaccaatagaaacaaatggagtatgctcaaaaggatatgctacttgcaatatttatctcataaactcgacgaaagaaaaacacagagattgaagaaaatcaaagatatgagaagacatttaagttcaagcacagaaagtaccagaaatgggtctaatagtctgccattaaacgaaaagagcaatgaaggagaaagcactaatgtcgaccaagatatcgaaggcgatgaatatcatagattgcacgaagatattttgaaaaatcaagaactagatgatggttcactggacgatctactttctcagataattcctaagatcactaactttaacagtggtgaaattgatgacgcaaaaaaagaagagttattgaaactcaacttcattgacccgtattccttcgaggatcctcttatttcttcgttttctgaagggctatggttcactatagccttgagaaatacattactctataaattagtgtttcattgtcaacccgataatgctgtacaaaattggaaagaatatggagaatttactgaattagaacaagaatttcaaataaaccaggaaaagttgattgacttagaggctgaaaatattaattctactactacaaatgttgtagataaggatagggaaaaggaaaaaatgagaaaagccgctgaattgagaatgaagttatccggtagtttgctttatggattcaatcaaaaggtttttgacaaacatacggcgcagagaatcttggaaaggatccacggtcatttggtcattttcccaaccgaatggttagctaaagaagttgagagtagaaattggatttttaactcggatagactttctccaatggaaatctacaattaa

SEQ ID NO: 45961 - DNA, 1980 bp, Saccharomyces cerevisiae
atgacatataagattaccacgagcgagagtaaaaaagagtatctctatatgggttcgggcgatactagaggagaaagctctctggtagctaaaccaatcgaaattatacttaataagctaccacatgccatactagcgcaacaacaatttcaaaaatatataacgagccccatctacagatatctttccaaacttctactgttcagagaggtggcttggcccgaaagtacaaaagatacccagaaaggacaagtagggatattttcctttcaaaacaattatgcagactctgcaacaactttcagaatacttgctcatttagatgagcacggatacccgctacccaacggtgccgctgaaaagaatttaccttctttatttgaaggattcaaagctaccgtttccatcattcaacagagactgttgttagacaatgtagacggggccacgaatagtgataaggaaaaatacgttcaattgccggatattaatactggttttgtgaataaaacgtactctagaattgacctaacacatttacttgaggatgtagaaactaacgtggaaaatctgtcaatcaataaaacgttagagatggatgagttgaccagattagattccatgatcaacgaactagaatccaggaaattaaaaatcctggaaagggttaagcacattgatagtaagtctaccaatcttgagaatgatgtaacactgataaaggatagaataaattttatcgaggaatacaatttggaagctgatcgtgaacagagcttacggaagcaaatggaagaagaaagatcatctgaagcgtcgtccttcacgcaaaatgaagaagccatatcgtcgttatgtgatgttgaaagtaaggatacgagattaaaagatttttacaagatgccccatgaaaaaagccacgataaaaacaggcaaattatctcagaaacatatagccgaaataccacggctttcagaatgacaataccccatggcgaacatggaaacagcataaccgcattagactttgatacaccatggggaaccttgtgctcatcaagctaccaagatcgtatagtaaaagtgtgggatttgaaccatgggatacaagttggagagctgcctggtcaccttgctactgttaattgcatgcaaatagataagaaaaattacaatatgttgattactggaagtaaggatgccactctgaagttatgggacttaaatctgagtagagaaatatatttggaccatagtccattgaaggagaagacagaagaaattgttacaccatgtatccataattttgagttacataaagacgaaatcacagccctgtcttttgattctgaagctttggttagcggatctagggacaaaaaaatattccactgggatttaacgacgggcaaatgtattcagcaacttgaccttatcttcacacctacacatagcgacattaaaatgcctgcacgttcattaaacaatggtgcatgtttacttggcacagaagcaccaatgataggagccctccaatgttacaactctgcattagcaacaggaacaaaagatggcattgtgcgactatgggatctaagagttggcaaaccggtgagattactagaaggccataccgatggaattacaagtttgaagtttgattccgaaaaattggtaacaggctcgatggacaatagcgtaaggatttgggatttgaggacaagctcaattcttgacgtgattgcttacgatttaccagtatcgtccttagatttcgatggtaaattaatcactgttggcgcaaacgagggaggggttaatgtctttaacatggagcgcgatgagcattggatgactcctgaaccaccgcattcactagatggggatgagctgagcagaagaattgctattgtcaagtataaagacggatttctgatcaatgggcacaacgatggagacatcaatgtatggacactttag

SEQ ID NO: 45962 - DNA, 1809 bp, Saccharomyces cerevisiae
atgagtaatacttcttcgtacgagaagaataatccagataatctgaaacacaatggtattaccatagattctgagtttctaactcaggagccaataaccattccctcaaatggctccgctgtttctattgacgaaacaggttcagggtccaaatggcaagactttaaagattctttcaaaagggtaaaacctattgaagttgatcctaatctttcagaagctgaaaaagtggctatcatcactgcccaaactccattgaagcaccacttgaagaatagacatttgcaaatgattgccatcggtggtgccatcggtactggtctgctggttgggtcaggtactgcactaagaacaggtggtcccgcttcgctactgattggatgggggtctacaggtaccatgatttacgctatggttatggctctgggtgagttggctgttatcttccctatttcgggtgggttcaccacgtacgctaccagatttattgatgagtcctttggttacgctaataatttcaattatatgttacaatggttggttgtgctaccattggaaattgtctctgcatctattactgtaaatttctggggtacagatccaaagtatagagatgggtttgttgcgttgttttggcttgcaattgttatcatcaatatgtttggtgtcaaaggttatggtgaagcagaattcgtcttttcatttatcaaggtcatcactgttgttgggttcatcatcttaggtatcattctaaactgtggtggtggtccaacaggtggttacattgggggcaagtactggcatgatcctggtgcctttgctggtgacactccaggtgctaaattcaaaggtgtttgttctgtcttcgtcaccgctgccttttcttttgccggttcagaattggttggtcttgctgccagtgaatccgtagagcctagaaagtccgttcctaaggctgctaaacaagttttctggagaatcaccctattttatattctgtcgctattaatgattggtcttttagtcccatacaacgataaaagtttgattggtgcctcctctgtggatgctgctgcttcacccttcgtcattgccattaagactcacggtatcaagggtttgccaagtgttgtcaacgtcgttatcttgattgccgtgttatctgtcggtaactctgccatttatgcatgttccagaacaatggttgccctagctgaacagagatttctgccagaaatcttttcctacgttgaccgtaagggtagaccattggtgggaattgctgtcacatctgcattcggtcttattgcgtttgttgccgcctccaaaaaggaaggtgaagttttcaactggttactagccttgtctgggttgtcatctctattcacatggggtggtatctgtatttgtcacattcgtttcagaaaggcattggccgcccaaggaagaggcttggatgaattgtctttcaagtctcctaccggtgtttggggttcctactgggggttatttatggttattattatgttcattgcccaattctacgttgctgtattccccgtgggagattctccaagtgcggaaggtttcttcgaagcttatctatccttcccacttgttatggttatgtacatcggacacaagatctataagaggaattggaagcttttcatcccagcagaaaagatggacattgatacgggtagaagagaagtcgatttagatttgttgaaacaagaaattgcagaagaaaaggcaattatggccacaaagccaagatggtatagaatctggaatttctggtgttaa

SEQ ID NO: 45963 - DNA, 1353 bp, Saccharomyces cerevisiae
atgtgtttccttctcgagacctcggcgtctcccagatcaaagctcagcaaagattttaaaccgcaatttacgctcctttcatcggtaactaagaagaaaaaaaaaaaagtacgaccacacaatttccagtgtattcattccttaaacttcgtttattttttattcattcattcatttttatttgaatataaccaactactagtccttcctttaaacaaaaatttaccctcccttaatttttcaagaaattccagtatgaaattatccgctctattagctttatcagcctccaccgccgtcttggccgctccagctgtccaccatagtgacaaccaccaccacaacgacaagcgtgccgttgtcaccgttactcagtacgtcaacgcagacggcgctgttgttattccagctgccaccaccgctacctcggcggctgctgatggaaaggtcgagtctgttgctgctgccaccactactttgtcctcgactgccgccgccgctactacctctgccgccgcctcttcttcctcctcttcctcttcctcctcttcctcttcttcctctgttggttctggagattttgaagatggtaccatttcctgttctgatttcccatccggacaaggtgctgtctccttggactggttaggtctaggcggctgggcttccatcatggacatgaacggtaacaccgccacctcttgtcaagacggatactactgttcttacgcttgttctccaggttacgctaagacccaatggccttctgaacaaccttccgatggtagatccgttggtggtttatactgtaagaacggtaaattataccgttccaacaccgacactaacagtttgtgtgtagaaggtcaaggctctgctcaagctgttaacaaggtctccggctccattgctatctgtggtaccgattatccaggttctgaaaacatggtcgttcctaccgtagttggcgctggttcctcccaaccaatcaacgtcatcaaggaggactcctactatcaatggcaaggtaagaagacctctgcccaatactacgttaacaacgctggtgtctctgtggaagatggttgtatctggggtactgagggttccggtgtcggtaactgggccccagttgtcttgggtgctggttacactgatggtatcacttacttgtccatcattccaaacccaaacaacaaagaagcaccaaactttaacatcaagatcgttgccaccgatggctctaccgtcaatggtgcttgctcttacgaaaatggtgtctactctggctctggctctgacggttgtactgtttcagttacttctggttctgctaactttgtcttctactag

SEQ ID NO: 45964 - DNA, 915 bp, Saccharomyces cerevisiae
atgaatacttcagaactgtcaatagctgaggaaatcgactacgaagctcttccatcacatgctccgctacattcccagttactggcaggagcatttgcaggtataatggagcattctttgatgtttccaatagatgctctgaaaacccgagtgcaggctgcaggattgaataaagctgcctctacagggatgatatctcagatatccaaaatatctacaatggaaggttcgatggctttatggaagggtgttcaatcggtaatactgggggcagggcctgcgcatgcagtatattttggtacatacgagttttgcaaagctcgcctgataagccctgaagatatgcaaactcatcaaccaatgaagaccgcactgagtggtaccattgctaccattgctgcggatgcattgatgaacccctttgacaccgttaaacaaagactacaattggatactaatctaagagtttggaatgttactaagcaaatatatcaaaatgaaggctttgcagcattttactactcctatcccacaacattggccatgaatatcccatttgcagcgttcaatttcatgatatatgaatctgccagcaaattcttcaacccacaaaattcctacaatccattgattcattgtctttgcggtgggataagtggtgcaacatgtgctgcgttaactacaccgttggattgcataaagactgtattacaggttagaggcagcgaaactgtctccatcgaaataatgaaggatgcgaacacttttggtagagcctcaagagccatactggaggttcatggttggaaggggttttggcgaggtttgaaaccaaggatagtggctaatataccagccactgccatttcttggactgcatatgaatgtgctaagcattttttaatgaaaaattga

SEQ ID NO: 45965 - DNA, 12279 bp, Saccharomyces cerevisiae
atgtgcaagaatgaggcaagacttgctaatgagctgatagaatttgttgcagctactgtaacgggtataaagaattctcccaaagagaatgagcaagcattcattgattatctacattgtcaataccttgaacggtttcaattttttttgggattattggatgggagagagttcgacacgttgtttgtcttcctttttgaagagctggatagaacaatagttacaatagacattggtgaagaggctatatatgatgccaacttggcgaataaaaagtattctactctattaattattaaatctagaagtgttattgtggatgcagaaccgattgcaacacaaataagtgccatatacttacctggtccagtaaatgcggggaacctggcctcaattatcacacatggcgtatcgtctgtgtttggccaattgataaaatcagatacaaagacatattctgtcgaaactatagataaaacgaggaggaaacttgacgacatttctaaacaatttcaacagttacatacctcaattgaaacgccagatcttttagcgatggtccctagcattatcaaattggctgtatcaaaaggggctacttcacatgattatgcaaactaccttcctagtaatgatttggaaagtatgagatttttgaacattttacaaagcattgcaaacaaatggtttttggttcttaaacaaacattagccattgacagagatataaaaaatggttcttttttagacgaagttgagttttggtcgaatttctacgaagtactgaagtcgttaattgaacaaacacaaagccaagaatttcaggtgtgtctatccgttctaacaaacgcaaagagatttcataatttaacaaatttattgaatgaaggttcactttcagataaatttaagctagcggataaatataaccaatttctatcgtcaatccctatcgatgaggttcgccaggcaagcaatcttgaggacttgcaggaactatttcctgttttagcatcttctttgaagaagttcagatattcaggttatccagttcaaagatttgttgtgctgatggacaaaatttcacaagaagtcatggatgcaattctaagtaatctttcagatttatttcagctagagtatggttcttttttgggtttatatgaaaaatcagcaggcatgatagaagaatgggatgatattgtccaggatgtcaatcttttaataagagaggatcttaggaaaagagcaccacaggagctacttatacaaaagctaacatttacaagtgcatccgtaaaggctactttggatgaaattttaagcacacgcaagcgatttttttcattggcagaaaccattaagagtatatccccttctacttatcacgaagaaatacagagattgtatcatccatttgagcagatccatgatatttccgtgaattttcgattgaaattggagcaagccgaaagtgaattcagtaaaaacatgctcgatttggaaaagaagttacaaaatacgttggcaagttttatggactctgatcactgtccaaccgaaaaattaagttatctagtaaaattcaagccattaatggaactttgtcctaggataaaagtaaaagtactagagaatcaacagatactgctacttgaaataaaaaaagatatacggcaactggagactggtttagagctcttgcctaaaattctgcacgtggaagctttaaataacattcctcccatatctgcaagaatttcctactttctgaatgtacaatcccgtattgacaatatagtgcagtatctcgaagcactttttggttctaattggaatgacacacttgaagggcgttcgatatcaacttcgatagtacaactacgtaaggaaacaaatcctcacgatgtgttccttcactggttggggaattttcctgaaaaagcaacagcaaatcttttgacgacacctattttaaagcttataagaaataatgaggatgattatgaactaaaagtcaacttcgattttgccttagctgctgcttactcggaattaaggagtttaacctatatggcttttcaagtgcctagccacatagtacgtattgcgagaacttacatgtatttgtatccgagggcaataaacttggttgaactaattcaaacttttttttcacttagtaaatcactttcctatacattttacacgaacatctttctgaagagaaacgtgcaaactgtatggctactattacaacaaattctgataacgccgtgggaatctttacaagaggaaagttccgaaatgtcctgttcggtacacagcctagcaagattggaaaagtcaattgatggaattctttctgattatcaaatattgaaaaactccgagcctcagtttgccaaggaattttctggcctgaaatcttttgacggtactgctgatgatctgcacgaagtggaggaaataataagcaatattcaagctatttttgaaaatctttttaccaagggtcttactaatgttagtgaccatatttccacgtttaataacttaattatcagcataatcttggagaaagtacgcttaaatttgaaaaaaatgcatttcccaaagcatgtattgaaactcagtttcaatgaaggtagaataacatcatctccatcgttagctgctatgaaacgttctttactgaaggatattgaggctcttttaaacaaagttgttttaattaattttttgcatgaccctgatcatcctctttccactaccctgacttttaattcgctagtcatcaaactaaaagatgatatacaaaattgtatagaacaggttcaaaatttacattgtaagataaattcttacgtcaaagaatggcaaaagatggaatttctctggcaaattacagaggaagcgtttttagaagtagtcgataacagtacacaaagatgctttggaattttaaaaggccttcttgattctcagtcaaaattcgatctaattataagccgaaataacttttcaaagaacttagtgcttcatacagaagatgcgcaacgtcatatccgttcgaaaatggattcttggatcttatatgtcagcaagcatctcttaacaatatatgaacgcgatgctagaaaattgcatgaagatatgaacagggacagagaagctgtcgaggatatggatataaattttacctctttaaagaatataacagtgatcattgaggctgtcaatgtaaataaaaggcatctcactgaacgagatatccaaatcaagctgcttgggtctgttatgagggcgcttacaaagctgaaggtgaggtttccatcgcattttgtctatatagaccagctcgataacgattttagttcgttgaggcaaagtttgagctatgttgaacaagagttgcaaaaacatcgcgttgttatagcaaaaagtctagaagaaggcgttgaaaatatcaataatctctcacaatctttgaacgaaagttggtcagtcagaaaaccaatatctccaacattaactccacctgaagcacttaaaatcctagagtttttcaatgaatcaattactaaattgaagaaaaagatgcactctgtcgcagccgctgcaaaaatgttactgatccccgttgttttgaatgaccagctaacacacgtggttgaagaggtcaaaacgtatgacctagtttggaggagcattaaaaacctttgggaagatgttcaaagaactttcgaaacgccgtggtgtagagtagatgtattgctacttcaatcggatttggcaaactttcttcggagggcggatgaactgccgagagctgtcaaacaatttgagatgtataaatcgctattttcacaggttaacatgcttacctctgtaaataaaatcttggtggagttaaaggatggtgctttaaagccacgacattggaacatgatattccgcgatattggtaaaagacagatacaaaaaaatctactggataaattggagttttctcttaaagatgtcatggtcctcaatttaactttaaatgaaatactacttacaaagattatagaaagagcccaaaaggaatttgttatagaaaagtctctgaacagaatcaaaaaattttggaaggaagctcaatatgaagtcatagagcactccagtggactcaagcttgtgagggaatgggatgtactggagcaagcctgtaaagaggatctagaggagctagtttctatgaaagcttcgaattattacaagatttttgaacaagactgtttggatttggaatctaaactgacaaaattatctgaaattcaggtaaattgggttgaagtacagttttactggttggacttgtatggaatccttggtgaaaacttggacattcaaaacttcttaccgctcgaaacttcgaaatttaaaagcttaaccagtgagtataaaatgataaccacaagagcgtttcaactcgacacaacaatcgaagtaatacatattccaaatttcgacacaactctgaagttaacgatagattctttaaagatgataaaatcgtcactatcgacatttttagagagacaaagaagacaattcccaaggttttactttttaggcaacgatgatcttttaaaaatcataggatctggaaaacaccacgaccaagtttcaaagtttatgaagaaaatgttcggaagcattgagtctataatattcctcgaagatttcataaccggtgtgcggtcagtggaaggtgaagtcctaaatttgaatgaaaaaatcgagctgaaggactcgattcaagctcaagagtggttaaacattttagacacagaaattaagctaagcgtcttcactcaatttagagactgtttgggccaactgaaagatggaacggacattgaagtagttgtatctaaatatatctttcaagccattcttctctcagctcaagttatgtggacggagctcgttgaaaaatgccttcaaactaatcaattttcaaagtactggaaagaagttgatatgaagattaagggactgctggataagttgaataaatcttccgataacgtgaagaaaaaaatagaggccctactggttgagtatttgcattttaataacgttattggacagcttaaaaattgttccactaaggaagaagctcgactactatgggcgaaagttcaaaagttttatcaaaagaatgacactttagatgatctcaactccgtttttatttctcagagtggctacctcttgcaatataaatttgagtatattggcatcccagaaagattaatatatacaccgttgcttcttattgggtttgcgacactcacagattctctgcatcaaaaatatggtgggtgcttcttcggtcctgcgggcacaggtaaaacagaaactgtgaaagcatttggtcaaaatctcggtcgcgtggttgtagtttttaattgtgatgattccttcgattatcaggttctttccaggcttctagtaggtatcacacagattggcgcatggggatgcttcgatgaattcaataggctcgatgagaaagttttgagtgcggtgtctgccaatatccaacaaatacaaaatggcctccaggttggtaagtcccatattacacttttagaagaagaaactccattgagccctcacactgcagtgtttattactttgaatcctgggtataatggaaggtcagagttaccggaaaatttgaagaagagttttcgagaattctctatgaaatctccgcaaagtggtactattgcagagatgatattacaaattatggggttcgaagattctaagtctttagcttcgaaaattgttcattttttagaactgttgtcttcaaaatgcagttcaatgaaccattatcattttggtttgagaacgctaaaaggtgtattaagaaattgcagccctttgattagtgaatttggtgaaggggaaaaaacggtagtcgaaagtttgaaaagagtgattttaccatcgctcggtgacaccgatgaattggtattcaaagacgaattatcgaaaatatttgattctgctggaacgccgctaaattcgaaggctattgttcaatgtttaaaggacgctggtcaaaggagtggcttttcaatgtctgaggaatttctcaagaaatgtatgcagttttattacatgcaaaaaacacaacaggctttgatactggtaggtaaggcaggctgtggtaaaacggcaacgtggaaaactgttattgatgccatggccatttttgatggtcacgctaacgtcgtctatgttattgatacaaaagttcttacaaaagaatccttgtatggaagtatgcttaaagcaacgctagagtggagagatgggctttttacttcgattctaagaagggttaacgatgatatcacaggaacttttaagaattcgagaatttgggtagtatttgatagtgatttagacccagaatatgtggaagccatgaattctgttcttgatgataataaaattttaacgcttccaaacggtgaaagacttcctattccgccgaactttcgcattttatttgaaacggataaccttgaccatactacacctgctactataacaagatgtggtttgctgtggttttctacggatgtgtgttcaatatcctccaagattgaccacctactgaataaaagttatgaagcgcttgataataaactatccatgtttgaattagataagttgaaggaccttatatctgattcttttgatatggcctctttaaccaatatttttacgtgttcaaatgatttagttcacattctcggggttcgaacctttaataagttagaaaccgcggtgcagttggctgttcatttaatatcgagttataggcagtggtttcaaaacttggacgataaaagtttgaaagatgtgattactttattgattaagagatccctactatatgcactagctggtgattcaactggtgaatcacaaagagcttttatacaaactataaacacttattttggacatgacagccaagaactatcagattattctaccatagttattgcgaacgataagttgagttttagttccttttgttccgaaattccctctgtttctttagaagcacatgaggtcatgaggcctgacattgttattcctacaattgatacgattaagcatgagaaaattttttatgacttgctcaattcaaaaaggggtattatcctttgtgggccacctggatctggtaaaacaatgattatgaataatgcactccggaactcttcgctctatgatgttgttggaataaatttttcgaaagacacgaccacagaacatattttgtcagccttgcataggcatacaaactacgtaactacatcaaaaggccttactttgttaccaaaatcggatataaaaaatttggtattattttgtgacgagattaatttaccaaaactcgacaagtatggttctcaaaatgtcgtcttattcttaaggcagttgatggaaaagcaaggattttggaaaacgccagaaaataagtgggtgacaatagagaggatacatattgttggtgcctgcaatcctccaaccgacccaggtagaattcctatgtcagaaagatttacacgacatgctgctattctttacctaggttatcccagcggaaaatctctttctcaaatttatgaaatttattacaaagccattttcaagctagtccctgagttcagatcatacacagagcccttcgcccgcgcttccgttcatttatataacgaatgtaaagcaagatacagtactgggcttcaatcacactatcttttttcaccaagagaattaacacgtttggttaggggtgtctacactgcaattaacactggtccaaggcaaacactaagatcactaatacggttatgggcttacgaagcttggagaatatttgcagataggctggttggtgtaaaagaaaaaaacagttttgaacaacttctttatgagacagtcgataaatatttacctaatcaggatttgggtaatataagctcaacttcacttctcttttcgggcttgttgagccttgatttcaaagaggtcaacaaaacagatcttgtaaactttatagaggaaagatttaaaacattctgtgatgaggagctggaagtgccaatggttatacacgagtctatggttgaccatattttgcgtattgatcgtgcgttaaaacaagttcaaggtcacatgatgctaattggtgcaagcagaacaggtaaaactattttaactaggtttgtcgcgtggttgaacggtttgaagattgttcaacccaagatccaccgtcattccaatcttagcgactttgatatgattttgaaaaaagctatttcagactgttcacttaaagaatctcgtacttgtttaatcattgatgaatccaacattttagagacggcttttttggagagaatgaatacattacttgccaacgctgatataccagatttgtttcaaggagaggagtatgataagctcttgaataacttgcgaaataaaaccaggtctttaggtcttttattggatacagaacaagaactgtatgactggtttgttggagaaattgccaaaaaccttcatgttgtcttcacgatctgcgatcctacaaacaataagtcctcagcaatgataagttctccagcccttttcaatcgttgcataattaattggatgggtgattgggatacgaaaacaatgtcccaagtggccaacaatatggtggacgtgatccctatggaatttaccgattttatagttccagaggtcaataaagagttggtatttacggagccaatccaaactataagagatgctgtggttaatattctgatacattttgatagaaatttttaccaaaaaatgaaggttggggtaaatccaaggtcacctgggtattttattgatggtttacgtgccttagtgaagcttgttacggcgaaatatcaagatttacaggaaaatcaaagatttgttaatgtaggtctcgaaaaactaaacgagtctgtcttgaaggttaacgaactaaacaaaactttgtcaaagaagagtacggaacttactgagaaagaaaaggaagcccggagtacattggataaaatgcttatggagcaaaacgagtcggaaagaaagcaggaggctacagaggaaatcaaaaagatattgaaagtacaagaagaagatataagaaaaagaaaggaggtcgtcatgaaaagtattcaagatatcgaacctaccattttagaggcacaacggggtgtaaagaacataaaaaagcaacagttgacagaaatcagatcaatggtcaaccccccctctggtgtgaaaattgttatggaggctgtttgcgccatcttgggctaccaattttccaactggagagatatccaacaatttattagaaaagatgactttattcataatatagtacattatgataccaccttacatatgaagccccaaattcgaaaatatatggaggaagaatttttgtcagatcctaattttacttatgagacaattaacagggccagcaaagcgtgtgggccgctatatcagtgggtcaatgcccaaataaacttcagtaaagttttagaaaacgtagatccgctgagacaagaaatgaaaagaatagagttcgaatcattgaagacgaaggccaatttacttgccgctgaagaaatgacacaggatttagaagcaagtattgaagtttcaaagcgaaaatatagtttgttgattagggatgttgaggccatcaagacagaaatgagtaacgtgcaggctaatcttgataggtctatatctttagttaagagtttaaccttcgaaaaagaaaggtggctgaacactacaaagcaatttagtaagacgagccaagagctgattggaaattgcataatttcatccatatatgaaacatactttggtcatttgaatgaaagggaaagagctgacatgttagtcattttaaagcgcctactaggcaaatttgctgttaaatatgatgtaaattatcgtttcatcgattatttggtaacactagatgaaaaaatgaagtggcttgaatgtggcttggataagaacgattactttttggaaaatatgagcatagtcatgaattcacaagacgctgttccttttcttttggatccaagctcccacatgataacagttatctcgaattattatggtaataaaactgtacttctcagttttcttgaagaaggttttgttaaaagattagaaaatgcaattagattcggaagtgtagttataattcaggatggagaattctttgatccaattatatcaagactaatctccagagagttcaatcatgccggaaacagagtcacggtggagattggtgatcatgaagtagatgtttcaggcgattttaaattattcattcactcttgcgatcccagtggagatattccaatattcctcagatctagggtaaggttagttcattttgtcacgaataaggaaagtattgagacacgaatttttgacatcactttgacagaagagaatgcagaaatgcaaaggaaaagggaagatttgataaaattgaataccgaatacaagttgaaactgaagaatctagaaaagcgacttttggaggaactaaataactcacaggggaatatgttggaaaatgatgaactgatggtgactttgaacaacctgaagaaagaggccatgaacattgaaaaaaagctaagtgaatctgaagagtttttcccacagtttgataatctggtagaagagtattctattatcggtaagcatagtgtcaaaatattctctatgttggagaagtttggtcagtttcattggttttacggcatttctataggacaatttctatcatgtttcaaacgtgtcttcattaagaaatctagggaaacaagagcagctaggacacgggtagatgaaattctttggctattatatcaagaagtatattgtcaattctccaccgctcttgacaaaaaatttaaaatgattatggctatgacgatgttttgtttgtataaattcgacattgaaagtgaacaatataaagaggcagttctaactatgattggagttctctctgaaagtagcgatggcgtaccaaaactaaccgtagatacaaataatgatttgcggtacttatgggactatgttacaaccaaatcgtatatatctgcgttgaactggttcaaaaatgagttttttgttgatgagtggaatatcgcggatgtggtagccaattccgagaacaactattttacaatggcaagcgagcgagatgttgatggcacattcaaattaatcgaattggcgaaagcctcgaaggaatcgttaaaaatcatcccgctagggtctatagaaaatctaaactatgctcaagaggaaatatcaaaatctaagatagaaggtggttggatattattacaaaacatacaaatgtcgctatcatgggtgaaaacgtatctgcacaagcatgttgaggagacaaaggcggcagaagaacatgagaaattcaaaatgttcatgacatgccatttgactggtgataaactacctgccccattgctacaaagaactgatagatttgtgtatgaggatatcccaggtatactagataccgtcaaagatctatggggttctcaatttttcactggtaaaatttcaggagtatggagcgtgtattgtaccttcctattgtcatggtttcatgccttgatcactgccaggacccgattggttcctcatgggttttccaagaagtattactttaatgattgcgactttcaatttgcctcagtgtatttagagaatgtattagccaccaattctaccaacaacattccttgggcacaagtgcgagatcacatagctacgatcgtatacggaggaaagatcgatgaagagaaagaccttgaagtggtcgctaaactttgtgcgcacgtattctgcggctcggacaatttgcagatcgttcctggggtacgaatcccacagcctcttcttcaacaaagtgaagaagaggaacgggcaaggcttactgccatactgtctaatacgattgagcctgcagattcactcagttcatggcttcaattgccaagggaatctattttgaattacgaacgtcttcaggctaaagaggtggctagctcaactgaacaacttcttcaagaaatgtag

SEQ ID NO: 45966 - DNA, 876 bp, Saccharomyces cerevisiae
atgaatacactattatttaagcgaaaaggtggcaattgtgggaacgaaagtaacatagtttcgcagggatcgccctcaagtagcaatcttcctgaatcacctggcactttagatgaaaagaatcttcccagattgcctactccattcgctagaagcctttctaccattcctagttatgagcagatgaaacgtacaaacaaactgccagattatcacctaaagattgttgttgtgggagatggcgctgtagggaagacgtgcctgctgatatcttatgtccaaggaacatttccgactgattatattcctactattttcgaaaattatgtcacaaacatagaaggacccaacggtcaaattatagaattggcattatgggacactgccggccaagaagagtatagtagacttagaccgctttcatatacgaatgcagatgtgctgatggtgtgctattctgttggtagtaagacatcgcttaaaaatgtggaagatctctggttcccagaggttaagcatttttgtccttccactccaatcatgctagtcggccttaaatcagatctatatgaagctgataacctttcagatctggtggaaccaagttcagcagaatccttggccaagcgtctgggggcatttgcacatattcaatgctcagcacgattgaaagaaaatatcgatgaagtatttgaaactgccatacacacgttactttccgattcattatatgctcccagagagcctacacatacaatcaaaaatccctttaaaagaaataccaccagatcagatatcgattcttctactggagataccagcgtctctatttccggaacgaaaagattaagaaaaaacaagtgtattataatgtaa

SEQ ID NO: 45967 - DNA, 1188 bp, Saccharomyces cerevisiae
atgtctgaaggtattactgatattgaagaatcccaaattcaaaccaactatgacaaggttgtctacaagttcgatgatatggaattggacgaaaacttgttaagaggtgttttcggttacggtttcgaagaaccatctgccattcaacaacgtgccatcatgcctattattgaaggtcacgatgtcttggctcaagctcaatctggtactggtaagaccggtaccttttccattgctgctttgcaaagaattgacacctctgtcaaggctcctcaagctttgatgttggctccaactagagaattggctttgcaaatccaaaaggttgtcatggctttggctttccacatggacatcaaggtccacgcttgtatcggtggtacttcctttgttgaagacgctgaaggtttgagagatgctcaaatcgtcgttggtactccaggtcgtgtttttgacaacatccaaagacgtagattcagaactgacaagatcaagatgttcatcttagatgaagctgatgaaatgttgtcttctggtttcaaggaacaaatctaccaaattttcaccttacttccaccaaccactcaagttgttctattgtccgccaccatgccaaatgacgtcttggaagttaccaccaaatttatgagaaacccagttagaattttggttaagaaggatgaattgactttggaaggtatcaaacaattctacgttaatgttgaagaagaagaatacaaatacgagtgtttgaccgatttatacgactctatctccgttactcaagctgtcatcttctgtaacaccagaagaaaggtcgaagaattgaccactaagttaagaaacgacaaatttaccgtttctgccatctactctgatttaccacaacaagaaagagacaccatcatgaaggaattcagaagtggttcttccagaattttgatctccactgatttgttggctagaggtatcgatgtccaacaagtttctttggttattaactacgacttaccagctaacaaagaaaactatattcacagaatcggtagaggtggtcgtttcggtagaaagggtgttgccatcaactttgttactaacgaagacgttggcgctatgagagaactagaaaagttctactccactcaaattgaagaattgccatccgacatcgctactttgttgaactaa

SEQ ID NO: 45968 - DNA, 1278 bp, Saccharomyces cerevisiae
atgcaaatctgcaaggtatttcttacacaggttaaaaaactactttttgttagtcttctattttgcttgatagctcaaacatgttggcttgcacttgtaccatatcagagacagctgagcctagattcgtatttttttagaagatctcgagaagtttcatcgagatatgattttacaaggaggcgacatatgaatcagacgctgaagctatctagcaacacttataatgatgaaccactaaacaagaccaagggaataaaaaatcaaagagaaaatgctacattgttaatgcttgtgcgtaattgggaactttcgggggcactccgttccatgagatcactagaagaccgtttcaataaaaactaccagtatgactggacatttcttaatgatgtcccatttgatcaagagttcatcgaagccaccacagccatggctagtggtagaacgcaatacgctttaatccctgcggaggactggaacaggccatcttggatcaacgaaactctatttgaagaggctttacaattaatggaggaaaaaaatatcttgtacggtgggtcaaagtcatatagaaatatgtgccgatttaattctggatttttctttagacaaaagatattagatccgtacgatttttatttcagagttgagccagatgtagagtatttttgcgattttccctacgatccattcaaggtgatgaggcagaacaataagaaatatggctttgtgataactatgtatgaatacgaagatacaattccgagcctatgggaagctgtagaagaatatctcgaagaaacagagtcagcagatattgacatggaaagcaacgctttcgggttcgtatcaaatttcgacttcatcggtaaatcttttggtgtcatcgatagtaacagcggctataatttatgtcatttttggacaaattttgaaattggcgatttgaactttttcagaagtgagaaatacattagatttttcgagtacttggattcaaagggcggtttttactatgaaaggtggggagatgcaccagttcattcgattgctgcctcacttcttttgaaaaaagacgaaatcatccattttgatgaattaggctataagcatatgccttttggcacgtgtccatctgcatactacctgagacttcaacaaagatgtctttgtgatagcaatcacccagacaatattgatctcaatgtcatcagctgcctgagaagatggtggaaggacggcagcggtaaatacttcctcaaacacgattcatag

SEQ ID NO: 45969 - DNA, 1782 bp, Saccharomyces cerevisiae
atggtacgagacttagtgacattgccttcatcactgcccttgattactgctggttttgctactgatcaggttcatttgcttattggtacagggtccacggactcagtaagcgtttgtaagaatagaatccactccattttgaatgctggtggtaatcccatagtagtgaatccctcgtcaccaagccatactaaacaattacaattggaatttggtaagtttgcaaagttcgaaatagtagaaagggagtttaggttatctgatttaactactttggggagagttctggtatgcaaggtagtggatagagtattcgtagatctacccataacacaaagtcgcctatgcgaggagatcttttggcaatgccaaaaactgagaattcccataaatacattccacaaaccagagttttctaccttcaatatgattcctacgtgggtcgacccaaaaggaagtggtttacaaatctcagttactacgaatgggaatggatacatcttggcaaacaggataaaaagagatataatatcacacttacctccaaacatatctgaggtggtgataaacatggggtatttgaaagaccgtattataaacgaagaccataaggccttgttagaggaaaagtactaccagactgacatgtcattacctggatttggctacggcttagatgaggacggttgggagagccataagtttaataagctaattcgtgaatttgaaatgaccagtagagaacagagacttaagagaaccagatggttatctcagataatggagtattacccgatgaacaagctgagtgacatcaagttggaagatttcgagacttcatcttctccaaataaaaagacaaagcaggaaactgtcacagagggtgtagtacctcctaccgatgaaaatattgaaaacggtacaaaacaactacaattatcggaagtgaaaaaagaggagggacctaaaaaactagggaagatttctttagtcggaagtggtccaggctcggtatctatgctaacgataggtgcattacaagaaataaagtctgcagatataatactggcagataaactggtaccgcaagccattttagatttaatacctccaaaaactgaaaccttcatagccaaaaaatttcccggtaatgcagaacgagcacaacaggaattactagctaaaggtttagaatcgttggataatggattgaaagtagtccgtttgaagcaaggtgatccgtatatttttggccgtggtggcgaggaatttaatttcttcaaagatcacggatatattcctgtggttttaccgggcataagctcatccctagcttgtactgtattggctcagatacccgctactcaacgtgatatagcagaccaagtgctcatatgtactgggactgggagaaagggcgctctgcctataattcctgaatttgttgaaagcagaaccaccgtctttctaatggcactgcatcgcgccaacgttctgatcacgggattattgaagcatggctgggatggtgatgtccccgctgcaattgtcgagagaggatcgtgccctgaccagcgtgttactagaactcttcttaaatgggtaccagaagtcgtggaggagattggttcaaggccccccggtgtcttggttgtaggcaaggctgtgaatgcattggttgaaaaagatctgataaattttgacgaatcaagaaaatttgtcattgatgaaggttttagagaatttgaggttgatgtagatagtctatttaagttatactaa

SEQ ID NO: 45970 - DNA, 3216 bp, Saccharomyces cerevisiae
atgggtcattcggggcgtgaggaaaggataaaagacatatttaaggaacttacgtcaaaagaactaacgcctgggttgcttttgacactgcagaaactagcgcaaaagccgaatactaatctagaacagtttattgccagctgtaaagctttgacgaaactcagcagtaacaatccaatcatttttaatgaacttctggagctcctcaagaataaatctgaagaggactcgacaggcccaaagaaaatcgccccttctataaataagagaaagaaatttaagatccagttagaccttgacgataatgaagatgagctagattctccagttcaaaaaaaaccagcacctacacggacgttgttcaagagaatagataaactaaaggccaaacagttgaggcagtattcgcccaccgtgaaggatccttctccaaatagtgaacagcaaacacagaatggtcatgctgaaacgaaggactatgaaccgactcgaagcgaagtagttgaggaggacagagaatggtatgataatgatgatgattatggaaatttggtgcctgaacctctgtctgaattgcctgaggaagcgaaactactacctgtcattaggaatatcgacaacgatgatgccttacgaaataccgttcaattataccccataccactcaagcaaagaatggaatggatccctccttttttatcaaagtttgctcttgaaaacaaagtgcccacttccataattatcgggtccatctctgagacgtccagccaagtatccgctttatcaatggtgaatccatttaggaatcctgacagtgaattttctgcgaacgccaaacgaggtagtaagctggttgccttgagaaggataaacatggaacatattcaacaatctcgagacaacaccactgttttgaacactgccatgggggaagtactaggcttggagaataacaataaagcaaaagataagagcaaccaaaagatttgcgacgatacagctcttttcacgccatcaaaagatgacattaaacatactaaagagcaactgcctgttttccgctgcagatctcaattgttatcattgataagagaaaatcaagtagtggtgataattggtgaaacgggctcaggtaaaaccacgcaacttgcacagtatttatatgaagaaggatatgccaacgatagggggaaatctattgttgtcacacagccgagaagagtagcagccatatccgttgcaaaaagggttgcaatggaaatgcaagttccattgggtaaggaagtaggctattctataaggtttgaagatgtgacggattctgagtgtacaaaacttaagtttgtaacggatggtattctactcagagagaccttattggatgatacactcgataaatattcgtgtgttattattgatgaagctcatgaaaggtcattaaatacagacattttactaggttttttcaagattttattagcacgtagaagagatctaaaactcataatcacttcagcaacaatgaatgcgaagaagttctccgcattttttggtaatgctcctcagttcacaattcctggaagaactttccccgtacagaccatatatacttccaaccctgttcaagactacgtagaagctgcagtttctcaggctgtgaaaattcatttagcaaacgattgttcaagcggtgatattctcattttcatgacaggtcaagaagatattgaaacaacgttcgacactctgcaagaaaagtttttgcaagtatattctaaaaagtttggtaccgcaaactttgaagagatcaatgatattgaaattttaccaatctactcggctttacctgcagatttgcaattcaaaatttttcaggatctacatggcactaaaaggaaaattataattgcgacaaatattgcagagacttcattgaccattaaaggtattagatatgtcattgattgtggttactctaaactgaaagtttacaatccaaagattgggcttgatagtttagtaataacgcccatatcaaaagctaacgccgaccaaagatccggaagagcgggaagaactgcgccaggcactgcatatcgattatacacggaagatacattcaaagaagatatgtacttacagacaatacctgagatccaaagaacgaatttgtcaaacacccttttactgctaaaatctctggacgttactgacgaattgagtaagttcccgttcattgataaaccacccttacaaacatttttatcctcattgtatgagttatggttcataggggctatagacactagtggacaattgactccattgggattacagatggcaaaatttcccctgcaaccttccctttccaaaattttattaattgcagttagaaacggctgcagtgatgaaatgttaacaatagtttccatgctttctgttccacaagtcttttatagacccaaggaaagacagaaagaagcagatattgctagaaataaattttttatcgcgaaatcagatcacttaacgttacttaatgtttttgaacaatggagggcaaataattttagttcgcattggtgtaacaaacattttgttcaatacaaatcacttgtcagggcaagagacattcgagaccagttgctaacaatactaaaatctcaaaaaattccggtcatttcctccggtaaggactgggatattattaaaaaatgtatttgttcaggatttgctcatcaagcagccaaaataacaggactacgaaattacgttcatttaaaaactggcgtaagtgttcaactacaccctacaagtgcattacacggattgggggatttacccccttacgtggtatatcatgaattattaatgactagcaaagaatacatttgttgtgttacttctgtagatccattctggttaatggaatatggtgggttactctacgacatcaagcgtattaaaaatgatcaggaggccacaactacaggcctctttggtgaacactatgaacatactctggacaaggttgaagatgatattgatatcaatattaggagatgtaaggatatgagagacagtgtgatacaggagctcaaaatgaccgacaattcaaacaaagaagacaaaaagcaaaaaacgaaaaagcaaaatatactgaacggcaaagaaaattcaatgaaacctttcaaaagaaggaagccttttttttag

SEQ ID NO: 45971 - DNA, 755 bp, Saccharomyces cerevisiae
atgcaaatgtatgttacggcgaatacagaatactatgttcgaaataatatgaggattatacgatagcaaaaaagccataaacgaaagacataaatggaaaatgattgacaagctcacaatttattaaacaagtagcaattgagaaaaactattactcgcggcaagcttctgagtttacattaaatctgtagagcaaattgaaaatgtcgcatatgtgctgaagggtttgtttgttccatcttattttgcataacatagttatatttacttggtcgcataaaaaatattttttactaacgtgaagtttctttctttatgatgtacgcacgcacgtctgtgcttactccataaatgaacttattccaattttgtacagcttcgttaagactttgactggtaagaccatcactttggaagttgaatcttctgacaccattgacaatgtcaagtccaagatccaagacaaggaaggtatcccacctgaccaacaaagattgatctttgctggtaagcaattggaagacggtagaactctatctgactacaacatccaaaaggaatccactttacatttggtcttgagattaagaggtggtatcattgaaccatctttgaaagccttggcttccaaatacaactgtgacaaatctgtttgtcgtaaatgttacgccagattaccaccaagagctaccaactgtagaaagagaaagtgtggtcacaccaaccaattgcgtccaaagaagaagttgaaataa

SEQ ID NO: 45972 - DNA, 5628 bp, Saccharomyces cerevisiae
atgtcggatcatgatactccaatggaaagcatacaaaatggtgaaaattcagacgaaagattgaacgccattgcgtcttttttcggttgctctttagagcaggttaaatcatttgacggtgatgtggtaaaacaccttaacgataaacttttacagtttaatgaacttaaatcggagaatctaaaggttaccgtctcattcgatgaattgaaggctagttctttaaagaaaattgatggtttgaagacagaaatggaaaacgttataagagaaaatgataaaatccgaaaagagaggaatgatacttttgttaagttcgaatctgtagaaaatgaaaagatgaaattatcaagtgagctagagtttgtgaaaaggaagctcgatgatttaactgaggagaaaaaggaaacccagagtaatcaacagcgaaccctgaaaatactggatgaaagactaaaagaaatagaattggtcagggttgagaataatcgctccaatagtgaatgtaagaaactacgctctacaataatggatttagaaacaaaacaacagggctatattactaatgacctgaattctagaactgaactggaaagaaaaacacaagaattgactttattgcagtcaaataatgattggctagaaaaggagctacgttcaaaaaatgaacagtatctctcctacagacaaaaaaccgacaaagtaattctagatatcaggaatgaattaaatcgtttaaggaatgattttcaaatggaaagaacgaataatgatgttttgaagcaaaaaaataacgaattgtcaaaatctttacaagaaaaactactggaaatcaagggtctatccgactccctaaattccgaaaagcaagaattttctgcagaaatgtccctaaagcaacgtttagtggaccttttagaatcacaattgaacgctgtaaaagaagaattgaacagtataagagagttgaacactgcaaaggtaatagcagatgattcaaaaaaacaaactcccgaaaatgaagacttacttaaggaattgcagttaacgaaagaaaaattagcacaatgcgaaaaagaatgtctacgtttatcctctataactgacgaagcagatgaagataatgaaaatttatctgcaaaatctagttctgattttatattcctgaagaaacaattaattaaagaaaggcgtaccaaggaacatcttcaaaatcaaattgaaacattcatcgtagagttggaacataaagtgcccattataaactctttcaaagaaagaactgacatgttggaaaacgaattgaataacgctgcattgttactagagcatacatcgaacgagaagaatgcaaaggttaaggaattaaatgccaaaaaccaaaagctagtggaatgtgaaaatgatcttcaaactttaactaaacaacgtctcgatctatgccgtcaaatacaataccttttaattaccaattctgtttctaatgactcgaagggacccttacgtaaggaagaaattcaatttattcaaaacattatgcaggaagacgatagtactatcacagaatctgactctcaaaaagtcgtaactgaaagactagttgaattcaaaaacattattcaattacaagaaaaaaatgcagaacttttgaaagtagtaagaaacttagccgataagttggaatcgaaagaaaagaaatctaaacaaagtcttcagaaaatcgaaagtgaaacagtaaatgaggctaaagaggctataataactttaaagagtgaaaaaatggatctagaatcaagaattgaggaactacagaaagagcttgaagaattgaaaacttctgttcccaacgaagatgcgtcatacagcaatgtaactataaaacagttaaccgaaactaagagagacctcgaatctcaagtacaagacttgcaaactcgtatctcgcaaattactagggagtctactgaaaatatgtcacttttaaacaaggagatacaggacctgtatgacagcaagagcgacatatccattaagcttggaaaggaaaaatcatcgagaatattggcagaggaacgatttaaactactttcgaatacgttagatctaactaaagctgagaacgaccaactgcgcaaaaggtttgattatttacagaatactattttaaaacaagattccaaaacacacgagacacttaatgaatacgtttcctgtaaatctaagttaagcattgttgaaacagaattattgaacctgaaagaagaacagaaattaagagttcatttagaaaagaacttgaaacaagaactgaataaactctcccctgaaaaggacagtttacgcatcatggtaactcaattacaaactttacaaaaggagcgtgaagatctattggaagagactaggaaatcatgtcaaaagaaaatagatgaacttgaagatgctctcagcgaacttaaaaaggaaacttctcaaaaagaccatcatatcaaacagctggaagaagacaacaattcaaatatagaatggtaccaaaataaaatcgaagctttgaagaaagattatgaatcagtaataacttctgtagatagtaagcaaactgacattgagaaattacaatataaagtcaaatcactagaaaaggaaatcgaggaggacaagattcgtttacatacttataatgttatggatgaaacaattaacgatgattccctacgcaaggagttggaaaaatccaagattaacttaactgatgcttattcacaaatcaaagaatacaaggatctctacgagactacctctcagtctttgcagcaaacgaattctaaattggatgaatctttcaaggactttactaaccagattaaaaacctaactgatgaaaaaactagtttggaggataagatttcgcttctaaaagagcaaatgtttaatttgaataatgagctagatttgcagaaaaaagggatggaaaaagaaaaagctgactttaagaaaaggatatcaattttacagaacaataataaagaagtcgaagctgttaagtccgaatatgaatcgaagttatcaaaaatccaaaacgaccttgatcaacaaactatatatgctaatactgcgcaaaacaactatgaacaagaactacagaaacatgcagatgtttctaagacgattagtgaattaagagagcaattacatacgtacaaaggtcaagttaagaccctgaacttatcgcgtgatcaactggagaatgctctgaaagaaaacgaaaagagttggtcctcccagaaggaatctttattagaacagctagatttatcgaattctcgtattgaggatttatcctcccaaaataaactattgtatgatcaaatacaaatctacacagctgcggacaaagaagtcaataattcgacaaacggacctggtttgaataatattttaattacactacgtcgcgaaagggatattcttgatacaaaagtgacggtggctgaaagagatgcaaaaatgttgagacaaaaaatttctttgatggatgttgaattacaagatgctcgtactaagctagataattcaagagttgaaaaggaaaatcattcttccattattcaacagcatgacgacattatggagaaattaaatcaattaaatctattaagagaaagtaacataacattgcggaatgagctggaaaacaacaataacaagaagaaggaactgcaatctgaattagataaattgaagcaaaatgttgcgcctatcgagtccgaattgacagccttgaaatattctatgcaagaaaaagagcaagagctcaaattagctaaagaagaggttcatcgttggaaaaagcgctcacaagacatattggagaaacatgaacaattgagctcaagcgattatgagaagctagaaagcgagatagaaaatttgaaggaggaactagaaaataaggagcgtcaaggagcggaagccgaggaaaaatttaacaggctgagaagacaagcgcaagagagattaaaaacatcaaaactctcacaggactcattgactgaacaagtaaatagtctaagggatgcaaagaacgtgttggaaaattccttgagtgaggcaaacgcgagaatcgaagagttacaaaatgcaaaagtagcacaaggtaacaaccagttagaagcaataagaaaattacaagaagacgcagaaaaggcttcaagagagcttcaagccaagttagaagaaagtacgacttcttacgaatctacgataaacggcttaaatgaagagattacaacattaaaagaagaaattgaaaaacaaaggcaaatccagcaacagttacaagctacatctgcaaatgaacaaaatgacttatctaacatagttgagtctatgaaaaagtcttttgaagaagataaaatcaaattcatcaaagaaaaaacccaagaagttaatgaaaaaatactcgaggcccaagaaaggctaaatcaaccttccaatatcaatatggaggagattaaaaaaaaatgggaatctgagcacgaacaggaagtatctcaaaagattcgcgaagctgaggaagccctcaaaaagcgaatcagattacccactgaggagaaaattaataagataatcgaacgaaagaaggaggaattggaaaaagagtttgaagaaaaggttgaggagagaataaaatcaatggaacaatctggagaaatagacgtggtgcttcgaaaacagctagaagctaaggttcaagagaaacaaaaggaattggaaaacgagtataacaaaaaattacaagaagaactcaaagatgtaccacactcaagtcatatctcagatgatgaaagggacaaattacgagcagaaatcgaaagcaggttgagggaggagttcaacaatgaactgcaagccataaagaagaaatccttcgacgaaggaaagcaacaagcaatgatgaaaactacccttttggaaagaaaacttgccaagatggaatctcaattgtcagaaacaaaacaaagtgccgagagtcctccgaaatctgttaacaatgtacaaaatccattactaggattacctaggaaaatcgaagagaattcaaattcaccattcaatccgttactttccggtgaaaaactcttaaagctaaattctaagtcttcatcaggtggatttaacccttttacctcgccatccccaaataagcacttacaaaatgataatgacaaaagggagtcgttggctaacaagacagatccaccaactcatttggaacccagcttcaacattcccgcctcaaggggtctaatatcttcatcttccactttgtcaactgatacaaatgatgaagaacttactagcaacaatcctgcccaaaaggattcatcgaacagaaatgttcaatcggaagaggatacagaaaaaaagaaagagggagaacctgttaaaagaggagaggcaatagaagagcagacgaaatccaacaagcgacctattgatgaggtaggagagctgaaaaatgatgaagacgacactacagaaaacattaatgagtcaaaaaagatcaagactgaagatgaggaagaaaaagaaaccgataaggtgaatgacgagaacagtatataa

SEQ ID NO: 45973 - DNA, 1650 bp, Saccharomyces cerevisiae
atgtccccttctaaaatgaatgctacagtaggatctacttccgaagttgaacaaaaaatcagacaagaattggctcttagtgacgaagtcaccaccatcagacgcaatgctccagctgccgttttgtatgaagatggtctaaaagaaaataaaactgtcatttcatcaagcggtgcattgatcgcttattccggtgttaaaaccggaagatctccaaaggacaaacgtattgttgaagaacctacctcgaaagacgaaatttggtggggtccggtcaataaaccatgttctgaaagaacatggtctatcaaccgtgaaagagctgcagattacttgagaacaagagaccacatttatattgtcgatgcatttgcaggatgggatccaaaatacagaatcaaagtccgcgttgtttgtgccagggcttaccacgctttattcatgacaaatatgcttattagacctacagaagaagaattagcccattttggagaacctgattttactgtctggaacgctggtcagttcccagccaatttacacacccaggatatgtcttcaaagagtactatagaaattaacttcaaagcaatggaaatgatcattttaggtaccgaatacgccggtgaaatgaaaaaaggtattttcacagttatgttttacttgatgcctgtgcaccataacgttttaactttgcactcttccgccaaccagggtattcaaaacggtgacgttactttattctttggcctaagtggtaccgggaaaaccactttatccgcagacccacatagattgttgatcggcgatgatgaacattgttggtccgaccatggtgtcttcaatatcgaaggtggttgttacgccaagtgtattaatttatctgccgaaaaggagcctgaaattttcgacgctatcaagtttggttctgtattagaaaacgttatctatgacgagaagtcgcatgtagtcgactatgacgactcttctattactgaaaatactagatgtgcctacccaattgactacattccaagtgccaagattccatgtttggcggactctcatccaaagaacattatcctgctaacttgtgatgcttcgggtgttttaccaccagtatctaaattgactcctgaacaagtcatgtaccatttcatctctggttacacttctaaaatggctggtactgagcaaggtgtcactgaacctgaaccaacattttcatcttgtttcggacaacccttcctagccttgcaccctattagatacgcaaccatgttagctacaaagatgtctcaacataaagctaatgcgtacttaatcaacaccggctggactggttcttcctacgtatctggtggtaaacgttgcccattgaagtacacaagggccattctggattctattcatgatggttcgttagccaatgaaacgtacgaaactttaccgattttcaatcttcaagtacctaccaaggttaacggtgttccagctgagcttttgaatcctgctaaaaactggtctcaaggtgaatccaaatacagaggtgcagttaccaacttggccaacttgtttgttcaaaatttcaagatttatcaagacagagccacaccagatgtattagccgctggtcctcaattcgagtaa

SEQ ID NO: 45974 - DNA, 2154 bp, Saccharomyces cerevisiae
atgttattaaacccagatcaaattctaaacctagttcgaaaagtatatgaagtagatattaaacagttttattcgcaattacggctaaagaacttaagaggattgttagaccatgctgctcatctgtttaatgtttacctgagggatttagaaatcaatcaggaaatggaagctttgacagcatttattattggttgttattatctgtaccttattattccacaatcgttacaattccaaacaagaaataatctctacagcagttacgcaaagctaaaaaacgactatcaagacgaacacgtgatgggttatgtgttaaaagtggtaagagatgaaagtactgttattgttgaccggtatttagcggagtcaaacggaatttgcaggaccataaaaagaaaaagagcctactccttaccgctacggcctttacctgttcatatggcctctttgtcaatacataacaagtttgatggctcactacatgaaataccgaatgagctaacaaaaccaacaaatgataattcgaaagaggacatagtcagggaaagtaatcagatagcatcaagtaataaattggaagctggttctgaagtggcgtactacacaagcaaagaagcattatcaaaaccctcgtatttaaaactcagtactggaaaggatgcattattcaaaacgctgtctagtccagcaactgctccccccgtgcactccttggaggtttcgtcacaaatcagagattctagccaagattcttcatcctctttatccaaggtggaaaagccaaaggaggaagaaggaaagatcgaggccatagaatcttcggccccgaaagcttacaatctaccagtaattgaagattctaatgatctgttatcagagttatctattactggcctgcaaaatccatgcaatacatgctatattaacagtataattcaatgtctgtttggcactaccttatttcgggatttgtttttaaccaagaaatataggctattcctcaatactaacaaatatccgaaagaagtccaactttcccgctcgatttacgttttgttcaaaaaaatgtatttgaatggaggaagagcgattataccaaatagattcttaaaaatgtgcaagaagttaaggccagatttgaacatcccagatgatcaacaggatacacaggaatttctactaatagttttagcacgaatacatgaagagctctcgaacgaaaatgttgtcaagtattatccagatctagtgtcatatgatgcgaatgctttacaagttaacccatccaaatacgagaaatggtacgagagaaatgttattactgatggtttatctccaattgatcacatatatcgagggcagttggagaacattttgaaatgtcagcgctgtggtaattcttcttatagctattctaccttctatgttctgtcacttgcgattccaaaactatcattgtatagctttacaagtaagtcgagaaaaattaaattagaggattgcataaacttatttacaggcgatgaagaactgtcaggcgacaatgcttgggattgtcctaattgtagaattactgattctaaatccaaaaaagaagaaattactagccagaagaaaaaatcaaccatattcggttttcattccagatcaaggtcaaaatcaccccaccatcatcaccatcatcaccatagcagcgatgattcaacaaaaaatgcaaagaagcgaaattctaaaaagttaaccacgattaagagtttagactttatagttttacctccgatacttgtcattcatttatcaaggttctattatgatttaacaaaaaaaaacagcactgtaataacctaccctttgatattgaacattattttaaagaacggtaaagtgattcgatacaagttatatggaacggtgaatcattccggtaaccttatcaatggacactatacttctgttgtgaacaaagaaaagagccatgaaattggactgaatagacaagtttgggttacatttgatgacgattatatacagcaacatcgcaaggatcgcaacaactttgaagccggcaaaacagaaatgtctagcgatgaggtatacgtcttattctacgaaagaatggatgaagagaactatgaagaagaattctgttaa

SEQ ID NO: 45975 - DNA, 3510 bp, Saccharomyces cerevisiae
atgcctgtggctgctcgatatatatttttgaccggcctatttttgctatctgtagctaatgttgctctaggtactacagaggcttgtttgccagctggagagaagaaaaatggtatgactataaacttttaccaatattccttaaaagattcatctacatactcaaatccgtcatatatggcctatggttatgctgatgcagaaaaactgggttctgtaagtgggcaaacaaagctttccatcgattattccatcccatgtaatggcgcatcagatacttgtgcttgttccgatgatgatgctactgaatatagcgcttcccaggttgtaccagtgaagcgtggcgttaaactttgttctgataatacaactctttcttctaaaactgagaaacgtgaaaatgacgattgcgatcaaggcgctgcctactggagttcagatctgttcggattctacacaacacccaccaacgtaaccgtggaaatgacaggttactttttaccaccaaaaactggtacctacacatttggcttcgctactgtggatgattcagcaattttatcggttggaggtaatgttgcctttgaatgttgtaaacaggaacagcctcctatcacatcaacggatttcactattaacggtattaaaccatggaacgcagatgcacctaccgacataaaggggtcaacgtacatgtacgccggttactattacccgatcaaaattgtttattcaaatgctgtatcctggggtacgcttcctgttagtgtggtattgccagatggtactgaggttaatgatgattttgaaggatatgttttttcttttgacgataatgctactcaagctcactgttccgttccaaaccctgctgagcatgcaagaacttgtgtatcatctgcaacatcttcctggtcgtccagtgaagtctgtacagagtgtaccgagaccgagtctaccagttatgtgacaccatatgtcactagctcttcctggtcgtccagtgaagtctgtacagagtgcaccgagaccgagtctactagcacctctactccatatgtcaccagctcttcctcgtcgtccagtgaagtctgtacggagtgcaccgaaactgagtctaccagttatgtgacaccatatgtcagctcgtctactgctgccgcaaactacactagctcattctcatcgtccagtgaagtctgtacagagtgcaccgaaactgagtctactagcacctctactccatatgtcactagctcttcctggtcgtccagtgaagtctgtacagagtgcaccgagaccgagtctaccagttatgtgacaccatatgtcagctcgtctactgctgccgcaaactacactagctcattctcatcgtccagtgaagtctgtacagagtgcaccgaaactgagtctactagcacctctactccatatgtcactagctcttcctcgtcgtccagtgaagtctgtacagagtgcaccgagaccgagtctaccagttatgtgacaccatatgtcagctcgtctactgctgccgcaaactacactagctctttctcatcgtccagtgaagtctgtacagagtgcaccgaaaccgagtctactagcacctctactccatatgtcaccagctcttcctggtcgtccagtgaagtctgtacagagtgcaccgagaccgagtctaccagttatgtgacaccatatgtcagctcgtctactgctgccgcaaactacactagctcattctcatcgtccagtgaagtctgtacagagtgcaccgaaaccgagtctacaagcacatccactccatatgcaacctcatctactggcacagctacttcatttaccgcttcaacttccaataccatgacgtctttggtccaaacagacacaaccgtttctttcagcctatcttcaactgtaagcgagcataccaacgctccaacttcatctgtagagtcaaatgctagtactttcatatcgtcaaataaaggcagcgttaaaagttatgttacgtcatccatacatagcattacgcccatgtatcctagtaaccaaaccgtaacatctagctctgttgtctccacaccaattacttccgaatcttctgaatcctcggcctcagttaccattctaccctcaactatcacttctgaattcaaaccatctacaatgaaaacgaaggtcgttagtatctcctcatcaccaactaatttgattaccagctatgacactacatctaaggattcaactgttggttcatccacatcgtctgtaagcctgatctctagtatttctctaccaagtagttattcagcttctagcgaacaaatatttcacagctccatcgttagttcaaacggtcaagcattaacaagtttttcttcgaccaaagtcagttcctcagaatcttctgaatcacatagaacatcgcccactacatccagtgaatcaggcatcaaatcttcaggcgttgaaatcgaatctacaagtacctcttctttcagctttcacgaaacttctacagcctccacctccgttcaaatatcttctcagtttgtgactccatcctcccctatttccacagttgcccctcgttctacagggctcaatagtcaaactgaaagtacaaattcttccaaggaaaccatgtcgtctgaaaatagcgccagcgttatgccttcttcatcagctacatctcccaaaacaggcaaagttaccagtgatgaaacttcttccggattttctcgtgatcgcaccactgtgtataggatgacttcagaaacaccctccacaaatgaacaaacaactttgattactgtaagttcttgtgaatcaaatagctgctcaaacacagtctcaagtgctgtagtttccacggccaccactaccatcaatgggattaccactgaatatactacatggtgccctctttctgctacggaattaacaacggtaagtaaattagagtcagaagaaaaaaccaccctaattacggttacttcttgtgagtctggtgtctgttccgaaactgcttcacctgctatcgtttcgacagccactgctaccgtcaatgatgtcgttacagtttattccacatggagcccacaggctacaaataaactagcggttagttctgacatcgaaaatagtgccagtaaggcttcattcgtttcagaggctgctgagacaaaatccataagcagaaacaacaattttgttccaacttctgggactacttctattgaaacacatacaaccactacaagcaacgcgtctgaaaatagcgacaatgtttctgcttctgaggctgtcagtagcaaaagtgtcacaaatcccgtgttgattagtgtatctcaacagcctcgtggcacaccagcaagtagtatgataggatctagtacagcctctttagagatgtcaagctacctcggcattgcaaatcatctactaaccaatagtggtattagtattttcattgcctccctattactggcaatcgtttaa

SEQ ID NO: 45976 - DNA, 975 bp, Saccharomyces cerevisiae
atgaagcgcattccaatcaaagaactaatagttgagcaccccggaaaagttcttatccttgatggtggacagggtacagaattggaaaacagaggcattaacataaatagtccggtatggtctgcagctccttttacgagcgaatccttttgggagccatcttctcaagagcgaaaggtggtagaagaaatgtacagagactttatgattgctggcgcaaacatattaatgacaattacttaccaggcaaactttcaaagcatatctgagaatacctcgattaaaactctggctgcttacaagcgttttctcgataaaatcgtgtcatttactcgtgaatttattggtgaggaaaggtacttaatcgggagtattggcccatgggcagcacatgtatcctgtgaatatactggtgactatggtccccatcctgagaatattgattactacggctttttcaaaccccagctggagaacttcaaccaaaatagagatattgatcttattggttttgaaacgattccaaattttcatgagttaaaggctattttatcctgggatgaagatattatttcgaagcccttttatattgggttgtcggtggatgacaatagtttgctacgagacggtaccactttggaagaaatttctgtccatataaaaggcctcggaaataaaattaacaagaatctcttattaatgggagttaactgtgtcagtttcaatcaatcggcattaattcttaaaatgttgcacgagcatctacctggcatgcctctgctagtttacccaaacagtggagaaatctacaatcccaaagagaagacatggcaccggccgactaataagttggatgactgggagaccacggttaagaaattcgttgataatggtgcgcgcattattggcggttgttgtagaacgtctcctaaagatatcgccgaaattgcatcagctgtagataaatactcctaa

SEQ ID NO: 45977 - DNA, 1752 bp, Saccharomyces cerevisiae
atggatgaatttgaatctaccaaactttcgaaggttcagttttccactagcgtgttaagtacgccttcgaatgaaggaaataatctaatacacagattcaagaactctttcaagcgaaatgattcaccagcgatccaagaaggtttgctgtattcggagctttcagaggaagaaaaaatacaatgggacttagccaaccagccgtataaaaaggtcctagatcaaagacacctgaccatgatagccattggaggtactctagggacgggtcttttcattggtttaggggaatcactagcgtccggacctgcttctttgctaattggtttcttgttggtcggcgcatctatgctctgtgttgttcagtgtggggccgaactttcatgtcagtaccctgtttccggctcctatgcgctgcacgccagtagatttatagacccatcagtcggcttcagtataggaattaactacttattgatgtggctcatatcttaccctagcgagctggtaggatgttcgcttaccatctcttattgggcaccatcggtcaatcctgctgcctgggttgcaatcgcgttcgttttaagcatgctattgaatctttttggggcaagaggctttgcagaatcagagttttatatgtcaattttcaaaattgtggctctattcatttttataattattggtattgttctcattgcaggtggtgggcctgattctactggatacatcggcacgaagtattggcacgatccaggctccttcgctgttcctgttttcaaaaacctctgcaatacttttgtttcggcagcatactcctttagtggtacagaaatggttgttttaaccagcactgaagcaaggagtgtttcctcagtctctcgggcagcgaaaggtacgttctggagaattatcatcttttatattgttacagtgattataattggttgcctggtcccttataatgatcctcgtctgattagcggttcatccagtgaggatattactgcttccccgtttgttattgccttgagcaatactggtgctatgggaacaagagtgtctcattttatgaatgcggtcatcttgatagccgtattttctgtttgcaattcctgcgtttacgcatcctctagattgattcagggtttggcgacagcaggccaacttccaaagatctgcgcttacatggacaggaatggtcggcctttagttggcatggctatatgtggcgcttttggattgttaggctttttggttgtttccaagaaccagggtacagttttcacatggttgtttgcgttgtgttccatttcatttttcacaacttggttctgtatttgcttctgtcaagtcagatttaggatggcaatgaaagctcaaggaaggtcaaaggatgacattatctatagatcgacattagggatatacggaggaattttcggctgtatcttaaatgttctattggtaattggagaaatatatgtatcggctgcacccgtgggtagtcccagttctgctgctaatttctttgaatattgtatgagtattcccataatgattgctgtatatattggccatagaatttaccgcagagactggagacactggtacatcaagcggatggatattgacctcgatagcggacattcgttagaggacttcgaagccaccaagcttgagagggatgaggataagaaatacgtttcctctaagccactttactataggatctatcggtttttctgttaa

SEQ ID NO: 45978 - DNA, 702 bp, Saccharomyces cerevisiae
atgaatggcagaggtttcctgatttacaatggaggtgaaaagatgaaacaaaaaatgataatatatgacacacccgcagggccttatccggcccgagtccgcattgccttggctgagaagaacatgctatcaagtgtgcaatttgtgaggatcaacctctggaagggagagcacaagaagcctgaatttcttgccaagaactattcaggcacagtgccagtgcttgaacttgatgacgggactttaatcgctgaatgcacagccattactgaatacattgatgcacttgatggtacacccactcttaccggcaaaacaccgctggaaaaaggcgtaatccacatgatgaacaaacgcgcagagttggaactgctcgaccctgttagtgtttattttcaccatgctacacctggattggggcctgaagtcgagctttaccaaaacaaagagtggggacttcgccagcgcgacaaagccctacatggaatgcattattttgataccgttctcagagaacgcccatatgttgctggtgattcattctcaatggctgacatcacagtaatagctggtctaatatttgctgcaattgtaaaactacaagtgccggaagagtgcgaggcgcttcgagcttggtataagagaatgcaacagcgccccagcgtgaagaaactgctagaaatccgttcaaaatcctcgtaa

SEQ ID NO: 45979 - DNA, 1596 bp, Saccharomyces cerevisiae
atgtcaaaagttgacgtaaaaattggagcagactcgatctcctcttctgatgaaatcctagttccttcgagactcgctgatgttacgctagcattcatggaggagaatgacgcagcagttccagaaatcacgcctgaacaagaaaaaaaattaaagagaaagctttttctcacaatattcacctttgtctctgccattaaccttttactttacatggacaaagccactttatcctatgattcgattctaggcttctttgaagatacaggtcttacccaaaatacttacaatactgtaaatacgctgttttacgttggttttgcaatcggccaatttcctggacaatacttggctcaaaagttaccacttgggaaattcttgggtgggttgttggccacatggactatacttattttcctaagttgtaccgcatacaacttttccggtgtcgttgcgttgagatttttcttggggctaacagagagtgttgttatcccgatattaattaccactatgggtatgttcttcgatgcttcagaaagagctgctgctcagccatttttctttgcagcatgtatggggtctccaattccaactgggtttattgcttatggtgttcttcatataacaaatcccagcatttcgttatggaaaatattcactatcatcattggtggtttgacttttatcatgacggttgttgtaattctgtggtttcctaataatcctgctgatgtgaaattcttttcaatacaagaaagggtatggattatcaggagagttcaggcatccacaggctcttccattgaacaaaaagtcttcaaaaagagtcaattcagagaggcaatgaaagattatataacctggttatttggattgttttttcttcttcaacagttagccaacaatctgccctatcaacagaacctgctatttgaaggaatgggtggagttgatgctctaggttcgacattggtatcagttgccggtgctggtttcgccgtcgtttgtgccttcatcgctacgttgatgttagcaaaatggaaaaatatttcagctttaacagccatcttttggactttaccagcattggtgggatccatcgctgcagctgctttaccatgggacaataagattggtatcttagcaaatatctgtatggcaggacaaatatttggtattccttttattatagctcttagctgggcaagttcaagtgcatctgggtacaccaaaaaactcacaagaagttcggtgtccttatttgcgatgggaattgctaatatcatatcaccacaaatatggagagagaaggactctcctcgctttttacctgcctggattgttcaaatcgttttatcattctctcttgcaccagccattttgttactgatccatttcatactaaaaagaaggaataatcaaagactaaaaaattatgacgaaaatttacaaaattatttggacagaattcaactcattgaaagcgaaaatccttcttccattgaagaagggaaagtggtaacccacgagaacaatttggcagtctttgatttgactgatttagaaaacgaaacttttatatatcctttgtaa

SEQ ID NO: 45980 - DNA, 611 bp, Saccharomyces cerevisiae
atgtctagatctgggtatgctaaatttcatttgtactcctgtgtaaactatcaattactaactaattgacatgatgctgttttatctcgctctcttatgtcctttctttcctccctttttaacatggaactttaaaaggaatgtgggggaaaaaattcataagaagccaggaaaatgtgaagtttctgtgtagtgttgctgttgctgatgaatcccttaccgctttcaatgacttgaaattgggtaaaaaatacaaatttattttattcggattgaacgatgctaaaaccgaaatcgttgtcaaggaaacctctactgacccatcttacgatgccttcttagagaaattgccagaaaacgactgtctttacgccatttacgattttgaatacgaaattaatggtaatgaaggtaagagatccaagattgttttcttcacttggtctccagacactgctccagtcagatctaagatggtctatgcatcctccaaggatgccttaagaagagccttaaacggtgtctctaccgatgttcaaggtactgatttttccgaagtttcttacgattctgttttggaaagagtcagcagaggcgctggttctcattaa

SEQ ID NO: 45981 - DNA, 4986 bp, Saccharomyces cerevisiae
atgcatcacgtactcaattcaacgagacctgaccatcggttttggttttacgatgacgtaactcagtacggcagaacaaagtaccttaattattatactcccttagtgcttttaatattcacggtgttgttcataacttataacatatggaaacattattactactatgacgttctacacttgaagcaaaaaaatccaattgatgaacttttatactcatctaccgacgaagacgaacagagtccgttgataaataataacaccatcacaactaattacgtggacaataattgtacaaaagacgcactaaaaaatagacacttttctctggaaaagctgaaatcagttaaggtaaatggagaacctcatggtacacctgaaatagttagaagaggcttcattgaaaaatcaagaattatccttgaattttttttggtactttctcaagttataatacattcttttatactattacactatgtcaataaaaacccagagttcacccaacaaggtacgattactggtttggtagaatggtgtgcattgtttatcattgtctctttacgtttagcaaatgtcaaccaaaatttcaaattcataaacaaatatcccggaaatctatggtcggtatcgttcataaactatttggccttgtttatctctatgattttaccctttcgttccattttcattcaccatataaacagtcctatttcgagaaagtattacatttcacaaatatcgattaaccttgcccttttcttgctactcttttttgcgaggataagaaataattttgccatcatctataaaactgacagctggattactccatctccagaaccagtcacttctattgctggattcatatgctgggcttggttagacagttttgtttggaaagcacacaaagttagtatcaaagttaaggatatttggggattgatgatgcaagattattctttctttgtagtgaaaaaattcagatattttgttgaccataaggttaaaaggaagcgtattttttcactaaaccttttctttttcttttcgaattatttggtactacaatgcttttgggcatttttaggcagcgtcctttcttttattccaacagttttactaaaaaggatcctggaatatgttgaagatcagtcatctgctccctcaaatttagcttggttttacgtcactgtcatgtttgtaggtaggatattagtggctatttgtcaagcacaggcactattctttggaaggagagtttgtatcagaatgaaaagtattataatctctgagatttatactaaagctttgagaagaaagatttccaccaacaagactaaaccttctaatgaggatccacaggaaattaatgatcaaaaaagtatcaacggcgatgaggagtccacttcttctgccaaccttggagcgattattaatctcatggctattgacgctttcaaggtttctgaaatttgtggttaccttcattcatttttggaggcttttgttatgactgttgtcgcactggcgctgttataccgtctgctgggttttgctgcgattgtgggtgtcttaatcattgtcgcaatgcttccactgaattataagcttgccaagtacatcggcgatttgcaaaagaaaaacttggctgtcacagataatcgtattcaaaagttgaatgaagcttttcaagctatcagaatcatcaaatacttttcatgggaggagaattttgaaaaagatatcaatactattagagaaaatgaattatctctactgctaatgagatccattgtttggtctatcagttcctttctttggtttgttaccccaactattgtaacagccgcctcatttgcttactacatttacgttcaaggcgaggtattaaccactccggttgcctttactgcactttctttattcacgttattaagagatcctttggatcgtttgtctgatatgttaagttttgtcgttcaatcaaaggtctcgttagatagagttcaggatttcttaaatgaaaatgatacaaagaaatacgatcaactgaccatagatccaaatggaaacagatttgcctttgagaattccaccatctcttgggataaggacaatcaagatttcaaattgaaagacttgaacattgaattcaaaactggtaaactaaatgtcgttattggccccactggttctggtaagacatccctactaatggcattattaggtgaaatgtatctactcaatggtaaggttgtcgtcccagctctagaaccaaggcaggaactaatagtagatgcgaatggaaccactaactctatcgcttattgttctcaggccgcttggcttctaaatgatactgtaaaaaacaacattttattcaatagtccattcaatgaggcaagatataaagctgttgtcgaagcatgcggattgaaacgtgattttgagatcttgaaagccggtgacctaacagaaatcggtgagaagggtattactttatccggtggtcaaaagcagagagtctcccttgctagagccttgtattccaatgctaggcatgtccttttggatgattgtttaagtgcagttgattcacatactgcatcttggatttacgataattgtattactggaccattaatggaagataggacatgtattttggtttcacacaacatcgccttgaccttgagaaatgctgaattggtagtcttactagaagatggtagggttaaagaccaaggtgatccaatagacatgttacagaagggtttgtttggtgaagacgagttagtgaaaagtagtatcttatcgcgtgcaaactcttctgctaacttagccgcaaaaagtagcacaagcttaagtaacctacccgctgtcaaagaacaacaagttagcgtgaacaacaactcctcccactttgaagccaagaaacttcaaaaatcattgaggacagaagctgaacgcactgaagatggtaaattaataaaagaggaaacaaaagaagaaggtgtggttggtctggatgtctataaatggtatttgaaaatttttggtggttggaagattgtttcatttttagcttccttgttcttgatagcccaacttttgtatatcggacaatcatggtgggttcgtgcctgggcgtcacacaatgtcattgctaaaattattcccagagcacaacgcgctattgcatttatctccaagaaggctagtcatctaattgattggaggggctcgtcccaaatcagtatggcgtcagctgaaaaccaaccttccagtggacactctacaatgtattatctggttttgtacctaatcattggttttgctcaggctttattgggagctggtaaaactattttaaatttcgttgctggtatcaacgcgtcaagaaagatatttaatatgattctaaacaaggttttacactccaagataagattttttgatgctactccaacaggtagaattatgaacaggttttccaaggatatcgaagctattgatcaggaactgacaccttatatacaaggcgccttctattcgcttattgaatgtttatccaccgtcatactgattacatttattactccacagttcttatctgttgctatagttgtttcaatattgtattattttgttgggtatttctacatggcaggttctcgtgaattgaaaagatttgaatctatttctagatcaccgatctatcaacatttttccgagactcttgtcggtgttaccaccattcgtgcgtttggtgatgaagggaggtttatgcaagagaatttacacaaaattgatgaaaataataaaccattcttctacttgtgggttgctaatcgttggttggcctttaggatagatatgattggatccttggtcatttttggagctggtttgttcattctattcaatattaataatctggattcgggtatggctggtatatctttgacgtatgctatttccttcactgaaggggcattgtggttggtaagattgtactctgaagtggagatgaatatgaattctgttgaaagagtcaaagaatatatggaaattgagcaagagccatacaacgaacacaaagaaataccgccaccacaatggccacaagacggtaaaatcgaggttaatgatttatcattacggtatgctccaaatctacctagagtaattaaaaatgtttcattttctgtcgacgctcagtctaagatcggtattgttggtagaaccggtgccggtaaatcaactattattaccgccttgttcagatttttggaacctgagacaggccatatcaaaattgataatatcgatatttccggtgttgatttacaaagactgcgtcgttctataactattattccacaagatccaacactattctcagggacgattaaaacaaacctagacccatatgatgaatttagtgacagacagatctttgaagctttgaaacgtgtaaatctaattagtgaagaacaattacaacaaggcgccacaagagaaacaagcaatgaggcttcgtcgactaactccgaaaatgttaataaattcttggatttaagtagtgaaattagcgaaggtggatccaatttgtctcaaggacagcgccaattgatgtgccttgctagatctttactgaggagtccaaagatcatattgctggacgaagctacagcgtccatcgactacagttccgatgcgaagatccaagaaaccataagaaaagagttccaaggtagtacaattttgacaattgcacataggttgagatctgttatcgattatgataaaattttggtgatggatgcaggtgaggtaaaagagtatgatcacccatattctttgttacttaacaaacaaagtgccttttatagcatgtgtgagcatagtggagaattggatatcctaattgaattggctaaaaaagcctttgtggaaaaattgaactctaaaaaggactag

SEQ ID NO: 45982 - DNA, 801 bp, Saccharomyces cerevisiae
atgttgaacgtgctattgagaaggaaggccttttgtttggtgacgaagaagggtatggctactgccacaacagctgcagctacgcatacccccagattgaaaacttttaaagtttacagatggaatccagacgagccaagtgctaaacctcatttacagtcatatcaagtggatctgaatgactgtgggcccatggtacttgatgcgctgttaaagatcaaagacgaacaggattctaccctaacttttagaagatcatgtagagaaggtatctgcggttcatgtgccatgaacattggcggtagaaacacgctagcttgtatatgtaagatcgaccagaacgaatccaaacaactcaagatctatccattaccccacatgtttattgtcaaagatttggtacctgatttaactaacttctaccaacaatacaaatctatccaaccttacttacagagatcatcgtttccaaaggatggaacggaagtgctacaaagtattgaagatcgtaagaaactggatggtctttacgaatgtattctgtgtgcatgctgctctacttcatgtccatcgtactggtggaaccaagaacagtatttgggccctgccgtgctaatgcaagcctaccgttggctaattgactctagagaccaagctacaaagacaagaaaggccatgctaaacaactccatgtcattgtacagatgtcacaccatcatgaactgtactagaacttgtccaaagggcttgaatcctggtttggctattgctgaaattaagaaatctttggcatttgcctag

SEQ ID NO: 45983 - DNA, 2514 bp, Saccharomyces cerevisiae
atggttaaagtaaagtcgaaaaagaactcattaacaagttctctagataacaagatcgtcgatcttatctatcgtctcttggaagaaaaaactttggacagaaaaaggtctctgagacaagaatcccaaggagaagagggcgagaacaacgagggtgaagaagatgaggatatatttgaatccatgtttttcgctaaagatttaacagcaggtgagatttttaccttttgtttgactaaagatttatcacttcaaagagttaagaaagttgtcttacaaaagacaattgaccgcatgctaaaagacgtgattgaatcagaattggaagaatttggttcttacccaggttacaacaacgaagaggaagagaaaccaagcttggaagaagaactagctaagaaaaatatgatgattgagcgagacacaaatgagatgaacaaacgcataactagcacgtggtccaaatctggatctgtttccgagtctataacagaaactgatgatcctaagacagaagaggttaaaaaatctaaaaaaagatccaaagaaggtacatgtaaggtaaaacgtcaaaaaatcaaggaagatagatctccacctaattcgtctctgaaatccttaggtggtatggatgatgtcgttgcacaacttatggaactaataggtctacccattcttcatccagagatatttttatccacgggtgtcgaaccacctagaggtgttctgttgcatggcccaccgggttgcggtaagacgtcgattgctaatgcgttagctggagaattacaagtcccatttatatctatttctgcaccttcagtcgtaagtggtatgtctggggaaagcgagaaaaagattagggatttgtttgatgaagcgagaagcttggcaccatgtcttgttttctttgatgaaatagatgccattacaccaaaacgtgatggaggagcccaaagagaaatggagagaagaatagttgcccaattattgacctcaatggatgaattaacgatggaaaagacaaatggaaaacctgttattatcataggtgccacgaatagacctgactctttggatgcagcattgagaagagcaggtagattcgatagagaaatatgcctgaatgtcccgaatgaagtctcaaggttacatattttaaagaaaatgtctgataacctaaaaattgatggtgctatcgattttgccaaattggcaaaattaaccccaggctttgttggcgctgatttaaaggctttagttactgctgccggtacatgcgctattaaaagaattttccaaacctatgctaatataaaatccacaccaactacggcaacggacagttcagaagataacatggaaattgatgaaacagcaaacggagatgaatctagcctgaagaacactgcgaatatgatcgatccgttgcctttatccgtagtccaacaatttattcgtaattatcctgagcctttatcaggagagcagttatcattattatcgattaagtacgaagattttttgaaagcgttgccaacaattcaaccaacagcaaagagagaagggttcgctacggtacctgatgttacttgggctaatgtaggcgcattgcaaagagttagacttgaattaaatatggctattgtgcaacccatcaagagaccagagctttatgaaaaagtgggaattagcgcccctggtggtgttttattgtggggaccaccaggttgtggtaaaacgttactagcaaaagctgttgccaatgaatctcgtgcaaatttcatatcaatcaaaggtcctgaattattaaataaatacgttggtgaatcagaaaggtccatcagacaagtttttactagagcaagggcgtctgtaccgtgtgttatattttttgatgaactggacgctttggtgccaagaagagatacttctttgtccgaatcctcctcaagagtcgtcaacactttgttaacggaattagatgggctgaacgatagaaggggaatttttgtgattggcgccactaatagacctgatatgattgatcctgctatgttaagaccgggcagattggataagagtttgtttattgagttacctaatactgaggaaaaactagatattatcaaaactttgaccaaatcacacggaacacctctgagtagcgatgttgattttgaagaaattatcagaaatgagaagtgcaacaatttttcaggcgctgacttggctgctttagtcagggagagttcagtcttggctctaaaaaggaagttttttcagagcgaagaaatacaatctgttcttgataatgacttagacaaggaatttgaggatctatcggttggcgtatctggcgaagaaattattgtgaccatgtctgacttccgaagtgcattaagaaagattaaaccctctgtgagcgataaagatagactgaaatatgatagattaaataagaaaatgggtttaacggaggagatgaaggatgcggaagaaatgaaacaataa

SEQ ID NO: 45984 - DNA, 2727 bp, Saccharomyces cerevisiae
atgaacgaccaaacgcaatttacagaaagggctctaacgattttgacgttggctcaaaaattggcttcggatcatcaacatccacaattacaacctatacatattctagctgccttcattgaaacgccagaagatggatcagtcccttacctacagaatctaattgagaagggccgttacgactatgatcttttcaagaaagtggttaatagaaatctagtaagaattcctcaacagcaacctgcacctgcggagataactccaagttatgctttggggaaagtccttcaagacgctgctaagattcaaaaacaacagaaggactcatttatagcgcaagaccatatattgtttgctctattcaatgattcgtctattcagcaaatatttaaggaagctcaagtagatattgaggccatcaagcaacaagctcttgaacttcgtggtaacactagaattgactctcgtggcgctgatacgaacacacctttggaatatttatcaaagtacgccattgatatgactgagcaggctcgtcaaggtaaacttgaccctgtcatcggccgtgaagaagaaataagaagcactattagagttttagcaagaagaattaagtccaacccatgtttaattggtgagccaggtatcggtaagaccgctattattgaaggtgttgctcaaagaatcattgacgatgacgttcccactatcttacaaggcgctaaattgttcagtctagatttggccgcattaaccgcaggtgctaaatacaaaggtgatttcgaagaaagattcaaaggtgttttgaaggaaatcgaagaatcaaagactctaattgtgttattcattgatgaaattcacatgttaatgggtaatggtaaggacgacgctgctaacatcttgaagccagctttgtccagaggccaattgaaggtcatcggtgccaccaccaataacgaatatagatctattgtggaaaaggatggtgcctttgaaagaagattccagaaaattgaagtcgctgaaccaagtgtgagacaaacagtggccatattgagaggtctgcaaccaaagtatgaaatacatcatggtgtaaggattctggatagcgccttagtcactgctgctcaattagccaagcgttacttgccatatagaagattgccagattctgctttggatttagttgatatttcttgtgctggtgtcgccgtcgcaagagattctaagccagaagaattggattccaaggaacgtcaattgcaattgattcaagtagagataaaagctctagagagagatgaagatgccgactccaccactaaagatagattaaagttagctaggcagaaggaagcttcattgcaagaagaattggaacctctaagacaacgttacaatgaagaaaagcatggccatgaagaattgacacaagctaaaaagaaattggatgaactggaaaacaaggcccttgatgctgaacgtagatatgatactgctaccgccgctgatttaaggtacttcgccatcccagatatcaaaaagcaaatcgaaaagcttgaagatcaggttgctgaggaagagagacgtgctggtgccaactccatgatccaaaatgtggtcgattcagacaccatttctgaaacagctgcaagattgactggtatccctgttaagaagttgtcagaatctgaaaatgaaaaattgattcatatggaacgtgacttatcatctgaagtcgtgggccaaatggatgccattaaagctgtttccaatgccgttagattgtctagatcaggtttagctaatccaaggcaaccagcatccttcttatttttaggtttgtccggttccggtaaaactgaattggctaaaaaagttgctggatttttgtttaatgatgaggacatgatgatcagggtcgattgttctgaattaagcgagaagtatgcggtctctaagttgttgggtaccacggcaggttatgtcgggtacgatgaaggtggctttttaactaaccaactgcaatacaaaccatactccgttttgttattcgatgaagtagaaaaggcacatcctgatgttttgactgtcatgctacaaatgttggatgacggtagaattacttctggtcaaggtaagacgatcgactgttccaattgtattgtcatcatgacttccaatctaggtgctgaatttatcaattctcaacaaggatcaaagatccaagaatctaccaagaatttggtcatgggtgctgttaggcaacatttcagaccagaatttttgaacagaatttctagtatagtcattttcaacaagctatctagaaaagctattcataagatcgtggatattcgtttgaaggaaattgaagagagattcgagcaaaatgataaacattacaagttgaatttaactcaagaggccaaggacttcttggccaaatatggttattccgatgatatgggtgcacgtccactgaacaggttaattcaaaacgaaattttgaacaaactggcactaaggatcttaaagaatgaaatcaaggataaggaaactgtcaatgtcgtcttgaagaagggtaaatctcgtgatgaaaatgttcctgaggaagctgaagaatgtctggaagttctaccaaatcacgaagctactataggggctgacacgttaggtgatgacgataatgaggacagtatggaaattgatgatgacctagattaa

SEQ ID NO: 45985 - DNA, 1920 bp, Saccharomyces cerevisiae
atgtctaaagctgtcggtattgatttaggtactacctactcctgtgttgctcacttctctaatgatcgtgttgacattattgccaacgaccaaggtaacagaaccactccatctttcgttggtttcactgatactgaaagattgattggtgacgctgctaagaaccaagctgctatgaacccagctaacactgttttcgacgctaagcgtttgatcggtagaaacttcaatgacccagaagtccaaggtgatatgaagcacttcccattcaagttgatcgatgttgacggtaagccacaaattcaagttgaatttaagggtgaaaccaagaactttaccccagaacaaatctcctccatggtcttgggtaagatgaaggaaactgccgaatcttacttgggtgccaaggtcaatgacgctgtcgtcactgtcccagcttacttcaacgattctcaaagacaagctaccaaggatgctggtaccattgctggtttgaatgtcttgcgtattattaacgaacctaccgccgctgccattgcttacggtttggacaagaagggtaaggaagaacacgtcttgattttcgacttgggtggtggtactttcgatgtctctttgttgtccattgaagacggtatctttgaagttaaggccaccgctggtgacacccatttgggtggtgaagattttgacaacagattggtcaaccacttcatccaagaattcaagagaaagaacaagaaggacttgtctaccaaccaaagagctttgagaagattaagaactgcttgtgaaagagccaagagaactttgtcttcctccgctcaaacttccgttgaaattgactctttgttcgaaggtatcgatttctacacttccatcaccagagccagattcgaagaattgtgtgctgacttgttcagatctactttggacccagttgaaaaggtcttgagagatgctaaattggataaatctcaagtcgatgaaattgtcttggtcggtggttctaccagaattccaaaggtccaaaaattggtcactgactacttcaacggtaaggaaccaaacagatctatcaacccagatgaagctgttgcttacggtgctgctgttcaagctgctattttgactggtgacgaatcttccaagactcaagatctattgttgttggatgtcgctccattatccttgggtattgaaactgctggtggtgtcatgaccaagttgattccaagaaactctaccattccaactaagaaatccgaagttttctctacttatgctgacaaccaaccaggtgtcttgattcaagtctttgaaggtgaaagagccaagactaaggacaacaacttgttgggtaagttcgaattgagtggtattccaccagctccaagaggtgtcccacaaattgaagtcactttcgatgtcgactctaacggtattttgaatgtttccgccgtcgaaaagggtactggtaagtctaacaagatcactattaccaacgacaagggtagattgtccaaggaagatatcgaaaagatggttgctgaagccgaaaaattcaaggaagaagatgaaaaggaatctcaaagaattgcttccaagaaccaattggaatccattgcttactctttgaagaacaccatttctgaagctggtgacaagctagagcaagctgacaaggacgctgtcactaagaaggctgaagaaactattgcttggttagacagcaacaccactgctaccaaggaagaattcgatgaccaattgaaggaattgcaagaggttgccaacccaatcatgtctaaattgtaccaagctggtggtgctccagaaggcgcagctccaggtggtttcccaggtggtgctcctccagctccagaagctgaaggtccaactgtcgaagaagttgattaa

SEQ ID NO: 45986 - DNA, 4401 bp, Saccharomyces cerevisiae
atgggtacgtcaagcgaggtttctctcgcacatcatagagatatcttccattactacgtctcactgaagacttttttcgaggtgactggcgaaaatcgtgacaggtcaaattcgacacgagctcaaaaggccagagccaagctgttgaagctatcttcttcgcaattttacgagctgagtacagacgtgtccgatgagctgcagaggagaatcggtgaagatgctaaccaaccagattaccttttgccgaaggcaaatttccacatgaaaaggaaccaggctagacagaaactggccaatctatcacaaactcgatttaatgatttgttggacgatatcctttttgagatcaagagaagagggttcgacaaggatttggatgctccacggcccccattaccgcagccgatgaaacaagaggtcagcaaagacagcgatgatactgcaagaacatccacaaattcttcctctgtgactcaagtagctccaaacgtctccgtacaaccttctttggtcattcctaagatggcatctatcgattggtcttctgaggaagaagaagaggagcaagtaaaggagaagccaaatgaaccggagggaaaacaaacaagcatggatgaaaagaaagaggctaaacctgctctaaaccccatagttacagattctgatctgcctgactcccaagtgctcgctcgtgatatcacatcaatggcaaggactccaacaacgacgcataaaaattactgggacgttaatgattctccaattatcaaggtagataaagatatcgataacgaaaagggtcccgaacagttgaagagccctgaagtacaacgggctgagaacaataaccctaactcagagatggaagacaaggttaaagaactgactgatttaaacagcgacttacatttgcaaattgaagatttgaatgctaagttagcatctttaaccagcgagaaggaaaaggagaagaaggaagagaaggaggaaaaagaaaaggaaaagaacttaaagattaactacaccattgatgaaagttttcagaaagaattgctgtcattaaactctcaaatcggtgaattatcaattgagaatgaaaatttgaagcagaaaatttcagaattcgaactgcatcaaaaaaagaatgacaaccataatgatttgaaaatcactgacggttttattagcaagtactcttctgccgatgggctcattccagctcaatacatcttaaacgctaacaacttgataattcaatttactactaggctttccgcagtacccataggcgactccacggcaatttcccatcaaattggcgaagagttatttcaaatattatcccagttatcgaacctaatctcccagctattactatcggccgacctattacagtacaaagatcaggtcattttactgaaggcatcattatcgcatgcgatcacatcgataagatatttctctgtttacggtcccgtattaattccgaaaataactgtgcaagctgctgtttcagaggtttgttttgccatgtgtaatctaattgattcagcgaaaataaaatccgattcaaatggtgagagcaccacctctaatgaaggtaaccgacaggtattagaatattcttcaccaactgctaccaccccaatgacgccaactttcccctcgacttctggaataaatatgaagaaggggtttataaacccaagaaaaccagcatctttcttgaatgatgtggaggaagaagaatctccagtcaagccattgaaaattacacaaaaggcaattaacagtccgatcataagaccgtcatcgtctaatggagttccaacaacctcaagaaaaccttcaggaacggggctatttagtttaatgattgattcatcaattgctaagaatagctcccataaagaggataatgataaatatgtctcgcccataaaggcagtaacatcggcctccaattctgcaagtagcaatatttccgaaattcctaaactaacactacctccacaagccaaaatcggtactgttattccaccgtcagagaatcaagttcccaatattaaaatcgagaatacagaagaggataataaaaggagtgacataacaaatgaaatctctgttaaaccaacttctagcattgctgataaactgaaacaatttgagcaaagttccgaaaagaaatcatcaccaaaggaaaatcctatagcaaaagaagaaatggattcaaaaccaaaactatccaataaatttatcacttcaatgaatgatgtgtccacagatgattcaagctctgatggtaacgaaaatgacgatgcagacgatgatgatgattttacctatatggcattgaaacaaacaatgaagagagaaggttcaaaaattgaaaaaaataatgacagcaaactacctgcaaatatagtggaacttgatttacatgagtcaccggagtccgtgaagattgaatctcctgaatcgataaaggaaatcacgtcatctgaaatgtcttcagaaatgccaagtagttcgctgcctaagagattagtagaggatgttgagccttcagaaatgccagagaagggcgcatctgtagaatcagtcaggaagaaaaattttcaagaaccacttggtaatgtcgaatctccggatatgacgcagaaggtcaagtctttgggtatgacaggaaaggctgtaggcccagaatcagatagtagggtcgaatctccgggcatgacaggacagattaaatctttgaatatggcaggaaaagttgtaggcccagaagcagatagtagggtcgaatctccgggcatgaaagagcagattaagtctttgggtatgacaggaaaaattacagctcaagaatcaatcaagtccccggaagcggctaggaagttggcgtcatcaggagaagttgacaaaattgaatctccaagaatggtaagggaaagcgagtccttggaggcagtaggcaatactatcccctcaaacatgacagtgaaaatggaatccccaaatttaaagggaaatactgtgtctgaacctcaagaaataaggagagacattgcctcctcagagccgatagagaatgttgaccccccaaaagtactaaaaaagattgtctttccaaaggctgttaatagaactggatcaccaaaatcagtcgaaaagactccatcttcagctacactgaaaaagagcgggctcccagaaccgaatagccaaattgtttctcctgaattggcaaaaaattcacctctagcaccgataaagaaaaatgtcgagttacgagaaactaataaaccacatactgagactatcacttctgtggaaccaacaaacaaggatgccaatacttcttggagagacgccgacttaaaccgtacgatcaaacgagaggaggaggacgaagattttgatagagtgaaccacaatatccagatcactggtgcatatacgaaaactggaaaaattgattatcataaaatacctgttgatcgtaaagcaaaaagcgaagcagaagtgcatacttccgaggaagatattgatgaatcaaataatgttaatggaaaaagagctgatgcccaaatacacatcactgaaagaaagcatgctttcgtaaatccaactgaaaattcacaggtaaaaaagacgagccactcaccatttttaaacagtaaaccggttcaatacgagaactcagagtcgaacggcggcattaacaaccacataaagataaaaaatactggagaaactacggcacatgacgagaaacattatagtgatgatgatgattctagctatcaatttgttcccatgaaacatgaagaacaagaacaagaacaaaacagaagtgaggaagaggaaagtgaagatgacgatgaagaggaagaagacagtgattttgatgtggatacatttgacattgaaaatccggataatacactatcagagttactattgtatttagaacatcaaacaatggacgtcatatccacgattcaatcgcttttgacatcgatcaagaaaccacaggtgacgaagggtaatttgaggggagaatcgaatgcaatcaaccaagtcataggtcaaatggtggacgctactagcatatcaatggagcaaagcagaaatgccaatttgaagaaacacggtgattgggtggtgcaaagtctaagagactgttcgcgtagaatgacaattttgtgccaattaactggcgatggaatactagcgaaggaaaagagcgatcaagattatgctgacaaaaacttcaaacagcggttggcagggattgcgtttgatgttgccaaatgtacaaaggagctggtaaaaactgtagaagaggcaagtttgaaggacgaaataaattatttgaattcgaagttgaagtaa

SEQ ID NO: 45987 - DNA, 2214 bp, Saccharomyces cerevisiae
atgtcacagaatattcaaattggcactagaaaacgttcaagagcaaatatgaataattccactactacgggccctgctaacaatacaagctctaacaagacctttttggataatttcgaagaaacgcgcacaaacaagctgctggacgagatgtttgctcggcaaaattcttttctaacagacaatctgaggaacagtctagacctgaatcaagcagacaatccgctccgtcctcggcaacaccaacaccagttgttcttggacaatgaaaatgccatagaactagacgaggagccgcgtatcattaacaccacaatcaataacagtaataatcataacagtagtcgagtggacgaggatgctgacgatgacatcatttttatcaaagagcagccaattcagttttcgtcacctttgattctgcctagtagcagcagtatcaataacaacaataatattgttacttcaaataatccagggtgcggtaccgcagctacaagcaatagtacgtatatcacgacaccaaagaaattcaagaagcaaagaaccatctcactgcctcagttgcctctatcgaagctgagctaccaatcgaactattttaatgttcctgatcaaaccaacgctatcgtgccaagagtaacgcaaactgaaaatgagctgttgcatctaacggggtcgtgtgcaaagactctggagggcaacaaggcagtgaatctcacgattgctcacagcacttctcccttttccaacccaccagcacaaatagcttccctgcctcaatccaacctcaagaaacaaattggttcttcactacggaaatttacatcaaacggctcttcagaaagcgcatcatccaataaatcaaatttcaaaacggacaaagacggtcactacgtttaccaggaaaacgacatatttggcagtggcggccgctttgttgtgaaggacctattgggccaaggcacgtttggtaaagtacttaaatgcatcgataacaagtatgaacctaattacgtggctgtaaaagtgataagggctgtagatagatatagagaagccgccaaaacagaactaagaattctacagactatcctgaataatgaccctcaaggtcagttccagtgcctcttgctaagggagtgcttcgattacaaaaatcacatttgtttggtgacagatctatacggcaggtccatttacgattttatgtgctccaacggcattgccaggttccccggctctcatattcaggccattgccagacagctaatcagatctgtctgcttcttgcacgatttgggcataatacacacggatttgaaaccagaaaatatcctgatttgtgacgaaacccatattgctcaaaaattgcctttgaaaaccgtacagtcgctaagcaagagacgccgtgaagccagtaaggggaagcgcaaaatcttgaaaaatccagaaatcaaaatcattgatttcggtagcgcaattttccattacgaatatcatcctcctgtaatatccactcgtcactatagagccccggaaattgtccttggcttgggctggtcgttcccctgcgacatttggtccatcgcgtgtgtcctagtagaactggttattggcgaatctctttaccccattcatgaaaatctagaacatatggctatgatgcaacgaatcaatggaacccctttccccacagacattattgataagatgttttacaaatctaaacataaattgggcaactctccatcagacctaaattcaacggtgataaagcatttcgacagaaaaactttaagcttacaatggcctgaaaaaaataaacgcggagataccataaccaccgaaaagtcaatgaaaagggtcttgcagtcatgtgatcgcttagatatttacatctcaaaggtcttgaaacaggattacggcgatagcttaagcatcaattggaatctaccgccggagaaaaactggtctttgataaattcgaaattggcatggaaaagacaaacacattcctcttcttcctcaactactgatgaactcgataaggaaactttcttgttttggtactggttcatcgatctactcaggaaaatgtttgagttcgacccaacaaaaaggattaccgcaaaggacgctctggaccatgaatggtttaatctgggcatactggatgatggtattgcaacttataataatacccaaggatag

SEQ ID NO: 45988 - DNA, 3147 bp, Saccharomyces cerevisiae
atgcctataacgtcaagccccgatctgttctatctcaatgattgtgatgtcgtctattggtatgacctcactcgcttagtgtgtcattatgttaatttaacagagcgcgacctattggcaaatgaacgggaaaagtttctaacttccttggatttattaacagctcaaataacctatgtttatatgcttttcaggaatctccgtttagttgaagatagtttcaaaaaaaccctcaaaaaactaatttacaccttgtctaggttttcaataaatgcaaatatttggtttcattccacattgtttgaagaaagagaagccatagcctcccagaaggatccagaaagaagatcccctcttctacagtcaatcctaggaaccttccaaaaatttcattttctactgcgtttactacatttcctctcaaatcctaacgaacttacaatactgcctcaattgactcctcgatttttcaaggattctttcaatacaatttcatggaataacccgtttttgcgtaagcgtctcaaccagcatatgtcccatgacctaccgagacagatgattaaagccgttgctggtgcttcaggaattgttgcggaaaatattgatgaaattccagcttccaaacagggcacttcatgctcgtcagaaacgtctcaccattcaccatcagccccgtttcaaagaaggagaagaggtaccattttctctaatgtgtcaggaagttccgatgagtctgacaccatatggtccaaaaggaaaaaaccatacccgctaaatgaagaaactctaagccttgtaagggccaggaagaagcagcttgatggtaaactaaaacaaatgatcaaaagtgctaatgaatatctcagtaacacggctaatttttcaaaaatgttgaattttgaaatgaatttcaaaacctacgaagaagtaagcggaacaattcctataattgatattctggaaaacctagatttaactatttttctaaacttgagagagttgggagatgagaatagagtttttgacgaagatgtcgctattgatgatgaagatgaagagtttttgaaacattctttatcatccctatcgtatatcttatccgactattttaatatgaagcaatattttcatgatgtagtagtgaaatttataattgtcgcccagcatttgacattagaggatcctttcgttttctcgccaatgcaaaacgacttgcctaccggttattatgaaccaatgaaaccttcatccttgaatttagataatgccaaggataagaagaatgggagccaaaatactgatatccaagaggaggaagatgaatatgagccagacccggatagtcttattctcttccacaacctcatcaatcaagattctgatttcaatgatttaaagttttttaatctcgcccacgtttttaaaaaatcctgtgatgactattttgatgtgcttaaactagccattgagttcgtgaatcaattaattctagaaagagagaatttgttaaattatgctgctagaatgatgaaaaacaatatcacggaattgctattgcgcggggaagaaggctatgggtcctatgacggcggtgaaactgccgaaaaaagtgacacgaatgctgtttatgcagattcagatactaaagacaatgacgaatggcgtgacagccaagtcaaattaccgaggtatttgcagcgcgagtatgacagtgaactgatttggggctctaacaataggattaaaggtggttctaaacacgcactgatctcttacttgacagataatgaaaagaaggatctatttttcgatattacttttttaatcactttcagaagcatctttactacaacggagtttttaagctacttgatttcgcaatataatttggatccaccagaggatttgtgctttgaagaatacaatgaatgggtgacgaaaaagcttataccggttaaatgtagggtggttgagattatgacaacctttttcaagcaatattggttcctgggctatgatgagcccgatcttgcgaccctaaatctggattattttgcgcaagtagcaatcaaggaaaatataacaggatctgtggaattactaaaggaggtcaatcagaagtttaaacatggtaatatacaagaagcgactgcaccaatgaaaacgttagatcaacagatctgccaggaccattactcgggcactttatactctaccacggaatccattttggccgtcgatccagttttatttgccactcaattaacgatactagagcatgaaatttattgtgagataaccatttttgattgtttacaaaaaatttggaagaacaagtatacaaaatcgtatggggcttcaccgggtttgaacgagtttatcagttttgccaataaactgacaaatttcatatcctactctgttgtaaaggaggctgataaaagtaagcgcgccaagctactctctcattttatttttatcgcagaatattgtaggaaattcaataacttttcttccatgactgcaatcatttcagcattatattcttcaccaatttatcgtttagagaaaacctggcaggcagttattcctcaaacgagagatctattgcagtcactgaacaagttgatggatcccaagaaaaatttcataaattacagaaacgagctgaaatctttacatagcgctccctgcgtaccgtttttcggcgtttatttatctgatctaacctttactgattccggaaatccggattatcttgtcttggaacatggtttaaagggtgtccatgatgagaagaaatatataaacttcaacaaaaggagcagacttgttgatatcttacaagagatcatatatttcaagaaaacacattatgatttcactaaagatcggacggtaattgaatgtatatcaaattcattggaaaacatcccccatattgagaaacaataccaattatcattaattattgaaccaaaaccaagaaagaaagtcgttccgaattccaattcgaataataaatcacaagaaaaatccagggatgaccaaaccgatgaaggaaaaacatccactaagaaagacagatttccaaaatttcaattacataagacaaagaaaaaagctcccaaggtttctaagtaa

SEQ ID NO: 45989 - DNA, 2259 bp, Saccharomyces cerevisiae
atggtggtaggaactaaaaaatactctaatttggactttgtccctacaatcagtgacagtgaagacgatgttccaattctagattcttctgatgacgaaaaagtcgaggctaagaagactacgaagaagcggaagggtaagaataacaagaaaaaggttagtgagggggataacctcgatgaggatgttcatgaggacttggacgcggggtttaagtttgatttggacgccgatgataccacttcgaacttccaaggctggaactttctagcagagggcgagtccaataaggacgatgccgaagcttttgtgaagaaggacgttgacttggataagattattagaagaaaaggtgggctggtgaaaatggcccatattgatagtaaacaagaagaagaaaccgagaaagaaaaagtagaaaaagaaaacgatagcgacgatgaggaattagcaatggacgggttcggtatgggagctcccatgaacaatggagacgaaaatcagtcagaagaagaagaagaagaggaggaaaaggaagaggaagaggaggaagaggaggaacaagaagagatgacgttagaaaaaggcggcaaagatgacgaaatagatgaagaagacgattctgaagaggcaaaagccgatttctatgcgcctgaaactgagggagatgaagctaaaaagcaaatgtacgaaaatttcaacagtttgtctttatctcgtccggttcttaagggccttgcaagtttgggttacgtcaagccttcccctattcaaagcgccacaatccccattgccttattgggtaaagacatcattgccggtgctgtgactggttccggtaagactgctgcgtttatgattcccataatcgagcgtttgttgtataaaccagccaaaatcgcttccaccagagttattgttctattgcccactcgtgagttagctatccaagtcgctgacgttggtaaacaaattgcacgtttcgtctccggtataacctttggtctggccgttggtggtttgaacttgagacaacaagaacaaatgttgaaatctcgtccggacatcgtcattgctaccccaggtagattcattgatcatatcaggaactcagcaagttttaatgtggactcagtagagattctggttatggatgaagccgatagaatgttagaagaaggttttcaagatgaactgaacgaaattatgggcctattaccaagcaatagacagaacctattgttttctgctacaatgaactccaaaattaaaagtttagttagtctttctctaaaaaaaccagtaaggattatgattgatcctccaaagaaagctgctactaagttgacacaagaattcgttcgtattcgtaaaagagaccatttgaagcctgccttgttatttaatttgattaggaaattggatccaacgggtcaaaagaggattgtcgtttttgtggctagaaaagaaactgctcataggttaaggattatcatgggtcttttaggtatgagtgtgggtgaattacacggttctttaacccaagaacagcgtttagattccgttaataaattcaaaaatttggaagttcctgtacttatctgtacggatttggcctccagaggtcttgatatccccaagattgaggttgttatcaactacgatatgcccaagagttatgagatctacctgcatagagttggtcgtaccgccagagctggtagggaaggtcgttccgtcaccttcgtcggtgaatcatctcaagatagaagtattgtacgtgctgctataaagagtgtagaagaaaataagtccctaactcaaggtaaagcacttggtagaaacgtagactgggttcaaatcgaagaaacaaacaaacttgttgaatccatgaacgatacgattgaagatattctggtggaagaaaaggaggagaaggaaatattaagggctgaaatgcaattaagaaagggtgaaaatatgttgaagcataaaaaggaaatccaggcaagaccaagaaggacatggttccaaagcgaatcagataagaaaaattccaaagtattaggtgctttatcaaggaacaagaaagtcactaacagcaaaaagagaaagcgtgaagaagctaaggcagatggcaatggtgcacgttcttatagaaaaaccaaaaccgaccgtattgcagatcaagaaagaacttttaaaaagcagaagagtacaaattcaaataagaagaagggcttcaaaagccgtaggtaa

SEQ ID NO: 45990 - DNA, 2274 bp, Saccharomyces cerevisiae
atggctagtttagaagatcttattcctactgtcaacaagctgcaggatgttatgtacgactccgggatcgatacactcgatttgcccattttagctgttgttgggtcacaatcctccgggaaatcctcgatattggaaacgttagttggaagagattttttacctaggggtactggtattgtcacaagaagaccgttagttcttcaacttaataacatatctccaaattctcctctaatagaggaagatgataactcagttaatccacatgatgaagttacaaaaatatcaggattcgaagctggtacgaagcccttggagtataggggcaaggaaagaaatcatgcagatgagtggggggaattcctgcatataccaggaaaacggttttatgatttcgacgatatcaaaagagaaatcgaaaacgaaacagcgaggatagccggtaaggataagggcatcagtaagattccgattaatttgaaagtgttttcccctcatgttttgaatctaacgctagtagatttgcctgggattacaaaggttcctattggggaacaaccacctgatattgaaaagcaaatcaagaatttgatcctagactatatagccactccaaattgtttaatcttggccgtctctccagctaacgttgatcttgttaattctgaatccttaaagttggccagagaggtagaccctcagggcaaaaggactattggtgtcattaccaaattagatttgatggattctgggactaatgctctagatatcttgtctggaaaaatgtatcctctgaaattggggtttgttggtgtagtgaatcgctcgcaacaggatattcaattgaacaaaaccgttgaagaatcattggacaaagaagaggactatttcaggaaacatccagtctacagaactatttcaacaaagtgtggtacgcgttatttagctaaattgctaaaccagacattattaagccacattagagacaagcttccggatattaaaaccaagttaaataccctgatctctcaaaccgaacaagagctcgctagatacggtggcgtaggagctactactaatgaaagcagagctagccttgttcttcaactaatgaataagttttctacaaacttcatttcatctatagatggtacatcctccgacattaatacgaaggaactctgtggtggtgcccgtatttattacatttacaataatgtttttgggaattctttgaagtcgattgatccaacttctaatttatccgttcttgatgttagaacagcgattagaaattctactggtccccgtcctacattatttgtacctgagttggcttttgacctattggttaaacctcaaattaaacttttactagaaccatctcaacgttgcgtcgagttagtttacgaggagctgatgaaaatatgccataaatgtggctccgctgagctagctagatatcctaaattgaagagtatgttaatagaagttataagcgaactacttagagaaaggttacaacctactcgctcttacgttgaaagcttgattgacatacatcgagcctacatcaatactaatcatcctaattttttaagtgcaacagaagcaatggatgacatcatgaaaacgcgtagaaaacggaatcaagagttattgaaaagtaagttgtctcaacaggagaatggacaaaccaacggtattaatggtacttcatctatctcttcgaatatagatcaagattctgctaaaaacagtgactacgatgatgatggtatcgacgcagaatcgaagcaaacgaaggacaaatttttaaattatttctttggcaaggataaaaagggtcaacctgtgttcgatgcatcagacaagaaaagatccattgccggtgatggaaatattgaagattttagaaatttacaaatatcagatttttcactgggcgatatagatgaccttgaaaacgctgaacctccactgaccgagagagaagaattggagtgcgaattaattaaacgtctgattgtttcatactttgatattataagagaaatgattgaagatcaagtaccaaaggcagttatgtgtttactcgtcaattattgtaaggattctgttcaaaacagattggtaaccaaactctacaaagaaacactgtttgaagaacttttagttgaggatcaaactttagctcaagatagagaactatgtgtgaaatcactcggagtttataaaaaggctgcaacccttattagtaatattctgtaa

SEQ ID NO: 45991 - DNA, 1572 bp, Saccharomyces cerevisiae
atgaaaaacatgtcacaacgatccatggacgtggagaagaaggcagctaacgctgatagttgttccgtaagtacctcgagcattaatgtagacgatgcggacgttgctttaagattcctgaaacagaacggtctcgacgaaagctccacggctaatgaagacgatgttgtagcaggcgaagaagccaacttctatggttcccatgaattatctcctaaggtcctgagaaaagttgacctcttcatcctgccctttttatgctgtacatatcttctgatgtttttggataaggctctgctgaactacgctgcatctatgggtatcaaagatcatttgaaaggtaacgaattttctaatttgggtactatcttttctgctgcttacattttcatggaacctgtggtcacttacttaattcaaaaattccccatttccaaaatcctaggtacttttattaccgtctggggtatcgtgttggcttgccatgctgcttgtaagacgtacgcctcgttgatggtcgttcgtactctcctaggtctctttgaatcctcgagtgcagttggttgtatcgctattagtggtatgtactatactaaatctgaacagagtgcaagaattggattctgggccacacaggctggtacaggttatattgtgggcgggttaatttcttttggctttttacattatcatggtaccgctttcacctcttggcaaataatgtttttggtcgttggtctggttacagttgcgtttggtgttctaacattcttataccttccagataacgtcaccaatgcttggttcctaaacaaagaggaaaaaattcaagttgttgagcatatcagagctaaccaaactggcctggaaacaaagaagtttaagaagcagcaagttaaagaactattccttcatgataagtttacttggccgatgcttttattaactgcatgttctcaaatttctactggtgccattggtacattttcagtgaccatcactggtacttttggtttcgacaagtacgaaacagcattactgcagttgcctattggtgccattacggctatgattattcttataacaactcaaatgttgtcccgctggggtcatatcacactcataaccacatctatgtatattccagctattataggttgtatcgttcttatcagtttacccttatcccataagatcggtaacttattttctctgtacttgctttacagtggttcctgtgtcattaccaatatttacatctggaattcatgcaacacctccggttacaccaaaagagtttttagaaatgctattacaatgattgtatacaatgtctcctgtattattgctccacagatgtttagggcatactctgctccacgttacataccagcaaagattgccttattggtcactcagtgtgtttgtgttcccctacaattatacattggctacatttgcaagaaggagaacgaaaagcgtgataaggaacaagaaggtcaagaaaggaagaagtaccaatttttggacttgactgatatcgaaaacagaaatttcaggtacatttactaa

SEQ ID NO: 45992 - DNA, 1386 bp, Saccharomyces cerevisiae
atggctcctgtagttatttcagaatctgaagaggatgaggatagagttgccattactagaagaactaagagacaagttcattttgatggcgagggagatgatcgtgtagaccaacagcaacagcagcacagttcaagccacagggatagggataaacatgtgcagcgtaagaagaagaaaaggctctcgaatagaaacctgcaaggttcaaatggtgggtacgcttgggaggatgagatcaagagaagttgggatttggtgaaagtggacgatgaaggggatatggcatctcttgtggctagcatagtcgaggccagaaagaaacgtactgctaagaaaaacataacgccataccaaagaggtattatcagaagtttaatattaacactagattgtagtgaagctatgttggaaaaggatttgagaccaaacaggcatgccatgattatccagtacgccatagattttgtccatgaatttttcgaccaaaatccgatatctcaaatgggtattatcataatgagaaacggtttggcacaactggtcagccaagttagcggaaacccgcaggatcacattgatgcgttgaaatccatcaggaaacaagaaccgaaaggaaacccttcattgcaaaatgcattggaaatggcaagaggccttttattgcctgttcctgcgcattgtacaagggaagtactgattgtatttggtagtctttccacaactgatcctggagatattcaccaaactatcgattcgttagtttctgagaaaattagagtgaaggttttggggttatcagctcaagtggccatatgtaaagaattatgcaaggcaacgaattatggtgatgaatccttctataaaattttactcgatgaaactcacttaaaggagctatttaacgaggctgttacccctttacccgttaacaaaattaataagggtttcacactcgtaaagatggggtttccgacaaggatattcgaagatactccaactttttgttcgtgccattccaagttagtttacggcggatacttctgtcccaattgtcatagtaaagtttgttcattgcccacagtctgtccatgttgtgacttgatgctaatcctttctacccacctggccagatcatatcaccatctgatgccgttaaaaacatttgcagaagtacctacaacagaaaaatttcgatcagaagactgctttagttgccagtcaagatttcccatactgaaaaaccataaaaatggtaaactactgacaagttctcgctatcgttgtgaagattgtaaacaagaattttgtgttgactgcgatgtgttcatccatgaaatccttcataactgcccaggctgtgaatccaagcccgtaataacttaa

SEQ ID NO: 45993 - DNA, 2139 bp, Saccharomyces cerevisiae
atgctcaattctgcgttactgtggaaggtttggctacgaatagacaactccactgatgaagtaaaccaaccaattgctgtacagttcgatgaaatagatactgttgatgatttgaagagcaggttttttcagaaactgagttcgactcgatggcgagaaattaacgataatgcttccattgcaataggcctctacgcacctaaatttgacaatcaagccgacaataccagtagtaacaacactaacgataatagttgtcgaagtaagagtaacggtgctggaagtggcgccaacctttccgttaatagcaataccaagagttcagtgagccccacagcaggatcatttggtctttcaaaagaccttgcaaaggacaggaatgttctccagcatcctaaacctacgcagaaaagaggagcattatacgacgcctttgccgccgtgccgacagtggccgcgactaccaatgtggattttcctcccaacgaggcgccaatgctaagcccgcaaagaccatactctactagtcctaaacagtttccagcaacaactaaaagtccgttactgcgatttgcctcagtctcaccctaccctaaatttcattctgataatcaaattatggcatcagctggtcttacatacgtctcaccgcataataaaaataaatacacaaggccgttgattagaaaaggtttaaattttaccacagaatcagttaatgattgcacttataaaatcatctttgaaccggatgaattggctattaacatatataaggaactattcggaaccatgggttcccaacctgcatcgcagcctttgctgatattttcgaatgttaatttacgccaggatgtaccgcctttagatatcttaaatgttgtagactatgttcctacgaatgaagaaatttcgcagcagaaaactcaaccaacagaccatggggccgttggtgtttttcatctagacgaccatatttctccgggcgaacaaggtcttaagcaaacaattggtgataaagcagatcttaaaggtaaagatggcaatagcagccctcaggaatttaaattaataactgatgaagagcaattgagaagagcgtcacaagaactgaaggatgaggaaaaggatgccgagtctccttggcaagcaatcttgctgttaccaaaaggttataaaggaggggtagattttcgaaataaaccagtggcccacacggattcatctttcaataatgaagacacaattactcattcagagttagaagtgaacaccggatccccttcgcaagaaagcggatcacttaatgaagctggtataggcataacgcaacccatgtcggaagtacaaagaagaaaagaagacgttacgcccgcatcaccaatattaacaagtagtcaaacgccgcattactcaaactcgctttataacgcaccttttgctgtttcctctccaccagatcctttaccaaacctttttaccaccacaagtgaaaaagttttccccaaaattaatgttttaatagttgaagacaacgtcatcaaccaagctatcttaggttcctttctgaggaaacacaaaatctcatataaactggctaaaaatggtcaagaagctgttaatatttggaaggaaggcggtcttcatttaatatttatggatttacagctgcctgtcttgtctggtatagaagctgccaagcagattagggacttcgaaaaacaaaatggcattggcattcaaaaaagtctcaataactcacactccaatcttgaaaaaggtacttcaaagagattctctcaggcgcccgtgattattgtagcattgaccgcatctaactctcagatggataaaagaaaagcacttctttctggttgtaacgactacctgactaaaccagtgaatttacactggcttagtaagaaaattacagagtggggatgtatgcaagccttgattgattttgacagctggaagcagggagaaagccggatgaccgacagtgttttggttaaatctccacagaaacctattgcaccttccaaccctcactcattcaaacaagcgacatctatgacccctacacacagcccagtaagaaaaaattcaaacctctcgcccactcaaatagaattgtga

SEQ ID NO: 45994 - DNA, 1299 bp, Saccharomyces cerevisiae
atgaacaaaagaacacaggaatacaagaacacaagagcgataatgtctgccactctgttcaataacatcgaattgctgccccctgatgccctttttggtattaagcaaaggtacgggcaagatcaacgtgctaccaaggtcgacttgggtatcggggcctacagagacgacaacggtaaaccatgggtcttgccaagtgttaaagccgccgaaaagctaattcataacgacagctcctacaaccatgaatacctcggtattaccggtctgccaagtttgacatctaacgccgccaagatcatcttcggtacgcaatccgatgcctttcaggaagacagagtaatctcagtacaatcactgtctggtacgggtgctcttcatatatctgcgaagtttttttcaaaattcttcccagataaactggtctatttgtctaagcctacttgggccaaccacatggccatttttgagaatcaaggcttgaaaacggcgacttacccttactgggccaacgaaactaagtctttggacctaaacggctttctaaatgctattcaaaaagctccagagggctccattttcgttctgcactcttgcgcccataacccaactggtctggaccctactagtgaacaatgggttcaaatcgttgatgctatcgcctcaaagaaccacatcgccttatttgacaccgcctaccaagggtttgccactggagatttggacaaggatgcctatgctgtgcgtctaggtgtggagaagctttcaacggtctctcccgtctttgtctgtcagtcctttgccaagaacgccggtatgtacggtgagcgtgtaggttgtttccatctagcacttacaaaacaagctcaaaacaaaactataaagcctgctgttacatctcaattggccaaaatcattcgtagtgaagtgtccaacccacccgcctacggcgctaagattgtcgctaaactgttggaaacgccagaattaacggaacagtggcacaaggatatggttaccatgtcctccagaattacgaaaatgaggcacgcattaagagaccatttagtcaagttgggcactcctggcaactgggatcatatagtaaatcaatgcgggatgttctcctttacaggattgactcctcaaatggttaaacgacttgaagaaacccacgcagtttacttggttgcctcaggtagagcttctattgctggattgaatcaaggaaacgtggaatacgtggctaaagccattgatgaagtggtgcgcttctatactattgaagctaaattgtaa

SEQ ID NO: 45995 - DNA, 3510 bp, Saccharomyces cerevisiae
atgagtcatattgaacaggaagaaaggaagaggttttttaacgatgaccttgacacttcagaaacatcgttaaacttcaaatctgagaataaagagtcgtttttatttgcaaatagtcataatgatgatgatgatgatgttgttgtatcagtgagtgatacaacagaaggagagggagaccgatctattgtgccagtcaggcgagaaatagaagaagaaggccagaatcagtttattacagagcttttaaggattattccagaaatgccaaaggatcttgtgatggaacttaatgaaaaattcggcagtcaggaggaagggctctctttagcattatcacattactttgatcacaatagcgggacgtctatcagcaaaataccgtcttccccgaatcaactaaatacactctcagatacctcaaattcaaccttgtccccatcttcattccatcctaaaagaagaagaatatacgggttcagaaaccaaacacgattagaagataaagttacttggaaaagatttataggtgctttgcaagtcactggtatggctaccagacccaccgtcaggcccttgaagtacggctctcagatgaagctaaagagatcaagtgaagagatttctgctactaaagtatatgactcacgtggtagaaagaaagcgtccatggctagtttggtaagaatttttgatatccaatatgatagagaaattggcagagtttcggaagacattgctcaaatactataccctcttttaagttcacacgaaataagttttgaagttacattgattttttgtgataataaacggttgagtataggtgatagctttattctacaattggattgctttttaacatctctcatttttgaggaacgtaatgatggagaatccttgatgaaaagaagacgtacagagggaggaaataaaagagagaaagacaatggaaattttggaagaacattgactgaaactgatgaagagctagaaagccgctcgaaaagactggctctactaaagttatttgataaattgaggctaaagcctattttggacgagcagaaggcattagaaaagcataaaatagagcttaatagtgaccccgaaatcattgatttagataacgacgagatttgctctaatcaagtgactgaagtccataacaatctccgagatactcagcacgaagaagaaacaatgaacttgaatcaattgaaaacattttataaggccgcacaatcatcagaatctttaaaaagtttgcctgaaacagaaccttctcgcgatgtcttcaagctagaactaagaaattatcaaaagcaaggtcttacttggatgctaaggagggagcaagagtttgccaaagcagcctctgatggtgaggcttcagaaacgggtgctaatatgataaacccattatggaagcagttcaaatggccaaatgatatgtcgtgggcagctcaaaatttgcagcaggaccatgtaaacgttgaagatggcatattcttttatgcgaacttacattctggtgaattttcgctagcaaaacctatattaaaaactatgataaagggtggcatattatcagatgaaatggggttgggtaaaacagtggcagcgtattctttagttttatcttgtcctcacgatagtgatgttgttgacaagaaactgtttgatattgagaacacagcagtctcagataatcttccaagcacttggcaagataataagaaaccatatgcttcaaaaacaacgctaatcgtggtcccaatgtctttgttaacgcagtggagtaacgagtttacaaaagctaataattcccccgatatgtatcatgaggtgtattatggtgggaatgtttccagtttgaaaaccctattaaccaagacaaaaacccctccaactgtagtccttactacatatggtattgttcaaaatgaatggactaaacattccaagggaaggatgacagatgaggacgtcaatatatcttcaggcttattttctgtcaatttttatcgcataataatcgacgagggtcataacattagaaacagaacgacagttacatctaaagcagtcatggctttacaaggcaaatgtaaatgggttttaacaggaacaccaattattaacaggcttgacgatttatacagtctggttaagtttttagagttagatccctggcggcaaattaattactggaagacctttgtatcaacgccttttgagagtaaaaattacaaacaagcatttgatgtggtgaatgcaattctggaacccgtattgttaagaaggacaaaacaaatgaaagataaagatggtaagccattagtagagttgccaccaaaggaggtcgttattaaaagacttcccttcagtaaatctcaagatcttctatacaagtttctgttggataaggctgaagtttctgttaaatcgggtattgcacgcggtgatttattgaaaaagtactccactatccttgtccatattttaagattgaggcaagtctgttgccatcccggtcttattgggagtcaagatgagaacgatgaggatttatctaaaaataataaattggttacggaacaaacggtggagcttgactctttaatgcgtgttgtttccgagagattcgataactcattttctaaggaggaattagatgcaatgatacaaagattaaaagttaaatatccagacaataaatcgtttcagtccttagagtgctccatctgcacaacggaacctatggatttggacaaggctttatttacagaatgcggccacagtttttgtgagaaatgtttatttgaatatattgagtttcagaacagtaagaatttgggtttaaagtgccccaattgccgtaaccaaatagacgcttgtcggttgttggcattggtacaaacgaatagcaactcgaaaaatttggaattcaaaccatattcaccagcctccaaatcaagcaaaatcactgctttattgaaggagcttcaattgctacaggatagttcggcaggcgaacaagttgtcattttttcccaattttctacatacttggatatcctggagaaagagctaactcatactttctcaaaagatgttgcaaaaatttataaattcgatggacgtctctcattaaaagaaagaactagtgtattagcagattttgccgttaaagactatagcaggcaaaaaatcctattactctcgctgaaggctggtggcgtgggtttgaatctaacgtgtgcttcccacgcttatatgatggacccatggtggtcgcccagtatggaagatcaggcaatcgatagactgcatagaattggccagacaaacagcgtcaaagttatgagatttatcatacaagatagcatagaagaaaaaatgctacgcattcaagaaaagaagagaaccatcggtgaggccatggacacagacgaagacgagagaagaaaaaggagaattgaagaaatccagatgctgtttgaatag

SEQ ID NO: 45996 - DNA, 1692 bp, Saccharomyces cerevisiae
atgtctgaaattactttgggtaaatatttgttcgaaagattaaagcaagtcaacgttaacaccgttttcggtttgccaggtgacttcaacttgtccttgttggacaagatctacgaagttgaaggtatgagatgggctggtaacgccaacgaattgaacgctgcttacgccgctgatggttacgctcgtatcaagggtatgtcttgtatcatcaccaccttcggtgtcggtgaattgtctgctttgaacggtattgccggttcttacgctgaacacgtcggtgttttgcacgttgttggtgtcccatccatctctgctcaagctaagcaattgttgttgcaccacaccttgggtaacggtgacttcactgttttccacagaatgtctgccaacatttctgaaaccactgctatgatcactgacattgctaccgccccagctgaaattgacagatgtatcagaaccacttacgtcacccaaagaccagtctacttaggtttgccagctaacttggtcgacttgaacgtcccagctaagttgttgcaaactccaattgacatgtctttgaagccaaacgatgctgaatccgaaaaggaagtcattgacaccatcttggctttggtcaaggatgctaagaacccagttatcttggctgatgcttgttgttccagacacgacgtcaaggctgaaactaagaagttgattgacttgactcaattcccagctttcgtcaccccaatgggtaagggttccattgacgaacaacacccaagatacggtggtgtttacgtcggtaccttgtccaagccagaagttaaggaagccgttgaatctgctgacttgattttgtctgtcggtgctttgttgtctgatttcaacaccggttctttctcttactcttacaagaccaagaacattgtcgaattccactccgaccacatgaagatcagaaacgccactttcccaggtgtccaaatgaaattcgttttgcaaaagttgttgaccactattgctgacgccgctaagggttacaagccagttgctgtcccagctagaactccagctaacgctgctgtcccagcttctaccccattgaagcaagaatggatgtggaaccaattgggtaacttcttgcaagaaggtgatgttgtcattgctgaaaccggtacctccgctttcggtatcaaccaaaccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaataa

SEQ ID NO: 45997 - DNA, 1098 bp, Saccharomyces cerevisiae
atggatttggtcttagaagtcgctgaccattatgtcttagacgacttgtacgctaaagttctgcccgcttcgttggcagctaatattcctgtcaagtggcagaaattgctagggttgaacagtgggttcagcaattctacgattttgcaggagactttgaactccaagaatgccgtcaaagaatgtagaaggttctacgggcaggtgccattcctgtttgatatgtcgacgacgtcttttgcatcgctattgcctcgttccagcatcttgagagaattcctctcactatgggttattgttacgatctttggtttactactttacttattcacggctagtctcagctacgtgtttgtgtttgacaagtcgattttcaaccatcctcgttacttgaaaaaccaaatggcaatggaaatcaagttggcagtcagtgctatcccatggatgtcgatgttgaccgttccatggtttgttatggaattgaacggccattctaaactatacatgaagattgattatgaaaaccacggtgtaaggaagctcattatcgagtacttcactttcatctttttcactgattgcggtgtgtatttagcgcacagatggttgcattggccaagggtctaccgtgctctgcacaagcctcatcacaagtggctggtctgcacacctttcgcatctcattctttccatcctgtagacgggtttttgcaatccatctcgtaccacatctacccattgattctgccattacacaaggtttcttatttgattctgttcacttttgttaacttttggactgttatgattcatgacggtcaatacctatcaaacaatcctgccgtcaacggtactgcctgccacacggttcaccatctatatttcaactacaactacggtcaattcaccactctgtgggacagactagggggttcttaccgtagaccagatgactcattgtttgatcctaagttaagagatgctaaggagacctgggacgctcaagttaaggaagttgaacatttcatcaaggaggtcgaaggtgatgataatgatagaatctatgaaaacgacccaaataccaagaagaacaactga

SEQ ID NO: 45998 - DNA, 1071 bp, Saccharomyces cerevisiae
atgactgacttaactacacaagaagctattgttctagagcgacctggtaaaatcaccctaactaatgtcagcatcccaaagatttcagatcctaacgaagtaatcatccagatcaaggcgacaggaatatgcgggtcagatatccattactatacccatggaagaatagccaattacgtggtagaatcaccaatggtgctgggacatgaatcatcaggaatagtggccctcataggtgagaacgtcaagacacttaaagtaggagatagggtggcacttgagcccggaatacctgacaggttttcaccggagatgaaagagggcagatacaacctggaccccaatttaaaatttgctgcgacacctccctttgatgggaccttgacaaagtattataagaccatgaaagatttcgtctataaacttcctgatgatgtgtcattcgaggaaggagcactaatagagccattatcagtggcaatccatgctaataaattagcaaagatcaagtttggagcccgttgcgtcgtctttggagctgggcccataggtttgctagccgggaaagtagccagtgtctttggtgctgcagatgttgtttttgtagatctattagaaaacaagctggaaacggctaggcagtttggtgccacccacatcgtcaactcaggtgatctcccacatggcgttactgtagatagtgttataaaaaaagcaatcggcaagaaaggtgctgacgttgtgtttgaatgttctggtgcagagccttgcgttcgagcaggcatcgaagtctgtaaggcaggtggaacgatcgttcaagttggaatgggacaagaggaaatacaatttcccatctcgatcattccaacaaaagaactgacattccaaggctgtttccgatactgtcaaggtgattatagtgactccatcgagctagtctctagcagaaaactctcgcttaaaccattcattacacatcgctatagctttaaggatgctgtcgaggcattcgaagaaacaagccaccacccgttaaataatatcaagacgatcattgagggcccggaatga

SEQ ID NO: 45999 - DNA, 855 bp, Saccharomyces cerevisiae
atgactccttccaccccaccaaggtccagagggactaggtaccttgcgcagcctagtggcaatactagttctagtgccctaatgcaaggtcaaaagaccccccaaaagccttcacagaacctagtccctgtcactccctcaacaactaagtcttttaaaaatgcgccattattagcacctcccaattcgaacatgggtatgacctctccatttaatgggcttacgtctcctcaacgctcgccgtttccaaaatcttcagtgaagaggacactattccaatttgaaagtcatgataatggaacagtaagggaagagcaggaaccattgggtcgtgtaaataggatattgtttcccacgcagcaaaatgtggatatagatgcagcagaagaagaagaagaaggagaagttcttcttccccccagcagacctacatctgccaggcagttacatttatcacttgaaagagatgagtttgatcagacacatagaaagaagattattaaagatgtacctggtacgcccagcgacaaggtgataacatttgaattggcaaaaaattggaacaacaactctccgaaaaatgacgccaggagtcaagaaagtgaagacgaggaagacatcatcatcaatccagtgcgggtgggtaaaaatccctttgcatcagatgaactggtcactcaggaaattagaaatgaacgtaaaagggcaatgttgagagaaaacccagatatagaagacgtaataacatatgtcaataagaagggagaggtggtagagaaacgaaggttaacggatgaagaaaagagaagattcaagccaaaggcattgtttcaatctagggatcaagagcattga

SEQ ID NO: 46000 - DNA, 1725 bp, Saccharomyces cerevisiae
atggcagttgaggagaacaatatgcctgttgtttcacagcaaccccaagctggtgaagacgtgatctcttcactcagtaaagattcccatttaagcgcacaatctcaaaagtattctaatgatgaattgaaagccggtgagtcagggtctgaaggctcccaaagtgttcctatagagatacccaagaagcccatgtctgaatatgttaccgtttccttgctttgtttgtgtgttgccttcggcggcttcatgtttggctgggataccggtactatttctgggtttgttgtccaaacagactttttgagaaggtttggtatgaaacataaggatggtacccactatttgtcaaacgtcagaacaggtttaatcgtcgccattttcaatattggctgtgcctttggtggtattatactttccaaaggtggagatatgtatggccgtaaaaagggtctttcgattgtcgtctcggtttatatagttggtattatcattcaaattgcctctatcaacaagtggtaccaatatttcattggtagaatcatatctggtttgggtgtcggcggcatcgccgtcttatgtcctatgttgatctctgaaattgctccaaagcacttgagaggcacactagtttcttgttatcagctgatgattactgcaggtatctttttgggctactgtactaattacggtacaaagagctattcgaactcagttcaatggagagttccattagggctatgtttcgcttggtcattatttatgattggcgctttgacgttagttcctgaatccccacgttatttatgtgaggtgaataaggtagaagacgccaagcgttccattgctaagtctaacaaggtgtcaccagaggatcctgccgtccaggcagagttagatctgatcatggccggtatagaagctgaaaaactggctggcaatgcgtcctggggggaattattttccaccaagaccaaagtatttcaacgtttgttgatgggtgtgtttgttcaaatgttccaacaattaaccggtaacaattattttttctactacggtaccgttattttcaagtcagttggcctggatgattcctttgaaacatccattgtcattggtgtagtcaactttgcctccactttctttagtttgtggactgtcgaaaacttgggacatcgtaaatgtttacttttgggcgctgccactatgatggcttgtatggtcatctacgcctctgttggtgttactagattatatcctcacggtaaaagccagccatcttctaaaggtgccggtaactgtatgattgtctttacctgtttttatattttctgttatgccacaacctgggcgccagttgcctgggtcatcacagcagaatcattcccactgagagtcaagtcgaaatgtatggcgttggcctctgcttccaattgggtatgggggttcttgattgcatttttcaccccattcatcacatctgccattaacttctactacggttatgtcttcatgggctgtttggttgccatgtttttttatgtctttttctttgttccagaaactaaaggcctatcgttagaagaaattcaagaattatgggaagaaggtgttttaccttggaaatctgaaggctggattccttcatccagaagaggtaataattacgatttagaggatttacaacatgacgacaaaccgtggtacaaggccatgctagaataa

SEQ ID NO: 46001 - DNA, 1317 bp, Saccharomyces cerevisiae
atggaaacaccacccattgtgattgataatggctcatacgaaatcaagtttggtccttccacgaataagaaaccgttccgagctttaaatgcattggccaaagataaatttgggacatcgtatttatcaaatcatatcaaaaacatcaaagatatttcatctatcaccttcaggaggccacatgaactaggacagctcacattatgggaattagagagttgtatatgggattattgccttttcaatccttcagagtttgatgggtttgatctgaaagagggaaagggtcatcatttggttgctagcgagagctgtatgactttaccagaattaagtaagcatgccgaccaggtgatatttgaagaatatgaattcgacagtcttttcaagtctcctgtagcagtctttgtaccatttaccaagtcatataagggtgaaatgagaacaatttcaggtaaggacgaagatatcgatattgtccgtggcaactcagacagtacaaattccacatcaagcgagtccaagaatgcgcaggattcaggtagcgattatcatgatttccaattagttattgattccgggtttaattgtacttggataattcctgtcctgaagggaataccgtactataaagcggtaaaaaaattggacattggaggccgtttcctaactgggctactaaaggaaactctatcattcagacactacaatatgatggatgaaaccatacttgttaacaatatcaaggaacaatgcttgttcgttagcccggtgtcttattttgatagtttcaaaacgaaggataagcatgcactagaatatgtacttcctgacttccaaacaagctttcttggttacgtaagaaaccccagaaaagaaaatgtaccgttacctgaagatgcgcagatcataacactgacagatgagcttttcacaataccagaaacttttttccatccagaaatttcgcaaattactaaaccaggcattgtggaggccatcctagagagcctttccatgttgcccgaaatagtgcgacctcttatggtaggaaacattgtatgtacaggaggaaactttaatctgcccaatttcgcccaacggcttgcggcagaactacaaaggcaattacccacagattggacttgtcatgtttcggtgcccgaaggtgactgtgctctgtttgggtgggaagtgatgtcacagtttgcaaagacagattcctaccgaaaagcgagggtcacaagagaagaatactatgagcatggtcccgattggtgtacgaagcacaggtttggttaccagaattggatataa

SEQ ID NO: 46002 - DNA, 4257 bp, Saccharomyces cerevisiae
atgtctgatagtccattgagcaaaagacaaaagcggaagtccgcccaagaaccagaattatctcttgatcaaggtgatgccgaagaagattcgcaggtagaaaaccgagttaacctaagcgagaatacaccagagccggatcttcctgcgttggaagcatcttattccaaatcttatactcccagaaagcttgttttaagttctggggaaaatcggtatgccttttctcaacctacaaactcaacaaccacgtcattacatgtaccgaacttgcaaccaccaaaaacctcttctaggggtcgcgaccataagtcctactctcaatcaccaccaaggtctccaggaagatcgccaactagaagattagaattgctccagctttcgccagtgaaaaatagcagggttgaactacaaaaaatttatgataggcaccagtcgtcgagcaagcaacagagcagactatttattaacgaactagtcttagagaacttcaagtcctacgctggtaaacaagtagtaggaccctttcatactagcttctcggccgtggtaggccccaatggttcaggtaaatcaaatgtcatcgattccatgttatttgtatttggatttagagcgaacaagatgagacaggacagattgtcggatttaattcataaatcagaagctttcccaagtttgcaatcatgttccgtagctgtacattttcagtacgttattgatgaatcttcgggtacttcccgaatcgatgaagaaaaacctggattgatcattacaaggaaagcctttaaaaacaactcatcgaaatattacataaacgaaaaagaaagtagctacacagaggtgacaaagcttttaaagaatgagggtattgatttagaccataaacgatttttaattctacaaggtgaagtagagaatattgctcaaatgaagcctaaagcagaaaaagagagtgacgacggactactggaatatctggaggacataattggaactgcaaactataagccgttaattgaagagcgaatgggacagattgagaatctaaatgaagtttgcctggaaaaggaaaatagatttgaaattgttgatagagaaaaaaactctttagagtcagggaaagaaacggcgttagagtttttagagaaggaaaagcagctgacgcttttaagatcaaaattatttcaatttaaattgttgcaaagcaactctaaacttgccagcaccttggaaaagatctcctcttcgaataaagacctcgaagatgagaagatgaaatttcaagaatctttgaaaaaagtggatgagattaaagcacaacgtaaggaaataaaagatcgaatatcatcttgtagctcgaaagaaaagaccctggttttagaaagaagagaattagaaggcaccagggtgtctctagaagagagaacaaaaaatttggtaagtaaaatggaaaaagcagaaaagactttgaaatccaccaaacattcaatatcggaggccgagaatatgcttgaagagcttcgtggacaacaaaccgaacacgagacggagatcaaagacttgactcaattgctggaaaaggaacgaagtatacttgatgatattaaactatctttgaaagataaaacgaagaatatatctgcagagattattcggcatgaaaaggaactggagccttgggacctccaacttcaggaaaaagaatcacagatacaattggctgaatccgaactatctttgttggaggaaactcaagctaaactgaaaaaaaacgttgaaactttagaagaaaaaattcttgccaagaaaacacacaagcaggagctacaagatcttatcctcgatctgaaaaagaagctgaactcacttaaagatgaaaggtcgcaaggtgaaaagaattttacttctgctcatctaaagttaaaagaaatgcaaaaggttttgaacgcgcatcgccagcgtgcaatggaagctagatcctctttatcaaaagctcagaataaaagtaaggttttaacagctttatcgagactgcaaaagtcaggacgtataaatggtttccatggacgtttgggcgatttgggcgttatcgacgatagttttgacgttgctatttctactgcttgtccgagactagatgatgtcgtggttgatactgtagaatgtgcgcaacactgcatcgactacttaagaaaaaacaaacttggttatgcaaggtttattctcttggataggttacgccaattcaatttacaacctatcagtacaccagaaaatgtaccgagactatttgatttagttaaacctaaaaacccaaaattctcaaatgcattttacagtgttcttagagacactttggttgctcagaatttaaaacaagccaataatgtagcatatgggaagaaaagatttagagttgtcactgtggatgggaaattaattgatatttctggtacaatgagtggtggtggcaaccatgtagcaaaaggtctaatgaaattaggtacgaatcagtcagacaaggttgatgattacacccccgaggaagtagataaaattgagcgtgagctatctgaaagagaaaataacttccgcgtggcaagcgatacggtccacgagatggaggaagaactgaaaaaattgagggaccacgaaccagacttggaatcacaaatatcaaaggcagaaatggaagctgattccttggcgagtgaattgacactggcagaacaacaagtgaaagaggcagaaatggcgtacgtcaaggcagttagtgacaaagcgcaactaaacgtggtgatgaagaatttggaacgcttgagaggcgaatacaatgatttgcaatccgaaacaaaaactaaaaaggaaaagatcaaaggcttgcaagacgaaatcatgaaaattggtggtatcaaattgcaaatgcaaaattcaaaagttgaatcagtttgtcagaaattggatattctagtggccaaacttaaaaaagtcaaatctgcctcaaagaagtcaggaggagatgtcgtaaagtttcaaaaactgctccaaaactctgaaagagacgtagaactatcatcagatgagttaaaagtcatcgaagaacaactaaaacatacaaaactggctttggcagaaaatgacacaaatatgaatgagacgctcaacttgaaagttgaattaaaagaacagagcgaacaactgaaggaacaaatggaggacatggaggaaagcatcaatgaatttaaatctatagaaatcgaaatgaagaacaagctggaaaaattgaactcactgttgacgtacatcaaaagtgagataacgcagcaagaaaaaggattaaacgaactatcaattagggatgtaacccacaccctgggaatgttagacgataataaaatggactcagtgaaagaggatgttaaaaacaatcaagaacttgatcaggaataccggtcctgtgaaactcaagatgagagtgaaataaaagacgctgagacttcttgtgacaattatcatcctatgaacattgatgagacttcagatgaggtatccagagggataccaagactttctgaggacgaattaagggagttggacgtagaactgattgaaagtaaaataaatgaattgtcatattatgtcgaagagactaacgtggatattggagttttggaagagtacgctaggcgcttagcagagttcaaaagaaggaagctggatttaaataatgctgttcaaaaaagagatgaagttaaggaacaattaggaatacttaaaaagaaaagatttgatgaatttatggctggctttaatatcatatcaatgaccctaaaagaaatgtaccaaatgattactatgggtggaaatgctgaattagaacttgtggatagtctagatcctttttctgaaggagttacgtttagtgttatgcctcctaaaaagagttggagaaatataacaaacctttcaggtggtgagaaaacactaagctccttggctttggtttttgctttacataagtataaaccaacccccctttatgtcatggatgaaatagatgccgctctggatttcagaaatgtctcaatcgtagctaactatatcaaagaaagaaccaagaatgcacagtttattgttatttcgctgagaaataacatgttcgaattagcacaacagttagttggtgtttataaaagagataatagaaccaaaagtaccacgattaaaaacatagatatcttaaacagaacttag

SEQ ID NO: 46003 - DNA, 3444 bp, Saccharomyces cerevisiae
atgcctaatccgaatacagcagattacttggtgaatccaaatttcaggaccagtaagggcggatctttatcgccgacgccagaagctttcaacgacacgcgagttgctgcaccagccactcttcgcatgatgggcaagcaatctggaccaagaaatgaccagcaacaagcaccactgatgcctcctgcagatatcaaacagggcaaggaacaggcagctcagagacaaaatgatgcatcgaggcctaatggcgccgtggaattaaggcaatttcatagaagatctttgggagattgggagttccttgaaacggttggcgcaggctctatgggtaaagttaaattggtcaagcatcgtcaaacaaaggaaatttgtgtaataaagattgttaatagggcttccaaggcttatctccataaacagcactctttaccttccccaaagaatgagagtgagatattagaaagacaaaagcggttagaaaaagaaattgcgagggataaaaggactgttagggaagcctctttgggccaaatcctttaccatcctcatatctgtcgtttatttgaaatgtgcactatgtcaaaccatttttatatgctttttgaatacgtttccggtggacagctgttagattatattattcagcatggctcattaaaggaacaccatgcgaggaaatttgccagaggtatagctagtgcgctgcaatacttacatgccaataatattgttcatcgagatctgaaaattgagaatataatgatatctagttcaggtgaaattaagatcattgattttggtctttccaacatttttgattataggaaacaattacatacgttttgtggttccttgtactttgcagcaccagaactattaaaagcgcagccatacacaggacctgaggtagatatttggtcgtttggtattgttctttatgtcttggtctgcggtaaagtaccatttgatgatgagaactcaagcattttacatgaaaaaataaaaaaaggtaaagtagactatccttcacacttatccattgaagttatatctttattaaccaggatgattgttgtcgacccattaagaagagcaacattaaagaatgtcgttgagcatccatggatgaacagaggatacgattttaaggctccatcatatgttcctaatcgtgttccattaacccctgaaatgatagatagccaagttctgaaggaaatgtatcgcctagaatttattgacgatattgaagatacaagaagatcattgatccgattagtaactgaaaaggaatacatccaactttcccaagaatactgggacaaattatccaacgccaaggggttgagttcaagtttaaataataactacctaaattcaacggcacaacaaaccttaatacaaaatcatattacaagtaatccatcgcaaagtggttataatgaaccagatagtaattttgaagatcctactttagcatatcatccattactatcaatatatcacttggtttcagaaatggttgcacggaaattagcgaagttgcaaagaaggcaagcattggccctgcaagcgcaagctcagcaaaggcaacaacagcaacaagtagcacttggcactaaggtcgccttaaataataactccccggatattatgaccaaaatgaggagccctcagaaagaagtagtacctaatcctggtatttttcaagtgccggcaattggaacatcgggaacctcaaacaacactaatacctcaaacaaacctccactgcatgtaatggttcctcctaaactaacaataccggaacaagcgcatacttctccaacatctaggaagagttccgacattcatacggaattaaatggtgttttgaaatcaacaccagtccccgtgtctggcgaatatcagcaacgttctgcttcacccgtagtaggtgaacatcaggaaaagaatacaataggcggcatattcagaagaatatcacaaagtggacaatctcagcatcccacacggcaacaggaacctcttccagaaagagaacctccaacatatatgtcaaaatcaaatgaaatttccatcaaagtaccgaaaagccatagtcgtactatatcagattatattcctagcgctagaagatatccatcttacgtgccaaattctgttgatgtaaaacagaaacccgctaaaaacactaccatagcacctcctataaggtcagtatcacaaaagcaaaacagtgatcttccagctttacctcagaacgccgaactaattgttcaaaaacaacggcaaaaactattacaggaaaatctcgacaaattacaaattaatgataatgataacaacaatgtgaacgctgtagtcgatggtatcaataatgataatagtgaccattatctctccgttccgaagggtcgtaagttacatcctagtgcaagggctaaatcggtggggcatgctcgtcgtgaatctttgaaatttactaggccgcctataccagcagcccttccgccatcagatatgacaaacgataacggctttttgggagaggcaaacaaggagagatacaatcctgttagcagtaacttttcgaccgttcctgaagattctaccacatacagtaacgatactaacaatagactgacttcggtgtattctcaggagcttactgagaagcaaattttggaggaagcttcaaaggcaccccccgggtctatgccatcaattgattatccaaagtcaatgtttttgaagggttttttctctgtacaaacaacctcctctaaaccattgcctattgttcgtcacaatatcatatctgttttaacaagaatgaatattgatttcaaagaagtgaaaggcgggttcatatgtgtccaacaaaggccatctattgagactgcagctgtccctgttataaccactactggcgtgggtttggattccggaaaggcgatggatctgcaaaatagtttagacagtcaattatcatccagttaccatagtacagcgtcctcagcatcaagaaatagttcgataaaacgccaaggttcttataagaggggccagaataatataccactaacacctttagcgaccaatacacatcaaagaaattcatctatcccaatgtctccaaactacggaaaccaaagtaatggtacatcaggggaactatcttccatgtcattagattatgttcaacaacaggatgatattttaacaacatcaagagcccaaaatataaataacgtaaatggtcaaacagagcaaaccaatacttctggtataaaagaaaggcctcctattaaatttgagattcacattgtaaaggttcgtatcgtcggcctagcaggtgtacatttcaaaaaggtttctggtaatacgtggctatataaagaattggcatcgtatattttaaaagaattaaacctatag

SEQ ID NO: 46004 - DNA, 226 bp, Saccharomyces cerevisiae
ggacacttacttggttgctgggttaacacctaggtatcctcgcggactagacacgatacacacaaaaaaacctattttgaataatttcagcatggcgtttcaacaaataactgcagaaacggatgctaaagtgagaatagataattttgaaagttccataattgaaatacgtcgtgaagatctttcaccattcctggagaagctgaccttgagtggattgttataa

SEQ ID NO: 46005 - DNA, 1727 bp, Saccharomyces cerevisiae
atgtattatggaatcagccagtttagcgaagcctacaacaaaatcttaaggaattcatcgtctcattcatcatgtcaattggtcattttcgtttcttgtcttaacatcgatgcgctgtgtgcgacgaagatgttgtcactattattcaaaaaacaattggtacaatctcaaatagtaccgatatttgggtactctgaattacgacgccactattctcaattggatgacaatataaatagtctgctattagtagggtttggaggcgttattgatctggaggctttcttagaaatcgatccccaagagtatgttatcgatacagatgaaaagtcgggggaacaaagtttcaggagagacatctacgtgttggatgctcatagaccgtggaatctcgacaatatatttggatcacaaatcatccaatgttttgacgacggtacggtggatgacacattaggcgaacaaaaagaagcatactataaattgcttgaactggacgaggagagtggtgacgatgagctctcaggtgacgagaacgataataatgggggtgacgatgaggcaactgatgccgatgaagtcacagacgaggacgaagaagacgaagatgagacaatatctaataaaagaggtaattcttcaataggaccgaatgatctctcaaaaagaaagcaacgaaagaagcaaatccatgaatatgaaggtgttttggaggaatactattctcaaggcacaacagtggttaactcgatatctgcacaaatctattcattattgtctgctatcggagaaacaaatctttcaaacctgtggttgaatatacttggtacgacctcgttagatatagcatatgctcaagtttacaatcgattataccccttattgcaagatgaagtgaagcgtctcacaccaagcagtagaaactcagtaaagacccctgatacattgacgttaaacatccaaccggattactaccttttcttactgaggcattcttcattgtacgacagtttttattattctaactatgtcaatgccaaactatccctatggaatgaaaatgggaaaaagagattgcataagatgtttgctagaatgggtataccattaagtactgcacaagaaacatggttatacatggatcattctattaagagagaacttgggataatatttgacaaaaatttggatcgttatgggttgcaagatataattagagatgggtttgttagaactcttggatatcgtgggtccataagtgccagtgaatttgtcgaagcactaacagctcttttggaagtaggtaattcaactgataaggatagtgtgaaaataaataatgacaataatgacgatacagatggagaggaagaagaagataacagcgctcaaaaattgacgaatttgagaaaaagatgggtttcgaatttttggctcagttgggatgctctagatgacagaaaggtggaactattaaaccgtggcattcaactagcacaagacttacagagagcaatttttaataccggggttgctatattggagaagaaattaatcaagcatttaagaatttatagattatgcgtcttacaagacggacccgatttagacttgtacagaaacccattgacgttattaagattaggaaattggctcatagaatgctgtgcggaatctgaagacaagcaattgttgcccatggtgcttgccagcatagatgaaaatac

SEQ ID NO: 46006 - DNA, 24 bp, Saccharomyces cerevisiae
atgaccactaacgaggaattcatt

SEQ ID NO: 46007 - DNA, 1284 bp, Saccharomyces cerevisiae
aggacacagatattcggtacagttttcgagatcacaaatagatacaatgatttaaaccccgttgggatgggggcatttgggttggtttgctcagccacggacactttgacatctcagccagttgccattaagaaaatcatgaaacctttttccactgcagtgctggccaaaaggacatatcgtgaactaaaactactaaaacatctaagacacgagaacttgatttgccttcaggacatatttctttctccattggaagatatatattttgtcacggaattacaaggaacagatttacatagactcttgcaaacaagacccttggaaaagcaatttgttcagtatttcctataccaaattctaaggggtttaaaatacgttcactccgcgggcgtcattcatagagatttgaaaccgagcaacattctgattaatgaaaactgtgatttgaagatttgcgatttcggtctagcaagaattcaagaccctcaaatgacaggctatgtttccactagatactacagggcacctgaaatcatgctaacgtggcaaaaatatgacgtcgaggtcgacatttggtccgctggttgtatttttgccgaaatgattgaaggtaagcctttgttccctgggaaagatcatgttcaccaattttcgatcatcactgacttgttgggatctccgccaaaggatgtgataaatactatttgttccgaaaatactctaaaatttgttacttcgttaccacacagagatccaattccattttctgaaagatttaaaacagtcgaacctgatgccgtagaccttttggaaaaaatgctggtttttgatcctaagaagagaatcactgcggcggatgccttggctcatccttattcggctccttaccacgatccaacggatgaaccagtagccgatgccaagttcgattggcactttaatgacgctgatctgcctgtcgatacctggcgtgttatgatgtactcagaaatcctagacttccataagattggtggcagtgatggacagattgatatatctgccacgtttgatgaccaagttgctgcagccaccgctgccgcggcgcaggcacaggctcaggctcaggctcaagttcagttaaacatggctgcgcattcgcataatggcgctggcactactggaaatgatcactcagatatagctggtggaaacaaagtcagcgatcatgtagctgcaaatgacaccattacggactacggtaaccaggccatacagtacgctaatgagttccaacagtaa

SEQ ID NO: 46008 - DNA, 684 bp, Saccharomyces cerevisiae
atgaatggacttagagttgcagcaaaaattcagccagcacgccaaactatcatattcttgcatggattaggtgatacaggttcgggatggggatttttagctcagtatttacaacagagagaccctgccgctttccagcatactaattttgtttttcctaatgctccagagcttcatgtgacagcaaacggcggtgcattgatgcctgcttggtttgacatcttggaatgggatcctagtttttccaaagttgacagtgacggttttatgaattctttgaattccatagaaaagacggttaagcaagaaattgataaaggaattaaaccggagcagattattatcggaggtttctctcagggtgccgcattagctctcgcaacatcagttactttaccatggaaaatcggtggtatagtagctctgtcgggattttgttccatcccaggaattctgaaacaacataagaatggcattaatgtaaagacaccaatttttcatgggcatggtgacatggatccagtagttcctattggactaggtataaaggcaaaacagttctatcaagatagctgtgagatacaaaattatgaatttaaagtatacaaaggtatggcccattctacagttccagatgaattagaagacttggcttcatttatcaagaagagcttatcatcatag

SEQ ID NO: 46009 - DNA, 1710 bp, Saccharomyces cerevisiae
atgaaactgaaaactgtaagatctgcggtcctttcgtcactctttgcatcgcaggttctcggtaagataataccagcagcaaacaagcgcgacgacgactcgaattccaagttcgtcaagttgccctttcataagctttacggggactcgctagaaaatgtgggaagcgacaaaaaaccggaagtacgcctattgaagagggctgacggttatgaagaaattataattaccaaccagcaaagtttctattcggtggacttggaagtgggcacgccaccacagaacgtaacggtcctggtggacacaggctcctctgatctatggattatgggctcggataatccatactgttcttcgaacagtatgggtagtagccggagacgtgttattgacaaacgtgatgattcgtcaagcggcggatctttgattaatgatataaacccatttggctggttgacgggaacgggcagtgccattggccccactgctacgggcttaggaggcggttcaggtacggcaactcaatccgtgcctgcttcggaagccaccatggactgtcaacaatacgggacattttccacttcgggctcttctacatttagatcaaacaacacctatttcagtattagctacggtgatgggacttttgcctccggtacttttggtacggatgttttggatttaagcgacttgaacgttaccgggttgtcttttgccgttgccaatgaaacgaattctactatgggtgtgttaggtattggtttgcccgaattagaagtcacttattctggctctactgcgtctcatagtggaaaagcttataaatacgacaacttccccattgtattgaaaaattctggtgctatcaaaagcaacacatattctttgtatttgaacgactcggacgctatgcatggcaccattttgttcggagccgtggaccacagtaaatataccggcaccttatacacaatccccatcgtaaacactctgagtgctagtggatttagctctcccattcaatttgatgtcactattaatggtatcggtattagtgattctgggagtagtaacaagaccttgactaccactaaaatacctgctttgttggattccggtactactttgacttatttacctcaaacagtggtaagtatgatcgctactgaactaggtgcgcaatactcttccaggatagggtattacgtattggactgtccatctgatgatagtatggaaatagtgttcgattttggtggttttcacatcaatgcaccactttcgagttttatcttgagtactggcactacatgtcttttaggtattatcccaacgagtgatgacacaggtaccattttgggtgattcatttttgactaacgcgtacgtggtttatgatttggagaatcttgaaatatccatggcacaagctcgctataataccacaagcgaaaatatcgaaattattacatcctctgttccaagcgccgtaaaggcaccaggctatacaaacacttggtccacaagtgcatctattgttaccggtggtaacatatttactgtaaattcctcacaaactgcttcctttagcggtaacctgacgaccagtactgcatccgccacttctacatcaagtaaaagaaatgttggtgatcatatagttccatctttacccctcacattaatttctcttctttttgcattcatctga

SEQ ID NO: 46010 - DNA, 1527 bp, Saccharomyces cerevisiae
atgaaacttcaattggcggcagtggctacattagcagtcttaactagtccggcattcggtagagtacttcccgatgggaaatacgtcaagattcccttcacaaaaaaaaagaacggcgacaatggtgaactcagcaagagatcgaacggccatgaaaaatttgtactagctaacgagcaaagcttttattctgttgagctagccattggtacaccttcacaaaacctcactgtgctgttagacacaggctcagctgacttatgggttcctggcaagggaaacccctactgcggttctgtgatggactgtgaccagtatggcgtgttcgacaagaccaagtcgtccacgttcaaagccaacaagtcctcgcctttttatgccgcttacggtgacggaacctatgcagaaggtgcatttggtcaagataaattaaagtacaacgaattagacctcagtggtctatcgtttgccgtggccaacgaatctaactcaacctttggtgtgctcgggatcggcctttccacgcttgaagtcacctattctggaaaagtcgctattatggacaagagaagctacgagtatgataactttcccctgttcctaaaacattctggagccatcgatgcaaccgcatactctcttttcctaaatgacgagtcacagtcctccggcagcatcctcttcggcgctgtagatcacagcaagtacgagggccaactgtacactatcccgttggttaatctttataagtcgcagggttatcagcacccggtggcgttcgatgtcactttacagggcttaggactgcaaaccgacaagcgcaacatcacattgaccaccaccaagctcccagccctactcgattcaggcacaacgctaacatatctgccctcccaggcagtggctttgctagcaaagagcttgaatgcctcgtattccaagacattgggttattatgagtacacgtgtccctcgagcgacaacaaaaccagcgtggccttcgacttcggtggcttccgtatcaacgctcctctatccgactttactatgcagaccagtgtggggacctgtgtcttggcaataattccacaagcgggcaacgccaccgctatccttggtgattccttcttgagaaacgcctacgtggtctacgatttggataactacgagatttccctagctcaagccaagtatggcacggggaaagagaacgtcgaagtcatcaaatctaccgttcccagtgcaataagggcccccagttacaacaacacttggtctaactacgcctccgccacgtccggtggtaatatttttaccaccgtgcgcactttcaatggcaccagtactgccaccactacgaggtcaaccaccaccaagaagacaaactctaccactactgcaaagtcgactcataaaagcaagagggcactccagagggctgctaccaactccgcttccagtatacgctctaccttgggtttactgctagtcccctccttactcatcctttccgttttcttttcgtaa

SEQ ID NO: 46011 - DNA, 2313 bp, Saccharomyces cerevisiae
atggataacgttgtagatccgtggtatataaatccctcaggcttcgcgaaagacactcaagatgaggagtatgttcaacatcatgataatgtcaatcctaccatacccccacccgacaattatattttgaataatgaaaacgatgatggcctcgataacttgttaggtatggactactataacatcgatgacctgttgactcaagagttaagagatctggatattcctttagtgccttctcctaagacgggcgatggttcttctgataaaaagaatattgatagaacttggaaccttggtgatgaaaacaacaaagtctcccactatagcaaaaaatcaatgtcctcacacaagagaggtctaagtggcacagcgatatttggatttctcggccataataagacattgagtatttccagtttacagcaatccattctaaatatgtctaaagatccgcaacccatggaactcataaatgaattgggtaatcataatacggtaaaaaataacaatgatgactttgaccatataagggaaaatgatggtgaaaatagctatttgagccaagttttgttgaaacagcaggaggagttaagaattgctcttgaaaaacaaaaggaagtgaacgaaaaattggagaagcagttgagagacaatcaaatacagcaagaaaagttgcgtaaagtattagaagagcaagaagaggtggcgcagaagttggtttctggggctacaaattctaattccaaacctggatctccagtaatactaaagacacctgccatgcaaaacggtagaatgaaagataatgctataatcgtcacaacgaactctgcaaatggcggatatcaatttcctcctccgacgttaatatcgcctcggatgtcaaatacttcaataaatggttcaccatccaggaaataccataggcaacgatatccaaataaaagcccagaaagtaatggattgaaccttttttcctctaacagtggttatttgagagattctgaactgctttcattttctccacaaaattataatttaaacttggacggcttgacttataatgaccataataacaccagtgataaaaacaataatgataaaaaaaatagtactggtgataacatattccgtctgttcgaaaagacttccccgggtgggctaagtatctctccaaggataaatggaaatagtttgagatcgcccttcctcgtcggcacagataaaagcagggatgatcgatatgctgctggcacgttcacgcctagaacacagttgtcacctatccacaagaaaagggaatccgtagtttccacggtctcgacaatatcacaactgcaggatgacactgaacccatccacatgcgaaatacccagaacccaacattaagaaatgcaaacgctttagcgtcatcaagtgtactacctcctattcctggttccagcaataacactccaattaagaattctttgccacaaaaacatgtatttcaacatactcccgtcaaagctccaccaaagaacggaagtaacctagctccgcttctaaatgcaccggatttaacagatcatcagttagaaattaagacacccatacgaaataacagtcactgtgaagtggaaagctatccgcaagtaccacctgtcacacatgatattcacaaaagccccactttgcatagtacgtctcctttaccagatgaaataatacctaggactacgccaatgaaaataaccaagaaaccaactactctgcctccgggtaccattgaccagtacgtcaaggaactacccgacaaactattcgagtgcttataccctaactgtaacaaagtattcaagcgtagatacaacataaggtcgcatattcagacacatttgcaagatagaccgtattcatgcgactttcccggttgcaccaaggcgtttgttcgcaatcatgatttaataagacacaaaatctcccataatgccaagaaatacatctgcccatgcggaaagagatttaatagggaggatgctctaatggtgcatagaagtcggatgatttgcaccggcggtaagaaattagaacattcgatcaacaagaaacttacatctcccaaaaaaagcctgcttgacagcccgcatgacacaagtcccgtaaaagaaactatcgcccgggataaagatgggagcgtcctaatgaaaatggaggaacagctgcgagatgatatgcgcaaacatggattactggatccacccccatccacagcagcgcacgagcaaaactcgaaccgcaccctttcaaacgaaactgatgctctctga

SEQ ID NO: 46012 - DNA, 1749 bp, Saccharomyces cerevisiae
atggtacaagaatcacgtccagggagtgtaagaagttactcggtcggttaccaagcaaggtccagatcgagttctcaaagaagacattcgttaacacgccaacgttcctcgcaaagactgattagaaccatcagtatcgagtctgatgtgtctaatattactgacgatgacgatttgagagctgtcaatgagggagtagcgggtgtgcaactggacgtctctgaaaccgcaaataagggaccaagaagagcatcagcaactgatgtcacagatagtttgggttcgacttcgtcggaatatattgagattccctttgttaaggaaacattggatgcaagtttaccttcggattatctgaagcaggacatattaaatctcattcagagtttgaagatatccaaatggtataacaacaagaaaatccaaccggtagcacaagatatgaacttagtcaagatctctggtgcgatgacaaacgcaattttcaaagttgaataccctaagttaccatcgttgctattgagaatatacggaccgaatattgataatatcattgacagggaatatgaattgcagattttggctaggctttcattgaaaaatataggtccttccctttacggctgttttgtaaacggtagatttgagcagtttctggagaattctaagactttaacaaaagacgacattagaaactggaagaactctcaaaggattgcaaggagaatgaaggagttacatgtaggtgttcctctcttgagttcagaaaggaagaacgggtcggcttgttggcaaaagattaaccagtggttgcgcacgattgagaaagtcgaccaatgggtgggggatcctaaaaacattgaaaactctttattatgtgagaattggtccaagtttatggatattgtcgatagatatcacaagtggcttatttctcaagaacagggtatagagcaagtcaacaaaaatcttatattctgccataatgatgcccaatacggcaatttacttttcactgctcctgtgatgaacacaccgagcctatacactgcaccttcgtctacatcattgacttcccaatcaagttccttatttccttcgagctccaatgtcattgtagatgatataatcaacccgccaaagcaggagcaaagccaagattccaaattggtcgtcattgattttgaatatgcaggtgccaatcccgccgcatatgatttagcgaatcatctttccgagtggatgtatgattacaacaatgctaaggccccacatcagtgccacgctgatagatatcccgataaagaacaggttttgaatttcttatactcttatgtttcgcatctaaggggtggtgctaaggaacccatagatgaagaggttcaaagactctataagtcaatcattcaatggagacccactgtacaactattttggtcgctctgggccatcctacaaagtggtaaattagagaaaaaagaagcctccactgccatcactagagaagaaattggacccaatggaaaaaaatatatcatcaagactgaacccgaatcccctgaagaagactttgttgaaaatgacgacgagcctgaagctggcgtcagcattgacacgttcgattatatggcttatggtcgtgacaagattgcggtcttttggggcgacctcattggcttaggcataatcaccgaagaagaatgcaaaaatttcagctctttcaagttcctcgatactagttatttgtaa

SEQ ID NO: 46013 - DNA, 1692 bp, Saccharomyces cerevisiae
atgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctgctgatggttacgctcgtatcaagggtatgtcctgtattattaccaccttcggtgttggtgaattgtctgctttgaatggtattgccggttcttacgctgaacatgtcggtgttttgcacgttgttggtgttccatccatctcttctcaagctaagcaattgttgttgcatcataccttgggtaacggtgacttcactgttttccacagaatgtctgccaacatttctgaaaccactgccatgatcactgatattgctaacgctccagctgaaattgacagatgtatcagaaccacctacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataa

SEQ ID NO: 46014 - DNA, 2052 bp, Saccharomyces cerevisiae
atgacaatcaaggaacataaagtagtttatgaagctcacaacgtaaaggctcttaaggctcctcaacatttttacaacagccaacccggcaagggttacgttactgatatgcaacattatcaagaaatgtatcaacaatctatcaatgagccagaaaaattctttgataagatggctaaggaatacttgcattgggatgctccatacaccaaagttcaatctggttcattgaacaatggtgatgttgcatggtttttgaacggtaaattgaatgcatcatacaattgtgttgacagacatgcctttgctaatcccgacaagccagctttgatctatgaagctgatgacgaatccgacaacaaaatcatcacatttggtgaattactcagaaaagtttcccaaatcgctggtgtcttaaaaagctggggcgttaagaaaggtgacacagtggctatctatttgccaatgattccagaagcggtcattgctatgttggctgtggctcgtattggtgctattcactctgttgtctttgctgggttctccgctggttcgttgaaagatcgtgtcgttgacgctaattctaaagtggtcatcacttgtgatgaaggtaaaagaggtggtaagaccatcaacactaaaaaaattgttgacgaaggtttgaacggagtcgatttggtttcccgtatcttggttttccaaagaactggtactgaaggtattccaatgaaggccggtagagattactggtggcatgaggaggccgctaagcagagaacttacctacctcctgtttcatgtgacgctgaagatcctctatttttattatacacttccggttccactggttctccaaagggtgtcgttcacactacaggtggttatttattaggtgccgctttaacaactagatacgtttttgatattcacccagaagatgttctcttcactgccggtgacgtcggctggatcacgggtcacacctatgctctatatggtccattaaccttgggtaccgcctcaataattttcgaatccactcctgcctacccagattatggtagatattggagaattatccaacgtcacaaggctacccatttctatgtggctccaactgctttaagattaatcaaacgtgtaggtgaagccgaaattgccaaatatgacacttcctcattacgtgtcttgggttccgtcggtgaaccaatctctccagacttatgggaatggtatcatgaaaaagtgggtaacaaaaactgtgtcatttgtgacactatgtggcaaacagagtctggttctcatttaattgctcctttggcaggtgctgtcccaacaaaacctggttctgctaccgtgccattctttggtattaacgcttgtatcattgaccctgttacaggtgtggaattagaaggtaatgatgtcgaaggtgtccttgccgttaaatcaccatggccatcaatggctagatctgtttggaaccaccacgaccgttacatggatacttacttgaaaccttatcctggtcactatttcacaggtgatggtgctggtagagatcatgatggttactactggatcaggggtagagttgacgacgttgtaaatgtttccggtcatagattatccacatcagaaattgaagcatctatctcaaatcacgaaaacgtctcggaagctgctgttgtcggtattccagatgaattgaccggtcaaaccgtcgttgcatatgtttccctaaaagatggttatctacaaaacaacgctactgaaggtgatgcagaacacatcacaccagataatttacgtagagaattgatcttacaagttaggggtgagattggtcctttcgcctcaccaaaaaccattattctagttagagatctaccaagaacaaggtcaggaaagattatgagaagagttctaagaaaggttgcttctaacgaagccgaacagctaggtgacctaactactttggccaacccagaagttgtacctgccatcatttctgctgtagagaaccaatttttctctcaaaaaaagaaataa

SEQ ID NO: 46015 - DNA, 1389 bp, Saccharomyces cerevisiae
atgttttcaagaacagcatccaagttccgtaatacacggaggcttttaagtacaatttcctcacaaattccaggaaccagaacctctaaacttcctaatgggttgacaattgccacagagtacatccccaacacatcttcggctactgttggaatatttgtcgatgctggttctagggcagaaaacgtaaaaaacaatggtacagcgcattttctagaacacttggctttcaagggtactcagaataggtcacaacaaggaattgaattggaaattgaaaatatcggatctcatttgaatgcatatacatcaagagaaaacacagtttattatgctaagtccctacaagaagatatcccaaaggctgttgatattctaagtgatattttgactaagtcagttttagataatagtgctattgagagagaaagggatgtcatcatcagagaaagtgaagaggtggacaagatgtatgatgaagttgtttttgaccatcttcatgagattacgtataaggaccaacctttaggaagaaccattctgggtcctataaaaaacataaaatcaataacaagaactgatttgaaagactatataaccaagaactataaaggcgacagaatggtattggcaggtgcgggcgctgttgatcatgaaaaattggtacagtatgctcaaaaatactttggccatgtgcccaaatctgaatcgcctgtcccgttgggatcaccaaggggcccattaccagttttttgtagaggtgaaaggtttatcaaagaaaacacgttacctacaacacatattgctatcgcattagaaggcgtgtcatggtctgcacctgattattttgtagctctggcaacacaagcgattgttggtaactgggacagagccattggcacaggtacaaactccccctctccattagctgttgcagcaagtcaaaatggttctttggctaattcttatatgtcattttccacctcttacgctgattcaggtctgtggggaatgtacatagtaactgattctaatgagcataacgtgcagttaattgttaatgagatcctgaaagagtggaagagaataaaatctggcaaaatatcggatgcagaggtgaatagggcaaaagctcagctaaaggcagctctgttgctatcgttggatggatcgacagccattgtagaagatataggcagacaagtggtgaccacaggtaaaagattatcaccagaagaagttttcgagcaggttgataaaatcactaaggatgatattattatgtgggcaaattacagattacaaaacaaaccagtttcaatggttgccctaggaaatacatccactgtccctaatgtatcctatatcgaagaaaaactgaaccaatga

SEQ ID NO: 46016 - DNA, 507 bp, Saccharomyces cerevisiae
atgtcatcgactaagtttttgaaaccactctgcagaataagggcttttcatacttcaattgccagatcctttaccattccttttctgccaaagattccacagaaacctggaggtgtgagtgggaccgcaaatgattcctcttatatgccgcccgaaagcagagctcagggttcgtaccattggattgtcgagcgcggactgtccttagcggttcttccgctgatcgcagttcccttggtcactacaggccctatttccacttttaccgacacatttctttccttggtcctgctaggtcattgtcatatcggatttcagtcttgcattatagactatatttctgaaagagtctatggaaaggtacatcattacgcgatgtatttattgagcttgggctcctttttatcgttcgtcggtatatataaattagagagtcaagaagctggtcttattgcctctttaaaatcattatgggataacaaacctgtggaaaaaaagaggcagtaa

SEQ ID NO: 46017 - DNA, 2616 bp, Saccharomyces cerevisiae
atgaactcattatatgaactcgatccgaaatggaagaaactattgaaaacggacaatttcctgggcggattaacagtcaatgaattcgttcaggaattgagcaaagaccatcgtaatgacgtgttgattgatgcaaacacgaaaaatcttccaaccaatgaaaaggatcaggatgcaatcagagaggctatttggaaacaattagatccaaaaccttacattagaacttttgaatctaccttaaaggaactaaaaaacttaaatgaggaaacactaaataaaagacagtatttttccgagcaagtggctactcaggaagttattcattcggagaatgtgataaaattatccaaggatttgcatactactttacttacattcgacaagctagatgatcgcttgacaaatgttactcaagttgtttcgccattgggagataaattagaaaccgcaatcaagaaaaagcaaaactatattcaaagtgtggaattgattcgcaggtacaatgacttttattccatgggaaaatcagatattgttgaacaattaaggctgtctaaaaactggaaattaaacttaaagtccgtgaaattaatgaagaatctattgatattatcatccaaactagagacaagttcaataccaaaaacaataaacacaaagctggttattgaaaagtactctgaaatgatggaaaatgagctgttagagaattttaattctgcatatagagagaataattttactaaattaaatgaaattgccatcattctcaacaattttaatggcggtgttaatgtcattcaaagcttcatcaatcagcacgattatttcattgacaccaagcagattgacttggaaaatgaatttgagaatgttttcataaaaaacgtgaagtttaaggaacagctgattgattttgagaaccacagtgttatcatcgagacatccatgcaaaatttgataaatgatgtggaaactgtaataaaaaatgaatccaagattgttaaaagggtatttgaagaaaaggcaactcatgtgatacaattgtttattcaaagagtttttgctcaaaaaattgaaccaagatttgaggttttattgaggaattccctgtcaatctcaaatttggcttatgtgagaatattacacggactgttcactttatttggtaagttcactaaaagtttaattgattactttcaactattagaaattgacgacagtaaccaaatcttatcaacaaccctagaacaatgttttgctgatttgttttcgcattatctatatgataggtccaaatatttcggtattgagaaaagatccttggaagcgattctagtggatatgacatccaagtttactgtaaactatgataaagaaatcaacaagagggttttattagataagtataaggagaaactatcaactaatgtggatgcattcatgcattctcctagagggaatacacactctcgtcaagattcaacatcaaggagtaaattgtcacaatttaattcctttttgaaaactcatttagataaagatcatttgagtctaaaccgtacaaatactttgagcgattcgtttaacaacagctcttcttctacgcagtatgatgtagcaaacaactcttcaagtttggtaaattctagttttacagcaagcgatattgataacagtccaaacagtccggcgaactattctttgaacgatgttgattctatgttaaaatgtgtggtggagtctactgcaagagtaatggaactaattccaaacaaagcacatctatacatcctagaaatattaaaaataatgtttttgggaattgttgattcgtacatggaaattgcgttagaagtcgcttactggaaaatttgtaaagttgatattaataaaacagcaggagtggtaaacttaaatttcttgaaatttatttcaatgagcacggagatattagatttattgtcaatttcaatcaaatccattttcttaccattattaaataattcgccagaaattaaagctcagattattgagatgacaaattcacaaattcaaaagatggaaatacttattaatataattttgcaagagaccattacggtaatttcgactaaattttccgcaattttgtgcaagcaaaagaagaaggattttgtgccaaaatctcaagagctattggatcaagacaccttaccggctattgagattgtcaatattttaaacttaatctttgaacagtcttccaagtttcttaaaggaaaaaacttacagacatttttaacgttgattggggaagagttatacggtttactactgtcacattattcacactttcaagtcaattccattggcggtgttgtagttacgaaggatatcataggctaccaaactgcaatagaagattggggagtagcgtccttgattgacaaatttgctactttgagagaacttgcaaatctatttactgttcaacctgaattattagaatcactaactaaggagggtcatttagcagacattggaagggatattattcaaagctacatttccaacagagaggacttcaatcatgacaatttcattaatagcgttaaattgaattttagatag

SEQ ID NO: 46018 - DNA, 1239 bp, Saccharomyces cerevisiae
atgacaaagattaaggtagctaaccccattgtggaaatggacggcgatgagcaaacaagaataatctggcatttaatcagggacaagttagtcttgccctatcttgacgttgatttgaagtactacgatctttccgtggagtatcgtgaccagactaatgatcaagtaactgtggattctgccaccgcgactttaaagtatggagtagctgtcaaatgcgcgactattacacccgatgaggcaagggtcgaggaatttcatttgaaaaagatgtggaaatctccaaatggtactattagaaacattttgggtggtacagtgttcagagaacctattattatccctagaattccaaggctagttcctcaatgggagaagcccatcatcattgggagacacgcattcggcgatcagtacaaagctaccgatgtaatagtccctgaagaaggcgagttgaggcttgtttataaatccaagagcggaactcatgatgtagatctgaaggtatttgactacccagaacatggtggggttgccatgatgatgtacaacactacagattcgatcgaagggtttgcgaaggcctcctttgaattggccattgaaaggaagttaccattatattccactactaagaatactattttgaagaagtatgatggtaaattcaaagatgttttcgaagccatgtatgctagaagttataaagagaagtttgaatcccttggcatctggtacgagcaccgtttaattgatgatatggtggcccaaatgttgaaatctaaaggtggatacataattgccatgaaaaattacgacggtgacgtagaatcagatattgttgcacaaggatttggctccttggggttaatgacatctgtgttgattaccccggacggtaaaacctttgaaagcgaagccgcccacggtacagtaacaagacattttagacagcatcagcaaggaaaggagacgtcaacaaattccattgcatcaattttcgcgtggactagaggtattattcaaaggggtaaacttgataatactccagatgtagttaagttcggccaaatattggaaagcgctacggtaaatacagtgcaagaagatggaatcatgactaaagatttggcgctcattctcggtaagtctgaaagatccgcttatgtcactaccgaggagttcattgacgcggtggaatctagattgaaaaaagagttcgaggcagctgcattgtaa

SEQ ID NO: 46019 - DNA, 1149 bp, Saccharomyces cerevisiae
atggccggtacatttttattcacttctgaatccgttggtgaaggtcacccagataagatctgtgaccaagtttccgacgccatcttggacgcttgtttagccgaggaccctcactccaaagttgcgtgtgaaaccgcggcaaagactggtatgattatggtctttggtgaaattactaccaaggcacagttggattaccaaaaaatcgtcagagacaccatcaagaagattggttacgatgattccgccaagggtttcgactataagacctgtaacgtccttgtcgccattgagcaacaatctccagatatcgcccaaggtgtccacgaggagaaggatttggaagacatcggtgccggtgaccaaggtatcatgtttggttacgccacagatgaaactccagagggtttgcctttgactattcttttggctcataaactaaacatggccatggctgacgcgagaagagatggctctttagcgtggttgagaccagacaccaagactcaagtcaccgtcgaatacaaggatgaccacggtagatgggttccacaaagaatcgacaccgtcgtcgtctccgctcaacatgctgacgaaatcacgaccgaggacttaagagcgcaactaaagtccgagatcattgaaaaagtcatcccaagagacatgttggacgaaaacaccaaatactttatccaaccttccggtagattcgtcatcggtggtcctcaaggtgacgctggtttgaccggtagaaagatcatcgtcgacgcttacggtggtgcctcatccgtcggtggtggtgccttctccggtaaggactactctaaggttgatcgttctgccgcttatgccgctagatgggttgccaagtccctagttgccgctggtttatgtaagagagttcaagttcaattttcttatgccatcggtattgcggaaccattgtccttgcacgttgacacctatggtactgcgaccaagtctgacgaagaaattatcgacattatcagcaagaactttgacttgagacctggtgtattggtcaaggagttggacttagctagaccaatctacttgccaaccgcttcttatggccatttcacaaaccaagaatacccatgggaaaagcctaagactttgaagttctaa

SEQ ID NO: 46020 - DNA, 2088 bp, Saccharomyces cerevisiae
atgattgtaagaatgatacgtctttgtaaaggtccaaagttgttgcgaagtcaattcgcatcagcaagtgcactatattcaaccaagtcattgttcaaacctcccatgtaccaaaaagcggaaattaatttgattattccacatagaaagcactttttgttgcggtcgattcgattacaatcagacattgcgcaaggaaagaagtccaccaagcccactttaaagttgtccaatgcaaattcaaaatcctcggggtttaaagacattaaacggctattcgtcttatctaaaccggaatccaagtacattggtcttgccctccttttaatcctcatttcaagttcagttagtatggctgtaccttccgttatcggtaaattattagacttggcttccgaaagtgacggcgaagatgaagagggctcaaaaagcaataagttatatggttttacgaagaagcaatttttcacagcattaggagcagtatttataattggagcagttgctaatgcaagcagaatcatcattttaaaggtcaccggtgagagactggtcgcaagattaagaacgagaacaatgaaagctgcattagatcaagatgccacatttttagatactaatcgtgtcggtgatttgatctcaagattatcatctgatgcatctatagtggccaaatcggtcacacaaaacgtctctgatggaacaagggcaattattcaagggtttgtcggttttggcatgatgagcttcctctcgtggaaattgacttgcgtaatgatgattttagcccctcctttaggtgctatggcactgatatatggtaggaaaatacgaaacctatcaagacagttacaaacctcagtaggtgggttaacaaaagtggcagaagagcaattaaatgctactaggacaattcaagcatatggtggtgaaaaaaacgaggttcgccgctatgcaaaagaggttagaaatgtatttcatattggtctgaaggaagcggttacttccggtttattcttcggaagtactgggctagttggcaacactgcaatgctgtcgttattattggttggaacaagcatgattcaaagtggttcaatgactgtcggtgaattatctagtttcatgatgtatgccgtgtataccggaagttcattatttggtttatcgagcttctattcagaacttatgaaaggtgctggtgcggctgccagggtttttgaattaaatgaccgtaagccattgattcgtccgactattggaaaggatcctgtgtcattagcccaaaaacccatcgttttcaaaaacgtgtcattcacttatcccactcggcccaaacaccagattttcaaggatttgaatattactatcaagcctggtgaacacgtttgcgctgtcggtccatcaggaagcggcaaatcaacaattgcgtctttgttgctcaggtactacgatgtgaactcaggatcgatcgaatttggtgatgaagacatcagaaatttcaacttgaggaagtatcgaagactaataggatacgtgcaacaagaaccactacttttcaatgggactattctggacaatatcctctactgcattccgcctgaaattgcggagcaggatgatcgtattagacgtgctattggaaaagctaattgcacaaaatttttggccaattttccagatggattgcagactatggttggtgctagaggcgcgcaattgtccggtggtcaaaagcaaagaattgcattagctagagcgtttttactagatcctgccgtccttattttagatgaagcaaccagtgcccttgactctcaaagtgaagaaatagttgccaaaaatcttcagagacgtgtggaaagggggttcactactatatcaattgcacataggctttcgacgatcaaacacagtactagggtgattgtgttaggaaaacatggctcagtggttgaaaccggttcattccgagatctaatcgccattcctaatagtgaactaaatgcgctgcttgccgaacagcaggacgaggaaggaaaagggggagtgatagatttggacaatagtgttgcccgggaagtataa

SEQ ID NO: 46021 - DNA, 1491 bp, Saccharomyces cerevisiae
atgtcaatgagtaatattgttgtttttggaggggactcgcaccccgagttagttactaagatctgtgaaaatttggacattcacccatcgaaagtagaattagggaagttttctaatggggaaacgaacattgctcttcgcgaatctgttcgtgaaaaggatgtatatatcatccagagtggttgtggccaggtgaacgacacgttcatgcagttgctgattttaatcagtgcctgcaagtccgcttctgcctcgagggttacagccgtaatgccatatctctgctactcgagacagccagatattccatatactgccaagggtgctcccataatttccaagcctaaagaaaactatacttttgaatcgcatccaggcacacccgtgtcatcttctttaatgacgcaaagaccaggtgctgagagctcgttgaagagtttggatagtgcaatacgatcaactatcaacttagaaaatcctcaacctatcagaacaccaaacagcagtgctacggcgaataacaatttcgacatcaagaagacgctttctttttcaagaattcctatgattcccggtggtaagttacaaaatacaagcaatagcacggacgctggtgaattgttcaacgctcaaaatgcaggctataagctatgggtagtacaagccggtactttgattgctcatttgttgagtgctgcaggtgctgaccatgtgatcacaatggatttgcacgatccacagttccctgggttttttgacattccagtggataatctctactgtaaacccattgcacaaaactacatccagcatcgcattccagattatcaggatgctgtgatcgtttctccagatgctggtggtgcaaagagagctacggctattgcagacgccttggaattgtccttcgccctaattcataaagaaagaagatctcagttattgaagggccctccagatgcgacgttaacctctggtggttcgttaccagtatctccaaggccattagttactactttggtttcctcccaaaatactacttcttcaggtgccactggggttgcggcccttgaaatgaagaaaacaacttcaacatcttccacctcgtcgcaatcttctaattcgtccaagttcgttcaaactaccatgcttgttggcgatgttagaaacaaggtgtgtattatagtcgacgacttggtggatacttcatacactattacaagagctgcgaaattgttgaaggatcaaggatctaccaaagtttatgccttaataacgcacggtgttttttccggtgatgcgctagaaagaatcggccaaagtagtatagataagttgatcatttctaacacggttcctcaagatagaacactacagtacctaggtaaggacagagtggatgttattgatgtctcctgcataatcggtgaagcaattagaagaatccataacggtgaatccatttctatgttgttcgagcatggatggtag

SEQ ID NO: 46022 - DNA, 1323 bp, Saccharomyces cerevisiae
atgcttgctgtcagaagattaacaagatacacattccttaagcgaacgcatccggtgttatatactcgtcgtgcatataaaattttgccttcaagatctactttcctaagaagatcattattacaaacacaactgcactcaaagatgactgctcatactaatatcaaacagcacaaacactgtcatgaggaccatcctatcagaagatcggactctgccgtgtcaattgtacatttgaaacgtgcgcccttcaaggttacagtgattggttctggtaactgggggaccaccatcgccaaagtcattgcggaaaacacagaattgcattcccatatcttcgagccagaggtgagaatgtgggtttttgatgaaaagatcggcgacgaaaatctgacggatatcataaatacaagacaccagaacgttaaatatctacccaatattgacctgccccataatctagtggccgatcctgatcttttacactccatcaagggtgctgacatccttgttttcaacatccctcatcaatttttaccaaacatagtcaaacaattgcaaggccacgtggcccctcatgtaagggccatctcgtgtctaaaagggttcgagttgggctccaagggtgtgcaattgctatcctcctatgttactgatgagttaggaatccaatgtggcgcactatctggtgcaaacttggcaccggaagtggccaaggagcattggtccgaaaccaccgtggcttaccaactaccaaaggattatcaaggtgatggcaaggatgtagatcataagattttgaaattgctgttccacagaccttacttccacgtcaatgtcatcgatgatgttgctggtatatccattgccggtgccttgaagaacgtcgtggcacttgcatgtggtttcgtagaaggtatgggatggggtaacaatgcctccgcagccattcaaaggctgggtttaggtgaaattatcaagttcggtagaatgtttttcccagaatccaaagtcgagacctactatcaagaatccgctggtgttgcagatctgatcaccacctgctcaggcggtagaaacgtcaaggttgccacatacatggccaagaccggtaagtcagccttggaagcagaaaaggaattgcttaacggtcaatccgcccaagggataatcacatgcagagaagttcacgagtggctacaaacatgtgagttgacccaagaattcccattattcgaggcagtctaccagatagtctacaacaacgtccgcatggaagacctaccggagatgattgaagagctagacatcgatgacgaatag

SEQ ID NO: 46023 - DNA, 1263 bp, Saccharomyces cerevisiae
atgtctaagggaaaagtttgtttggcttattctggtggtttagatacctccgtcattttggcttggctactagaccaaggctacgaagttgtagctttcatggctaatgtagggcaagaagaagatttcgatgccgccaaggaaaaggccttgaagatcggtgcctgcaagttcgtttgtgtggattgtcgtgaagattttgtcaaggatattctattcccagctgtacaggtcaacgctgtgtacgaagacgtttatctgttgggtacctctttggcaagacctgttattgccaaagcccaaattgacgtcgctaaacaggagggctgtttcgcggtctctcatggttgtaccggtaaaggtaatgatcaaatcagattcgaattgtcattttacgctctgaagccagacgttaagtgtattacaccatggagaatgcctgaatttttcgaaagatttgctggcagaaaggatttgttagactatgctgcacaaaagggtattcccgtcgcccaaaccaaggccaagccatggtctactgacgaaaaccaagcccacatttcttacgaggcaggtatcttggaagacccagataccaccccaccaaaggacatgtggaaattgatcgtcgatccaatggatgctccggaccaaccacaagatttgaccattgactttgaacgtggtcttccagtcaagttgacctacaccgacaacaagacttccaaggaagtttccgttaccaagcctttggatgttttcttggccgcatccaacttagcaagggccaacggtgttggtagaatcgatattgtagaagatcgttacattaacttgaaatccagaggttgttacgaacaggctccattgactgttttgagaaaagctcatgttgatttggaaggtttgactttagacaaagaagtccgtcaattgagagactcattcgtcacaccaaactactccagattgatatataacggtttcctacttcacccagagtgtgagtacatcagatctatgatccaaccatcccaaaatagcgttaacggtactgtcagggttagactgtataagggtaacgtcatcattctgggcagatctacaaagactgaaaagttgtacgatccgacagaatcctctatggatgagttgaccggtttcttacctaccgataccaccggtttcattgccatccaggccattagaattaaaaaatacggtgaatccaaaaaaaccaaaggtgaagagttgactttgtaa

SEQ ID NO: 46024 - DNA, 912 bp, Saccharomyces cerevisiae
atgactgttactgacacttttaaactgtttattttaaggcatggtcaaagtgaattaaactcagaaaacatattctgcggatggattgatgctcaattaacggaaaaagggaagtctcaggcccgccactctgcaaaattgatcaagcagttttgcgattctaacaatatctctttgcctcagattggctatacttcaaggttgattcgaactcagcagaccatggacgttattctcgaagagttgggactaaaacacaccaattatgtaattactacgaatacaaacattaaggaggagctgcaggacacaagatttgaaggaagtatgcctgtgttgcaaacctggaggttaaatgagcgtcattacggcgcatggcaaggacaaagaaagccagatatcttgaaagaatacggtaaggaaaaatacatgtatatcagaagagattacaacggaaaaccccctaaagtcaacctaaacctggaaatggtccaagaggaaaatgatcaggggtcctccacaggctatgattttaaggagcccaatagacacttaaaatacggccccgaagagaaggctaatgagcgtctgccagaaagtgagtctctttgtgaagtggtcgtcagattgaaaccatttttaaataatgttgttctgtctaccgccaacaaaatcagtcaagaatcgtgtgttatagttgggcatggcagctctgtaagatctctgctgaaagtattggaaggtatctcagatgaagacatcaaagatgtcgatattcccaacggcattccgctagttatagagttggatagagacaattactcttttgtgaggaaattttacttggatccagaatcagctaaagttaatgctcaaatggttcgtgatgagggtttcgaaaagaatccatga

SEQ ID NO: 46025 - DNA, 1191 bp, Saccharomyces cerevisiae
atgactgtcaccataaaagaattgactaaccacaactacattgaccacgaactatcagccactttagactcaacggatgcgttcgagggtcccgagaagttgctggaaatctggttcttccctcacaagaagtccatcacgaccgaaaagacattaagaaatattggcatggatagatggatcgagattttgaaattagtgaaatgcgaagttctttccatgaagaagactaaagaactggatgcctttttgttgagtgagtcttccctcttcgtcttcgatcacaaattgacgatgaagacgtgcggtactacaaccacattgttctgtctcgaaaagcttttccagatcgttgagcaagagttatcgtgggctttccgcacaacacaagggggcaagtacaaaccatttaaagtgttttattctagacgatgtttccttttcccctgtaagcaagccgctatccatcaaaactgggctgacgaagtcgactatttgaacaaatttttcgacaatggtaaaagttattccgtgggaagaaatgacaagagcaaccactggaacctgtacgtcaccgagacggaccgctccacacctaagggaaaggagtacatcgaggatgacgacgaaactttcgaagtactgatgacggagctggacccagaatgcgctagtaagtttgtttgcgggcctgaggcatccacaaccgctctcgtggagccaaacgaagataagggccacaacctcggctaccaaatgactaaaaatacaaggcttgacgaaatatatgtcaactcggcccaagactccgatttatcatttcaccacgatgcatttgcgttcacgccatgtggatactcatccaatatgattctcgctgaaaaatactattacaccctgcacgtgactccggaaaagggttggtcttacgcctctttcgaaagtaacatacccgtatttgacatttcccaagggaagcaagacaacttggacgttcttctacatattctgaacgtttttcaaccaagagagttctcgatgaccttttttaccaaaaattatcagaaccaatccttccaaaaactactaagcatcaacgagtcactgcccgactacatcaagttagacaaaattgtttatgatctggacgactaccaccttttctatatgaaattgcagaagaaaatatga

SEQ ID NO: 46026 - DNA, 1143 bp, Saccharomyces cerevisiae
atgagagaggaaagtaggtctaggaagagaaagcatattcctgttgatattgaagaggtagaagttcgatctaagtatttcaaaaagaatgagagaactgttgagttagtaaaagaaaataaaatcaataaagatttgcaaaattacggcggagtaaatattgactggatcaaggcactgaagccaatagagtattttgaatggatcgaatcaaggacttgtgatgatccgagaacttggggacggccaataactaaagaagaaatgattaacgattctggggcgaaagttcctgagagtttcttacccatatataatcgggtgagattaatgaggtccaaggttaaaaccccggtagatgctatgggatgtagcatgattcctgttttagtttctaataaatgtgggatacctagtgaaaaagtcgatccaaagaatttcaggcttcaatttcttattggcactatgctttctgctcaaacgagggacgaaaggatggcgcaagcggctttgaatatcaccgaatactgcttaaacacattaaaaatagcagagggtattacgctagatggactgcttaaaattgatgaacctgtattagcaaatctaattcgatgcgttagcttctataccagaaaagccaatttcatcaaaagaaccgcacaattattggtagacaatttcgattcagatataccgtatgatatagagggaattctctcgttacctggagttggacctaaaatgggatatttaacactgcaaaaaggttgggggctgattgccggcatatgcgtcgatgttcatgtccataggctgtgtaaaatgtggaattgggtagaccctattaagtgtaagactgccgagcatactagaaaggagttacaggtttggctacctcactcactgtggtacgaaataaacaccgttttggttggatttggtcaattgatctgcatggccaggggtaagaggtgtgatttatgtctagcaaacgatgtctgcaatgctcgcaatgagaagctaatcgaatcttccaaatttcatcaattggaggacaaagaagacatcgagaaagtatattcgcattggttggacacggttacaaatggaattacaacagaaagacacaagaaaaaatag

SEQ ID NO: 46027 - DNA, 765 bp, Saccharomyces cerevisiae
atgagtggttacgatagagctttgtccattttctccccagatggacacattttccaagtggagtacgccctggaggcggtaaagaggggtacctgtgctgtaggtgtcaagggtaagaattgtgtagtattgggctgcgaaagaaggtctactttgaagctgcaagacactagaattacgccttccaaagtttccaaaattgactcgcatgtggtgttgtcattttctggtttaaatgcagattccagaattcttatcgagaaggctagagtggaggcccaaagtcacagactaacgttggaggatcccgtgacggtggagtatctcacacgttatgtcgctggtgtgcaacaaaggtacacgcagtcaggaggtgttagaccatttggtgtgtcgacgctgattgccggcttcgacccgagagatgatgaacccaagctttaccagaccgagccaagtggtatatactcttcgtggtccgctcagaccattgggagaaactccaagacggtacgtgagtttttggagaagaattacgatcgcaaagaaccaccagccacagtggaagaatgtgtcaaacttactgtaagatctctgttggaggtagttcaaacaggtgcaaaaaatattgaaatcactgttgttaagccggactcagatattgttgcgttgagcagtgaggaaattaaccagtacgtcacccaaatcgaacaagaaaagcaagagcagcaagagcaggacaaaaagaaaaaatctaaccattaa

SEQ ID NO: 46028 - DNA, 3282 bp, Saccharomyces cerevisiae
atgaccagtctaatagatttgggcagatatgttgaaagaacgcatcatggagaagatacagagccaagatcgaaaagggtaaaaatcgcaaaacctgacttgtcttccttccaaccaggcagcattattaagatccgtttacaggattttgttacttacactttaaccgaattcaatctttcaccgtctttaaatatgatcattgggccaaacggatctggaaaatctactttcgtatgcgcagtgtgtttaggattggctggtaaacccgagtatattggtaggagtaaaaaagtggaagatttcatcaaaaatggtcaagatgtttcaaaaattgaaatcaccttgaaaaattcaccaaatgttactgatattgaatacatagacgcacgtgatgaaacaataaagattaccaggattattacgagatccaagaggagatcggattatctaataaatgactaccaggtatctgagagtgtagttaaaactttagttgctcagctgaacattcagttggataatctttgtcaatttttatctcaagagcgtgttgaggagtttgctcgcttgaagtcagttaaattattagtagagactataaggtcaatcgatgcaagcttattggatgtgttggatgaactaagggaattacaaggaaatgagcaaagcttgcaaaaagatctcgattttaaaaaagctaaaattgttcatttgagacaagaaagtgataaactacgtaaatcagttgaatctttacgagattttcaaaataagaagggtgaaatcgagttacactcccaactattaccttatgtgaaagtaaaggaccataaagaaaagctaaacatatataaagaagaatacgaacgagcgaaagcgaacttaagggctatactgaaggataaaaaaccatttgcaaatactaagaagactttggaaaatcaggtggaagagttaacagagaagtgttccctaaaaactgatgagttcctgaaagcaaaagaaaagatcaacgaaatcttcgaaaaattaaatactattagggatgaggtcatcaaaaagaaaaaccagaacgaatattatagaggaagaaccaaaaaactacaggccaccattattagtacaaaggaagattttctaaggagtcaggaaatattagcacaaacacatcttcctgagaaaagcgtatttgaagatatagacattaaaagaaaggaaattattaataaagaaggcgaaattagggatcttatttccgaaattgatgcgaaggcgaacgctattaatcatgagatgagaagcatacagagacaagctgaaagcaagaccaaatcccttacaacaactgataaaatcggtatcttaaatcaggaccaggatttaaaggaggtccgtgatgctgtgttgatggttagagagcatccagaaatgaaagataaaattctagaaccgccaataatgaccgtgtctgccattaacgctcaatttgctgcatatttagcacaatgtgtggattataatacgagtaaagccttgactgttgttgattctgattcttacaagctatttgcaaatccaattcttgacaaattcaaggttaatttgagagaactctccagtgcagacaccacccctcctgtaccagcggaaacggtgagggacctgggatttgagggttatctatccgattttattaccggtgataagagggttatgaaaatgctttgtcaaactagcaaaattcatactataccggtatcaagaagggaattgacgcctgctcagataaagaagttgattacaccaagaccgaatgggaaaattctttttaaaaggattattcatgggaataggttagtcgatatcaagcaatcagcatatggtagtaagcaggtctttcctactgacgttagtattaaacaaactaatttttatcagggatcaatcatgtcaaatgagcagaaaattagaattgaaaatgaaattatcaacttaaagaatgaatacaacgatcgaaaatctacgttagatgcattgtcaaaccagaaaagtggttataggcacgaattatctgagttggcgtcaaaaaacgacgatattaatagggaagctcatcaattaaatgagattcgcaagaagtacactatgagaaaaagtacaatagagactttaagagagaaattagatcaactgaaacgtgaagctagaaaggacgtatctcaaaagattaaagatattgatgatcagatccaacaactattactcaagcaaagacatttgctgtctaaaatggcctcttcaatgaagagtttaaagaattgtcagaaggagttaataagtactcaaatccttcaatttgaagcccaaaatatggatgtttctatgaatgacgtaattggttttttcaatgagagggaagctgatttgaagagccaatatgaagacaagaaaaagttcgtaaaagaaatgagagacactcctgaatttcaatcatggatgagagaaatcaggtcttatgaccaagacactaaggaaaaattgaataaagtggcagaaaaatacgaggaggaagggaatttcaatctgtcattcgttcaggatgttctcgataaattagaatcggagatagctatggtaaaccacgacgagtcagccgtaacaattttggatcaagtcacagccgaactgagagagttggagcacacggttcctcagcagtcgaaagacttggagaccattaaagctaaattaaaagaagatcacgcagttttggagcccaaattagatgatattgtatcaaaaatctctgcaagatttgcgcgcttattcaacaatgttgggagtgctggtgcggttcgtctagaaaagccgaaggactatgctgaatggaagatagaaatcatggtaaaattcagagataatgcacctttaaaaaagttagattcccacacgcaatcaggtggtgaaagagctgtttctacagttctttacatgattgctttgcaagagtttacctctgcaccatttagagtggttgatgaaatcaatcaaggtatggactctagaaatgaaaggatcgttcataaagctatggtggagaacgcgtgtgccgaaaacacttctcaatattttttaatcactccaaaattattgactggcttgcattatcatgaaaagatgagaatacactgtgtcatggctggttcttggattccaaacccttctgaggatccgaagatgatacatttcggtgaaacttctaactactcattcgattaa

SEQ ID NO: 46029 - DNA, 1611 bp, Saccharomyces cerevisiae
atgatcatgttgagaataccgacacggtcttattgttcaccttcgaagctaataaagggcgtaggtctctcaccattgaagaaatctctgttatccaagaaaataaaggaagatatccatccttctttacctgttagaactaggtttgcgccttctccaactgggtttttacacttggggtcactgagaacagccctttacaattacctattagcaagaaacaccaatgggcagtttttgcttcgtttagaagatacagaccagaagaggctaatagagggagcagaagaaaacatctacgagattctgaaatggtgtaacataaactacgatgaaacccctataaagcaaagtgaaaggaaactaatatatgacaaatatgtaaaaatattactatcttctgggaaggcgtatagatgtttttgttcaaaggagcgattgaacgatttgagacactctgcaatggaattgaaacctccttcgatggcaagctatgatcgatgttgtgcacacttaggggaggaagaaataaaatctaagctagcgcaaggtatacctttcactgtgcggtttaaatcgccagaacgatatccaacgtttactgatcttttacatggacaaataaatcttcaaccgcaagtaaactttaacgataaacggtacgatgaccttatccttgttaagtcggataagttgccaacctatcatctggcaaatgttgtggatgaccatttgatgggaataacccatgttataagaggtgaggaatggctgccctctactcctaaacatatcgccctatataatgcatttgggtgggcttgcccaaagttcatccacattcccttattgacgacggttggtgataagaaattgagtaaaagaaaaggtgatatgtctatctcggatttaaaaagacagggagttttgccagaagctttgattaacttttgtgcgctatttggctggtctcctccaagagatctggcttcgaaaaagcatgagtgtttttcaatggaggaattggaaaccatttttaatttgaatggtttgacgaagggaaatgccaaagtcgatgataaaaaattgtggttcttcaataagcattttttgcaaaaaagaatacttaatccttctacattgagggagcttgtcgacgacattatgccttctttagagtccatatataacacatctaccataagccgtgagaaagtagctaaaattttactgaactgtggtggttctctatcaaggattaacgattttcatgatgaattttattatttttttgaaaagcccaaatataatgataatgatgctgtcacgaaatttctaagcaagaacgaaagccgccacattgctcacttattgaagaagcttggacagtttcaagagggcaccgatgctcaagaagtcgaatctatggtcgaaacgatgtattatgagaacggtttttctaggaaagtcacgtatcaggcaatgagatttgctcttgcgggatgtcacccaggtgccaaaatagcagccatgatagatattttgggcatcaaggaaagtaacaaaagattatccgaaggtttacagttcttgcaaagagagaaaaagtaa

SEQ ID NO: 46030 - DNA, 2031 bp, Saccharomyces cerevisiae
atgctcagaagacacggattattctggttaaagacatgtccccgtctaaatgttcttctaaatcaatccataccgatacctcatttgcttcatagccgtgatatttgccagcaaagatggtatgcaaaagggaaaagaaggaaccagatttccaagaaagagttaaagcctctcaatttttctattccgaattatatttctgtgaataaattggccaatttgttaaattgtcgtgtggaaagattaatcaaagatttgacagcattaggtttcgaaaatattacaaccacgtatatattatcaaaagaatacgtcgaattgattttacaagaatacaactttgcccttccgaatctgtcaacgtctacaaatttagataatgtttatgatgagctaaaatctcctgtaaacccaaaattattaaccaaaagagcccccgtggtaactataatgggccatgttgatcatggtaagaccactatcatagactatctaaggaaatcttctgttgtggctcaagaacatggtggaatcacgcaacacattggtgcctttcaaataacagctccgaagtctgggaaaaagatcacatttttagacacccctggccatgctgcctttttgaaaatgagagaaagaggtgcaaatattactgatattattgttttggtggtatctgtagaagattctctgatgccccagacattagaagccataaaacatgccaaaaattcaggaaatgaaatgataattgcaataacgaaaatagatagaattccacagccaaaagaacgtgaaaaaaaaattgaaaaagttataaatgatttgattgttcaaggaataccagtagagaaaattggcggagacgttcaagtgatcccgataagtgccaaaactggtgagaacatggaccttttagaggaatcaatagtcctattaagtgaagtaatggatataagagctgaaaactcccctaaaactatcgcagagggttggattatcgaaagtcaagttaaaaaacaggtcggaaatgtggcgaccgtcttggttaagaagggcactttacaaaaagggaaaattctaatttgtggtaatacattctgcaagatcaaaaatttaattgatgataagggcataccgattcttaaggcaacaccatcatatgctacagaggttcttggttggaaagatgtaccccatgttggagatgaggtcattcaggtaaagagcgaagcgatcgctaaaaagttcatcagtaaaaggcaagatcttatcgaagttcaaaaaaactctagtatcgttgaaaaattaaatgaagaaagggcccttgccaaagagcaacacctaaataaggaactggaacatgagaatactgtccaggaacacgaacaaaatactggtcctaaacttattaattacatcatcaaatgtgatgtctctggctcagcagaagcggtttcagaaagcatttcctctctaggaaatgacgaagtgagatgtaatgttatctcttcttctgttggtatacctacggaaagtgacttaaagatggcgcaaataacggagagtacaattctatgcttcaatttggggaatttgccgagtgaggtgatcaacaatcgtgctggcatcaaaataaaacagtacaatgttatctataagctaattgaagacgtcactgaaacactaactgaaaatctaaagcccatctttgaaaaaaagatcgtttcaactgttgacgttcgtgaaacttttgactttaggttaaagaaaaaaattattaggattgcaggttgcaaagtaaacaacggtgtcatcaaaaagaattcattggtgcaggtagttagaggtcctaacgaagatgtaatttttgatgggaaaatctctactttgaagcacaataaagatgacgtagcagaagtttcaaaagggcatgaatgtggaatcacttttgagagtggattcgagggtttcaaaccaggtgataagatcctagtttatgaaaacgtgcgagttcctcgttacttgtaa

SEQ ID NO: 46031 - DNA, 3006 bp, Saccharomyces cerevisiae
atgtcagttcccgctatcgcccccagacggaagagacttgcagatggtttaagcgtcactcagaaggtgtttgtaaggtctcgtaatggaggcgctaccaagatcgtaagagaacactatttaagatcggacatcccatgtctttcgagaagttgtaccaagtgtccgcaaattgtcgtccccgatgctcaaaatgagttgccgaagttcatcttgtcagattctcccttagaattaagcgcacccattggtaagcattacgtcgtcttggataccaacgtggtgttacaggcaattgaccttttagagaatccgaattgttttttcgacgtcattgtcccccagattgtcctagatgaagtgagaaacaagtcatatccggtgtacacgagattaagaactctatgcagagatagtgacgatcataagagattcatcgtgtttcataacgaatttagtgaacatacttttgtggaaaggcttccaaatgaaacgattaatgacagaaacgacagggctataaggaaaacctgtcaatggtatagtgagcacttgaaaccttatgacataaacgtcgttcttgttaccaacgatcgtttgaatagagaagctgccactaaggaagtggagtccaatataataaccaagagcttggtacagtatatcgagttactaccaaatgcagacgacatcagagactctattcctcaaatggattcttttgataaagatcttgaaagggacacattttcagatttcacgttcccggagtactattctacagcaagagtaatgggtggtttgaaaaatggcgttttgtaccagggcaatattcaaatatcagagtacaactttctagaaggttcagtgagtttaccaagattttccaaaccagtgttaattgttgggcagaaaaacctaaatagagcattcaacggtgaccaggttatcgtggaactgctacctcaatcagaatggaaggcaccctcatccattgtcttggattctgaacatttcgacgttaacgataaccccgatattgaggctggcgatgacgatgacaataatgagtcctcttccaataccaccgtgatttccgacaagcagcgcaggctgcttgctaaagatgctatgatagctcaaagatcgaaaaaaattcagcccacggcaaaagttgtatatatacaaagaagatcctggagacagtacgtcggtcaactagcaccaagttctgttgatccacaaagcagtagtacacagaatgtcttcgttattttgatggacaaatgtcttccaaaagtcagaatcagaacaaggcgtgctgctgaattattggataagaggattgtcatttccattgattcgtggcccaccactcataaatacccattaggtcactttgtgagagacctcggtacaattgaatctgctcaagctgaaacagaggccttattgttggagcatgatgttgaatataggcctttttccaagaaagttctagaatgtttgcccgcagaaggccacgattggaaggccccaacaaaactggacgatcctgaggctgtttcaaaggatccattattgacaaaaagaaaggatctcagagataaacttatatgtagtatcgatcctccaggatgtgttgatattgacgatgccctacatgcgaaaaagcttccaaacggtaattgggaagttggtgttcatattgctgatgttactcacttcgttaaaccgggcactgccctggatgcggaaggtgctgcaagaggtacttctgtatatttggtagacaaacgtattgacatgctgcccatgcttctaggtaccgacctgtgttctctaaaaccatacgttgatagattcgcattctctgtcatttgggaattggatgatagtgctaatattgtaaatgttaattttatgaaatccgtcatcagatctagagaagctttctcatacgaacaagcacaactgagaattgatgacaaaacccaaaatgatgaattaacgatgggtatgagggctctcttgaaattgtctgtaaaactgaagcaaaagagactagaggcaggtgccttgaacttagcttctcctgaggttaaggtccatatggatagtgagacttcagatccaaatgaagtggaaatcaaaaaattactggcgacaaattctttagttgaagaatttatgttgttggctaatatatcagtggcaaggaagatatacgatgccttccctcaaacggcgatgctaagaagacacgcagctccgccatctaccaattttgaaatcttaaatgaaatgttaaacacaagaaagaatatgtcaatttcgttggaatcgtccaaggccttggccgattctttagacaggtgtgtggatcccgaagatccatattttaatacattggttcgtatcatgtcgactcgctgtatgatggcagcccaatacttttattctggagcttattcttatcctgactttagacactatggtttagccgttgatatctacacacatttcacatcacctattagacgttactgtgatgttgtggcccatagacaattagcaggtgccattgggtatgaacccctaagtttgactcatcgtgataagaataaaatggacatgatttgcagaaatatcaacagaaagcacagaaacgcccaattcgccggtagggcaagcatagaatactatgtcgggcaagtaatgaggaataacgagtccacagaaactggatatgttattaaggtatttaataatggtatagtcgtactggttcccaagtttggcgtggaaggcttgataagactggataatttgactgaggatcctaactcagccgcttttgatgaggtggaatacaaattaacctttgtgcctacaaattcagataaaccgagggatgtttacgttttcgataaggtcgaagttcaagttaggtcggtgatggatccaattactagcaagcgtaaggcagaattattgttaaaatag

SEQ ID NO: 46032 - DNA, 1779 bp, Saccharomyces cerevisiae
atgaccgaagactttatttcttctgtcaagcgttcaaatgaggagctgaaggagcgaaaatctaactttggatttgtagaatacaaatccaagcaattaacatcatcctcatcacacaattcaaactcatcgcatcacgatgatgacaaccaacacggcaagaggaatattttccagcgatgtgttgattctttcaagtctcctctggacggctcgttcgacacaagtaatttgaagaggactctgaaaccaaggcacttaatcatgattgccattgggggcagtataggtactggtttgtttgtcggtagtggtaaggcaatcgccgaaggtggtcctcttggtgtcgtcattggttgggctattgcaggctctcaaatcatcgggacgattcatgggctaggtgaaatcacggtgcggttccccgttgtcggggcctttgccaattacggcacaaggtttttggatccaagtataagttttgttgtttcgaccatatacgtgctacagtggttttttgtattacccttagaaatcattgcggcggcaatgaccgtacagtactggaactcgtctattgaccccgtaatttgggtagccatcttttatgctgttattgtttccataaatttgtttggtgtacgaggttttggggaagcggaatttgcattttccaccataaaagcaataacagtttgcggattcattatattgtgcgttgtcctcatttgcggtggaggtcccgaccacgagttcattggcgccaaatactggcacgaccctggttgtttggccaatgggttcccgggcgttctatctgttcttgttgttgcttcgtattctctcggtggtatagaaatgacgtgcctggcatcaggtgaaacggaccccaaaggcttaccaagtgctatcaagcaagtgttttggaggatcttatttttctttttgatatcactgaccctggtaggattcctggttccatatacaaaccaaaacttactgggtggttcatctgtggacaactcaccttttgtcattgccataaaattgcatcacattaaagccttgccctccatcgtcaatgcggtcatccttatcagtgttttgagtgtaggtaactcctgcatcttcgcttcaagtagaacgttgtgttcgatggcccaccaaggccttattccatggtggtttggttatatcgaccgtgctggtaggccactggttggcattatggcaaattcactatttggattactagcatttctggtcaaatctggctcgatgtctgaagttttcaattggttaatggccattgccggcctggccacgtgcattgtctggttgagcatcaacctgtcacatatcagatttagactggcgatgaaggctcaagggaagtctctggatgaattagaatttgttagtgctgtcgggatttggggatcagcgtattccgctttaatcaactgtctaatcttgatagctcaattctattgttcactatggcccattggtggctggaccagcggcaaagaaagggctaaaatattttttcaaaattatctgtgtgccttaatcatgttatttatattcatcgtccacaaaatttattacaagtgtcaaacaggcaaatggtggggggttaaggcgttaaaggacatagatttggaaaccgatcgtaaagatatcgacatcgaaatagtcaagcaagaaattgccgaaaagaaaatgtacctagattcccgtccatggtacgtgagacagttccatttctggtgttaa

SEQ ID NO: 46033 - DNA, 1344 bp, Saccharomyces cerevisiae
atgcccaaggagtcagaggtcataaattctgaatttcatgtagatgtccaagatccagagcgtctaaacggccaccctgtagcaaaatttatcaataaattaagcggtcaacctgaatcttacgtcaacaggactaattatattttcggtcgaacactgggtgccggttccttcggtgttgtgagacaagccagaaagttgtccacaaatgaagatgttgctataaagatcttattgaagaaggcattgcagggaaacaatgtgcaattacagatgctgtacgaagagctgtccattcttcaaaaattgagtcatccgaacattgtgtcattcaaggattggtttgaatcgaaggataagttctatattgtcactcagctggcaacaggaggtgaattatttgatagaattctgtctagagggaagttcacagaagtggatgctgttgaaatcatagttcagattcttggtgccgtggagtatatgcattccaagaatgttgttcatagggatttgaaacctgagaacgttttgtatgttgataagtcagaaaattcgcctctggtaattgcggacttcggtatagctaaacaattgaagggggaggaggatttgatatacaaagcagccggatcgttgggttatgtggcaccagaagtcctcacacaagatggacatggtaagccttgtgatatatggtccattggtgtgatcacatatactttactgtgcggttattctccttttattgccgaaagcgttgaaggattcatggaggaatgtacagcttcgagatacccggtaaccttccatatgccatattgggataacatatctattgatgttaagcgtttcatcttgaaggcattgagattgaatccagctgacagaccaactgctacggaattgctggacgatccatggattacttcaaagagagttgaaactagtaatattttaccagacgttaagaaagggttttctttgcgtaagaaattacgtgacgctattgaaattgtgaagcttaataatagaattaagaggttaagaaatatgtattcattaggggacgatggcgataacgatatagaagagaattccctcaatgaaagtcttctggacggcgtcacacattcgttggatgatttacgtctgcaatctcagaagaaagggggagaactaacagaagagcaaatgaaattgaagtctgcattaacaaaggatgcctttgttcaaattgtcaaagctgcaacaaagaataaacataaagttttggctggtgaagaggaagacgatagcaagaaaacactgcatgatgatcgggagtcgaagtcagaagactaa

SEQ ID NO: 46034 - DNA, 2061 bp, Saccharomyces cerevisiae
atgatacgtccattatgttcaaaaattattatcagttacatattcgcaatttctcagtttctactggccgctaatgcgtggtcgcccacagatagttatgttcctggcaccgtgtcgtgtcccgatgacataaatctggtaagagaggctacgtctatatctcagaatgagagcgcatggttggaaaagaggaataaagtcactagtgtagctttaaaagatttcttgactagggctactgcaaatttttcagatagctcagaagttttgtcgaagctatttaatgatggcaacagcgaaaacctgccgaaaattgctgtcgccgtttcaggtgggggctatcggtccatgctaacaggtgcgggtgttctagcagcaatggataacagaactgaaggtgcttatgagcatgggctgggtggacttttacaaagcacaacatatttatctggtgcctcgggcggcaactggctagttggtacattagccttgaacaattggacatccgtgcaagacattcttaataatatgcagaacgacgattctatttgggatttgtcagattctattgttacccccggcggcattaatatattcaaaacagccaaaaggtgggatcatatctctaatgctgtcgaatctaagcagaacgccgattacaatacttctttggccgatatttggggcagagccttggcgtataattttttcccttctctaaatagagggggtataggcctgacttggtcttccattagggatttcccagtgtttcaaaatgctgaaatgccttttccaatttctgttgcggacggtaggtatcctggaacaaaagtcatcaatttgaacgcaacggtttttgaatttaatccctttgaaatgggatcctgggatccctctttgaactcttttgccaacgttaagtaccttggaacgaatgtctccaatggtgtaccattggaaaggggaaaatgtaccgcaggctttgataatgcaggttttatcatgggtacttcctccaccttatttaaccagtttcttttgagaataaactccactcacttacctagtttcatcacaagattagcaagacattttctaaaggatttatctcaagattttaatgatatcgctgtttacagtcctaatccatttaaagacacgaagtttttggatagtgactatacgacaagtattgttgattcagacagcctattcttagttgacggcggtgaagacgacgaaaatgttcctgtgttaccgcttatacaaaaggaacgtgatgtggacattatttttgcggtagataattctgccgatatgagattggcttggcctgacggttcttctttagtccatacctatgagcgtcaattcgttaagcaaggtcaaggtatgtccttcccatatgttccagatacgaatacattcgttaatttgggtttgaacaagaaaccaaccttcttcggttgcgatgctaataatttgaccgatcttcaatatattccacctctagttgtttatctgccaaatgcagaatactctttcaatagtaatcagagcgcgttcaagctatcatattccgaatcccaaagaagaagtatgattcaaaacgggtttgaaattgcaactaggaacaacttcactgatgatcctgaattcatgggctgcgtcggctgcgccatcattagacgtaagcaacaagctttgaatattactttgcctccggaatgtgaaacctgttttaaaaattattgctggaatggtaccctggatactaccccattaccagatgttgaaaaggatgttcaccactcctttatcaacgtcaatagcttcaacagctccataggacaagaagaaagtctttacgccggatcttcagcttcccagtcatcgtcttcatcatcgtcttcatcttcgtcttcggaaattccttcggctactgcaacccttgagaaaaaggcagctactaattctggatcacatttatctggcataagtgtaaagttctctgctatgattatgcttactttattgatgtttaccggagcagtataa

SEQ ID NO: 46035 - DNA, 2310 bp, Saccharomyces cerevisiae
atgactattgctgatgcttccaaagttaatcatgagttgtcttctgatgacgatgacgatgtgccattatctcaaactttaaaaaaaagaaaggtggcgtccatgaactctgcctctcttcaagacgaagcggaaccttatgatagtgatgaggcaatctctaagatttccaagaaaaagactaagaaaataaagaccgaaccagtgcaatcgtcgtcattaccatcgcctccagcaaagaaaagcgcgacatcaaagcctaaaaaaatcaagaaagaagatggtgatgtaaaggtaaaaacaactaaaaaggaagaacaggagaacgaaaaaaagaaacgagaagaagaagaagaggaggacaagaaagcgaaggaggaggaggaagaatataaatggtgggaaaaagaaaacgaagatgacaccataaaatgggtcacactgaagcataacggtgttatattccctccaccataccagcccttaccatctcacatcaaattatattacgatgggaagccagtagatttacctccgcaagctgaagaagtagccgggttctttgctgccctattagagagtgatcatgccaaaaatcctgttttccaaaagaacttcttcaatgatttcttgcaagtactgaaagaaagtggtggtcccctcaatggaattgagataaaggaattttctcgttgcgatttcaccaaaatgtttgattacttccagttacaaaaagaacagaaaaagcaactgacttcccaagaaaagaaacagattcgtttggaaagagaaaaattcgaggaagattataaattctgtgaattagatggcagaagggaacaagtagggaatttcaaggttgaacctcctgatctatttagaggtcgtggcgctcacccaaaaacaggcaaattgaagagaagagtgaatcctgaggatatcgttttaaatctaagtaaagacgcacccgttccgccagccccagaagggcacaagtggggtgaaatcagacacgacaataccgttcaatggttagccatgtggagagagaatattttcaactcattcaaatacgtcagattggcagcgaactcttcattgaagggtcaaagtgactacaagaagtttgaaaaggcgagacaattgaaatcctatatcgatgccatcagaagggattacacgagaaatttgaaaagcaaagttatgctagagcgccaaaaggccgtagccatttatttgatcgatgtattcgctttaagagccggtggtgaaaaatccgaagatgaagccgatactgtgggttgttgttcattgcgatatgagcatgttactttgaaacctccgaatactgttatctttgatttcttaggtaaggattctattagattttatcaagaggtagaagttgacaaacaagttttcaaaaatttgacaatttttaaaaggccgcccaaacagccaggacatcaactgtttgatcgtctagatccatctatactgaacaaatatctacaaaactacatgccgggattgactgctaaagttttccgtacatataatgcttccaaaacaatgcaagatcaactggatctaattccaaataaaggatctgtcgcagagaaaatattgaagtacaacgcagcaaatagaactgtagccatcctatgtaaccatcaaaggactgtcacgaaggggcatgcacaaacagtggaaaaggccaataatagaatacaagagttggaatggcaaaagattcgttgcaagagggccattttacaattggataaggatcttttaaagaaagagccaaaatatttcgaagaaatcgacgatttgacgaaagaagatgaagccaccattcacaagagaattattgatagagaaattgaaaaatatcagcgaaaatttgttagggagaacgataagaggaaatttgaaaaggaagaattattgccggaaagtcaattgaaggaatggttggagaaagtcgacgaaaagaaacaagaattcgaaaaggaattgaaaaccggtgaagtggaactgaaatcaagttggaattcagtcgaaaaaataaaagcacaagtagagaaattagaacagcgtatccaaactagttccattcagttgaaagataaagaggaaaactcccaggtttcactgggcacttccaaaatcaattatatagaccctagactttctgtggtattttgcaaaaagtatgatgttccgattgaaaagatttttacaaaaaccctaagagaaaaattcaaatgggccatagaatcggtagatgaaaattggaggttttaa

SEQ ID NO: 46036 - DNA, 882 bp, Saccharomyces cerevisiae
atggaaagcacatcaggagaacgttccgaaaatatacatgaggatcaagggataccaaaagtaattctgcccgctgattttaataaatgctctagaactgacctagtggtgctcatatcacgaatgttagtatcgctgatagcaatcaatgaaaattcagcaacaaagaaatctgatgaccaaattactttaacacgataccattctaagattcctccaaacatatcaatcttcaactatttcatacgactgacaaagttttcctctttagaacattgtgtgcttatgacatcactctattatatcgatttattgcaaactgtgtatcctgattttacgcttaattcgttgactgcccataggtttttattaacagccaccacagtcgcaacaaaaggcttatgtgattcgttctcaacaaacgcccattatgcaaaagttggaggagtacgatgtcacgaattgaatatactggagaacgattttttaaagagagtaaactacagaatcattccgcgggatcataacattacgttatgtagtatagagcaaaaacagaaaaagtttgtcatagataaaaacgcattagggtctctcgatttggattcttattcttacgttaatcgtccaaaaagtggatataatgttctagataaatactatcgaagaatagttcagctggtgggttcctttaacgcttcacctgataagagtagaaaggttgattatgttctcccgccaaatattgatatagtgagtgaaagtggctcccaaactactcaactaaaggggtcgtcatcacccaattctcactcttcacaaaagcgatattctgaggcaaaggacgcacatatctataacaagcgatcaaagccagattaa

SEQ ID NO: 46037 - DNA, 1137 bp, Saccharomyces cerevisiae
atgagaccgaacaaaacaagtctgcttctggcgttattatccattttatcgcaagcgaacgcctatgaatacgtgaattgttttagctcactaccctctgacttttcaaaggccgattcatataactggcagtcgagttcacactgtaacagtgagtgtagcgcaaaaggtgcaagctactttgccctttataatcattcagaatgttattgtggtgatactaatccatctggttcggaatctacttcctcttcatgtaatacgtattgctttggttacagcagtgagatgtgtggtggtgaagatgcctattctgtgtaccaacttgactctgacacaaatagcaatagcataagcagctcagattcaagtacggagtctacttctgcgtcgtcttccacaacttcttcaacaacgtcctccacaacatcaactacatcatcgactacatcatcaactacatcatcaatggcgtcttcctctacagtacagaattcccccgagtcaactcaagcagctgcctctatttcaacgtcacagagttcgagcactgtaacgtcagaaagctcgctaacttcggatactttggcaacgagcagtactagctctcaatcacaggacgccacttcgataatctattccactacttttcacactgagggcggttccacaatttttgtcacgaacaccatcacggcaagtgcacagaattcaggatcggccacaggtacagctggatctgactctacgagtggaagtaaaactcataaaaagaaagccaatgtaggggcaattgtaggcggcgttgtaggtggtgtagtgggagccgtagccattgctctttgtatcttgttgattgtcagacacattaatatgaagcgggaacaagacaggatggaaaaggaataccaagaggcgataaaaccagttgagtaccctgataaactatacgcctcttcattttcatctaatcacgggccctcttcaggtagcttcgaggaggagcacaccaaagggcaaactgatattaaccctttcgacgactcaaggagaataagtaacggaacattcataaatggcggaccaggagggaaaaacaacgttttaacagtggtcaatccagacgaagctgattga

SEQ ID NO: 46038 - DNA, 1464 bp, Saccharomyces cerevisiae
atggcttactctaaaatcacattactagccgctcttgctgctattgcttacgctcaaacccaagcacaaatcaacgaattgaacgttgttttagatgatgttaagaccaacattgccgactacatcaccctatcctacactccaaattcaggtttttccttggaccaaatgccagctggtattatggatattgctgcgcaattggttgcaaatccaagtgatgactcctacaccactttgtactctgaagtggacttttctgctgttgagcatatgttgactatggtcccatggtactcttctagactgcttccagaattagaagcaatggatgcttctctaactacctcaagttctgctgccacatcttcaagtgaagttgctagctcttctattgcttcatccactagctcttctgttgcaccatcctcaagtgaagttgtcagctcttccgttgcaccatcctcaagtgaagttgtcagctcttccgttgcaccatcctcaagtgaagttgtcagctcttccgttgcttcatcctcaagtgaagttgccagctcctctgttgcgccatcctcaagtgaagttgtcagctcttccgttgcttcatcctcaagtgaagttgccagctcctctgttgcgccatcctcaagtgaagttgtcagctcttccgttgcaccatcctcaagtgaagttgtcagctcttccgttgcttcatcctcaagtgaagttgccagctcctctgttgcgccatcctcaagtgaagttgtcagctcttccgttgcttcttctacaagcgaagctactagttcttctgctgtcacatcttcctccgctgtttcctcttcgaccgagtctgttagctcttcctctgtcagttcttcctcagccgtttcctcttctgaagctgtcagttcctctccagtttcctcagttgtttcatcttcggccggacctgctagctcaagcgttgctccttacaactcaaccattgctagctcttcttccactgcccagacttctatctcgaccattgctccttacaactccacaaccaccaccaccccagctagttctgcttccagcgttattatctcaaccagaaacggtaccactgttactgaaactgacaacactcttgtcaccaaagaaaccactgtctgtgactactcttcaacatctgccgttccagcttccaccaccggttacaacaattctactaaggtttcaaccgctactatctgcagtacatgcaaagaaggtacctctactgcaactgacttctctacactaaagactacagttaccgtatgtgactccgcctgtcaagctaagaagtctgctaccgttgttagcgttcaatctaaaactaccggtatcgttgaacaaaccgaaaacggtgctgccaaggctgttatcggtatgggtgccggtgctttagctgctgttgccgccatgctactatga

SEQ ID NO: 46039 - DNA, 756 bp, Saccharomyces cerevisiae
atggcttacatcaagatcgctttattagctgctatcgctgctttggcttctgcccaaactcaggaagaaattgacgaattgaacgttattttgaatgacgttaagtccaacttgcaagaatatattagtttggctgaagattcttcatctggattttccttaagcagtctgccatctggtgttttagacatcggtttagctttggcttccgccactgatgactcctacactactttgtactctgaggttgactttgctgctgttagcaagatgttgaccatggttccatggtattcttccaggcttctaccagaattggaatccttgttaggaacttctaccaccgctgcctcttctactgaagcttcttctgctgctacttcttccgctgttgcttcctccagtgaaactacttcttctgccgtcgcttcctccagtgaagctacttcttctgccgtcgcttcttccagtgaagcttcttcttctgctgctacttcttctgctgtcgcttcttccagtgaggctacctcttccaccgtcgcttcctctaccaaggctgcctcttccactaaggcttcttcctctgctgtttcttcagctgttgcttcttccaccaaagcctccgccatttctcaaatcagtgatggtcaagttcaagccactagcactgtttccgaacaaactgaaaacggtgctgccaaggctgtcatcggtatgggtgctggtgtcatggccgctgccgccatgttattataa

SEQ ID NO: 46040 - DNA, 4185 bp, Saccharomyces cerevisiae
atgtcaatttcaaagtacttcactcccgttgctgacgggtcactcactttcaatggcgcgaacattcaatttggcgccgatgctcaaggcgagtcaaaaaagagttatgacgctgaggacagcatgccgaatccggcaaatcaactaaatgacataaccttccaagcagaggctggtgaaatggttttggttttgggttatcccacatccactctatttaagactttgtttcatggtaaaactagtttgtcatactctcctccaggctcgattaaatttaaaaataatgagtttaagagcttttccgaaaaatgtccccaccaaatcatttacaataatgaacaagatgtgcatttcccatttctaacggtagaacaaacaattgattttgccttgagttgtaagttcgatattccaaaaggtgagcgcgatcaaataagaaatgaacttctaagagaattcggcctgtctcatgtattgaaaactattgtaggaaatgattttttccgtggtgtttctggtggtgagcgtaaacgtatttctattattgaaacgtttattgctaatggttccgtttatctatgggataattctactaaaggtttagattccgccacagctctcgattttttggaaattcttagaaaaatggcaaaagctactcgttctgtaaacttagtcagaatttcccaggcaagtgataaaattgttgataagtttgacaagattcttatgctatccgattcctaccagcttttctatggtacggtcgatgagtgtttgacttattttcgtgacactttaggtattgagaaagatcctaacgattgtattattgaatatctgacctctatcttaaattttcagttcaaaaataaaaatttggggaatttatcaaattcatcatctgctagcgttctcaaaaccgcaacaggggaagtcactaagtatacttataattctgatttcgatttatatgatcaatggaaacattcttcgtactatagaaatataaagcagcaaatccaggggtcttcaattgatgactccattaaggaagtggatccctctgatgtctcacctatttttaatattccgttgaagaaacaattattattttgcacaaaaagagcttttcaacgaagtttgggtgataaagcttatatgacggcacaatttatttctgtcgttattcaatctttggtcattggttcactgttttacgaaattccgttgactaccattggttcatactcaagaggttctttaacctttttctccattcttttcttcacttttctttctcttgcagatatgcctattgccttccaaagacaacccgtcgttaaaaagcaatcccaacttcacttctatactaactgggttgaaaccctttcaacaacagtgttcgactactgctttaaactttgtttggtaattgtattcagtatcatcctatacttccttgctcacctgcaatacaaggctgcaagatttttcattttcctcctgttcctttccttttacaatttctgtatggtgtccttattcgctttgacgacactagttgctccaaccatttcagttgcaaatttatttgcaggtattctgctactagctatagcaatgtatgcttcttacgtcatctacctgaaaaatatgcatccttggtttgtatggattgcttatctaaatcctgcaatgtacgctatggaggcaatactgtctaatgagctttacaatttgaagctggattgtagtgagacaattgttccaagaggtcctacttacaacgatgttccattttcccataaggcctgtgcttggcaaggtgctactctgggtaatgattacgttagaggccgtgattacttgaagcaaggtttatcctacacgtatcatcatgtgtggagaaactttggtattatcattggtttcctagtattctttattgcctgtactctgtttgcatctcaatatattaagccttatttcaataaggatgaaatagagcgcaacaatagtcgtttgacaagatggctaccatttttgaataaaaagagaggtaccaggtcctctgcaagaaatgacagtaagtatgttggtatcccaaagtcgcactccgtttcgtcttcctcgtctagcctgtcggctgttccatatcagatatcaccctcaaataaggaaatggctctaaacgattataacgagcaacctatcacggaaacagtagagactcaaaagcatatcatctcttggaaaaatatcaactacacagttggtacaaagaaactgattaataatgcatccggtttcatcagttctggtttgaccgccttaatgggtgagtccggtgcaggtaaaactactttgctgaatgtcttatcacaaagagttgagacaggtgttgttagcggcgaaattttgatcgatggccacccattgacagatgaggacgcgtttaagagaagtattggttttgttcaacaacaggatttgcatctagatttgctgtctgtgaaagaatctctggaaatatcatgtcttttgagaggtgatggtgacagggcatacttagacactgtttcaaatttactgaaattgccatctgacattttagtcgctgatttaaacccgactcaaaggaagcttttatctatcggtgttgaacttgttactaagccttcacttttattattcctagacgaaccaacctctgggctggacgctgaggctgcactaacaatcgtcaaatttttaaaacaactttctttacagggtcaggctattttttgtaccattcatcagcctagtaaaagtgtcatcagccattttgacaatattttcttattgaaaaggggtggtgaatgtgtcttctttggaccaatggacgatgcctgcggctatttcatgtctcatgacaacacgctcgtttacgataaagaacatgataaccctgcagatttcgtcattgatgcagtaggtaacagtaactcctcggcagggaaagatacagcggaggaagctcttactttgaacaaagaagccatagattggagtgcattatgggaatcttctgtagaaaagaaactagttaaaaaagaaacagctaggttagaagatgatgctcgtgcgtctggtgttgattacacaacctcattgtggaagcagccttcctacttacagcaattagctcttattacaagaagacaatatatttgtacgaaaagagacatgacttatgtcatggccaagtactgtttgaatggtggcgctggtttgtttatcggtttctcattttggcacattaagcataatattatcggtttgcaggatagtatcttcttctgtttcatggctctttgtgtttcatctccattgatcaatcaaattcaggacaaagccttgaaaacaaaggaagtttatgttgctagggaggcgagatctaacacttatcactggactgttcttcttttgtcacagtcaattattgaactaccactggcacttacaagttccacactatttttcgtctgtgcctttttctcttgtggatttaacaacgctggctggagtgccggtgttttctttttaaactatatgcttttcgctgcttattactcgactcttggtttatggctgatctatactgctcctaatctacaaactgctgctgtttttgttgcgtttatttacagttttacagcatcattctgtggtgttatgcaaccatactctttgtttccaactttttggaaattcatgtacagggtttcgccatacacatattttgtggaaacttttgttagtattctattgcataactgggaaatcaagtgtgacatgtcggagatggttcctggtcaacctctgacggggcaatcttgtggccaatttatggaagctttcatagaagaatacggtggctatctacataataagaacactttcacagtctgcgcttattgtacgtacactgttggcgatgacttcctgaaaaatgagaatatgagttacgaccacgtttggaggaactttggtattgaatgggcttttgttggtttcaatttctttgcgatgtttgctggttactacttaacttacgtggcaagaatatggccaaaggtctttaaaattatcaccaaagtaattccacacagagggaagaagcctgtacagaactaa

SEQ ID NO: 46041 - DNA, 2274 bp, Saccharomyces cerevisiae
atgatgcgtggtttcaagcaaagattaataaagaagaccaccgggtcttcttcttcttcaagcagtaaaaagaaggacaaagagaaggaaaaagaaaaaagttccactacctcatccacatcaaagaagcccgcttcggctagtagctcttcccacgggactactcacagttctgccagcagtaccggatcaaagtctacaactgagaagggcaagcaatctggtagtgttccctcgcaagggaagcatcatagtagctctacatcaaaaacaaaaacagcgacgaccccttcttccagcagcagtagcagtagaagttcaagtgtcagtcgctccggttcaagctccacaaagaaaacaagttcaagaaaaggacaagaacagtccaaacaatcgcaacagccatcacaatctcaaaagcaaggatcttcttcatcatctgccgctataatgaaccccactccagtactcactgttactaaggacgacaaaagcacttctggtgaagatcatgcacatcctactttgctgggggcagtatccgctgttccatcatctcccatttcaaatgcttcaggtacagcagtttcttctgatgtagaaaatggtaatagtaataataacaatatgaatattaatactagtaatactcaggatgcaaaccacgcctcctcacaaagtatcgacattccgagatcatcacactcatttgagagactaccaacacccacaaaacttaaccctgacacagatttagagttaattaagactccccaacgtcattcttcatctagattcgagccatctagatatacgccattaacgaaattgccaaattttaatgaagtttctcctgaagaaagaatccctttgttcattgccaaagttgaccagtgtaacactatgtttgactttaatgatccaagttttgacattcaaggtaaagagattaaaagaagcaccttagatgagctaatagaattccttgtaacaaataggttcacttacacgaatgagatgtacgctcatgtggtgaacatgttcaaaatcaatctgtttagacctattccaccaccagtaaatccagttggtgacatttatgacccagatgaagatgaacctgttaacgaactagcctggcctcatatgcaagctgtttacgaattctttttaaggtttgtggaaagtcctgatttcaatcatcagattgctaaacaatatattgatcaggactttattttaaagttactggaattatttgatagcgaagatatcagagaaagagactgtttgaaaacgacactgcatagaatatatgggaagttcttatcattaagaagctttattcgtcggtcgatgaataatatttttttgcaatttatttatgagactgagaagtttaacggtgtggcagaattgttagaaattttgggttccataattaatggatttgcacttccattaaaggaagagcacaaggttttcttggtgaggatattgataccattacacaaggtccgttgtttatcattataccaccctcagttggcttactgtatcgttcaatttctcgaaaaagatcctttattaaccgaagaggtagttatgggcttactgcgttattggccaaaaataaattccacaaaagagataatgtttctaaatgaaatcgaggatatttttgaagtgatcgaaccgctggaatttattaaagtagaagttccgttatttgttcaattagctaagtgtatttcttctccacatttccaagtggcggaaaaggttttaagttattggaataatgaatatttcttaaacttatgtatcgaaaatgccgaagtcatcctacccattatatttcctgcattatatgaattaacttctcagttagagctagatacagcaaatggcgaagatagcatttcagacccttacatgcttgttgagcaagcaatcaattctggttcgtggaatagggcaattcatgctatggcattcaaggcattgaaaatttttctggaaacaaacccagtattgtacgaaaactgtaatgcattgtacttatcaagtgtaaaagaaactcaacagcgtaaggtgcaacgtgaagaaaattggagcaaacttgaagaatatgtaaaaaatctaaggattaacaatgataaggaccaatacacaatcaaaaacccagaattaagaaacagtttcaacacagcaagtgagaataacacattaaatgaagagaacgaaaatgattgtgacagcgagatacagtga

SEQ ID NO: 46042 - DNA, 321 bp, Saccharomyces cerevisiae
atgtccacccttttgaagtctgctaaatctatcgttccattgatggaccgtgtccttgtccaaagaatcaaggcacaagcaaagacagcatccgggttgtatttacctgaaaagaacgtggagaagttaaaccaagctgaagttgttgccgtaggcccgggctttactgatgctaatggtaataaggttgttcctcaagttaaagttggtgaccaagttttgattccacagtttggtggttctaccattaaattgggtaacgacgatgaagttattcttttcagggacgctgaaatcctggctaagattgccaaggactaa

SEQ ID NO: 46043 - DNA, 1026 bp, Saccharomyces cerevisiae
atgcagatagtacaaattgagcaggccccaaaagactacataagcgacatcaaaataatcccttccaagtcactgcttttgattacgtcttgggatggctctttaacagtctacaaattcgacattcaagcaaagaatgttgaccttttacaatcgctacgatataaacatccgttattgtgctgcaatttcatcgacaataccgatctgcaaatatacgtgggaactgtacagggtgaaattctaaaagttgatttgataggtagtcccagcttccaagctttgacgaacaatgaagccaatttgggtatttgccgaatatgcaaatatggagacgataaactcattgccgcgtcatgggatggcctgatagaggttatcgaccctcgcaattatggtgatggagttattgctgttaaaaatttgaactctaataacacaaaggtgaagaataagatatttactatggatacaaactcctctcgattgatcgttggtatgaacaatagtcaggttcaatggtttcgcctgccactctgtgaggatgataacggaacaattgaagaatcaggactgaagtaccaaataagagatgtcgctcttttaccgaaagaacaagaaggttatgcatgtagcagcattgacgggcgagttgctgtggagtttttcgatgatcagggcgatgattacaactcaagcaaaagatttgcatttagatgccaccgtttgaatttaaaagatacaaacttagcgtatccagtaaattctattgaattttccccccgtcataagttcctatacacggctggctctgatggcataatttcatgctggaacctacaaacccgcaagaaaataaaaaatttcgccaaatttaacgaagacagcgtggttaaaattgcttgttcggacaatattctatgtctggcaacttctgatgatactttcaagacaaacgccgcaattgaccaaactattgaactaaacgcaagttcaatatacataatatttgactatgagaactga

SEQ ID NO: 46044 - DNA, 1770 bp, Saccharomyces cerevisiae
atgtcattgacagccgatgaatacaaacaacaaggtaacgctgcatttaccgctaaggattacgataaagcgatagagctcttcactaaagctattgaagtttctgaaactccaaaccatgttttatattctaacaggtccgcctgttatacttctttaaagaaatttagtgacgcattgaatgatgctaatgaatgtgtcaaaatcaatccatcttggtctaagggttataatagactcggtgccgcccacttaggtcttggcgatctcgacgaagctgaaagcaactacaaaaaagccttggagttggatgccagtaacaaggccgccaaagaaggattggatcaggttcatcgtacccaacaggcaagacaggcacagcctgatttagggttgacacagttgtttgctgacccaaatttaattgaaaatttaaagaagaacccaaaaactagcgaaatgatgaaggaccctcaattagtggctaaactgattgggtacaaacaaaatccgcaagctattggccaagatctgtttactgatccaagattaatgaccatcatggctacattgatgggggttgatttaaacatggatgatataaaccaatcaaactccatgccaaaggaaccggaaaccagtaaaagcactgaacaaaagaaagatgctgaaccacaaagcgattccactacgagcaaggaaaattcctctaaagcaccacagaaagaagaaagtaaggaatccgagccaatggaagttgatgaagatgactctaaaattgaggccgacaaggaaaaggccgaaggtaacaagttttacaaggcacgtcaattcgatgaagctatagagcactacaacaaggcgtgggaactgcataaagatattacctatttaaacaaccgtgctgctgctgaatacgaaaaaggcgaatacgagacagctatttctaccttgaatgatgctgttgagcaaggtagagaaatgagagcggattacaaggtcatttccaaatcatttgcgcgtattggtaatgcctatcacaaattgggtgacttgaagaaaactatagaatactaccaaaaatcattgaccgaacatcgtactgctgacattttgaccaagttaaggaatgctgaaaaagaattgaagaaagctgaggcggaggcgtatgttaaccctgaaaaggcggaggaagcccgtcttgaaggtaaggaatattttaccaagagtgattggccgaatgctgttaaggcttacactgaaatgatcaaaagggcacctgaagatgctagaggatattctaatagagctgctgcactagcgaagttaatgtctttccctgaagctatcgcagattgtaacaaagccattgaaaaagatccaaatttcgtgagagcttatatcagaaaggccaccgcacaaattgctgttaaagaatatgcttccgctttggaaacactagatgcggccagaaccaaagatgctgaagtgaataatggttctagtgcaagggaaattgatcaactgtactacaaggcaagccaacaaagattccaacctggtaccagtaacgaaaccccagaagaaacctatcaaagggccatgaaagatcctgaagtggctgcgatcatgcaagatcctgttatgcaaagtattttgcagcaggcccaacagaatcccgctgctttacaagaacacatgaaaaatccagaagtattcaaaaagattcagacgttgatcgctgctggtatcatccggactggccgctaa

SEQ ID NO: 46045 - DNA, 2109 bp, Saccharomyces cerevisiae
atgggtatccaaggtcttcttcctcagttaaagcccatacagaatccagtatcactacgtaggtatgaaggagaagtgttagccattgatggctatgcatggctacatagagcagcctgctcttgtgcttatgaacttgcaatgggaaaaccaactgataagtacctgcagtttttcataaaaagatttagtttattgaaaacctttaaagttgaaccgtatttggtcttcgatggtgatgccattccagttaaaaagtctactgaatctaaaagaagggataagagaaaagaaaacaaagccatagctgaaagactgtgggcctgtggcgaaaagaaaaatgctatggactattttcaaaaatgtgtcgacataacgcctgaaatggcaaaatgtatcatatgctactgtaagctaaacggtattcggtacatagtggctccgtttgaggctgactctcaaatggtatatttagaacagaaaaacattgtgcaaggaataatatccgaagattctgacctcctcgtcttcggatgtcgacgtctcattacgaagctgaatgattatggagaatgtttagaaatatgtcgcgataattttattaaactgcctaaaaagtttccgttgggatccttaactaatgaagaaatcataacaatggtttgtttatccggttgtgactatacaaatggaattcccaaggttggcctgattaccgcaatgaaattagttagaagattcaatactattgaaaggataattctgagtatacagcgggagggaaaactgatgataccagacacatacattaatgaatatgaagctgcagttttagcatttcaattccaaagggtattttgccctattcggaagaaaatagtgagcttgaatgaaattccgctgtacttgaaagataccgaaagtaaaagaaaaagactctacgcgtgcattggttttgtcatacacagagaaactcagaaaaagcaaattgttcatttcgacgacgatatagatcaccacttgcatttaaaaattgctcaaggtgacttgaatccatatgattttcaccaacctctagccaacagagagcacaaattacagctggcatccaagtcaaatatagagttcgggaaaactaatactactaattctgaagccaaagtcaaaccaatagaatcgttcttccaaaaaatgacaaaattggatcataacccaaaagttgcaaataacatccatagtctaagacaagcggaagacaaactgacaatggcaattaagcgtaggaaattaagtaatgccaatgtagtccaagaaacgttgaaggatacaagaagcaaattttttaataaaccctccatgactgttgtggaaaacttcaaagaaaaaggcgacagcatacaggattttaaagaggacacaaactcacaatctttggaagagcctgtttccgagtctcaactatctacacaaatacctagttcttttattacaaccaatttagaggatgacgacaacctgagtgaagaggtttctgaagttgtcagtgacattgaagaggaccgaaagaattctgaaggaaagactatcggtaacgaaatctataatacagatgatgacggtgatggcgatactagcgaggattatagcgaaactgcggaatcaagagttcccacgagcagcaccacctcatttcccgggtcatcccagaggagtatatcggggtgcacaaaagttttacaaaagtttagatattcatcttcattcagcggagttaatgcaaatagacaaccactatttcctcggcacgttaatcaaaaaagtagaggaatggtatacgtcaatcaaaatagagatgatgattgcgacgataacgatggtaaaaatcaaatcacgcaaaggccatcactgcgaaaaagccttattggtgccaggtcacagagaattgtgattgacatgaaaagcgtagatgaacgaaaatcattcaattcatcaccaattttgcatgaggaaagtaagaaaagggacatcgaaactactaagtcaagccaagctcggccggcagtcagatctatctccttgctttcccaatttgtttataaaggtaaataa

SEQ ID NO: 46046 - DNA, 2250 bp, Saccharomyces cerevisiae
atgaccagtatgtcaattattgatgatgagaacgtgaaaaaaacttctaatggggcagctgttgtcactgatgtggctcaacacgctgtaagtgattcggacaataacaaagcgcaacttctaggcgatggatccaacactgaatatgtggttgatattttcattgaagccgctaaggatggggatttaaaagtggtgaaggacgtggtcgaaagtggagcagtggatattaataacgaccgcattgatgaattatccggcttacactgggcctgtataaacaataggttttctgtagcaaagttcctattacttaggggagcaaatcctaaccaggcggcaggccccggaggggctactgctttgcactgggccgcaaggtacggtaatatctacattgttgacctgcttctcaaacatggcgctgatccgacgctcaaagatgagcagggtcttaacatcatgcattttagcgtttacagttctaacattttacttgttgtttatgttctttattttgtcgtaaacaacaatgacaacgtcgatatcgattcaaaagataacaataacagaacacccctactttgggctgcttatcaaggagattttctcactgtagaacttttattgaaatttggctccacagttgcatggacggacaacagagggttcaatgctctccattgtgctctagttggaggtgatcaaagggtcatatgtgacttaatacttagcggtgcaaatttctacgaaaggaataaccagaagcaagactgttttgatctagccgaaggaatgggaaccaaatcactttttgaacaagcgttgcaacatcatggatatgacaggcttggaaatcagaaagacaaactgttcaagaaaagctcgcatgcacaattcacaatttttttgtcaccatttttactcatggtttacatatacttaatttctctcgttctttctccagtgctagccattatgctttccctactggtcactgttgtcatggtcaacacattaaagaagtttgtattaccatgccttcccagaaaaaacacttacaaagtttctttgactagaactccctttttcagtggcctctttctgtccactttctgttttttaatatatatatggacgaagaaactctatccatatagtgtatctgactataccatgaaaaacgtccagtttttggttacttcctttctcacagttgtactatttctgagattagtacggtcagatcctggttgtctgaaaacggatgatagtttgacttcgatacaagaaacaataaaacaactgattgacttagggaagtttgatagggaaaacttttgtgttgagacattagaaaggaagcctttgaggagtaaatattctttctttagcggcgccctggtggccagatatgaccattattgtccatggatttataatgatgttggcttaaaaaatcacaaactttttgtcttctttgctgtgacggtccaatatcacatgtttttgttcatgtggttatgtctggcatattttaagaaaacgaactatatttacgaacaagttgaagaatatgcaagatgtgccctgctcaagaatgagactttgtgtaagggttctaattacgatccctctaccttttttttattcatttggattagcgtaaacttcatctggctgggggctatgttgattgtccagttcttccagatattaaaaggaatcacgactcctgaattgttcatcttaatcaaggaggagcacaaggcaaaatttatcaatctgatacccttcgaaaactctatatataccagtgaaagtaaaggtgttgaagatagtgatatgattcctgaaggtccaagtgcgaccaccattactcacacaatttctattgatggtttggaaccaagaaataggcgccgcgccattcttagcgcttgcttttcaatgatgggtattaatcaatggctcgttactattaaggaaatagtaggtataacccacattttgcatggacaggttccacaacaacatcacagttcattgcttcgaagtttcttagtgacaaatcactggaagacgaatttgacggatttttggcttaatagtgatgtaacagcgcccttgtggcaacgatttttctattcttcggatacttcaaaagctatgttgggtggaactgaggttgactactacgagctatacgaatatccggcccgagaaggagaagtattacgtccaaactaa

SEQ ID NO: 46047 - DNA, 777 bp, Saccharomyces cerevisiae
atgggcagtagatcggagaatgtgggaacagtgactagagaaggctccagagtggaacaagatgatgtcctcatggatgatgactctgactcatcggaatacgtggatatgtggatcgatttatttcttgggagaaaaggccatgaatatttctgtgatgtcgatcctgagtacatcactgatcgttttaatctgatgaacttgcaaaagacagtttcaaaattttcctacgtggtacaatatattgtggatgatttggatgatagtatcctagagaatatgacacatgcccgtttagaacaattagaatcagattcccggaagctgtatggtctcatccatgcacgctacattataactatcaaaggattgcaaaaaatgtacgctaagtacaaagaggcggactttggaagatgtccccgtgtgtattgtaatttacaacagttgttaccggttggtttgcatgacattcctggtatagattgtgtcaagttatattgtccatcttgtgaggatctttatataccaaaatcatcgagacatagttccattgatggtgcatactttggaacaagttttccaggtatgtttttgcaagcatttccagatatggtacccaaacacccaactaaaagatatgttccaaaaatatttggatttgaattacataaacaagctcaactgacaaggtggcaagaactacaacgactcaagttagttgagaaacttgaatccaaagatgttgatttgacgaaaagtggtggttttaaaacctaa

SEQ ID NO: 46048 - DNA, 858 bp, Saccharomyces cerevisiae
atgaagtttttactgcagcaaataagaaatatgcatgttaagcctataaaaatgcgatggttgacaggtggtgtcaattatagttatttactaagcactgaagacaggagaaactcatggctgattgaccctgcagaaccacttgaggtgtcgccaaaattaagcgccgaagagaaaaaaagtattgatgctattgtcaatacacatcaccattatgaccattcgggggggaacctagcgctttatagtatcttgtgccaagaaaactcaggtcacgatattaaaataattggtggatctaagtcctccccgggtgtcactgaagtacccgataatttgcagcagtatcacttgggtaacttaagagtaacatgtattaggactccatgccatacaaaagattccatatgctattatatcaaagatttagaaacaggtgagcagtgcatcttcacaggcgacactttattcattgccggttgtgggaggtttttcgagggcacaggaagagatatggacatggccttaaaccagataatgttaagggctgttggtgagacgaactggaataaggttaaaatataccctggtcatgagtacaccaaaggcaatgttagctttatcagagcaaaaatctattccgatatagggcagaacaaggagtttgatgcgttggaacagtattgcaaatctaacgagtgcaccaccggtcacttcaccctgagagatgaactaggttataacccattcatgagattggatgatcgtgccgttagactagcagtcggcgatactgctgggacttatcccagatccgtagtgatgcaagagttaagaaagcttaaaaacgctatgtaa

SEQ ID NO: 46049 - DNA, 1449 bp, Saccharomyces cerevisiae
atgagtgatacaaagagagatccggccgatttactagcttctttaaagattgataatgagaaagaggatacaagtgaagtttcaacaaaagagactgttaagtcccaaccagaaaagactgctgattcgatcaagcctgcagaaaaattagttccaaaagttgaggaaaaaaaaacaaaacaggaggatagtaatttaatcagctcagaatatgaagttaaggtcaaacttgctgatatccaggctgacccaaattctccattgtacagtgctaaatcttttgatgaattaggattagcaccagaactactaaaggggatatatgctatgaaatttcaaaaaccatccaaaattcaagaaagggcgctgccattattattacataatccgcctaggaacatgattgctcagtctcaatcaggtacaggtaaaactgccgccttttctttaacgatgctaacaagagtaaacccagaagacgcatctccacaggcaatttgcttagccccctccagagaactggccagacaaacactagaagtcgttcaggaaatgggtaagttcacaaaaataaccagtcagttaattgttcccgattcttttgagaaaaacaagcaaattaatgctcaagtgattgttggtacgccgggcactgttcttgacctaatgcgtagaaaattgatgcagctacagaaaattaaaatttttgttttggatgaagccgataacatgttggatcagcagggtctaggtgaccagtgtattcgtgttaagagatttttacccaaggatactcaacttgttttgtttagtgctacttttgccgatgcagttaggcagtacgcaaagaagatcgttccaaatgctaatactttagaattacaaacaaatgaagttaatgttgatgccatcaaacaactatacatggactgcaaaaacgaagcagataagtttgatgttttaactgagctatatggtttaatgacaattggatcttccattatttttgttgcaaccaaaaaaaccgcaaacgttttatatgggaaattgaaaagtgaaggtcatgaagtttctatcttgcatggtgatttacagacacaagaaagagacagattaatagacgacttcagagagggtagatccaaagttttgattactactaatgtcctggcccgtggtattgatattcctactgtctcaatggttgtcaactatgatcttccaacgcttgctaacggacaagcagatccagctacttacattcacagaatcggtagaaccggtagattcggcagaaaaggtgttgccatttcctttgtacatgacaaaaattctttcaatattttatctgcaattcagaaatacttcggtgatatagaaatgactcgtgttccaacggatgattgggatgaagtcgaaaaaatagttaagaaagtgttaaaggattag

SEQ ID NO: 46050 - DNA, 2658 bp, Saccharomyces cerevisiae
atggagacagcaacttcttcccctttgcccattaaatcgaggagaaacagcgaaaattctgggtctactacagttataccgcatatgaacccttctttagcaacaccgttgactgtgtcgaccatggtaaatcaatcaaattctaaagagtttatgaagttgaccccagttcgtattagagattttggttctcctttgaaaaacgtgtccactaattaccattttttagactcagaaaatggtaaaggtaacacaatggataatatgtatagagaaaatttcattcttatttcaaaggatctagagaaattactggagaatctcaatgtcatatatcaaaatattgggtattctaatacggaaattatcaccaaggagaaaatcatattcaccactatatctaattccataaaacaattttttgagcaagctgacgaagaattgaaaagactgtccgcagagaacggaattgaacaggatattctaaataacattctagagagaataaatgacccaagtggcataaagactattcctgacttatacattagaaatgctattctactgcaagaaagtaaaactgtgccacagtcaccgaaaaagccactttccttactaagcaaaaaagcagcattagatacagcaaaaaaatttgtcctaggaagttttttacccaggctccgcgactatttaaaatccttaatcactctaaaacacctcatacaatctgtaaaagaaaaccttcctggattgacagaagcagataacgaggctatcgccgagtttccagaattaagcacattaaccgcatatttgttacaaatagaaaatggtaaaggcgatattggtttgtccatgaaatttattatagataatagaaaagatattttaaagggatcggcatttaaaactattaacgaagaatctgtgaaacacatgaatgaagtcataaaaatttacgaggaagaatacgagaggaggtttaaaagcgtactcacaaaaaaggttagtatttcatcaatatgtgaacaacttggaactcccctagcaacgttaatcggtgaagattttgaacaagatctaagatcatatggagaagaggaaaactccacatcagaaataccaaatttccacccggtagacagagaaagaatgtctaaaattgatattacattggaaaaactgcaagctatccataaggaaagagcagacaaaaagaggctcctgatggaacaatgccaaaaactttggacaaggctaaaaatttctcaagaatacataaagacttttatgcgtaacaattcaagtttatcaaccgagtccttaggtagaatctctaaagaagttatgcgacttgaagcaatgaaaaaaaaactaataaaaaaacttatatcagattcctgggacaaaattcaggaattgtggcgtacgttacagtattcagaagaaagtcggtctaaattcatcattgtatttgaagaactaaggaacagtgcaacaactttacaggaagatgagcttcttctagaaacttgcgaaaatgagctaaaaagactagaagaaaaactgaccctttataagccaattttaaaattaatatcagattttgaatctttacaagaagatcaagaatttttggaaagaagttcaaaagactcttcacggcttttgtctagaaattctcataagatattactaactgaagaaaaaatgaggaaaaggataacaagacactttcctcgagtcatcaatgatttaagaattaaattagaagaggccgatggtctatttgatcaaccttttttgttcaaaggtaagccactttcagaagcaattgacattcagcaacaggaaatcgaagcaaaatatccaagatgtagagttagaatgcagagatctaaaaagggaaaatgtggtgcgaacaaagagaataaagtcataaaaaacactttcaaggccacagaaagttccatcagggtaccgattggtttgaatttaaatgatgccaacattacttataaaacgccttcaaagaaaacaatacaaggcttaacaaagaatgatctatcccaagagaactcgcttgctcgtcatatgcaaggaacaacgaagttatctagtccgaacagaagagcaacaagattactagcacccacagtaatatctaggaattccaaagggaatatagagagacctaccttaaacagaaacagatcatccgatctttcatcatcgcctaggataaatcatacgcatggcgaacatgcagtaaaaccacgccaattgtttcctatcccgctgaacaaagtcgacactaagggtagtcatatccctcaattaactaaagaaaaggctttagaacttcttaaaaggtcgactggcaccacgggtaaggagaatgtacgaagcccggaacgcaaaagctcattagaagattacgcacaaaaattgagcagtccttataaagaacctgagcacagcatatataaactttccatgtcgccagaaggtaaatttcaattaaacattcaacaaaaagatattgaaagcggatttgatgataccagtatgatggaagatgaaaatgataaggattttattacatggaaaaatgagcaagtttcgaaattgaatggattctcctttacagatatttga

SEQ ID NO: 46051 - DNA, 1020 bp, Saccharomyces cerevisiae
atgccattacctccgtcaacattgaaccagaaatctaatagagtctactctgtagctagggtgtacaagaatgcctgcgaggagagaccacaagaatactgggactacgaacaaggggtgaccatcgattggggaaagatttccaattacgaaattatcaacaaaattggaagagggaaatattccgaagtgttcagcggtagatgtattgtaaacaaccagaagtgtgttattaaagttttaaaaccagttaaaatgaaaaaaatttatagagagttgaaaattctgaccaatctaacaggcggccccaatgttgttggcctttatgatatagtacaagacgctgactccaaaatacctgctttgatctttgaggaaatcaaaaatgttgatttcagaactttatatcctacattcaaacttcctgacatccagtattatttcacgcaattattgattgcgttagactactgtcactccatgggcataatgcacagagacgtaaagcctcagaatgtcatgattgatcctacggaacgtaaactaaggctgatcgattggggcctggcggagttctaccatccaggtgtagattacaacgttcgtgtcgcttcgcgttaccacaagggaccagaacttttagtaaacttgaaccaatatgactactccctagacttatggtcagtaggatgcatgctagcagctattgtcttcaaaaaagaaccttttttcaaagggtcgtctaatccagatcaactggtaaagattgccacagtactaggaaccaaggaactgttaggctatttgggtaagtacgggttgcacttaccatctgaatacgacaacattatgagagactttacaaaaaaatcgtggacacactttataacctccgagaccaaattagctgttcctgaagtggttgatttaatcgacaatttattaaggtatgaccatcaagaaagattaacagcaaaggaggctatggatcataagtttttcaaaacgaagtttgaataa

SEQ ID NO: 46052 - DNA, 633 bp, Saccharomyces cerevisiae
atgaacacatcagtcacttccataaagttggtactgttgggtgaggcagcagttggtaaatcgtcaatagtcctaaggtttgtatctaatgattttgccgaaaataaggagcccaccattggtgcagcattcctcactcaaagagttactataaatgaacatactgttaagtttgaaatatgggacactgctgggcaagagagatttgcatctttagcacctatgtactatagaaacgcacaagctgctcttgtagtatacgacgttacaaaaccacaatcctttattaaagcgcgccactgggttaaggaattacatgaacaggcatcaaaggatatcatcattgcgttagttggtaacaagatcgatatgctgcaagaaggtggggaaagaaaagtcgcaagggaagaaggtgaaaagctagcggaagaaaagggcttgttgttctttgaaacaagtgcaaagacaggagagaatgttaacgatgtatttttgggaatcggtgaaaagataccactgaagacggctgaagagcaaaatagtgcaagtaacgaacgtgagtcgaacaatcaaagagtggatttgaacgctgctaatgatgggaccagcgcaaacagtgcttgcagttgttag

SEQ ID NO: 46053 - DNA, 552 bp, Saccharomyces cerevisiae
atgggcaattcaatttcgaaggttctgggaaaactatttggctcgaaagaaatgaaaattttgatgctaggcctggataaggctggtaagacaacaatattgtacaaactaaaattaaataaaataaagacgtctactcccactgtcggttttaacgtggaaaccgttacttataaaaacgtaaaattcaacatgtgggatgtaggaggacaacaaagattgagacctctctggagacattattttccagccaccaccgcacttatctttgtgatagattctagtgctagaaaccgtatggaagaggccaaagaagagttatatagtatcataggtgagaaagagatggagaatgtagtactgctggtatgggcaaacaaacaagatttgaaagatgcaatgaaacctcaagaggtttccgattttttagaactggagaaaaatttgaaaaaccaaccttggtgtgtcatcggtagtaacgccttatccggacagggtcttgttgaaggattatcctggatttcgaacaacacaaacgttccaaagaaataa

SEQ ID NO: 46054 - DNA, 1182 bp, Saccharomyces cerevisiae
atggcgaagattatgatcccagctagcaagcagcctgtttacaaaaaattaggacttcttctggtcgccgtgtttactgtgtatgtgttctttcatggagctcagtatgcgagaggctctgccccaagcccaaagtacagtaccgtgctatcttccggctcgggctataaatactcgaaagtggaactaccaaagtataccggtcctcgggaaaaggccacttttgtcactctagtgcgtaatagagatctatattcgttggctgagtctattaaatccgtggaagatagatttaactccaagttcaactatgattgggtgtttttgaatgatgaagagttcactgatgaattcaaaaacgttacgtcagctttagttagtggtacaacaaaatacggtgtcatcccaaaggaacattggtccttccctgagtggattgatgaagaaaaggccgctcaagtcaggaaggagatgggtgagaagagaatcatctacggtgattctatctcttacagacacatgtgtcgttttgaatcaggcttcttttacagacatcctttgatggatgactacgattggtattggcgtgtggaacctgatatcaagttgcactgtgatatcgactacgatgtcttcaaattcatgaaagacaataagaaaaagtatgcctttgccatttccattaaggagtatgaagctactatccccactttatgggagactactcgtaaattcatggaagcccatcctgagcttatccatgaaaataatatgttagactttgttagcgacgatcagggactttcatacaatttgtgccatttttggtctaattttgaaattgctgctttggatttgtggagatctccagcatactccgcatattttgattatttagatcgtgaaggtggattcttttatgaaagatggggtgatgctccagttcattctattggtgctgcgctgttcttggaccgctctgaaatccatcacttcggtgatattggttattaccatgttccatttcactcctgtccaatagacacaagtatcagactggctaacaaatgtgactgtgatccaagcaaagatttcacatggcacagttattcatgtactactaaattctacaatataaacaagttgccaaagcctgctggttggcaaaaccatatcggttga

SEQ ID NO: 46055 - DNA, 984 bp, Saccharomyces cerevisiae
atgtcttcagacacttcattatcagaatcttcattattgaaagaagagagtgggagcttgaccaagtctcgtccacctataaaatcaaaccctgtacgcgaaaatatcaaatcatttgtggccggtggagttggcggggtatgtgcggtgtttacgggtcatcccttcgatttgattaaagtgagatgtcaaaatggacaagcgaattccacggtacatgccattacaaatattataaaagaagcaaaaactcaagtaaagggcacattatttaccaattccgtaaaggggttctataaaggtgttatcccgcccttattaggtgttactcccatattcgctgtttctttctggggttacgatgtgggtaagaaactggttacttttaataacaagcaaggaggcagtaacgagttaactatgggacaaatggctgcagcaggatttatcagcgctattcctaccactttagtgactgcgccaacggaaagagtaaaggttgtcctgcaaacatcttctaagggctctttcattcaggcggctaaaaccattgttaaagaaggtggcatagcttctttatttaaaggttcattagccactttagcaagagatgggcctggctcagctctatattttgcatcttatgaaatttcaaaaaattacttgaatagtaggcaacctcgtcaagatgcgggcaaagatgaaccggtcaatatcttgaacgtgtgtcttgctggtggtattgctggtatgtcgatgtggctagctgttttccccatagacactataaagacaaaattgcaggcttcctccacgaggcagaatatgctttccgccacaaaggaaatttatctacaaagaggtggtatcaagggatttttccctggtttaggtcctgctttactaagatctttcccagccaatgcggccacatttttaggtgtggagatgactcattcactgttcaagaagtatggcatatga

SEQ ID NO: 46056 - DNA, 930 bp, Saccharomyces cerevisiae
atgcagggaaataaatcaactataagagagtataagatagtagttgtcggtggaggtggcgttggtaaatctgctttaacaattcaattcattcaatcatactttgtggacgaatatgaccctactatcgaagattcttacagaaaacaagttgtcatcgatgacaaagtatccattttggacattctagatactgctggacaagaagagtattctgcgatgagagaacagtacatgaggactggggaaggtttcctactggtctattccgtcacctctagaaattcctttgatgagttactgtcttattatcagcaaattcaaagagtaaaagattctgactacattcctgtagtcgtggtaggtaacaaattggaccttgaaaatgaaagacaagtctcttatgaagacgggttacgcctggccaagcagttgaatgcaccctttctagaaacgtctgcgaaacaagccatcaacgtagacgaggccttttatagccttattcgtttggtaagggacgacggtgggaaatacaatagcatgaatcgtcaactggataatacgaatgaaataagagattcggagctaacctcatctgcaacagcggatagagaaaaaaagaacaacgggtcttatgtactcgataattctttgaccaatgctggcactggctccagttcaaagtcagccgttaaccataacggtgaaactactaaacgaactgatgaaaagaattacgttaatcaaaacaataacaatgaaggaaataccaagtactccagtaacggcaacggaaatcgaagtgatattagtcgtggtaatcaaaataatgccttaaattcgagaagtaaacagtctgctgagccacaaaaaaattcaagcgccaacgctagaaaagaatctagtggtggttgttgtataatttgttga

SEQ ID NO: 46057 - DNA, 4383 bp, Saccharomyces cerevisiae
atgaaggaagtcgttgtaagtgaaaccccgaaaaggattaaagggctggaatttagcgctttaagcgctgccgatattgtcgcccagtctgaagtggaagtgtctacaagagatctcttcgatttagaaaaagatcgtgctcctaaggcgaacggtgctttagaccccaagatgggtgtctcttcctccagtcttgaatgtgcaacctgtcacggcaacttggcatcgtgtcatggccattttggtcacttaaaattagctttgcctgttttccacattgggtacttcaaagccaccattcaaatactgcaaggtatctgtaaaaactgttctgccatattgttatcagaaacagataaaagacaatttttgcatgaacttcgtcgtccaggcgtagataatttaagacgtatgggtatattgaagaagattttggaccaatgtaaaaagcaaagaaggtgtctgcattgtggtgctcttaatggtgtcgtgaaaaaagccgctgctggtgctggttcagccgcgttgaagattatccatgatacatttcgttgggtaggtaaaaagtccgctcctgaaaaggatatttgggtgggagaatggaaggaagttcttgctcataatccagaactagagcgttatgtgaaacgttgtatggatgatttaaatccactgaaaactttaaatcttttcaagcaaattaagtctgcagattgtgagctgcttggtatagatgcaacagttccctctggtagaccagagacttacatatggagatatttacccgcacctccggtttgtataaggccttccgttatgatgcaagactctccagcatctaacgaagatgacttgacagtaaagcttacggaaatagtttggacttcgtctttaatcaaagccggtcttgacaagggtatttccattaacaatatgatggaacattgggattacttacaactgactgttgcaatgtacatcaactcagactcagtcaatcctgcgatgctaccaggttcatccaatggcggcggaaaagtgaaaccaattagagggttctgccaaagactaaagggtaaacaaggtcgattcaggggtaatttgtctggtaagcgtgtcgatttttctggtagaactgttatttctccggacccaaacttgtccattgacgaggttgctgtcccagatcgtgttgcaaaagtcttgacgtatcccgaaaaggtaacaaggtataatagacataaattacaagaattaattgtaaatggacccaatgtccatcctggggcgaactatttactgaaaagaaacgaagatgcaagaagaaacctaagatatggtgatcgtatgaagttagccaaaaatttacaaattggtgatgtcgtcgaaagacatttagaagacggtgatgtggtcctattcaaccgtcaaccatctttgcatagattatcaattttatcgcattatgctaagattcgtccttggagaacctttagattaaatgaatgtgtttgcacaccttataacgctgacttcgacggtgacgaaatgaatttgcatgttccacaaaccgaagaggctcgtgcagaagctatcaatttaatgggtgtgaaaaataacttattaacacctaagtcaggtgaacctattattgcggctactcaagatttcataactggttcatatttaatatcacataaggattctttctatgatcgtgctacattaactcaactattgtctatgatgtctgacggtatcgagcactttgacataccacctcctgctatcatgaaaccgtattacttatggaccggtaaacaagttttttcacttttgataaaaccaaatcacaattccccagttgtgataaacttagacgcgaagaacaaagtctttgtccctccaaaatcaaaatccctaccaaatgaaatgtcacaaaacgacgggtttgtaattattagaggctctcaaattttaagtggggtgatggacaagtctgttctaggtgatggtaagaagcattctgtgttttatacgatattaagagattacggcccacaagaagccgctaatgctatgaatagaatggcaaaactatgtgctaggttcttaggtaatagagggttttctattggtattaatgatgtcacacctgctgatgatttgaagcaaaagaaggaagaactagtcgaaattgcataccataagtgtgacgaattgatcacattattcaataaaggtgaattagaaacacaacctggttgcaatgaagaacaaacattggaagctaagattggtgggcttctatctaaagtcagagaagaagttggtgatgtttgtattaatgaattagataattggaatgcaccattaattatggctacttgtggttctaaaggttccacattaaatgtttcacagatggtggctgtcgttggtcaacaaattatttctggtaatcgtgttccggatggttttcaagatcgttcgttaccgcatttccccaagaattcgaaaacaccccaatccaaaggttttgtaagaaattctttcttttcaggcttatctcccccagaatttctgttccatgctatttcgggtcgtgaaggtttagttgacacagctgttaaaaccgcagagactggttacatgtctcgtagattaatgaagtctttagaagatctttcttgtcagtatgacaatacggtcagaacttcagccaacggtatcgtccaattcacatatggtggtgacgggttggatcctctggaaatggaaggtaatgcacaaccggtcaatttcaatagaagttgggaccatgcatacaatattacttttaataaccaagataagggcttactaccctatgcaattatggaaactgcaaacgaaatattaggaccattggaggaaaggttggtcagatatgataatagtggatgtttagtgaaaagggaagacttgaataaagcggaatatgtggatcagtatgatgccgagagagatttttaccattccttaagagaatatattaatggcaaagcaactgctttggctaatttaagaaagtccaggggaatgttaggcctattagaacctcctgcaaaagaattacaaggtattgatccagatgaaaccgttcctgataatgttaaaacatctgtaagccaactttatagaatcagtgaaaaatcggtgagaaagtttttagaaattgctcttttcaaatatcgtaaggcaagactggagccaggtactgctattggtgctattggtgctcaatccattggtgaaccaggtacacaaatgacattgaagacctttcattttgcaggtgtggcttccatgaatgttacattaggtgttcctcgtatcaaagaaattatcaatgcttccaaggtcatttctacacctattataaatgctgtattagtaaatgataacgatgaaagggctgctagggttgttaaaggtagagtggaaaagacactgctatctgacgtagctttctatgtccaagatgtttacaaagacaacttgtctttcattcaagtgcgtattgatttaggtacgattgataaactacaattggagttgaccatagaagatatcgcggttgctataaccagggcttctaaattgaaaatacaagcctctgatgtcaatattattggtaaagatcgaattgcaatcaacgtattcccagaagggtacaaagcaaaatcgatatctacatctgcgaaagaaccaagtgagaatgatgttttttaccgaatgcaacagttacgtcgtgcgcttcctgatgttgttgttaaaggtttacctgatatttctcgtgcggttattaatattcgcgatgacggcaagagggaattattggttgaaggttacggcctgcgagatgtgatgtgtacagatggtgtcattggttctagaactacaactaaccatgttttagaagtcttttccgttttgggtatcgaagctgcaagatatagcattattagagaaattaactataccatgagtaatcacggtatgagtgtcgatccacgtcatatccaactattaggtgatgtgatgacatataagggtgaagtgttgggtattacaagatttggtttgagtaaaatgagggactctgttttgcagctagcctccttcgaaaagacaactgaccatttattcgatgcggccttttatatgaaaaaggacgctgttgaaggtgtttctgaatgtattattttgggtcaaacgatgtcgatcggtaccggttcctttaaagttgttaaaggtactaatatatctgaaaaggatctggttcctaagcgatgtctatttgaaagtctctcaaatgaggcagctttaaaagcgaactaa

SEQ ID NO: 46058 - DNA, 1305 bp, Saccharomyces cerevisiae
atggccaccttggaagaattggatgctcaaactttaccaggagacgatgaattagatcaagagattttgaatctttcgacgcaggagcttcaaacaagagccaagctcttggacaatgaaattcgtatttttagatctgaattgcaaagactgtcccatgaaaacaacgttatgctcgagaagattaaggacaataaggaaaaaatcaagaataatagacagttaccgtaccttgtggctaacgttgtcgaggtcatggatatgaatgagattgaagacaaagaaaatagtgaatctactacacaaggtggtaatgtcaacttagataacaccgctgttggcaaagctgctgtagtcaagacttcttctagacagactgttttcttgcccatggtcggtttagtagatcctgataaacttaagccaaatgacctggtaggtgtgaataaagactcgtatttgattttggatactttaccctctgaatttgattctcgtgtaaaagctatggaggtagatgaaaaacccacagaaacttactcggacgtgggtgggttggataaacagattgaagagctggtggaggccattgtgttacctatgaaacgtgcagataaattcaaagatatgggaattagagcgcccaagggtgccctaatgtacgggcctccgggtacaggtaaaactttattagctcgtgcttgcgcggctcagacgaatgctacttttttgaagctggcagcacctcaattggtacaaatgtatatcggtgaaggtgctaaactagtccgcgatgcttttgcactggccaaggaaaaggcaccaactattattttcattgacgaattggatgccattggtactaagagatttgattctgaaaaatccggtgatagggaagtgcaaagaaccatgctggaattattgaatcaattggatggctttagctccgatgatcgtgtcaaagtcttggcggctaccaatagagttgatgttttagatcctgctttgttaagatcaggaagattggatagaaaaattgaattcccactcccatccgaagactcgagagctcaaattttacaaattcattcaagaaaaatgaccactgatgatgatattaactggcaagaacttgccaggtctactgatgagtttaatggtgcccagttaaaggcggtaactgtggaggcaggtatgattgccttaaggaatgggcaatcttccgttaaacacgaagatttcgttgagggtataagtgaagttcaagcaagaaaatcgaaatcggtatccttttatgcataa

SEQ ID NO: 46059 - DNA, 939 bp, Saccharomyces cerevisiae
atgcctgctactttacatgattctacgaaaatcctttctctaaatactggagcccaaatccctcaaataggtttaggtacgtggcagtcgaaagagaacgatgcttataaggctgttttaaccgctttgaaagatggctaccgacacattgatactgctgctatttaccgtaatgaagaccaagtcggtcaagccatcaaggattcaggtgttcctcgggaagaaatctttgttactacaaagttatggtgtacacaacaccacgaacctgaagtagcgctggatcaatcactaaagaggttaggattggactacgtagacttatatttgatgcattggcctgccagattagatccagcctacatcaaaaatgaagacatcttgagtgtgccaacaaagaaggatggttctcgtgcagtggatatcaccaattggaatttcatcaaaacctgggaattaatgcaggaactaccaaagactggtaaaactaaggccgttggagtctccaacttttctataaataacctgaaagatctattagcatctcaaggtaataagcttacgccagctgctaaccaagtcgaaatacatccattactacctcaagacgaattgattaatttttgtaaaagtaaaggcattgtggttgaagcttattctccgttaggtagtaccgatgctccactattgaaggaaccggttatccttgaaattgcgaagaaaaataacgttcaacccggacacgttgttattagctggcacgtccaaagaggttatgttgtcttgccaaaatctgtgaatcccgatcgaatcaaaacgaacaggaaaatatttactttgtctactgaggactttgaagctatcaataacatatcgaaggaaaagggcgaaaaaagggttgtacatccaaattggtctcctttcgaagtattcaagtaa

SEQ ID NO: 46060 - DNA, 590 bp, Saccharomyces cerevisiae
atgtcttggcaaggtatgtgaacgagacaattatcaattgattaagaaagaaatgagtcggaggttagcttgtgtgacaatgtttggcaatgcccgatttttgttgatgcgcgtaatttcgaagattaaccactcagagtaaattactaactggaatatcaaaaaacatatgaaatttcaaacatgaatttctttccgtttttttctcctacttttaaacagcatacactgataacttaataggaaccggtaaagtcgacaaagctgtcatctactcgagagcaggtgacgctgtttgggctacttctggtggcctatctttgcaaccaaacgaaattggtgaaattgttcaaggcttcgacaatccagctggtttgcaaagcaatggtttgcatattcaaggccaaaagttcatgttgttgagagctgacgatagaagtatctacggtagacatgatgctgagggtgttgtttgtgtaagaactaagcaaaccgttattattgctcattatccaccaaccgtacaagccggtgaggccaccaagattgtcgagcaattggctgactacttgattggtgttcaatactaa

SEQ ID NO: 46061 - DNA, 3819 bp, Saccharomyces cerevisiae
atgccgaacgaagataatgaacttcaaaaagcaattgagaaccatcataatcaactactaaaccaggataaagaaaatgctgacagaaatgggtctgttatagaagacctcccattatacgggacaagtataaaccagcagtctacccctggagatgttgacgatggaaaacacttactgtatccagatattgccaccaacctaccactgaagacttctgacagacttttggacgatatactttgcgatactatttttctcaattctacagacccgaaggtcatgcaaaagggcctgcaatcgaggggtattttaaaagagtctatgctttcttactcaactttcagaagtagtattcgccctaactgcttgggttcattaactgatcaagtggtttttcaaacaaaatccgagtatgattccatttcatgcccaaaatataataaaatacatgtatttcaggcggtcatctttaatccatcactggcagaacagcaaatttcaacttttgatgatattgttaaaattcctatttatcatcttaaggttagcgtaaaagtccgccaagaactggagcggttgaagaagcatgtcggtgttactcaattccactcactagatcatttgcacgaatacgatcgagtagacctttcgacttttgattcttccgatcctaatttgttggattacggtatttacgtttctgatgatactaacaaactgatcttgattgaaatttttaaacccgagtttaattcacctgaagagcatgagagttttactgccgacgcaattaagaagagatacaatgctatgtgtgtaaaaaatgaatcactagataaaagcgagacgccatctcaagttgactgtttttacacactttttaaaatttttaaagggcctttgacgaggaaaagtaaagcggaacctacaaagacaattgattctggaaatttggcccttaacactcacctgaatcctgaatggttaacgtccaagtatggatttcaagcaagctcagaaatcgatgaggaaactaatgagatatttactgaatacgtccctccagatatggtggactatgtaaacgatttggagacaagaaaaattcgagaatcgtttgtgaggaagtgtttacaactgatattttggggtcaactatctacctcattactggcacctaattctcccttgaaaaatacgaaaagcgtaaagggaatgtcttcattacaaacttctttctcaacactaccttggttccatttattgggagaatccagagcaaggattctattaaattccaatgagcaaactcattcgcctttggacgcagaacctcattttattaatctttccgtttcgcattattataccgatagagatataatcagaaactacgaatctttgtcttctttggatcctgaaaatattgggctgtattttgacgcactgacatacattgcaaataggaagggggcatatcaattgattgcttactgtggaaaacaggacattataggccaagaagctctagaaaatgctttgttaatgtttaaaattaaccctaaagagtgtaacatctccgaattaaatgaggcgactttgctatctatttacaaatatgaaacatcaaataagagccaagtaacctctaatcacctaacaaatttgaaaaatgctctaagattgttggccaaatataccaaatctgacaaactaaaattttacgtcgatcatgagccctacagagctttatcccaggcatacgacacactttcaattgacgagtctgttgatgaagacattataaaaactgcatattcggtcaagattaacgactctcccggattaaagttggattgtgatagagcactttacaccattgctatcagtaaaagaagccttgatttgttcaattttttaacagaggaatgcccacagttttccaactattatggtccagagaagcttgattaccaagaggcattgaagcttcttcaagtgaatgaaaatgcctctgacgaaaccattttgaaaatctttaaacaaaagtggtttgatgaaaacgtttatgagcctgaccaatttcttattttgagggcagcattgaccaaaatcagtatagaaagaaattcaactttaatcaccaacttcttactaactggtacgatagatccaaattccttgccgccagaaaattggccaactggcattaataatatcgggaacacctgttacctaaattctttattacaatattacttttccattgcgccactaagaagatatgtattggaatatcaaaaaacggtagaaaatttcaatgaccacctctctaatagtgggcatattagaagaattggtggaagagaaattagtagaggcgaagtggaaagatctattcaattcatataccaacttcgcaaccttttctatgcgatggttcatacaagagaaagatgtgtaacaccctcaaaagagctagcatatttggcatttgctccaagtaatgttgaagtagaatttgaagtggaaggcaataaagtagttgatcaaacaggagttctttcggattcaaagaaggaaacaacggatgacgcatttactacaaaaataaaggatacaagcctgattgatttagaaatggaagatggccttaatggcgatgttggtacagatgcgaacagaaaaaaaaatgaatcgaatgatgctgaagtaagtgagaacgaagatacaacaggattaacttcacctacgcgtgtggcaaaaatcagttctgatcaattagaaaatgctttggaaatgggtaggcaacaagatgttactgaatgcataggaaacgtgttatttcagatagaaagcggttcagagcctatccgatatgatgaagacaacgagcaatatgacttggttaagcaactattttatggtactactaaacaaagtattgttcctttgtccgcaacaaataaagtccgtacgaaagttgaaagattcctatcgttactgataaatattggcgatcatcctaaagatatttatgatgcgtttgattcttattttaaagacgaatatctgacaatggaagagtatggtgatgttatacgtaccgttgctgttacaacttttcctactattttgcaggtacaaatccaaagagtttattacgatcgtgaaagattaatgccgtttaaatccattgagcccttaccattcaaagaagttatttacatggacagatacgcggatacagagaaccctttattgttggcaaaaaagaaagaaacagaagaaatgaagcaaaagttgaaggtaatgaaaaatagacaaagagagcttttgagtcgtgatgattcagggcttacaaggaaggatgcatttttggagagtatcaagctattggaatcggataccataaagaaaactcctttaaaaattgaggctgctaatgatgtgataaagacgctgagaaacaacgttcaaaatatcgataatgaattgatgaaattatacaatgatatcaacagtttggaagagaaaataagccatcaatttgacgatttcaaggaatatggttactcactgttttcggtttttattcatcgcggcgaggccagttatggtcactattggatatatatcaaggacagaaatcgcaatggaatttggaggaagtacaatgatgaaaccatcagtgaggtccaggaagaggaggtcttcaatttcaatgagggtaacactgcaactccatatttcctagtatatgtcaaacaaggacaagaaggtgatattgagccattgaaaagaattctaaagtag

SEQ ID NO: 46062 - DNA, 3024 bp, Saccharomyces cerevisiae
atggcatcaactgctcccaatgaacaatttccatcctgcgtacgatgcaaagaatttattaccacggggcatgcatatgagttgggttgtgatagatggcacacacattgtttcgcttgttacaaatgtgagaaaccattaagctgcgaatctgattttttagtccttggaacaggtgctttgatctgctttgattgttccgattcttgtaaaaattgcggtaaaaagattgatgatttggccataatactgtcctcttcaaatgaggcctattgttcagattgttttaaatgctgtaaatgtggtgaaaatattgctgacctacggtacgcgaaaaccaagcgaggtttattctgtttaagctgtcacgaaaagctattagccaaacgaaaatactacgaagagaagaaaaggcgactcaaaaagaatttaccaagtttacccacacctgtgattgataatggccatactgatgaggtctcagcttctgcagtcctcccagaaaaaacatttagcagacctgcatcactagttaatgagattccttcaggttctgaaccttccaaggacatagaaaccaattcgagtgatattgttccgcattttatcactgggtataacgatagcgatgacaactctggaagttcaaaattcggttcaaatgtgtccatagatgttataggaccggaagaaaatagcacggagcatgtaaatgatgatgttaaagaggaagcagaagcaccttcagcgaatatgtcactcaatgttgctacggatccaaccctaagttgtaaagaacctcctagccattcgaggaatttgttaaataaaacaccgttgagaaattcttcgggtcagtatctcgcaaaatctccaagctcctatagacagggaataattgttaacgatagtctggaagagagcgatcaaattgatcctccaaataacagttcacgaaatgcaagtgaattgttgacctcggtattgcatagcccagtttctgttaatatgaaaaatccgaagggttcaaatacggatattttcaacaccggtgaaatatcccaaatggatccttcgctatcaaggaaagtattgaataatattgtcgaagaaacaaacgcacttcaaaggccagttgttgaagttgtcaaggaagacagaagtgttcctgacctagcaggtgttcagcaagagcaagcagagaaatattcctattcaaacaatagtggaaaaggcagaaaaatttcaagatcattgtcacgaaggtccaaagatttgatgattaatctaaaatccagagccacaggcaaacaggatagtaacgttaaactttcacctgcttctaaagtgacatctagacgctcacaagatttaatgagggataatgattcacataccggccttgacacaccaaattctaacagcacttctttagatattttggtgaataatcaaaaaagcctaaactataaaagatttaccgataatggcactcttagggtgactagtggaaaggaaaccgcccttgaagaacagaagaatcacagttttaaatctccgtcaccaattgatcatttgttacaatcgccagctacaccaagtaatgtatccatgtatcgaactccgcctttagatagctcattgacatttgataggcggaatgggtcttcatacagtaaccaaaattatagcatacctagttggcagaaaactccaaagacccaattggagaatagcgacaattttgaggaacagaaggaaacactttacgaaaatagcgaatctagaaacgatccctcgcttgataaagaaattgtcacggcagagcactatctgaagcaattaaaaataaatttgaaagaacttgaatctcaaagggaagaattaatgaaagagatcactgaaatgaagtctatgaaagaggctctacgccgacatattgaatcctataatagcgagaaaaataaactatatcttgactccaatgaattatcaaataatccaccgatgataaatgaaatcagcttaggtgagtcgccacccgtgaaacatgttgcaactgcaagttctgtagcgcgaagttctgttaaaccaaaattttggaagtttttttcatctgcaaagccacagaccgagcaatctatacaaggtgtcagtacaaataatacaaattccatcgttaaaagtgccccagttttgctttctgctccctcatctggtagtaattccggccgtttagaaatttcaccacctgtgctacaaaatcctaatgaatttagtgacgttagattagtacctatcgagaacgatgcaaatatgggacaaagtaaagatggagaagaatatttggatggaagcaatttgtatggttcaagtctcgttgctaggtgcaattatgaaaacaatgaaataccgatgatactatctgtctgcatagattttattgaatcagacgaagaaaatatgagatcggagggcatttatagaaaatcaggttcccagctagtcatagaagaaatagaaaagcaattttctgcatggaaagtacaacaaaataccgaaacgccaaatattttaacggaacaagatctcaacgttgttactggtgtgttgaagcgatacttaagaaagctccccaaccctatctttacctttcaaatatacgagccgttgatgaggttagttaaatctaaaaaaatgatggaaaacttgccatttgttggaggaaagttgtccttagaagcaaagaattcggacacttatatgtcgagcaagagcgctttaaaaaacatattggaagaccttccaagggaacattatagggtgttaagagtactgagtgaacatatagaaaaggttacacggtacagtcactggaatcgaatgacgctttataatttggctttagtttttgctccaggtttgattcgtgatttcagtggagaaaaggatattattgatatgaaagaaagaaactatattgtcgcatttatatttgggaactacaaagatatcctgacgtag

SEQ ID NO: 46063 - DNA, 879 bp, Saccharomyces cerevisiae
atggaggacagtaaaaagaaaggattaatagaaggcgctatactcgatataataaacggttccattgcaggcgcctgtggtaaggtgatcgagtttcctttcgatactgtgaaagtcaggttgcaaacacaagcatccaacgtgttcccaacaacatggtcttgtataaaatttacttaccaaaatgaaggaatagcacgagggttttttcaaggcattgcttcacctttagttggagcatgtctggagaacgcgacattatttgtgtcttataaccaatgttctaaatttttagaaaaacatacaaacgttttcccgttggggcaaatcctgatctctggtggagtagcgggttcatgtgctagtttagttttgacacccgtggagctggtgaagtgtaagttgcaggttgcgaacttacaagttgcatcagctaaaacgaaacatacaaaggtgttgcctacaataaaagcaattataactgagagaggattggcaggattgtggcaagggcaatcgggcacttttattcgagaaagcttcggtggtgttgcctggtttgcaacctacgaaatagttaagaagtcgttgaaagataggcactcccttgatgacccaaaaagagatgaaagtaagatatgggaactacttattagtggagggagcgctggattggcattcaacgccagtatttttcctgcggatactgtgaaatcagtaatgcaaactgaacatataagcctcaccaatgcggtgaagaagatatttggcaaatttggactaaagggtttttatcgaggactgggtataaccctttttagggcagtaccagcaaacgctgcagttttttacatctttgagactctttctgcactttaa

SEQ ID NO: 46064 - DNA, 1110 bp, Saccharomyces cerevisiae
atgttgagaaatactttttttagaaacacctcgaggaggtttttggctactgtaaagcaaccttcaatcggaagatataccggcaaacctaacccttctaccggcaaatacacggtctcgttcattgaaggtgatggtatcggacctgaaatttccaagtctgtaaagaaaatctttagtgcagcaaacgtccccatagaatgggaatcttgtgatgttagccctatctttgtcaacggattaacgaccattcctgaccctgccgtacaatctatcacaaaaaacctggttgcactaaaaggtccactagctacacctattggtaaaggtcacagatctttgaatttgacattgagaaaaacatttgggttatttgccaacgttcgtcccgcaaagtctattgaaggttttaagaccacttacgaaaacgttgatttagttcttatcagagagaataccgaaggtgaatattctggtatcgaacacatagtttgccctggcgttgttcaatctattaaactgatcacaagagatgcctctgagcgagtcattagatacgcttttgaatatgcaagagccatcggcagaccaagagttattgtggtacataaatctactatccagagattagctgatggtttattcgttaatgttgccaaagaactatccaaagagtatcctgaccttactttagaaactgaacttattgataacagtgtgttaaaggtggtcaccaacccatctgcttacacagacgctgtttctgtttgtccaaatctatacggtgatatcttgtccgacttgaactctggtttgagcgccggttctttaggtttaactccatctgccaatattggtcataaaatctcgatctttgaagctgtccatggctctgcccctgatattgccggtcaagataaagcgaatccaactgccctacttttatcttcagtaatgatgttaaaccacatgggtctaacgaatcatgctgaccaaattcaaaatgcagtattgtctactatcgcatcaggtccagaaaacagaacaggtgacttggctggtactgctactacttcatcattcactgaagcagtcatcaagagattataa

SEQ ID NO: 46065 - DNA, 990 bp, Saccharomyces cerevisiae
atgttaagatctaccgtttcaaaagcttctctcaaaatttgtcgtcactttcacagagaatctattccttacgataagacgatcaaaaatttgctgcttcccaaggacaccaaggtgatctttcaggggttcacaggtaaacaaggtacttttcatgccagcatctctcaagaatatggtacaaatgttgtgggtggtacgaacccaaaaaaggcgggtcaaacacatttaggccaacctgtctttgcctctgtgaaggacgcgattaaggagactggagccactgccagtgccatctttgttcctccaccgatcgcagctgctgccattaaagaatctattgaagctgaaattccgttagctgtatgtatcactgaaggtattcctcaacatgacatgttatacattgcagaaatgttgcagacacaagataaaacaagattagttgggcccaactgccctggtatcattaacccagcaacaaaggtaagaattggtatccagcccccaaaaatttttcaagctggtaaaatcggtattatttccagatcgggaactttgacatacgaagctgttcagcaaactacaaaaactgaccttggtcaatcactggttattggtatgggtggtgatgcttttcccggtactgattttattgacgccttgaaattatttctagaagatgaaactacagaaggtattattatgttaggtgaaataggtggtaaggccgaaatcgaagctgctcaatttctcaaagaatacaactttagcaggagtaagccgatgccggtggcatctttcatcgcaggaactgttgctggtcaaatgaaaggtgttagaatgggtcactccggtgcaattgtagaaggatctggaactgatgcagaatccaaaaaacaagctttgagagatgttggtgttgccgtcgttgaatctccaggttacttaggtcaagctttactggatcaatttgccaaatttaaatga

SEQ ID NO: 46066 - DNA, 3675 bp, Saccharomyces cerevisiae
atgtcagaccttgcaaactcagaaaagtattatgatgaggacccatatggattcgaggatgaaagtgcaccaattactgcagaagattcgtgggctgttatatccgctttttttcgcgagaaggggctagtttcacaacaacttgactctttcaatcaattcgttgattatactttacaagacattatttgcgaggattccaccttgattttagagcagttggctcaacatactaccgaatcagacaacatcagtagaaagtatgagattagttttggtaaaatctatgttacaaagccaatggtaaatgaatctgatggtgttacccatgcgttgtatccacaagaagcacgtttacgtaatttgacatattcgtctggtttatttgttgatgttaagaagagaacatatgaagctattgatgttccaggtagggaactgaaatatgaattaattgccgaagaatctgaagatgacagcgaaagcggaaaagttttcattggccgtttaccgattatgttaagatcaaagaattgttacctaagtgaggctacagaatcagatttatataagctgaaagaatgtccctttgatatgggtggttatttcatcattaatggttctgaaaaagttttgattgcacaggagcgttctgcaggtaatattgttcaagtgtttaaaaaagccgccccatctccaatttctcatgtagcagaaattagatctgcccttgaaaaaggttctaggtttatcagtacccttcaagtcaagctttatggtcgtgagggtagttcagctcgtactattaaagccacattaccatatatcaaacaggatattcctattgtaatcatattcagagctttaggtattattccagacggtgaaattttagaacatatctgctacgacgtaaatgattggcaaatgctggaaatgcttaagccttgtgttgaagacgggtttgttattcaagatcgtgaaactgcattagactttattggtcgtcgtggtactgcccttggtattaagaaagaaaaaagaatccaatatgcaaaagacattttacaaaaagaattcctacctcatattactcaattagaaggttttgaaagtagaaaggcatttttcttaggttatatgataaacagattattactgtgtgctttagatcgtaaagaccaagatgatcgtgatcatttcgggaaaaaaagattagatttggcaggtccattattggcccaacttttcaagacattgttcaaaaaattaactaaagatattttccgttatatgcaaagaactgtagaggaagcccatgactttaacatgaaattagcgattaacgcaaaaaccataacatcgggtcttaagtacgctttggctactggtaactggggtgaacaaaaaaaagccatgtcttctagggcaggtgtttctcaggttttgaaccgttacacttattcatccaccttatcacatttaagaagaacaaatacccctattggtcgtgatggtaaattagccaaaccacgtcaattgcataatacacattgggggttggtctgtcctgcagaaactcctgaaggccaagcgtgtggtttagttaagaatctgtcactgatgtcttgtatttctgttggtacagatccgatgcctatcatcacttttttgagtgaatggggtatggaaccactggaagattacgtaccacatcaatcacctgacgcgacaagggtcttcgtcaatggtgtttggcacggtgttcacagaaacccagcaagattaatggaaacccttagaacattgagaagaaagggtgatatcaatccggaagtttctatgattagagatattcgtgaaaaggagctaaaaatctttacagatgccggtagagtttatagaccattatttattgttgaagacgatgaatcactaggccataaggaattaaaggtaagaaagggtcatattgccaaactgatggctaccgaatatcaagatattgaaggtggatttgaagatgtagaagaatatacatggtcatcattattgaatgagggtttagtggaatacattgatgctgaagaagaagaatctatattgatcgcaatgcaaccggaagatctcgagcctgcagaggcaaatgaggaaaacgatctcgatgttgatcctgccaaacgtataagagtatcacatcatgctacaacatttacacattgtgagattcatccttctatgattctcggtgtcgcagcatccattattccattccctgaccataatcaatctccgcgtaacacttaccaatctgcgatgggtaagcaagctatgggtgtgtttttaacaaactataatgtgcgtatggatactatggccaatattctatattatcctcaaaaaccattgggtactacacgtgcgatggaatatttgaagtttagagaattacccgctggtcaaaatgcaattgttgctattgcatgttactccggttataatcaagaagattctatgattatgaaccagtcttcaattgatcgtggtctattcagatctctgtttttcagatcttatatggatcaggaaaagaagtacggtatgtctataacggagacttttgagaaaccacaacgtacaaacaccttaagaatgaaacatggtacatacgataagttggacgatgatggtctaattgcgcctggtgttagagtttcaggagaagatgtgattatcggtaaaaccacaccaatctcaccagatgaagaggaactcggtcaaagaacagcataccattccaaacgtgatgcttccacaccattgagaagtactgaaaacggtattgttgatcaagttttagtcacaacaaaccaagatgggttaaagtttgtcaaagttcgtgtaagaactacaaagattcctcaaattggtgacaaatttgcttctcgtcacggtcaaaagggtactattggtatcacatatcgtagagaagatatgccatttaccgcagaaggtattgttccagatttgattattaaccctcatgctattccatctcgtatgactgttgcccatttaattgaatgtttgttgagtaaagtcgcggcactatctggtaatgaaggtgacgcctctcctttcacggacattactgtagaaggtatatccaaactactgcgtgagcatggttatcaatctcgtgggtttgaagttatgtataatggtcacacaggtaaaaaactaatggctcaaattttctttggtcctacatattatcaacgactaagacacatggtggatgacaagatacatgccagagcacgtggtccaatgcaagtattgacgagacagcctgtagagggtagatcgagagacggtggtttaagattcggtgagatggaacgtgactgtatgattgctcatggtgctgcctcattcttgaaggagagattaatggaagcatccgatgcctttagagtccatatttgtggtatttgcgggctgatgacagttatcgcgaaattaaatcataaccaatttgaatgtaagggatgtgataataagattgatatttaccaaattcatattccatacgccgcgaagttattattccaagaacttatggctatgaacattacaccacgtttatataccgatcgttcgagagatttttaa

SEQ ID NO: 46067 - DNA, 4536 bp, Saccharomyces cerevisiae
atgcccgaggccaagcttaacaataacgtcaacgacgttactagctactcctccgcgtcttcttctactgaaaacgctgctgatctacacaattataatgggttcgatgagcatacagaagctcgaatccaaaaactggcaaggactctgaccgcacagagtatgcaaaactccactcaatcggcacccaacaaaagtgatgctcagtctatattttctagcggtgtggaaggtgtaaacccgatattctctgatcctgaagctccaggctatgacccaaaattggaccccaactccgaaaatttttctagtgccgcctgggttaagaatatggctcacctaagtgcggcagaccctgacttttataagccttattccttaggttgcgcttggaagaacttaagtgcttctggtgcttccgcagatgtcgcctatcagtcaactgtggttaatattccatacaaaatcctaaaaagtgggctgagaaagtttcaacgttctaaagaaaccaatactttccaaatcttgaaaccaatggatggttgcctaaacccaggtgaattgctagtcgttttaggtagaccaggctctggctgtactactttattaaaatccatctcttcaaatactcatggttttgatcttggtgcagatactaaaatttcttacagcggctactcaggtgatgatattaagaaacattttcgtggtgaagttgtttacaacgcagaagctgatgtacatctgcctcatttaacagtcttcgaaactttggttacagtagcgaggttgaaaaccccacagaaccgtatcaagggtgtcgatagggaaagttatgcgaatcatttggcggaagtagcaatggcaacgtacggtttatcgcatacaaggaatacaaaagttggtaacgacatcgtcagaggtgtttccggtggtgaaaggaagcgtgtctccattgctgaagtctccatctgtggatccaaatttcaatgctgggataatgctacaaggggtttggattccgctaccgctttggaatttattcgtgccttaaagactcaagctgatatttccaatacatctgccacagtggccatctatcaatgttctcaagatgcgtacgacttgttcaataaagtctgtgttttggatgatggttatcagatctactatggccccgccgataaggccaagaagtactttgaagatatggggtatgtttgtccaagcagacaaaccaccgcagattttttgacctcagttacaagtccctctgagagaaccctgaacaaagatatgctaaaaaaaggtattcatataccacagaccccgaaggaaatgaacgattactgggtaaaatctccaaattacaaagagctaatgaaagaagtcgaccaacgattattgaatgacgatgaagcaagccgtgaagctattaaggaagcccacattgctaagcagtccaagagagcaagaccttcctctccttatactgtcagctacatgatgcaagttaaatacctattaatcagaaatatgtggagactgcgaaataatatcgggtttacattatttatgattttgggtaactgtagtatggctttaatcttgggttcaatgtttttcaagatcatgaaaaagggtgatacttctacattctatttccgtggttctgctatgttttttgcaattctattcaatgcattttcttctctgttagaaatcttttcgttatatgaggccagaccaatcactgaaaaacatagaacatattcgttataccatccaagtgctgacgcttttgcatcagttctatcagaaataccctcaaagttaatcatcgctgtttgcttcaatataatcttctatttcttagtagactttagaagaaatggtggtgtattctttttctacttattaataaacattgtcgcggttttctccatgtctcacttgtttagatgtgttggttccttaacaaagacattgtcagaagctatggttcccgcttctatgttattgttggctctatccatgtataccggttttgctattcctaagaagaagatcctacgttggtctaaatggatttggtatatcaatccgttggcttacttattcgaatctttgttaattaacgagtttcatggtataaaattcccctgcgctgaatatgttcctcgtggtcctgcgtatgcaaacatttctagtacagaatctgtttgtaccgtggttggagctgttccaggccaagactatgttctgggtgatgatttcattagaggaacttatcaatactaccacaaagacaaatggcgtggtttcggtattggtatggcttatgtcgtcttctttttctttgtctatctattcttatgtgaatacaacgagggtgctaaacaaaaaggtgaaatattagttttcccacgcagtatagttaaaagaatgaagaaaagaggtgtactaactgaaaagaatgcaaatgaccccgaaaacgttggggaacgtagtgacttatccagcgataggaaaatgctacaagaaagctctgaagaggaatccgatacttacggagaaattggtttatccaagtcagaggctatatttcactggagaaacctttgttacgaagttcagattaaggccgaaacaagacgtattttgaacaatgttgatggttgggttaaaccaggtactttaacagctttaatgggtgcttcaggtgctggtaaaaccacacttctggattgtttggccgaaagggttaccatgggtgttataactggtgatatcttggtcaatggtattccccgtgataaatctttcccaagatccattggttattgtcagcaacaagatttgcatttgaaaactgccactgtgagggagtcattgagattttctgcttacctacgtcaaccagctgaagtttccattgaagaaaagaacagatatgttgaagaagttattaaaattcttgaaatggaaaaatatgctgatgctgttgttggtgttgctggtgaaggtttaaacgttgaacaaagaaaaagattaaccattggtgttgaattaactgccaaaccaaaactgttggtctttttagatgaacctacttctggtttggattctcaaactgcttggtctatttgtcagctaatgaaaaagttggcaaatcatggtcaagcaattctatgtactattcaccaaccctctgctattttgatgcaagaattcgatcgtttactatttatgcaacgtggtggtaagactgtctactttggcgacttgggcgaaggttgtaaaactatgatcgattattttgaaagccatggtgctcataaatgccctgctgacgccaacccagctgaatggatgctagaagttgttggtgcagctccaggctctcatgcaaatcaagattattacgaagtttggaggaattctgaagagtacagggccgttcaatctgaattagattggatggaaagagaattaccaaagaaaggttcgataactgcagctgaggacaaacacgaattttcacaatcaattatttatcaaacaaaattggtcagtattcgtctattccagcaatattggagatctccagattatttatggtcgaagtttattttaactattttcaatcaattgttcatcggtttcactttcttcaaagcaggaacctcgctacagggtttacaaaatcaaatgttggctgtgttcatgtttacggttattttcaatcctattctacaacaatacctaccatcttttgtccagcaaagagatttgtatgaggccagggaacgcccctcaaggactttttcttggatttcatttatcttcgctcaaatattcgtggaagttccatggaatatattggcaggtactattgcttattttatctactattatccaattggattttactccaacgcgtctgcagctggccagttgcatgaaaggggtgctttattttggttgttctcttgtgctttctacgtttatgttggttctatgggtctgcttgtcatttcattcaaccaagttgcagaaagtgcagctaacttagcctctttgttgtttacaatgtctttgtctttttgtggtgttatgactaccccaagtgccatgcctagattttggatattcatgtacagggtttcacctttgacttatttcattcaggctctgttggctgttggtgttgctaacgtagacgtcaaatgcgctgattacgaattgctagaattcacaccaccatccggtatgacatgtgggcagtacatggaaccatatttacaactagcaaagactggttacttaactgatgaaaatgccactgacacctgtagtttctgtcaaatatctacaaccaatgattacttagctaatgtcaattctttctacagtgagagatggagaaattatggtatcttcatctgttatattgcattcaattatatcgctggtgtctttttctactggttagcaagagtgcctaaaaagaacggtaaactctccaagaaataa

SEQ ID NO: 46068 - DNA, 786 bp, Saccharomyces cerevisiae
atggcaggtttatcgttcgacaattatcaaagaaataatttcttagcggaaaactcgcacacacaacctaaggcaacttccacgggtaccaccattgtaggcgtaaaattcaataacggagtggtgattgcagcagatacaagatcaacacaaggtccaattgtcgcagataagaattgcgcaaaattgcatagaatttcccccaaaatatggtgtgctggtgccggtaccgccgccgatactgaggcagttacgcagttgatcgggtctaacattgaattacattccttatatacctcgagagaaccaagagtggtctcagctttacaaatgctaaagcagcacctatttaagtaccaaggtcatattggtgcttatttgattgttgcaggtgtagaccctacgggatctcatttgttctccattcatgcgcatggttctactgacgtgggctactacctttctctaggatctggttctctagcggcaatggctgtgttggaatcacactggaagcaagaccttacgaaggaggaagccataaagttggcctctgatgcaatccaggctggtatctggaatgatttggggtctggttctaatgtggatgtgtgtgtcatggaaataggtaaagatgcagaatacttgaggaattacttgactccaaatgttagagaagaaaagcagaaaagctacaaattccccaggggtacaactgctgtgctgaaggagagtattgtcaatatttgtgacatacaagaagaacaagtcgatataacggcttga

SEQ ID NO: 46069 - DNA, 1182 bp, Saccharomyces cerevisiae
atgctttccagaacaatccgtacacaaggttccttcctaagaagatcacaactgaccattacaagatcattttcggttacattcaacatgcagaatgcacaaaagagatcacccacaggaattgttttgatgaacatgggtggcccctctaaagttgaggaaacatatgattttttgtatcaattatttgccgataatgacctaattcccattagtgctaagtatcagaagacaattgctaaatatattgctaagtttcgtacccccaagatagagaagcaatatagggaaattggtgggggctccccaatccggaaatggtctgagtatcaagccactgaggtctgtaaaatcttagataaaacctgtccagaaacggcgcctcataagccttacgtggcgtttcgttacgcaaagccgctaaccgcagaaacttataaacaaatgctaaaagatggcgtgaagaaggcagtggccttttctcaatatcctcatttctcttattccactaccgggtcatccatcaacgaattgtggagacagattaaggcattggactccgagagatctatatcttggtcggttattgatcgttggcctacaaatgaaggtctaatcaaggccttctccgaaaatatcaccaaaaaactacaagagtttccgcaacctgtcagagacaaggttgttttattgttttccgcacattctctacccatggatgttgttaacaccggtgatgcctacccagctgaggtagctgcgacggtttacaacatcatgcaaaaattaaagtttaaaaacccttataggttggtttggcaatcccaagttggaccaaaaccatggttgggagcgcagacagctgaaattgcggaatttttaggccccaaagttgatggcctaatgtttattcctatcgcctttacctctgatcatattgaaacattgcatgaaattgacttaggcgtcattggggaatcggaatataaggataaatttaagagatgcgaatctttaaatggcaaccagacctttattgaaggcatggcagatctcgtcaaaagccacttacagagtaaccaactctattctaatcaactacctcttgattttgcacttggcaagtccaatgatcctgtaaaggacctttcattggtatttggcaatcacgaatctacttga

SEQ ID NO: 46070 - DNA, 1395 bp, Saccharomyces cerevisiae
atgccagaagatacaagctatagcaactccttcgaggattattacaacaattctcacgcgatttccccttacaaggattcattttacaaagaaatgacaccatctaagccaaatgtaaggtttggtgatgatgatgttaacatttttgatcaaagaaaaaaagtaaatgaaatcaacaagaataacaccgtcaaaaggtcgatcccatcatcgataagcaccactattacccccaacaagtctagcttaaagtcaccaaggggaaaaagggcttcgaagaattcttttgataatgaaactaagttagaatcgaaaaatgaaactctgaaagaggtcaatgacgcggttaaccgttgctatgcgctttgtaacattccaactaagcatgtatccataaatagtatttctgatttggcgcagacgttcgaaacgcttgctgtagggataacccatgaaacgaacagaaaagctgagtgtgaacggagcaagaatgcaatagattcactttactaccatgaacagctagaaaaaaaagaacttaatgaaaaaagccttcaaatggcaatcgatcacttgctgaaggtcacaaagcaaaatttgagacaagctgacgatggaaacaaactgaaagaaacagaagcactcaaaagtttcattgaggaaatagaggaagttgacgataataagatttccatcaacagtttacaacaacagttgcttgaagaaaaaacggcaaacaacattttgcgaagggattattataaactccaggaacgtggaaggcgtttatgtcacgagtttcaggagttgcaagatgattattccaaacaaatgaaacaaaaggaatatgaggtgcaaaaactcaagaatgaaattaaagttttattaaacatgaacgataacttaaaggcagagaaggcccattactctcagaaagagaaacaatattttcaaaaatatacctatatagagaaatacatgaatcatgtcaaggaagagtataatagaaaagaggacgaatgcaaaaaattgaactttattattgacaagagcatgaaaaaaatagaacatttggagaggtcgcttcagactcaatttaccgctcaaaacagcttctcaactgcaatgatccaagaggaaggcccgaaagatgcccatttgaaggatcgctatcacaaagtcaaagagtttatggaacaaaagttgcagacttccaaaattaatgacccctcttgttctgaggcagaggcacttgataatgtactttgcttaatcgaaagcagtatgaaaacactggacaaaaatagtaaatgttatccaattgcgacaaaaaagtgcataaagtatgttactgactcaccaagacttaaagaaaatgaacacgttacaaattga

SEQ ID NO: 46071 - DNA, 2382 bp, Saccharomyces cerevisiae
atggtaatacaaactgctactacgttatcgccagctaaggcgagaccttctttccctcataacgatttgattaaaagtatgtcagacagccttataagtcgccccactcaccctccgattaggaaattaaagtcatccttgaaaatatcacaccctgaacctatttcaagatcaaagtcagaaattttctgcacatcacctgagaaaaatgtacgttttgctattgaattaacaactgttaagagatttgataaaaacgcggagccaagttctatctcaaatgaaaactcacccacattatcccctgttgatagcaataccgctgctgatgacgtccagcttttcaacaatgaggactgctggttcaatgattcttcgttggtcacaaacttgctgaaaaatgaaaagaagtttcgttatatgaattccttaaacaacatgttcaagttggacctttatgattcagaagatgaggatgatattgacgagcacatcaatagccaggccgagtatgggtatacctataattctttatctacccgaggaaaaacttctgaaaataaatctgctacctcttcactggctactcaggcaacaaatatatgtgattggaaacttcactgcacagacttggttcccttcaagatagcccctccactatttaccaaaacattatcggcctccgatttgcaaggtcagctcacaaagtacttaaatggccaaaatgtaaaactgcattctctcactcaattaggcgatgattcaagcaaaattacaggtctagtgtacgtcaaaaacttgagttttgaaaagtatttggaaattaaatttacgttcaactcttggagagatattcattacgttaccgccaactttaatagaacgataaattcgaatgttgatgagtttaaatttacaattgatttgaatagtttgaagtacattttactcatcaaaagaatcattactatggaaaagaatacaagcagctgtccactcaacattgaattatgctgcaggtatgacgttaataatgaaacatattatgataataataatggtaaaaattatcaccttttcatgactaccttcaagaagggcggtgaaacgaaggaaaagattccagttgtcgtcgagcctgcttctcaaacagatgcagccatgtcgccgaaggaaatgaaagcaaggttcgtctcctcgaatcccactctttcaaggtttttacctcaatcaagaaagttcagcgaggatacagattactataatacatctccattgaaacatctttatcataatgatacgacaagctgggttaagcccaagagattgaacgttgttttagataaacttgaaaatgctacccctcctcctccttcttctgctttggctaacgacaccgccagaactggtaaaataactaaagataagaacaatgtgctcgccccaccaacggccagtaatagtattgacctaccaatattaggatctcaacatcaatcactatattctggttcatcgtcatattcttcatcatcttcctccatttcctcttcattatcctttgcttcttcaaacaattcctccacaaattcttcttccgcctcttgtagtttcccacttactgagctcgataattttgattatgcgaacctatatgaacctaatgataccttcacaacggccaatttgtttaatcattcattaaattccctaatgccggagatttctactccatcattcttcggaggctttagaaatgagaatactattaataacaacgatagtaaaaatttggttacctctttggaggattcatatgaggacaaacaaagtgttattacagatactactatggacgaaaataataaaacttcgactatcaacaattccacagacacgttaatcaaaccctcaaaagaaaatggaacagttaaggagaataaatcatctgcaaacagcaccagtgcaccatcttcatctcagaaccgggccagtacaatactaaacgatcattcgaatgggaagagtgatctcaaatatgtcaactatcaatcattattggattcccattgtttctacaatcatccctcgtcgccgaatcttcaatctacttcattctcgagcgcagctcctttctcgggaatttcccaagcttctgatatttttgactatgaaaacgaagatagtgatagtaatcagattgcgggagaaatagacaataattcgtttcctcctcacttttacttagatgaggatgataaatctgcatgtctcagtgatgacgctttgattgatcatcacagaaataccaacccatttataaatactttcagttcatctccacccatcctttcccaagaggttgatcgatggcgactttga

SEQ ID NO: 46072 - DNA, 1902 bp, Saccharomyces cerevisiae
atgggactcctaaactcttcagataaggaaattatcaaaagggctctaccaaaagcgtcgaataagattattgatgttacggtggctcgactatacattgcataccctgataaaaatgaatggcagtacactggactttcaggagctcttgctctagtagacgatcttgtggggaatactttttttttgaaattagttgacatcaatggccatagaggagttatctgggaccaagaattgtatgtgaattttgaatactatcaagaccgtactttttttcatacatttgagatggaagaatgctttgcaggtttattgtttgtagatattaatgaagcatcgcactttttaaagagagttcaaaagcgtgaaagatatgctaacaggaaaactttgttgaacaaaaatgctgtagcattaaccaagaaagtaagagaagaacaaaaatctcaagtggtgcacggcccaagaggggagtcattgattgacaatcaaaggaaaagatataattatgaagatgtggacacaattccaactacaaagcataaggctcctccccctcctccgccaacggccgaaacatttgattcagaccaaacaagttcattttccgatatcaattcgacaacagcatccgcaccgactaccccagcccctgctcttcctcctgcatctcctgaagtaagaaaagaagaaacgcatccaaagcatagtttaccgcctttaccaaatcagtttgcgccattaccagaccctccacaacataactctccacctcaaaataacgcgccttcgcaaccccaaagcaatccatttccattcccaattcctgaaattccctcgacacagtctgcaacaaacccatttccatttccggtacctcagcagcagtttaatcaagctccttcaatgggcataccacagcagaataggccccttccacagttgcctaacagaaataatcggcctgtgccacctcctccgccaatgcgtaccactactgaaggttcaggtgttcgcctacctgctcctccacctccgccaaggcgtgggccagcaccaccgcctccaccacataggcacgtaaccagtaataccctgaattctgccggtggaaatagcctccttccacaggccactggaagaagagggccagcaccaccacctcctccaagagcatctcgccccacaccaaacgttacgatgcaacaaaatccacaacagtacaataattctaaccgcccctttggatatcagacaaatagcaacatgtcatctccaccccctcctccagtgacaactttcaataccctgacaccacaaatgactgcagcaactggacaacctgcagttccccttcctcagaatactcaagcaccttcgcaagccacaaatgtgccagtggcaccaccacctcctccggcatctttaggccagtcgcagatacctcagtcagcaccctcagcacctattccgccaacgttaccatcgacgacgagtgctgcaccacctccgccaccagcattcctaactcaacaacctcaatctggaggagctccagctccacccccacctcctcaaatgccagctacatcaacatccggaggcggttcattcgctgaaactactggagatgcaggtcgtgatgcacttttagcttcaattagaggggcaggtggcataggcgctttgagaaaagttgacaaatcgcagctagataagccctcagttttactgcaggaagcacgtggagaatctgcttcaccaccagcagcggctggaaatggaggcacacctggtggacctccggcttctttagcagatgcgttggcagcagctttaaacaaaagaaaaactaaagtgggagctcatgacgatatggacaatggtgatgattggtaa

SEQ ID NO: 46073 - DNA, 1188 bp, Saccharomyces cerevisiae
atgtctttggaaagagaggaaccacaacatttcggagcagggccagctcaaatgcctacaccagttttgcaacaagctgctaaagacttaatcaatttcaatgacataggtttgggtatcggtgaaatttctcaccgttcgaaggatgccaccaaagtgattgaagactctaagaagcacttaatcgaactgctaaatattcctgacactcatgaagtgttctacttgcaaggtggtggcactactggtttttcttccgttgctactaatttggcagctgcatatgtgggtaagcatgggaagattgcacctgccggttatttagtcaccggtagttggtctcagaaatcttttgaagaggcaaagagattgcacgttcctgctgaagttatcttcaacgctaaagattataacaatggcaaatttggtaaaattccggatgaatccctttgggaagataaaatcaaaggtaaggctttctcatacgtgtacctatgtgagaatgaaactgttcatggtgttgaatggccagaattaccaaaatgtttagtaaacgaccccaacatcgaaattgttgctgacttatccagcgacattttgtctcgtaagattgacgtttctcaatacggtgtcatcatggcaggcgcccaaaaaaacattggtttagcaggcttaaccctatacattatcaagaaatccatccttaagaatatttctggcgcttctgatgaaacattacatgaattgggagtaccaatcacccctattgcattcgactatccaacggtggtgaagaacaactcagcctataatacaattccaattttcactttacatgttatggatctcgtgttccaacatattttgaagaagggtggtgttgaagcgcaacaggctgaaaatgaagaaaaggccaagatattatatgaggcattggatgcaaattcagatttttacaacgttccagtggatccaaagtgtagatcaaaaatgaatgtcgttttcacccttaaaaaggacggccttgatgaccagtttctaaaagaggcagctgctcgtcatttaaccggtttgaaaggacatcgttcagttggtgggttcagagcctccatctataacgcgctttcagtgaaagctgtacaaaacttggtagattttatcaaggaatttgctgagaaaaacgcttaa

SEQ ID NO: 46074 - DNA, 663 bp, Saccharomyces cerevisiae
atgtcagcacctgctcaaaacaatgccgaggttcccactttcaagttagttcttgttggtgatggaggtactggtaagactacctttgtgaagagacatctgaccggtgaatttgaaaaaaaatacattgcaactatcggagtagaagttcatcctctatctttttatactaatttcggtgaaattaagttcgatgtctgggataccgcaggccaagaaaaatttggcgggttaagggatggttattacatcaatgctcaatgtgcaattattatgttcgatgtcacatccagaatcacttacaagaacgtccctaattggcatagagacttagtccgtgtgtgtgaaaatattcccatagtgctatgtggcaataaagtcgatgtcaaagagagaaaggtcaaggccaagactatcactttccatagaaaaaagaacttacaatattatgacatttctgcaaaatccaattataattttgaaaagcctttcttgtggttggctagaaaacttgccggtaacccacaattggagtttgttgcgtctcctgcattggccccacctgaggtgcaagttgacgagcaactaatgcaccaataccagcaagaaatggaccaagccactgctttaccattacctgatgaagacgatgctgatttataa

SEQ ID NO: 46075 - DNA, 1413 bp, Saccharomyces cerevisiae
atgtcctcccaacaacacaagttcaagcgcccagatgtctccgttagagacaagaaattggacactcttaacgttcaattgaaaaaaatcgacactgaaatcggtttaattagaaagcaaatcgatcaacaccaggtcaacgataccacccaacaagaacgtaagaagttacaggataagaacaaggagatcatcaagatccaagctgacttgaaaacccgtagaagcaacattcacgactctattaagcaattggatgctcaaatcaagagaaaaaacaaccaaattgaggagaagttaggcaaaaaggccaagttctcgtccactgcagaagccaagcaaagaatcaatgagattgaagagtctattgcctctggtgacctttctttggttcaagaaaaactactagtcaaagaaatgcaatctttgaacaaattgattaaggacttagttaacatcgagccaatcagaaagtctgttgatgctgacaaggctaaaatcaatcaattgaaggaagaattgaacggattgaatccaaaggatgtctccaaccaattcgaagagaaccagcaaaaattgaacgatatccattcaaaaactcaaggtgtttacgacaaaagacaaactttattcaacaaacgtgctgccttgtacaagaagcgtgacgaattatacagtcaaatcagacagatcagagctgactttgacaacgaattcaaatcattcagagccaaattggacaaagaacgtttgaaacgtgaagaagaacaaagattatccaaacttttggaacagaaagatgttgatatgggtaaattgcaagaaaagttgactcatgccaagattccagccttcacttatgaaatcggtgccattgagaattctttgcttgtcctggacccaacttatgtgaaaccaaagaaaaacatcctgcctgacttgagtagcaatgctttggagaccaagcctgccagaaaagttgttgctgatgatttggttttggtcactccaaagaaggatgattttgtcaatgttgctccatctaaatctaagaaatacaagaagaagaaccaacagaagaacactgaaaatgagcaacctgcttctattttcaacaaagtcgatggcaagtttactttagaaccaacactaattgctactttggccgaattagacgtaactgtcccaatcaacagtgatgatgtcaagatcaccgttgagcaattgaagaagaagcatgaagagcttttgtcgaaacaagaagagcaaacaaaacaaaacattgaatctgtcgaaaaggaaattgagaaattaaatttggactactctaacaaagagcaacaagtaaaaaaggaattggaagaaaaaagattgaaagaacaggaagagtctgaaaaagataaagaaaattaa

SEQ ID NO: 46076 - DNA, 663 bp, Saccharomyces cerevisiae
atgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtag

SEQ ID NO: 46077 - DNA, 1815 bp, Saccharomyces cerevisiae
atggctgaactgagcgaacaagtgcaaaatttaagcatcaacgacaacaacgagaatggttatgttcctcctcacttaagaggaaaaccaagaagtgccagaaataacagtagcaactacaataacaacaacggcggctacaacggtggccgtggcggtggcagcttctttagcaacaaccgtcgtggtggttacggcaacggtggtttcttcggtggaaacaacggtggcagcagatctaacggccgttctggtggtagatggatcgatggcaaacatgtcccagctccaagaaacgaaaaggccgagatcgccatatttggtgtccccgaggatccaaatttccaatcttctggtattaacttcgataactacgatgatattccagtggacgcctctggtaaggatgttcctgaaccaatcacagaatttacctcacctccattggacggattgttattggaaaacatcaaattggcccgtttcaccaagccaacacctgtgcaaaaatactccgtccctatcgttgccaacggcagagatttgatggcctgtgcgcagaccggttctggtaagactggtgggtttttattcccagtgttgtccgaatcatttaagactggaccatctcctcaaccagagtctcaaggctccttttaccaaagaaaggcctacccaactgctgtcattatggctccaactagagagttggccacccaaattttcgatgaagccaagaaatttacttatagatcctgggtcaaggcctgcgtcgtctacggtggttctccaattggtaaccaactaagagaaattgaacgtggttgcgatcttttagtcgctactccaggtcgtttgaatgacttgttggaacgtggtaaaatttctttggccaacgtcaagtatttggttctagatgaagctgatagaatgttggatatgggtttcgaacctcaaattagacatattgtcgaagactgtgatatgactcctgttggtgaaagacaaactctgatgttctcagctacttttcccgctgatatccaacatttggcccgtgatttcttaagtgactacatctttttgtctgttggtagagtcggttctacttcagaaaacattactcaaaaagtcttatacgttgaaaatcaagataagaagtcagccttattggatctattgtctgcatccactgacggtttgactttgatctttgtcgaaactaagagaatggcagatcaattgaccgatttcctgatcatgcaaaactttagagctaccgccattcatggtgaccgtacccaatctgagagagaacgtgccttggccgccttcagatctggtgccgctactttattggttgccacagctgtcgcagctagaggtctagatattccaaacgtcacccacgttatcaactacgatttaccaagtgatgtcgatgattacgtccatagaattggtagaactggtcgtgccggtaacaccggtcttgccactgcctttttcaacagtgaaaacagtaacattgttaaaggtttgcatgaaattttgactgaagctaaccaagaagtcccatcattcttgaaggacgctatgatgagtgctccaggtagcagaagcaacagccgtagaggcggtttcggtcgcaacaacaacagagattaccgtaaggccggaggcgctagcgcaggcggctggggctcttcaagaagcagagataactctttcagaggcggtagtggctggggtagcgattccaagtcttctggctggggtaacagcggtggttcaaacaactcttcttggtggtga

SEQ ID NO: 46078 - DNA, 3450 bp, Saccharomyces cerevisiae
atggttgctgcgacaaaaagacggaaaactcatatacataagcatgtgaaagacgaggcttttgatgatttattgaaaccagtatataaaggtaagaaactaactgatgaaatcaatactgctcaggataagtggcaccttttaccagcattcttgaaggttaaaggtttggtgaagcaacatcttgactcatttaactacttcgttgatacagatttaaaaaaaattataaaggcaaatcaattaattttgagtgatgttgatccagaattctacctgaagtacgtcgatattagagtgggtaagaagtcctcttcttcgacaaaagattatttgactccgcctcatgagtgtaggcttagagatatgacatactctgcaccaatctacgtggatatagaatacactagaggtagaaacattattatgcataaagacgtggaaattggtaggatgccgatcatgctgagatctaataaatgtatcctatatgatgctgatgaatcgaaaatggctaaattaaacgagtgtccgttggatcctggtggttactttattgttaacggtaccgaaaaagtaattcttgttcaagaacaattatccaagaatcgtattattgtggaggcagatgagaagaaaggcattgttcaggcctccgttacttcatctacccatgaaagaaaatctaagacttatgtcattaccaaaaatggcaagatctatttgaagcacaattccatcgctgaagaaattcctattgctattgttctcaaagcctgtggtattttatcagatttagaaattatgcaattggtttgcggtaatgatagtagctaccaagatatttttgcagtcaatttggaagaatcttcgaaattagatatttacacacaacagcaagctttagagtatattggtgcaaaagtaaagacaatgagaaggcaaaaactgactatcctgcaagagggtatagaggccattgctaccacggttattgcacatttgactgtggaagcccttgactttagagaaaaggctttatatattgccatgatgacgcgcagggtggtgatggcaatgtataaccctaagatgattgatgatagagattatgttggtaataaacgtcttgaattagcaggccaattgatttctttattgttcgaagatttgttcaaaaagtttaataatgattttaaactaagcattgataaggtcttgaaaaaaccaaatagggctatggaatacgatgcattattgtcaattaacgtccattcaaataacatcaccagcggactgaacagagctatctcaaccggtaattggtctcttaaaagatttaagatggaaagagcgggtgttacacatgttctttccagactatcttatatttccgcattgggtatgatgacaagaatttcttctcagtttgaaaaatcaagaaaagtttccggtccaagagcattacaaccttctcaatttggtatgctttgtactgcagatactccagaaggtgaggcgtgtggtctagtgaaaaatttagcattaatgactcatattactacagatgacgaagaggaacctataaagaaattatgttatgttcttggtgtagaagacataacattgattgacagtgcatccttgcatttaaactatggtgtttatttgaatggtactttaattggttcaatcagattcccaacaaaattcgttactcagttcagacatctgagaagaacaggtaaagtgtcggagtttatctcaatttattcaaattctcaccaaatggcagttcatattgcaacagatggtggtagaatttgtaggccattaatcattgtttctgatggtcaatctcgcgtgaaagatattcatttacgcaaattattagatggtgagttagatttcgatgattttttgaaactcggattggtggaatatttagatgtcaatgaagaaaacgattcttacattgcattgtatgaaaaagatatagttccctcgatgacacatttagaaatcgagccattcacaattttaggtgctgttgctggtttaattccatatccacatcataaccaatcccctcgtaacacatatcaatgtgcgatgggtaagcaagcgattggtgcaatcgcctacaatcaattcaagagaatagatacattattatacttgatgacttatccacaacagccaatggtgaaaaccaaaacaattgaattgatcgattatgataaattacctgctggtcaaaatgctacggttgctgtcatgtcctattctggttatgatattgaagatgctttggttttgaataagtcatccatcgatagaggtttcggccgttgcgaaacacgtagaaagacaaccactgttttgaaaagatatgcgaaccatacccaagatatcatcggtggtatgagagttgatgaaaatggagatcctatctggcaacatcaatctcttggtcctgatggtctaggtgaggtgggtatgaaggtccaaagtggacaaatttatataaataagtcagttccaactaactcagcagacgccccaaacccaaacaacgtaaacgtccaaactcaatatagggaagctccggtaatatatagaggtccagaaccttctcacattgaccaagttatgatgtctgtttcggataacgatcaagctttaatcaaagttttgctaagacaaaacagaaggccagaattaggtgacaaattttcttctagacatggtcaaaaaggtgtttgtggtattattgtaaagcaagaagacatgcccttcaacgatcaaggtatagttccagacattatcatgaaccctcacggttttccatctcgtatgactgtgggtaaaatgatcgaactgatatcgggtaaagctggtgtattgaatggtacattggaatatggtacttgttttggtggttctaaacttgaagatatgtctaagattttggtagaccaaggtttcaactattccggtaaggatatgttatattcaggtataacaggtgagtgtttacaggcttacatcttttttggccccatttactatcaaaagttaaagcatatggtcttagataagatgcatgcaagagctcgtggtccaagggctgttttgacacgtcaaccaactgagggtagatctagagatggtggtctgaggttgggtgagatggagagggattgtgtaatcgcgtatggtgcttcacaattgctgttagaaaggttgatgattagttcagatgcttttgaagttgatgtctgcgataaatgtggattaatgggctatagtggttggtgtactacctgcaaaagtgctgagaatattattaagatgactattccatatgcagcaaaactgttattccaggaattattatccatgaacatagccccaagattaagattggaagatatcttccagcagtaa

SEQ ID NO: 46079 - DNA, 2253 bp, Saccharomyces cerevisiae
atggatcgcatagcacagcaatatcgtaatggcaaaagagacaataacggcaatagaatggcttcttccgctatatcggaaaagggccacatacaagtcaatcaaactagaacacctggtcaaatgcccgtctatagaggtgaaactataaatctgtctaaccttccccaaaatcaaattaaaccgtgcaaagatttggacgacgttaacatacggcggaacaactctaataggcattctaaaatacttttactagatctgtgcgctggccccaataccaactcatttttaggcaataccaatgctaaggatatcacagttttatcgttgccgctacccagcactttggtgaaaaggtcgaactacccgttcgagaacttactaaagaattaccttggatctgatgaaaagtatattgagttcacaaagatcatcaaagattatgatattttcattttcagtgattcgtttagcagaatttcgagttgtttaaagacaactttttgcctcattgagaagtttaaaaagttcatctgccatttttttccatctccttatttgaaattctttcttctcgaaggctctctgaatgatagcaaggccccctcattaggaaaaaataagaaaaattgcatcttgcccaaattggatttgaacttgaatgtaaacttaacttcaaggtcaactttaaatttaagaataaacatacctccacccaatgattcaaataaaatatttttacagtctctgaaaaaggatctaattcattattctcctaattctttgcaaaagtttttccaattcaatatgcctgctgacttagcacctaacgacacgattttaccgaattggctaaaattctgctccgtaaaagaaaatgaaaaggtaatattaaagaaactctttaacaattttgaaactttagaaaattttgaaatgcaaagattagagaaatgcctgaaattcaagaaaaagcctttacatcaaaagcagctatcacaaaagcagaggggtccgcaatccacggatgattcaaaattatattctttaactagtttgcaacgacagtataaaagttctttgaaaagcaacatacagaaaaatcaaaagctaaaattaattataccaaaaaacaacacatcttcttcgccatcaccattatcttccgatgatactataatgtcaccaataaatgattacgaacttactgaaggaattcagtcttttactaagaatagatattctaatatcttaccttacgaacattcaagagtaaagttacctcactccccgaaaccacctgcagtttctgaagcatccacaaccgaaactaaaacagataagtcatatccgatgtgtcccgtagatgcaaaaaaccactcctgcaaaccgaacgactatatcaatgcgaactatttgaagctcacgcaaattaatcctgatttcaagtatattgctacccaagctccgcttccttctacgatggatgatttttggaaggttattactttaaataaagttaaagtaataatatcattgaattctgacgatgaattgaatttaagaaaatgggatatttactggaataatctgtcatattccaaccacactatcaaacttcagaacacctgggagaatatttgcaatattaatggctgtgttctcagagtctttcaagtcaagaaaacagctccacaaaatgataatatcagtcaagattgtgaccttccgcataatggtgaccttacttccattaccatggctgtatccgagccgtttattgtttaccaattacaatacaagaattggttagattcatgcggcgtagatatgaatgacatcattaaactacacaaagtcaaaaattcgttattgtttaacccgcaaagttttattacaagcctcgaaaaggatgtttgcaagcctgatttgatagatgataataatagtgagttacatctcgatacagcaaattcatcgccactattagtccattgttctgcagggtgtggaagaacaggtgttttcgttaccttggatttcctactaagtattctttcacctacaacaaatcactcaaacaagattgatgtttggaatatgactcaggaccttatctttatcatagtgaatgaattaagaaagcaaaggatttcaatggtacagaatctaactcaatatatcgcttgttatgaggcattattaaattattttgccctgcaaaagcagataaagaacgcgttaccttgttaa

SEQ ID NO: 46080 - DNA, 2709 bp, Saccharomyces cerevisiae
atgagtaattctacttcattaagggccatcccaagagtggcgaactataacacattagtaaggatgaatgcgagcccagtacggcttttaattctgagaagacagcttgctacgcatccggcgatactatatagctctccttacatcaaaagtccgttggtgcacttacacagccgcatgagcaatgttcacagatcagcacatgccaatgctttgagttttgttatcaccaggagatcgatatcacattttcctaaaattatatctaaaattattaggttacccatatatgtgggtggcgggatggctgctgcagggagttatatagcttataagatggaagaagctagctcttttactaaggacaaactagatcgaatcaaggatttaggtgaatcgatgaaggaaaagtttaataaaatgttttccggtgataagtcacaagacggtggtcatggaaacgatggaacggtgccaactgctactctaatagccgctacatcactcgacgatgacgaaagtaagaggcaaggagatcctaaagatgatgacgacgaagatgatgatgacgaggatgatgaaaacgattctgtagatacaacgcaagacgaaatgttaaacttaaccaaacaaatgattgaaattagaactattttgaataaagtggactcttcttctgcacatttaactttaccatctattgtcgtgataggttcacaatcgtctggtaaatcctcagtactagaatccattgttgggagggaattcttaccaaaaggttccaacatggtcacaagaagacccattgaattgactttggtcaatacacctaactcgaataatgtaacagctgattttccaagcatgcgtctatacaatatcaaggactttaaagaggtgaaaagaatgctaatggaactgaacatggccgttccgacttcagaggctgtttcagaggagcctattcaattgacaatcaaatcgtcccgcgttccagatttatcattggtggatctacctggctatatacaagtggaagcggcagaccagccaatagaactgaaaacaaaaatccgtgacctctgcgaaaaatatttgactgcacctaatattattttagcaatttctgctgcggatgttgacctggctaatagttctgctttgaaagcttctaaagcggcagatcctaaaggcttgagaacgataggtgtcattaccaaactggatttggtggatcctgaaaaagcaagaagcatcttgaataataaaaaatatcctctcagtatgggctatgtaggagtgattactaagacaccaagtagtataaacagaaaacacctaggtcttttcggtgaagcaccttcttcgtcattaagtgggatattttcaaaaggccagcacggccaaagtagcggagaagaaaataccaatggtttaaaacaaattgtgtctcatcaatttgaaaaagcttatttcaaagaaaacaaaaagtattttaccaattgccaagtttccactaagaaattgagagaaaagttgatcaaaatcttggagatttccatgtcaaatgcgctggagccgacttcaacacttattcaacaagagttggatgatacttcttatttgtttaaagtagagtttaacgacaggcatctaactcctaaatcataccttttgaataatatagatgtactaaagttgggtattaaagagtttcaggaaaaatttcatagaaatgaactgaaatcaatcttgagagcagaattggatcagaaagttttagatgttttggctacacggtattggaaggatgataatcttcaggatctatcttcctctaagctggaaagtgataccgatatgctatattggcataaaaaattggaactcgcatcatccggcttaactaaaatgggcattggtagattatctacaatgcttactaccaatgcaattttaaaggagctagataacattctggagtctactcaactaaaaaaccatgaactgatcaaagaccttgttagcaatacagccattaacgttctaaacagtaaatactattcaacggctgatcaagttgagaactgtatcaaacccttcaagtatgaaattgatttggaagaaagagactggagccttgctcgtcaacattccattaatttaataaaggaagaattacgtcaatgtaactcaaggtaccaggcaatcaaaaatgccgttggcagtaagaaattagcaaatgtaatgggctatttagaaaatgaatcaaatttgcaaaaagaaacactcggcatgtccaaattactattggaaagaggctctgaagctattttcctggataaaaggtgcaaagtgttatcgttcagattaaaaatgttgaaaaacaaatgtcattcgacaattgagaaggatcgttgtccagaggtatttctatctgcagttagtgataaattgacctccacagctgttttattccttaacgttgaattattaagcgattttttttataacttccctattgaattagacagaaggttaacattgttgggagatgaacaagtggaaatgtttgctaaggaagatccgaagatttcaaggcatattgaattgcaaaagagaaaggagctgttagaattagccttggagaaaatagattcaatcttggttttcaagaaaagctacaagggcgtctccaaaaatttatga

SEQ ID NO: 46081 - DNA, 1272 bp, Saccharomyces cerevisiae
atggcagcacatcagatggactcgataacgtattctaataatgtcacccaacagtatatacaaccacaaagtctacaggatatctctgcagtggaggatgaaattcaaaataaaatagaggccgccagacaagagagtaaacagcttcatgctcaaataaataaagcaaaacacaagatacaagatgcaagcttattccagatggccaacaaagttacttcgttgaccaaaaataagatcaacttaaagccaaatatcgtgttgaaaggccataataataaaatctcagattttcggtggagtcgagattcaaaacgtattttgagtgcaagtcaagatggctttatgcttatatgggacagtgcttcaggtttaaaacagaacgctattccattagattctcaatgggttctttcctgcgctatttcgccatcgagtactttggtagcaagcgcaggattaaacaataactgtaccatttatagagtttcgaaagaaaacagagtagcgcaaaacgttgcgtcaattttcaaaggacatacttgctatatttctgacattgaatttacagataacgcacatatattgacagcaagtggggatatgacatgtgccttgtgggatataccgaaagcaaagagggtgagagaatattctgaccatttaggtgatgttttggcattagctattcctgaagagccaaactcagaaaattcttcgaacacattcgctagctgtggatcagacgggtatacttacatatgggatagcagatctccgtccgctgtacaaagcttttacgttaacgatagtgatattaatgcacttcgttttttcaaagacgggatgtcgattgttgcaggaagtgacaatggtgcgataaatatgtatgatttaaggtcggactgttctattgctactttttctctttttcgaggttatgaagaacgtacccctacccctacttatatggcagctaacatggagtacaataccgcgcaatcgccacaaactttaaaatcaacaagctcaagctatctagacaaccaaggcgttgtttctttagattttagtgcatctggaagattgatgtactcatgctatacagacattggttgtgttgtgtgggatgtattaaaaggagagattgttggaaaattagaaggtcatggtggcagagtcactggtgtgcgctcgagtccagatgggttagctgtatgtacaggttcatgggactcaaccatgaaaatatggtctccaggttatcaatag

SEQ ID NO: 46082 - DNA, 747 bp, Saccharomyces cerevisiae
atggatcattcaatagaagtcactttcagagtaaaaacacaacaggttataataccggaacaaaacatccggggaaatgaacttcccttacgtcggtggcagatggaactcctcatgttagatgcaacaggaaaggaagtggagcctaccatcctctctaaatgcatctaccatttgcactctagcttcaaacagcccaaaagacgactgaactcgctgccattttttatcaaggaaaccggttggggagagtttaacttaaaaatagaatgcttttttataggtaacgctggaaagtttagcattgaacatgacttaacgtttgaagatgatgcatatgcagttgactataccgttgatgtgcctcatgaattctcacatctcaatagtgaactatctaaatattttgatctcccgtggaaagtagtgtctccggaggaagaaatgtctcttcgtatagccgatttgccctggattaaaagccttgcgcttatagatgaggatatgatgacggacgtggttcagatgatattgaatgatcctgcagtacagagagcaattgaaaatcatcccagaagggagcagttttttatgtttataacacaactaccagatgatttgttaatgaaaattcaggcatttttgaaattaccgaacaaaaattccactaaacaagaaaggacaaattttgggtcagacgcaatacataaggacgagccagtgaaggctcataacaagctaaagtag

SEQ ID NO: 46083 - DNA, 2586 bp, Saccharomyces cerevisiae
atggtcaatatttctgatttctttggtaaaaataagaaatccgtaagatcgtcaacatccagacctacgagacaggtgggttcgtctaaaccagaagttatcgacttagatactgaatctgaccaagaatcaaccaataaaacaccaaagaagatgcctgtaagtaatgtaattgatgtatcagagacacctgaaggagaaaaaaagctacctcttcccgctaagaggaaggcctcttcaccaactgtaaagccagcaagttcaaaaaaaaccaaaccctcctctaaaagttcagactcggcttcgaatattacggctcaagatgtactagataagattccatccttggatctgtcaaatgttcatgtgaaagagaatgctaaatttgatttcaaaagcgcaaattcaaatgcggatccagatgaaattgtttctgaaataggtagttttccagaaggaaagccaaattgtttattaggtctaacaattgtcttcacaggtgttctgccaaccttggagcgtggtgcatcggaagctttagcgaaaagatacggagcaagggttactaaatcaatttcaagcaaaacttctgtagtagtcttaggtgatgaagcagggccaaagaaactagaaaaaatcaagcaattgaaaatcaaagccatagacgaagaaggctttaagcaattaattgctgggatgcctgctgaaggtggtgacggggaagctgccgaaaaagcacgtcgaaaattagaagaacagcataatattgctaccaaagaagcagaattgcttgttaagaaagaagaggaaaggtcgaagaagcttgcagccactagagtttctggtggccatctggagagagacaatgtggttagggaagaagataaattgtggacagtaaagtacgcaccaacgaatctacaacaggtctgtggtaacaaaggaagtgtaatgaaattaaaaaactggttggctaattgggaaaattcaaagaaaaatagttttaaacatgctggtaaagatggctctggtgttttcagggctgcaatgttatacggtcctcctggtattgggaagacaactgctgctcatttagttgcacaagagcttgggtatgacattcttgaacaaaacgcttctgatgttcgctctaaaactttacttaatgccggtgttaaaaacgctcttgataacatgtctgtagtgggatatttcaaacacaacgaagaagctcaaaatttgaacgggaaacattttgtcattatcatggatgaagttgatggtatgagcggaggcgatagggggggagttggccagctggcacagttttgtcgtaagacgtcaactccattgattctaatttgtaatgaacgtaatttaccaaaaatgagaccattcgatagagtatgtcttgatatccaatttagaagacctgatgctaacagtatcaaatcaagattaatgacaattgcgatcagagaaaagttcaaacttgatccaaatgtcattgataggttgatacagactacaagaggtgatatccgccaggttattaatctactttcaacgatatctacgactactaaaaccataaaccatgaaaatatcaacgagatctcaaaggcatgggaaaagaatattgccctaaaaccctttgacattgcccataaaatgttggatggacaaatatactcagacataggttcaaggaactttacactgaatgataagatcgcattatattttgatgactttgatttcacacccctaatgattcaggaaaactatttatctacaagaccaagcgttttgaaacccggccagtcacatttggaagcagttgctgaggcggctaactgtatttcattaggtgatattgtcgaaaagaagattcgtagtagtgagcaattatggagtcttttgcctttgcatgctgttctttcatctgtttatccagcatcaaaagttgccggccatatggcgggaagaatcaatttcacagcttggttgggccaaaattctaaatctgccaaatattataggttactgcaagagatacattatcatacaagactaggtacatctactgataaaattggactaaggctggattacctaccaacttttagaaaaagattattggacccatttttgaagcaaggtgctgatgcaatttcatctgtcatagaggtaatggacgattactatttgaccaaagaagactgggattctattatggagtttttcgtaggtcctgatgtgaccacagccattatcaaaaagataccagctacggttaaaagtggattcacgcggaaatacaacagtatgacacatccagtcgcaatttacagaacaggtagtactattggtggtggtggtgttggcaccagtactagcacccccgatttcgaagatgtcgttgacgcagatgacaatccagttcccgcagatgatgaagaaacacaagatagtagcacagacttgaagaaggataaacttatcaagcagaaagccaaacctacgaagaggaagactgccaccagtaaacctggtggtagcaaaaaaaggaaaacgaaagcatga

SEQ ID NO: 46084 - DNA, 2796 bp, Saccharomyces cerevisiae
atgtctgcttcaactcattcgcataaaaggaagaatagtcatttatttccgcaaaggaaaagttcaaactcttccatggataagccattctttcctaataacgatagtgtagctaacacagatcctcaaagtaacgagaatggacatacaattaacgagattagaccgacagaagctacaatagatgttacagatgttcctcaaaccccctttctccaggaacaatactcaatgcgtcccagacgagaaagcttccagtttaatgatattgaaaaccagcatcacacgcattcctttttcagtgtaaacaaatttaatcgtcgatggggagaatggtctctgcccgagaaaagatcttatgtcttagtctttacattaatagcactatcagttttagttctacttgttattctaataccttcaaaacttctacctaccaaaatcacgcgtcctaagacatctgcaggagattctagtttgggcaaaagatctttctcaattgaaaacgttttgaacggagattttgccatccctgaggatactttccactttattgacccaccacagcgcttattaggccaagactcagatccggggctatattttactacaaaagaaattgatggacatacgaattttattgcaaagcagttatttgatgagacttttgaagtaaaccttgggggcaataggttcctatatgaaggagtagaatttaccgtaagtactgtccaaattaattataaattggataaacttatatttggaactaacttagagtctgagtttagacactcctcgaaggggttttattggatcaaagacttaaacacaggtaatattgaaccgatattacctcccgaaaaatcagatgataattatgaacttggattatcaaaactttcctatgcgcatttttctcctgcatacaattatatctattttgtttacgagaacaatctgtttctgcaacaagtaaatagcggagttgccaagaaggtaacggaagatggctccaaggatatattcaatgccaaaccagactggatatatgaagaagaggtccttgcttctgatcaagcaatatggtgggctccagacgattcgaaggctgtatttgcaagattcaatgacaccagtgttgacgatatccgattaaaccgttacacaaatatgaacgaagcatacctttccgacaccaaaatcaaatacccgaagccagggttccaaaatccacagttcgacttgtttctcgttaacttacagaacggtataatttactcaattaatactggtggtcagaaggattccattctgtataacggaaaatggattagtccagatacattcaggttcgaaatcaccgatagaaactctaagatattagacgtaaaagtgtatgatataccatcatctcaaatgcttactgtgaggaacaccaattcaaacctgttcaacggatggatcgaaaagacgaaggatattttaagcatccccccaaagccagagttgaaaagaatggattatgggtacattgatattcatgcagacagtagagggttcagtcatctcttttattacccaaccgtttttgccaaagagcctatccagttgaccaaagggaactgggaagtgactggaaatggaatagtcggctacgaatatgaaacagatactatattttttactgccaatgagattggtgtcatgtcacaacacctttatagtatcagccttacggattctacaactcagaatactttccaaagtttacaaaacccatcagacaaatacgatttttatgacttcgaattaagttctagtgcgagatatgctatttctaaaaaactggggcctgatacacctattaaagtagctggtccgcttacaagggttttgaacgttgccgaaattcacgatgattcaatcttgcaactgacgaaggatgaaaagttcaaggaaaaaataaagaactacgatttacctattacaagctataaaaccatggtcctagacgatggcgtagaaataaattacattgagatcaaaccagccaatttaaatcctaaaaaaaaatacccgatattagtcaacatttatggtggtccaggatctcaaacatttaccaccaagtcgtctcttgcgtttgaacaagcagttgtttcaggattagatgttatcgtcctacaaatagagcccagaggaactgggggtaaaggttggagttttagatcatgggcccgcgaaaaattaggatattgggaacctagagacattactgaagtcacaaaaaaattcatacaaaggaatagccaacatatagatgaaagcaaaattgctatttggggttggtcatacggcggttttactagcttgaaaaccgtggaattagacaacggcgacacatttaaatacgccatggctgtcgcgccagtaacaaactggacattgtatgattccgtttacacggaaagatatatgaaccaaccatcggaaaaccatgaaggctattttgaagtatccaccatccaaaatttcaaatcattcgaatctttaaagcgtcttttcattgtgcacggaactttcgatgataatgttcacatacaaaatacttttagattagttgatcaactgaatctattgggattgacgaactatgacatgcacatttttccagactctgatcattccatccggtaccacaacgctcaaagaattgtattccaaaaactatactattggttaagggatgcctttgctgaacgctttgacaacactgaagttttgcatttataa

SEQ ID NO: 46085 - DNA, 924 bp, Saccharomyces cerevisiae
atgtcatcagactcaaacgcaaagccattgccttttatatatcagttcatatcaggtgccgtcgccggtatttctgagttaactgttatgtatccgcttgatgttgttaagacaagatttcaactggaggtgacgacgcctactgccgctgcagtaggaaagcaagtagagagatataatggtgtcatcgattgtttgaaaaaaattgtaaagaaggaagggtttagcagactttacagaggtattagttcaccaatgttgatggaagcaccaaagagagccaccaaatttgcatgtaacgatcaatatcaaaaaatcttcaaaaacctattcaacacgaatgaaactacgcagaagatctccattgcggctggtgcatctgctggtatgacagaagctgcagttattgttccatttgaattgatcaaaatcaggatgcaagacgtcaagtccagctatcttggaccaatggactgtttgaaaaaaacaatcaaaaacgaaggtattatggggctatacaagggtatcgaatctaccatgtggagaaacgctctttggaatggtggctacttcggtgttatctaccaagtgagaaattccatgcccgtagcaaagacaaagggacaaaagaccagaaatgaccttattgcaggtgcgatcggtggtacggtcgggaccatgcttaacactccctttgacgtggtgaaatccagaatccaaagtgtggacgcggtcagcagtgctgttaaaaaatacaactggtgcctaccttcgctattggtcatataccgtgaagaaggcttcagagcattgtacaaaggtttcgtccccaaagtatgtagactagcacccggtggttcattaatgttggtggtttttaccggtatgatgaactttttcagggatctgaagtacggacactga

SEQ ID NO: 46086 - DNA, 3741 bp, Saccharomyces cerevisiae
atgagctccaagttgaagtacactgatatagatgtgccattggactggttgtataaggggaaacgaaggaataggaccaaaagtgcggcttccacgcgcacttcagaagctaccaccacctctgtaaagaaaactgctactttgccatcaaccgcagctgttcctacgaaaactatagcttctcctcaaaggcccctgagcggccagaatgtaaataacgaattatccaactctaaaccagcagtatccgccgagaaggtttcgcagcaaggacaagtgcccactaggaggactcgttctcactcagtatcgtacggcctactccagaagaagaataataacgatgacaccacagattctcctaaaatatctcgaattagaacggcacaggatcaacctgttaaggaaacaaaaagcagcacccttgcggaacccatcgtttcaaagaaggggagaagtcgttcttcttctatatcaacttctttgaatgaacgatctaagaaatctctgttcggttctttgttcgggagaaggccttccaccactccctcgcacgttgttgaaagaccgttgtcttctcagaatgaccataaaaaaagcacagaactccctcctatagataccagacagtcaaagatctccaccccaactagtactcctaccactgcatcttccaaacccagtagttctggtgggaatagacattctgatggatctcttacttcaaaacttctaagtattcctcataacatcttggaaacctcttctacgaattttaatgcccaccaccatatccagtcacatcatagtagtggtcgtgaacaagactcgccccattctgaatcatcagacctccctcccattttagaaaaagaaactacgcaaaaacaattacagaaggtgtcaaaggtaaatttgaaaagggttactattgcagttcaagaatttaactcagatcccccacaacaactaccttctaggaagcctaaaaggggtaatgttctcataccagaagatatgattagtgcccccccactaatctctctgggaattacaaacagcagcgatcaaagcagttttcagtccaatatctctccctcatattcaaaagattctaaagaatataaattagctttggaaaattttaaaaaagcagctaaagaagccgaaaaacatcaaaaggatgcgtattatgttgcagagcgaatggctcaagaagtggcaaactataaggccaggcaattgaagacatcgccgttaactggagcaactaattcagcagcagattcagcgacggatcaagaatcctcctctctagatgctagagcttctaagcttcatatcgataaaccgatcaatgtaggtgcacatcctttcgaaacacatcaggatgataacattaaatactcttctcaccttgaacaaacattggacgtagcttacactagatgctgtcatttgagagaaattttaccaataccgtccactttgagacaggtcaaaggtaaaaccgcacctttgcagactttgaaatttttgaatccaaaaccaaccttagtggatatattatcattttgtgattttattgccataactccgatccataacatcattttcgataatgtgtccttaacccatgatatgttcaagattgtcatttgttctttggtaacctctccggtagtggagaaattggggttaagaaatgttgtgataaacgaacaaagttggaaactactttgcaagtttttattacaaaataaaacattgatcaagctggatatttctcagactaaagcaaggacagatttaaatgattctaactacagagaccaaatggactgggaactattttgcgaagttcttagaaatagagaaggtagacctttggaagaattgcttttgaatggtttaaggtttgacaaaatgtcattcagtcatttcaaaaatatcctacttactttcgcacaaatgaaccctaaaaaccctattcgtctcgggatggctaacgtagaattctcaaccgagtgttttgattttctctttaattggatgtctgaatataacgttcaaggtgtggatttggcctataataatttagaaagtttggcaaaacgaatgatcaaaaaactagctaggcttccttataagcatttggaatattttacccttaacagcactaatatcacctctgttgatgatatgtcctacatactaaaatatctttcacgtttgccaagcataaaatttctagatttgagcaacttgcctcagttattcccggggattttaacatccggctataagtattttccccaatttccacaactgaaacgtattcattttgatttcgacgatctttctataaaagaaacaaccatgcttgtcagcatattagctaagtgtgaaaccctctctcatgtttcattgataggacaaagtcctatgcccgatgcaagtaaaatatccgacagtactgatgaacccgataagtcgaaagatgaaaagaaagaacaaatcgtatttatgagaaatacgctttgggcctcattgtatgcatttgttagggactctcacaatttagttagtttagacgttgactatgatcaagtaccagacgaaattcaatcaagaattgcgttatgcttaatgcataatatgaagagaattatggactctagctttaaattagatgaattgactgtacaagatgatttaatatttgatggttccttgataactgagacagcagaagaagttttgaaaagattaaatgacaaatctttacttcaaaatgatgttgggaagaaatatcttttaaagaaatattttgagaaaatggaaaaggtacatcataatgttcaaaatacaattgattctatgtttgagaaaagaaaatccggcgaactgccactgcaggaaaaggaaaacctactaaggttattgcttcttgagaaaaatttatcaaatattcttgatatttttgcttctatgcccaatatagcagatgtcgtaccattttcaaaagccgataatagtttccctaatattggggatagcacggttagcgcaaactataatgatggtattcgtccatctctaaaacacttagattctgacaggttaatcaacgatgtttcaattcctgaaaacgattcatcaattagaccacacttaatggccaccgactcgggacgaatcatcgatgtgaccactggtaaagctcttcttttcaagagttcgtctaatacctcactggccggcaagagacaggaagaagaggaaggtgaattacataaatggggtgtgtttgtacagcaccaaagctcaagacataactctgggcttccttcatccgccaattcttcgagaattagcgggtcgttaacaccagatagcagtgtcgccggaggaaagaaaggggaatcctctcgcacatctggtacaaggccaaaaatcttaccaaagattcctaccggtgccgaattaagggatgccattattaaagctaagggtattgattctgtagatgatctgattaaaaatgttacctctgaaaaggttggattggaatcattatatggagatgaattgaactctagaagcccgagtaatgacagtttacaagaatcacaacaaaaggcgcctttgcagaggccccttgttgaagatgaaacagtgacaaaaaaatatgacaaactattgaacgatctgtctaatgttcgtcacagtaaaacctaa

SEQ ID NO: 46087 - DNA, 1527 bp, Saccharomyces cerevisiae
atggcttcactgttcagacccccagaatctgcgaaatgcaacccaaactctcctagacttaaactgcccctcttacgaaataatcaggtagatgaaaataatatatacttgacgtcgaatgggagttccaccacagcttacagtagccacaccccagaaccactgacctcttccacatcgacacttttctcccaaactcgacttcatcctagcgactcttcaatgactttaaatacaatgaagaagaggcctgcaccgccatctttaccttcgctcagcataaattcacagtctaagtgcaaaacactacccgaactcgtacccatcgccgatgtgtctgatggtaaacatgatttaggattgaaacagcgtgtgatagccgaaaatgagttgtctggtaatagtgacttaaccccttcatcgatggcaagccccttttcacatacaaacacctcttctccctacctcagaaatgatctgagcaattcagtgggatctgacttttcaaatttgatatcggcatatgaacaaagttcaagtcccatcaagtcatcgtcccagcctaaatcatcttctgaatcgtacatagacttaaacagtgtacgagatgttgatcaattggatgaaaatggttggaaatatgcaaatttaaaagataggatcgagacattaggcattctaggagaaggagccggtggctctgtttccaagtgtaaattgaaaaatggatcaaaaatattcgctttaaaagtgataaacacattaaatacagatcccgagtatcagaagcaaatattcagagaattacagtttaataggagtttccaatccgaatatatcgtacgatattatggaatgtttacggatgacgaaaactcttcaatttatattgctatggagtacatgggtgggcgatcgttggatgctatttataaaaatttgttagagcgtggtggtaggatcagtgaaaaagtcctggggaagattgcagaagcggtactaagaggactatcatatttgcatgaaaaaaaagttattcatagagatattaagccccagaatattttactgaatgaaaatggtcaggtgaaactttgtgattttggggtcagtggagaagccgttaactcgctagccacaacattcacggggacgtcattctatatggctccagaaaggattcaaggtcaaccatacagtgtcacatctgatgtatggtcacttggattaacgattttggaagtggcgaacgggaaatttccatgctcttccgagaagatggcagccaatatagctccctttgaattgttaatgtggattttaacatttactcctgaattaaaggatgaacccgaatctaatatcatatggagtccatcattcaaatcctttatcgactactgtctgaaaaaagatagtcgtgaacggccatctccaagacaaatgatcaatcatccttggataaagggtcaaatgaaaaaaaatgtcaatatggaaaaattcgtgaggaagtgctggaaagattaa

SEQ ID NO: 46088 - DNA, 2403 bp, Saccharomyces cerevisiae
atggcttctgtacctaaacgccatacatacggtggcaacgttgtcactgatagggaccgtcattctcttcaaagaaacaatgagattttgcatcctatacataaaaatcagcgaaaacatgctaccttcggaccatacataatcggttccactttgggtgagggagaatttggtaaagttaagctgggttggaccaaggcttcctcctcgaacgaggttcctaagcaagtggcaatcaaattaattagaagagatacaatcaagaaagatgccgataaagaaattaaaatataccgcgaaattaacgcactgaagcatttaactcatcctaacattatctatttagaagaggtcctgcagaattcgaaatacattggaatagtgctagagtttgtatctgggggagaattctataagtatattcaacgtaagaggagattaaaggaatcttctgcatgcagattgtttgcccaattaattagtggggtcaattatatgcactacaaaggacttgttcatagggacttaaaactggaaaatttattattagataagcacgaaaatttagtcatcacggattttggttttgtgaatgaattttttgaagataacgaattaatgaaaacttcttgtggttcgccctgttatgcagcaccagaactagttgttagtaccaaggcatatgaagcaagaaaggcagatgtttggtcgtgtggtgttattctttatgcaatgctcgctggatatttgccgtgggatgacgatcatgaaaatccaacgggtgacgatattgctagactgtacaaatacatcacgcaaacacctcttaaatttcccgaatatataacccctattccaagagatttgctgaggcgaatactggtacccaatccaagaagaagaataaacttacaaacaataaaaaggcatgtgtggttgaagcctcatgaagcgtttttgagcattcagccgaactattgggatgaacacttacagaaggaacgtccgaaaccgccaaacaaaggtgacgttggtcgccactcaacttattcttcatcagcatcttcgtactcaaaaagtagggatagaaactctttaattatagagtcgactctagagcaacatcgaatgtctccacagcttgcgaccagcagaccagcatcaccaacattctctactggttccaaagtggtgttaaacgatacgaaaaatgacatgaaagaatctaatataaatggcgagcgtactagtgcatcatgcaggtacacacgtgattcgaagggcaacggccagacccaaatagaacaagtatcagctagacactcatccagaggcaataagcacacatcggtcgcgggactcgtaacaatccctggctcccccacaactgcaagaacaaggaatgcaccatcatcaaagcttactgagcatgtaaaagattctagtcagacaagctttactcaggaggaattccaccgtattggtaattatcacgtgcctcgcagtagacctaggccaacttcatattatcctggactcagtcgtaacaccgcggataatagtttagcggatattccagtaaataagttgggttcgaatggtaggttgacagatgccaaagacccggtaccgttgaacgcaatacacgataccaacaaagctacaatctccaacaattccattatgctattatcagaaggtccggctgcaaagacttccccagtagattaccattatgctattggcgacttaaaccatggtgacaaacccataactgaggttatcgacaaaattaataaggaccttactcataaagcagctgaaaatggttttcctcgagagagcatcgacccagagagtacctcaacgatattagttacgaaagaacccactaactccaccgatgaagatcatgtagaatctcagctggagaatgttggccactcttctaataaatcagacgcttcttctgataaagatagtaaaaagatctacgaaaaaaaaaggttcagcttcatgtcgttgtactcatccttaaatggttcaagatccactgttgaatctcgtacctcaaaagggaatgcacctcctgtttcatctagaaatccatcaggacaatcgaatagaagtaacattaaaataactcagcagcaaccacgtaacctttccgacagagttccaaatcccgataagaaaattaatgataatagaataagagacaacgcacctagctatgctgaaagcgagaatccgggaaggtctgtacgggcttctgttatggtgtcaacactacgagaagaaaatcgatcggaattgtcgaatgaagggaataatgtcgaggcacagacttcaacagcaagaaaggttctgaattttttcaaaagaaggagcatgagggtttga

SEQ ID NO: 46089 - DNA, 636 bp, Saccharomyces cerevisiae
atggctggaggaaagattcctattgtaggaattgtggcatgtttacagccggagatggggataggatttcgtggaggtctaccatggaggttgcccagtgaaatgaagtatttcagacaggtcacttcattgacgaaagatccaaacaaaaaaaatgctttgataatgggaaggaagacatgggaatccataccgcccaagtttcgcccactgcccaatagaatgaatgtcattatatcgagaagcttcaaggacgattttgtccacgataaagagagatcaatagtccaaagtaattcattggcaaacgcaataatgaacctagaaagcaattttaaggagcatctggaaagaatctacgtgattgggggtggcgaagtttatagtcaaatcttctccattacagatcattggctcatcacgaaaataaatccattagataaaaacgcaactcctgcaatggacactttccttgatgcgaagaaattggaagaagtatttagcgagcaagatccggcccagctgaaagaatttcttccccctaaagtagagttgcccgaaacagactgtgatcaacgctactcgctggaagaaaaaggttattgcttcgaattcactctatacaatcgtaaatga

SEQ ID NO: 46090 - DNA, 1647 bp, Saccharomyces cerevisiae
atgcataaaggaaaaaaaaattaccctaatttgattacttcgtttcggatgaatttgaaaaaaatcatattgaaccatgaccgatttagccatccagaaagatggaaaacaaacgcactcttaaggttcaccttcgtgtatataaaatttctcttcgacttgatgataatcaaaaatccattaaggatggttggaaaaacttatcgagacgctgttactgcgctaaactctttgcagtccaattatgccaacatcatggctatccgtcaaactggtgatcgtaaaaacactatgacattattggaaatgcatgaatggtctcgaagaattggttactctgcatcggatttcaataaattaaatattgttcatatcactggaacaaaaggtaaaggttctactgccgcatttacttcatcaattctaggacaatataaagaacaattaccacgtatcgggctatatacgtctccacatcttaagtcagtgagagaaagaataagaataaatggggagccaatttctgaagaaaaatttgcgaagtacttctttgaggtttgggaccgtctagatagtacaacctcttctttggataaattcccgcacatgatcccgggaagtaagcctggctatttcaagttcctcacattgctttcatttcacacttttatacaagaggactgcaaaagctgtgtctacgaagtcggcgtcggaggtgaattggatagcactaatataattgaaaagccaattgtctgcggtgttacactattaggaatagaccatactttcatgcttggtgatactattgaagaaattgcttggaataagggaggaattttcaaatctggagcaccagcattcaccgttgagaaacaacctcctcagggattaacaatattgaaagaaagagctgaggagcgcaaaacaacgctaacagaagtacccccatttaaacagttggaaaatgtcaagcttggaattgctggcgagtttcaaaaaagtaacgcctcccttgccgttatgctggcttctgagatcttgcatacgtccaatatattggaggagaagatcaaatgcagttcgaatgcatcgattccagaaaaattcataatcggtctacaaaatactaagtgggaaggcagatgtcaagtactagaaaagggaaaaaacgtttggtacattgatggtgctcacaccaaagatagtatggtagctgcatcaacatggttcagagatatggttcgattgtcgaagagaaagaagatcttgctcttcaaccaacaaagcagagatgccaacgctcttgtgaataacctgtactcatctgtttcgccagaaataacgttcgatgatgtgatatttactactaatgtcacttggaaatcaggctcatacagcgctgacctcgtttccatgaacacttctcaagaagatgtagaaaaattgaaagtccaggagtcattagtcaagaattggaacaaaatagacgataatcgtgctaaaacgcatgtaacggctagtatagaggaagcaaatgaattgattgaaacgctatacgatgaacctgctgatatatttgtaactggttcattacatcttgttggcggattattggtcgtttttgatagaatagatgtaaagtaa

SEQ ID NO: 46091 - DNA, 915 bp, Saccharomyces cerevisiae
atgccattatttgatcttatttctccaaaagcgtttgttaagttagtggccagtgagaaggttcatagaatcgttccagttgatgcaacatggtacctacccagttggaagcttgataataaagtggatttcttgaccaaaccacgtataccaaactccattttctttgatattgatgcaatcagtgacaaaaaatcgccctatccacatatgttccctacaaagaaggtttttgacgacgctatgagtaatttaggagttcaaaaagatgatatattagtggtttacgatcgtgttggtaactttagctcccctagatgtgcttggacattaggagtgatgggacatcctaaggtgtacttactaaataatttcaaccagtacagagagtttaagtaccctctagattcctctaaggtggcagcgttttcaccctatccaaagagtcattatgagtcctcagaaagtttccaagacaaggagattgtagactatgaggaaatgttccaattggtaaagagtggggaactggctaagaaattcaatgctttcgatgcaaggtcgctcggtagattcgaaggtacagaaccagagcctcgttccgacattccatcggggcatattccaggtacccaaccattaccatatggaagtttacttgatccggagaccaaaacgtacccagaagctggggaggcgatacacgctactttggaaaaggcattgaaagactttcattgcactttggacccaagtaaaccaactatttgctcttgtggaactggcgtttcaggagtcattatcaagacagcattggagctagcaggagttcccaatgttagattatatgatggatcctggaccgagtgggtcttgaaatccgggcccgagtggattgctgaaaacagagattaa

SEQ ID NO: 46092 - DNA, 1992 bp, Saccharomyces cerevisiae
atgcctacaaattacgagtatgatgaggctagtgagacgtggccgtccttcattttaacggggctcttgatggtcgtcgggcctatgacactgcttcaaatataccaaattttttttggggccaatgctgaagatgggaattcagggaagagtaaggagtttaatgaggaagttttcaagaacttgaatgaagaatacaccagtgatgaaatcaaacaatttagaaggaagtttgataaaaatagtaataagaagtccaaaatatggagcaggagaaatattataattattgtgggttggatcttagttgcaattcttctgcaaaggattaatagtaatgacgcgattaaagacgctgctacaaaattatttgatccttatgaaatccttggtatctctactagtgcttccgatagagacatcaaatctgcttatagaaaattatctgttaaatttcatccagataaattagcaaagggcctaacacctgatgagaaaagtgtgatggaagaaacttatgttcagattacgaaggcttacgaatcccttactgacgaattggttaggcaaaactatttgaaatacggtcatccagatggcccacaatctacttcacatggtatcgctctaccaagatttttggtagatggaagtgcatctccattattagtggtttgttatgttgcgctactaggtttaatcttgccatattttgttagtagatggtgggcaagaacacaatcgtatactaagaagggaatacataatgtgacggcttctaattttgttagtaacttagtcaattacaagccatctgagattgtcaccacagatttgatcttacactggttatcatttgctcatgaatttaaacaattcttcccggatttgcaaccaacggattttgaaaaacttttgcaagatcatattaaccgcagagatagtggtaaacttaacaatgcgaaatttagaatagtggccaaatgtcactctttgttacacggtttattggatattgcttgtggattcagaaatttagatattgcattgggtgcaatcaatactttcaagtgtattgttcaggctgtaccattaacaccaaactgtcaaatccttcaattgccgaacgtagataaagagcactttattaccaaaaccggagatattcatacattaggtaaattgtttactttagaagatgccaagattggtgaggttcttggaataaaggatcaagcaaagttaaacgaaactttgagagttgcatcgcatattccaaatctaaagatcatcaaggcagacttccttgtcccaggtgagaaccaagtaacaccatcatctaccccatacatttctttgaaagtactggttcgttctgctaaacagccattgataccaactagcttaattcctgaagaaaatttaacagaacctcaagattttgaatctcaaagagatccatttgctatgatgagtaaacagccactcgtcccatattcctttgcaccatttttccctacaaagagacgtgggagttggtgctgtctggtaagttctcaaaaagatggtaaaatacttcaaacgccaattatcattgaaaagctatcttacaagaacttgaacgatgacaaagatttctttgataagaggataaaaatggatttaaccaaacacgaaaaattcgatataaatgattgggaaatcgggaccataaaaattccattaggtcagcctgcacctgaaactgttggtgatttcttttttagagtaatcgttaaatccacagattatttcactacagatttggatattaccatgaatatgaaagttcgtgattctcctgcagtggaacaagtagaggtgtattctgaggaggatgatgagtactctactgatgacgacgaaaccgaaagtgatgatgaaagtgatgctagcgattatactgatatcgatacggatacagaagctgaagatgatgaatcaccagaatag

SEQ ID NO: 46093 - DNA, 486 bp, Saccharomyces cerevisiae
atgagtaagaacaggtcatcgctacagtctggtccacttaatagcgagttattggaggagcaaaagcaagaaatatatgaggcgttttcattgttcgatatgaacaatgatgggttcctcgattaccacgagttgaaagtagcaatgaaggccctgggatttgagctacccaagagagaaatacttgacttaatagatgaatatgatagtgaggggcggcatttgatgaagtatgatgatttttatattgtaatgggggaaaaaatattgaagagagatccgttagatgaaataaaaagggcattccaattatttgatgacgaccatactgggaaaataagtattaaaaacttgaggcgtgtagctaaagaattaggagaaactttgacggatgaagagctgagagcgatgattgaagagtttgatttggatggtgatggcgagattaatgaaaacgaatttatagctatttgcaccgatagttaa

SEQ ID NO: 46094 - DNA, 1314 bp, Saccharomyces cerevisiae
atgagtgaagaacaggaccctttattagcaggattgggggaaacgtccggcgacaatcacacccaacagtcacacgaacaacaaccagaacaaccacaggaaacggaagaacatcatgaagaggagccttctagagtggatcctgaacaggaggcccataacaaggccttgaatcaattcaagagaaagctgctagaacacagaaggtatgatgatcaattgaagcagcgccgtcaaaatatacgagatctagagaagttatatgacaagactgaaaacgacataaaagctttgcaaagtattggacaattgattggcgaagtcatgaaggaattatctgaagagaaatatatagtgaaggcctcttcgggcccacgttatattgtcggagttaggaattcggtagatcgctctaaattaaagaaaggggtgagagtcaccttagatatcaccactttgactataatgagaattttgcccagagagacagatccactggtgtataatatgaccagttttgaacaaggtgaaatcacttttgatggtattggtggtttgactgagcaaatcagagaattaagggaggttatagaattaccattgaagaacccagaaattttccagagggtcggtatcaaacctccaaagggtgtgctactatatggtccccctggtactggtaaaactttactagcgaaggcagttgctgctacgattggagccaacttcattttctctccagcgtctggtattgtggataaatacattggtgagtctgctcgtattattagagaaatgtttgcatatgcaaaggaacacgaaccttgcatcatttttatggatgaagtggatgctattggtggtagaagattcagtgaaggtacttcagcagaccgtgaaattcaacgtacgttgatggagttgttgacccagatggatggttttgataatcttggacagactaaaatcatcatggctacgaatagaccagatactttagatcctgctttgttgaggcccggtagactagacaggaaagttgaaatcccattgccaaatgaggccggcagattagaaattttcaaaattcatactgcaaaagtcaaaaaaacaggggaatttgacttcgaggctgctgtaaaaatgagtgatggtttcaatggtgctgatattcgtaactgtgcaactgaagcaggttttttcgccataagagatgaccgtgatcacatcaaccctgatgatttaatgaaagccgtaagaaaagtagctgaagttaagaaattggaaggcactatagaataccaaaaattatga

SEQ ID NO: 46095 - DNA, 1017 bp, Saccharomyces cerevisiae
atgtctctacaacacgagaaagttaccattgcaccactagttttgctatctgctttggatcattatgagcgtacgcagacaaaagaaaacaaaagatgcgttggtgtcatcttaggtgatgctaacagttccactatcagagtcactaattcctttgccttaccgtttgaagaagatgagaaaaactctgacgtgtggtttttagaccataattatattgaaaacatgaatgaaatgtgtaaaaagattaatgccaaggaaaaactcattggatggtatcatagtggtcctaaattaagggcttctgacctcaagattaatgagctgtttaaaaaatatactcagaataatccgctattattaattgttgatgtcaaacaacaaggtgttggtttaccaacagatgcatatgtcgcgattgagcaagttaaggatgatggtacgtctacagaaaagacgtttcttcatttgccttgtactattgaggccgaagaagctgaagaaattggtgtagaacacttattgagagacgtacgtgatcaagcagcaggtggcttatctatccggttgaccaaccaattaaaatctttgaaaggattacaaagcaaactaaaagacgttgtcgagtacttagacaaagtcattaataaggaattaccgataaaccacactatattgggcaagctacaagatgttttcaaccttttaccaaatctgggaacacctgatgatgacgaaatagatgtggagaatcatgacagaattaatatttcaaataacttacaaaaggctttaactgtgaaaactaatgatgaattaatggttatatatataagcaatttggttaggtcaattatcgcgtttgatgatttgattgaaaacaaaattcaaaataaaaaaattcaagaacaaagagtaaaggacaaacaatcaaaagtctctgatgacagtgagagtgagagtggtgacaaagaagcaactgcgccattgatccaacgaaagaacaagaaaaattaa

SEQ ID NO: 46096 - DNA, 2523 bp, Saccharomyces cerevisiae
atggcagagaaggaggaagcgatttttcgctctgctgaaatggctttagtccaattctatattcctcaagaaatttcaagagactctgcttacactttaggtcaattgggtcttgttcaattccgtgacttgaactctaaggtgcgtgcgtttcaaagaactttcgtgaacgaaattagaagactggataatgtagaaagacagtatcgttacttttattctcttttgaagaaacacgatattaagctctacgaaggagacacggacaaatatttggacggctcaggtgaattgtacgttccaccaagcggttcagtgatagatgattatgtccggaacgcttcatatttggaagaaagattgattcaaatggaggatgcaaccgatcaaattgaagtccagaaaaatgacttggaacagtatcgctttattttgcagtcaggtgatgaatttttcttgaagggtgataataccgacagcacttcctatatggatgaagacatgatcgacgctaatggggaaaacattgctgctgctatcggtgcttctgtaaactatgtcactggtgtcattgctagagacaaagttgccaccttagaacaaattctttggagagtattaagaggtaaccttttcttcaaaactgttgaaattgaacaacctgtttatgatgtcaaaaccagggagtataaacataaaaatgcttttatcgtattttctcacggtgatctgattattaaaagaatcagaaagattgcggaatcattggatgccaatctttacgatgttgactcttccaacgagggtagatcacaacaattggccaaggtcaacaagaatttgagtgatttgtacacagttttgaaaaccacttctaccactttagaaagtgaattatatgccattgccaaagaattggactcttggttccaagatgttacccgtgaaaaggcgatttttgaaattttgaacaagtctaactatgataccaatagaaagattttgattgctgaaggttggataccaagagacgaattggctactttgcaagctcgtcttggtgaaatgatcgcaagattgggtattgatgtcccatccattatccaagtcctggatacaaaccacactccacctaccttccacagaactaacaagtttactgctggtttccaaagtatctgtgactgttacggtattgctcagtacagagaaatcaatgctggtttacccacaattgtcactttccctttcatgtttgccatcatgtttggtgatatgggtcacgggttcttaatgaccttagccgcattgtctcttgtattgaatgaaaagaaaatcaacaaaatgaaaagaggcgaaattttcgatatggccttcactggtagatacattattttgttgatgggtgtcttttccatgtacacaggtttcctttacaacgatatcttctctaaaactatgactattttcaagtctggttggaaatggcctgatcattggaaaaaaggtgagagtattactgctacatcggtgggtacataccctatcggtttagattgggcttggcatggaactgaaaatgctttgttattttctaattcttacaaaatgaaactatcaattttaatggggttcatccacatgacctattcttatttcttttcgttggctaaccacctatactttaactctatgattgatatcatcggtaactttattcctggtttgctatttatgcaaggtatctttggttatctttccgtttgtattgtttacaaatgggctgttgattgggttaaggacggaaagcctgctccaggtttgttaaatatgttgatcaacatgtttttatcaccaggaactattgacgatgaattataccctcatcaagcaaaggtccaagtgtttttgttgttgatggccttggtttgtattccttggttgctattggtgaagccattacatttcaaattcactcataaaaagaaatctcacgaaccactgccatcgactgaagcagatgctagttctgaagatttggaagcacaacaattaatttccgcgatggacgccgatgacgctgaagaagaagaagttggttctggatctcatggtgaagactttggtgatattatgattcatcaagttattcatacaattgaattctgtttgaattgtgtttcgcacactgcatcctatttacgtttatgggccttatcattggcacatgctcaattgtctagtgttttatggacaatgacaattcaaattgcctttggatttagaggatttgtgggtgtgtttatgacggttgcactttttgccatgtggttcgcactaacatgtgcagttcttgttttgatggaaggtacatctgccatgcttcattccttacgtttgcactgggttgaatctatgtccaagtttttcgtgggtgaaggtttaccatacgaaccattcgcatttgagtataaagacatggaagtcgctgttgctagtgcaagctcttccgcttcaagctaa

SEQ ID NO: 46097 - DNA, 828 bp, Saccharomyces cerevisiae
atgtctagtcgtaaaaaagtcagagtattactgctcaagaataaaactgtccccattgataaatatgaattggagtgtaggagtaaggcgtttgaacccatattcgtaccgcttattaaacatacacatgtaattcaagattttagaaatgttttgaataccatcccaaactatttgaatactatcaattacattattattacctctcaaaggactgtagagtcattgaatgaagcgatcattcccacattgacaagtgaacaaaaagctgcattgctcagtaaaacagtttatactgtaggccctgctactgctaacttcatcagaagatcaggtttcattaatgttaaaggtggagaagacgctggtaatggttcaatccttgctgatataattattgatgacttgagtacggatattaaggcatgcccaccaagtgaactattatttctcgtgggtgaaattagaagagatatcatcccaaagaaactccatagcaagggaataaaagtaagagaagtggttacttataaaactgaagaattaagcgacggttttaaaagattcatacacgccatgaaagaatgcgatgaggatgaagtattctcggactgggtggtagttttcagtccccagggaacgaaagaaattactcagtatttgggtgacagtaaccgcctaccaggttcccatctacgggttgcgtccatcggacctaccactaaaaaatatctggatgataatgatgtaacctctgatgtggtcagtccaaaaccggaccccaagtcgctattagatgctattgaattataccagcgccataaataa

SEQ ID NO: 46098 - DNA, 420 bp, Saccharomyces cerevisiae
atgtggaaggccgtgatgaatgcttggaatggaaccgagagtcaaagtaagaatgtttcaaatattcaatcttacagttttgaagacatgaaaagaatcgttggaaagcatgatcctaatgtggttttggtagatgttagagaaccatctgagtactcgattgttcatattcctgcttccatcaatgtgccatatagatcgcaccctgacgcatttgccttagatcctttagaatttgagaaacagattggcatcccaaaacctgacagtgccaaggagctaatattttattgtgcttctggcaaacgcgggggagaagctcaaaaagtcgcctcctcacatggatattcaaacacctcactatatcctggctctatgaatgattgggtttctcatgggggtgataaacttgacttatag

SEQ ID NO: 46099 - DNA, 450 bp, Saccharomyces cerevisiae
atgttcaagcatagtacaggtattctctcgaggacagtttctgcaagatcgcctacattggtcctgagaacatttacaacgaaggctccaaagatctatacttttgaccaggtcaggaacctagtcgaacaccccaatgataaaaaactattggtagatgtaagggaacccaaggaagtaaaggattacaagatgccaactacaataaatattccggtgaatagtgcccctggcgctcttggattgcccgaaaaggagtttcacaaagttttccaatttgctaaaccacctcacgataaagaattgatttttctttgtgcgaaaggagtaagagccaaaactgccgaagagttggctcgatcttatgggtacgaaaacactggtatctatcctggttctattactgagtggttagctaaaggtggtgctgacgttaagcccaaaaaataa

SEQ ID NO: 46100 - DNA, 5112 bp, Saccharomyces cerevisiae
atgaacataccacagcgtcaatttagcaacgaagaggtcaaccgctgctatttaagatggcagcatttgagaaatgaacacggaatgaacgctccgagtgtgccggaatttatctatttgactaaagtgttgcaatttgctgccaagcagcgacaagaattacaaatgcaacgccaacagcaaggcatttcaggttctcagcaaaatattgttccaaattcttcagatcaagcagaactgccgaataatgcttcctcgcacatttctgcttctgcttccccgcatttagctccgaatatgcaattgaatggaaatgagacctttagcacttctgctcatcaatcaccaatcatgcaaacacagatgccattaaatagcaatggtggtaataacatgctaccacaacggcaatcttcggttggttcattaaatgcaactaatttttcaccaacaccagcaaacaatggagaaaatgctgcggagaaaccagataactcaaaccataataacttaaaccttaataattccgagcttcaaccgcaaaatcgatcattacaagaacacaacatacaggattcaaatgtgatgccaggttcgcagataaattctcctatgccccagcaggcgcagatgcagcaggcacaattccaagcacaacaggcgcaacaagcgcaacaggcacaacaggcacaacaagcacaagcgagactgcaacaggggagaagattacccatgacaatgtttactgccgagcaatccgaactgttaaaggcccaaatcacatctctaaaatgtctagtaaatagaaagcctattccgtttgaatttcaggctgttatccaaaaatctattaaccatcctccagatttcaaaagaatgttactgtctttgagtgagtttgcgagaagaagacaacccacagatcaaaataaccaatcaaatctcaatggcggcaacaatacgcagcaacccggcaccaattcccactacaataacactaacactgacaacgtttctgggcttaccagaaatgcacctttagatagcaaagacgaaaattttgcatctgtttcaccagctggtccatctagtgtacataatgcgaagaatggcaccctcgataaaaattcgcaaactgtaagtggcactccaatcacgcaaacagaatcgaaaaaagaggaaaacgaaaccatttcaaacgtagctaaaacagctcctaatagtaataagacccacaccgagcaaaataacccgccaaaaccgcagaaacccgttcctttaaacgtccttcaagatcaatataaggaaggaataaaagtggtagatatagatgatcctgatatgatggttgattcttttacgatgcccaatatctcacatagtaatatcgattatcagactttattggccaattcggatcatgcaaagtttactattgaacctggcgttctaccggttggtattgacacacataccgctactgacatttaccaaactttaattgcattgaacctagatactacggtaaatgactgtttggataagctactaaatgacgaatgtacggaatcaaccagggaaaatgctctttacgattactacgccttacaattattaccgttacaaaaagccgtaagaggtcatgtattacaatttgaatggcatcaaaattctttattaaccaatacacatccaaattttctttcgaaaataagaaacatcaacgttcaagatgcattgctaacaaaccaactttataagaatcatgaattacttaagttagaaaggaagaagactgaggcagtggccagattaaagtcgatgaataaatccgccatcaatcaatataatagaagacaagataaaaagaataaaaggttgaagtttggccatagactcattgctacgcatactaatttagaaagggatgagcaaaagagagctgaaaaaaaggcaaaagaacgtttacaggctttaaaggcgaacgatgaggaagcctatataaaattattagaccaaaccaaagatacaagaattacacatcttctaaggcaaacaaacgcatttttagattctttaacaagagccgtgaaagatcaacaaaagtacactaaagaaatgattgattcccacataaaggaagcatcggaggaagtggatgatttgtccatggtccccaagatgaaggatgaagaatatgatgacgacgacgacaattctaacgtcgattattacaatgtcgcacatagaattaaagaagatatcaagaagcagccttcaatattggttggtggtaccttaaaggactatcaaatcaagggtttacagtggatggtttcgcttttcaataatcatttaaatggtattttagcagacgaaatgggtcttggtaagactatccagacgatatccttacttacatatttatatgaaatgaagaatattcgtgggccatatttagtcattgttcctttatctacactgtcaaattggagcagtgaattcgcgaaatgggctcctaccttaagaactatatcatttaaaggttcgccaaatgagaggaaagccaaacaggctaaaataagggcaggtgaatttgatgtagttctgactacctttgagtatattattaaagaaagagcacttttatccaaggtcaagtgggtccatatgattattgatgaaggccatagaatgaaaaatgcgcaatccaagctttctttaaccttgaacacacattaccatgcagattatagattaattttgacaggtacaccacttcaaaacaacttgccagaattatgggccttattgaattttgtgttacccaagattttcaattccgtgaaatcttttgatgaatggttcaatacaccctttgccaacaccggtgggcaagataaaattgagttgagtgaagaagagacgcttttggttatcaggagattgcataaagtcttgagaccctttttattgcgtcgtttgaaaaaggatgtagaaaaagaattaccggataaagttgagaaggtagtgaagtgcaaaatgagcgctttacaacaaattatgtaccaacaaatgttgaaatatcgtcgtctttttatcggtgatcaaaataataagaaaatggtaggtttaagaggtttcaataatcaaatcatgcaactaaagaaaatctgtaatcatccttttgtatttgaagaagttgaggaccaaatcaatccaacaagagaaacgaatgatgatatttggcgtgttgctggtaaatttgaactattagatagaattttgcctaagcttaaggcaactgggcatagagtattaattttttttcaaatgacccaaattatggatattatggaagattttttaaggtacattaatatcaagtacctgaggttagatggtcatacaaaatctgatgaacgtagtgagttgttacgtctatttaacgcccctgattctgaatacttgtgctttatcttatcaactagagcgggtggtttgggtttaaatttacaaactgcagacactgtcattatttttgatactgactggaatcctcatcaagatttgcaagctcaggatagagcgcatagaataggtcagaagaatgaagttagaattctaagattgattactacgaattcagttgaagaagttatcctagagagagcctacaagaagctagatatcgatggtaaagtcattcaagcaggtaaattcgataacaaatctacatcggaggaacaagaagcgttgcttagatctttgctggatgcagaagaggaacgtagaaagaaaagagagtctggtgttgaagaagaagaggagttaaaagactcagaaatcaacgaaattcttgctcgaaatgacgaagaaatggctgttcttacaaggatggatgaagatagatcaaagaaggaggaagaattgggagtaaagagccgtctcttagaaaagagtgaattacctgatatttacagtagagatattggtgccgagctcaaacgtgaagaatcagaatctgctgctgtttacaatggaaggggtgcaagagaacgtaagacggcaacttacaacgataatatgtctgaagaacagtggttaagacaatttgaagttagcgatgatgaaaaaaatgacaagcaggcaagaaaacaacgaacaaagaaggaagataagagcgaggcgattgatgggaatggagaaattaaaggcgaaaacattgacgctgataatgacggtcctagaattaataatatatcggccgaagatcgggcagatacggatttggcaatgaatgacgatgatttcttgtctaaaaagagaaaggcaggaaggccccgtggaagacctaagaaagtgaaacttgaaggatctgaaaattctgaaccaccagcgcttgaatcaagtccagttactggcgataactctcccagtgaggattttatggacattccaaaaccacgtacagcgggaaaaacatctgttaaatcagcaagaacttcaacaaggggccgtggtcgcggtcgtggtcgtggtcgagggcgaggacgtggacgaggaaggccgccaaaagcaagaaatgggcttgattatgtccgcacgcccgctgcggcaacgagtcctattgatattagagagaaagttgctaaacaagctctagacttataccactttgctctcaattatgaaaatgaagctggaaggaaactttctgacattttcctctccaaaccttccaaagcactatatcccgactactatatgattattaagtaccctgtcgcctttgataatattaacacgcatattgaaacgctagcttacaactcccttaaagagacccttcaagactttcatctgatattttccaatgctaggatatacaatactgagggttcagtagtatacgaagactctttagaactggaaaaagtggttacgaagaaatactgtgagataatgggcgataactcacaactcgactttactgaatttgatgaacagtatggcaccagacccctcgtcttgcctcctgttgttacttcaagcgtggctgaatctttcacagatgaagcggactcgagcatgacagaagcgagtgtatag

SEQ ID NO: 46101 - DNA, 579 bp, Saccharomyces cerevisiae
atgctattgtttcctggcttgaagcctgttcttaatgcttccactgtcattgtaaatcctgtacgagctgtttttccaggattagtactttcaaccaaaagatccttttatagcattaatcgtttaaatgctgaaaataaaataaacgatattgcaaatacgtcaaaagaggcatcctcttcagtgcagatgtttaagcccccagagttctctcaatttaaggactcttatcaaaaagactatgagagaatagcaaaatatactttgattccattaacaatggtacctttttatgcctcctttaccggcggggttataaatcctttactcgatgcgtctttatcgtccatttttttgatatatttacagtatggcttcacaagttgtattattgactatataccgaagggaaagtatccaagatggcataagctcgccctttattgcctctatggaggatccatgttgtccctgtacggtatctacgaattggaaacgaaaaataatggttttgttgacctggtaaagaaactttggaatgaaaatgatgaccatttgtatatatttggaagaaactga

SEQ ID NO: 46102 - DNA, 1236 bp, Saccharomyces cerevisiae
atgtcctccgctgcaacaaaagctactttctgtatccaaaatggtccttcctttgaaggtatatcttttggtgcaaacaaatctgttgctggtgaaacagttttcactacttctctggttggttacccagagtccatgactgatccttcctaccgtggtcagatattagtcttcacgcaacccttgattggtaactacggtgtcccatccggcgaagcccgcgatgaatacaatttactgaagtattttgaatctccgcatatacatgtggtcggcatcgttgtcgctgaatatgcttatcaatattcgcattggaccgctgttgaatctctggcacaatggtgtcagagagaaggtgttgctgctattactggcgtagacacccgtgaactagtgcaatacttgagggaacaaggttcttctttgggccgtattacgttggctgatcatgaccctgtcccctacgtgaatcccatgaaaactaacttggttgctcaagtcaccacaaaaaagcctttccacgtctctgccttacctgggaaggctaaggcaaatgtggctcttattgactgtggtgttaaagaaaacattatcagatgcctagtcaaaagaggtgccaatgtaactgttttcccctatgattacagaattcaagatgttgcttctgaattcgacggtattttcttatccaatggaccaggcaacccagaactatgccaagctacaatttccaacgtcagggaattactaaataaccctgtttatgactgtatccctatttttgggatttgtctaggccatcaactcttggctctggcctccggtgcctctactcacaaattgaaatatggtaatagggctcacaacatccctgccatggatttgactaccggccagtgccacattacatctcaaaatcatggctatgcagttgatcctgagaccctaccaaaggaccaatggaaaccttattttgttaatttaaacgacaaatcaaacgaaggcatgatacaccttcaaagacccatattttctacccaatttcacccagaggcaaaaggtggtcccttagacacagctattctttttgacaaattcttcgataatatagaaaaataccaattacaatctcaggcaaaaagttcaatctcactaaaagtaacatacagtaccgataaatcgagattgcagagtataaatgttactaagttggccaaggaaagagtgttgttctaa

SEQ ID NO: 46103 - DNA, 3363 bp, Saccharomyces cerevisiae
atgacgacccagcaagaggagcaacgaagtgataccaagaatagcaaaagcgagtcaccttcagaagttttagtcgatactctcgactcaaagtcaaatggcagtagtgatgatgataatatcggacaaagtgaagagctatcagataaagaaatatatacagtagaagatagaccaccagaatattgggctcaaagaaagaaaaaattcgtacttgatgtagatccaaaatacgccaagcaaaaggacaagtccgatacgtacaaaagattcaaatatttattaggcgtcacagaccttttccgtcattttattggaattaaggcaaaacatgataaaaatattcaaaaactcttaaaacagttagattctgatgcaaacaaactttccaaatcacacagcaccgtcagttcgtcatcacgtcaccatagaaaaacagaaaaggaggaagatgctgaattaatggctgatgaggaagaagagattgtagatacatatcaggaagacatattcgtctcagaatctccctccttcgtcaagtcaggaaaattaagagactatcaagttcaaggcttaaactggttaatatcgttgcacgaaaacaaactatctggtatcttggccgatgaaatggggctgggtaaaaccttacaaacaatttcattcctaggttatttgagatacgtcaaacaaatcgagggaccctttctaataatagtaccgaagtcaacactagataattggagacgagagtttcttaaatggactccaaacgtcaatgtccttgtgttacatggtgataaagacacaagagctgatatagtacggaatataatattagaagctagatttgatgtattgattacatcttatgaaatggtcattagagaaaagaatgctttgaaaagattagcttggcaatatattgttattgatgaggctcacaggatcaaaaatgaacaaagcgcgttatctcaaataattagattattttactctaagaatagattattgattacgggcacgcctctacaaaacaatctacacgaattatgggccctgctaaatttcttattacctgatatatttggagattctgaactttttgatgaatggttcgaacaaaacaattcggaacaagatcaagaaattgtaatccaacagctacactcagtactaaacccctttttactgagaagagtcaaagcggatgtcgaaaaatctttgctacctaaaatcgaaacgaatgtttacgtggggatgacagacatgcaaatacaatggtataaatcattattagagaaggatatagacgctgttaacggtgctgttggaaaaagagaaggcaaaacgaggttactgaatattgttatgcaattaaggaaatgctgtaatcatccatatctttttgaaggcgcagaacctggacctccatacactaccgatgaacatttgattttcaattccgggaaaatgattatattagataagttactgaaaagactgaaggaaaagggatctagagtattgattttcagtcaaatgtcgagactattggatatcttagaagattattgctattttagagattttgaatattgcagaatcgacggttctactagccatgaagaacgtatagaagctatcgatgagtataataaacctaattctgaaaagttcgtttttttgctaacaacacgtgccggtggtttaggtattaaccttgtcacagccgacactgttattctttttgattctgattggaaccctcaagctgatctacaagcaatggatagagcgcatagaattggtcaaaagaaacaagttcatgtttatagatttgtcacagaaaatgctattgaagagaaagtcattgagcgtgccgcacaaaagctgagactagaccagttggttatccaacagggcacgggcaagaaaactgcatctcttggtaactcaaaggatgatctgttggatatgattcaatttggcgctaaaaatatgtttgaaaagaaagcaagtaaagtcactgttgatgctgatatcgatgatattttgaaaaagggggaacagaagacacaagaactaaatgccaaataccaaagtttaggacttgacgacttacaaaagttcaatgggatcgagaaccaatctgcttacgaatggaatggtaaaagctttcaaaaaaaatccaacgacaaagtagttgaatggattaatccttcccgaagagaaagaagaagagagcaaaccacttattcagttgacgattattataaggaaattattggtggtggctctaaatcagcaagcaagcaaactccgcagccaaaagcaccccgcgctccaaaggttatacacggtcaagatttccagttcttccccaaggagttggatgccttacaagaaaaggaacagctttacttcaagaaaaaggtcaactataaggttacttcttatgatattacgggagatatacgtaatgaaggaagcgatgctgaagaagaagaaggagaatacaaaaatgccgctaatacagaaggtcataaaggccatgaggaacttaaaagaaggattgaggaggagcaagagaagattaattcagcaccggattttacccaagaagatgaattacgaaagcaagaattgatatcaaaagcctttactaactggaataagagggactttatggcgtttatcaacgcctgcgccaaatacggtagagatgatatggaaaacattaagaaatctattgattccaaaacaccagaagaggttgaagtgtatgcaaaaatattctgggaaagactaaaggaaatcaatgggtgggagaagtatttacataatgtagaacttggtgaaaaaaaaaatgaaaaactgaaattccaggaaactctattgaggcagaaaatcgaacagtgtaaacatccattacatgagctgataatacagtatccacctaataatgctagaagaacttacaataccttagaagataaatttttattattagctgttaacaagtacggacttcgtgctgacaagctctatgaaaaattaaagcaagaaatcatgatgagtgatttgttcacttttgattggtttataaagacaagaacggtgcatgagctatcaaaaagagtccatacgctattaactttaattgtaagagagtatgagcaacctgacgcaaataagaagaaaaggagtagaacttcagcgactagagaggatactcctttatcccaaaatgaaagcactagagcttcaacggttccaaatctcccgacgacgatggtgacaaatcaaaaagatacaaacgatcatgttgataaaagaaccaaaattgatcaagaagcatga

SEQ ID NO: 46104 - DNA, 1566 bp, Saccharomyces cerevisiae
atgagctcagacagtttaacgcctaaagacactatagttccagaagaacaaaccaaccaactgcggcaacctgatttagatgaggatagcatacattatgatccagaagctgatgatttagagtcattagagactactgcctcttacgcgtcaacgtcggtgtcggcaaaggtgtataccaagaaggaagtaaataaaggaactgacattgaaagccaaccacattggggtgaaaatacctcgagcacgcacgacagtgacaaagaagaagattccaatgaagaaattgaaagcttcccggagggtggattcaaggcttgggttgtgacatttggttgcttcttgggtctaattgcatgctttggtttattaaactcaacgggggtcatagaaagtcatctacaggacaatcaattatccagtgaaagtgtttctaccattggttggctgttttctttgtttctttttgtttgctctgcctcatgtatcattagtggtacttactttgatagaaatggatttaggacaattatgattgtgggcacggtttttcatgtagccggtctgttcgctaccgccaactctactaaatattggcacttcatactgtcctttgccattgtctgcgggttcggtaatggtattgtactgagtcccctagtaagtgttcccgcccactatttttttaagagacgtggtactgcattggcaatggccactattggtggtagtgtgggtggcgtcgttttcccaattatgttgcgtagtttcttctctatgaagtcagacactgatccaacttatggatttgtttggggcattagaactttaggatttttagatttggctttgctaactctgtcaatcattttagtcaaagagaggttaccacatgttatcgaaaattccaaagatggtgagtcacgttggagatacatactcagagtttatattctgcaatgttttgatgcgaaggctttcctggatatgaaatatcttttttgtgtcctgggaacggtatttagtgagttatccattaattcagctcttacttattatggatcatacgccaccagccatggaatttctgctaatgacgcctacaccttgattatgattataaatgtctgcggcatacccgggagatgggttcctggctatttgagcgataagttcggtaggtttaacgtcgcaattgcaactctactcactctatttatcgtcatgtttgttggttggttaccatttggtaccaatttgacaaatatgtacgttattagtgccctatatggattttgttctggaagcgttttctccttacttcctgtttgctgtggccagatatctaaaacggaagagttcggtaaacgttactctacaatgtacttcgttgtcggtttcggtactttagtcggcattccgataacaggtgccattatctctatcaagacaacggccgattaccaacactatattattttttccggtttggcaacttttgtaagcgctgtttgctacataatttcgagagcatactgtgttggcttcaagtgggtcagattttaa

SEQ ID NO: 46105 - DNA, 1362 bp, Saccharomyces cerevisiae
atgattcaaacgcaaagtacagcgatcaaacgacgtaattctgttcataaaaacctctttgatccatcactgtatcaaataccagaaccaccacgtggggggttccaacaccaaaaaaaagaatacagtaaggagacattcagtaatcaagtctttggatatgatattactagccttaaaaaaagattcacgcaactatttcctagtaatatacaagggtacttacctgaagttgacctaagaataaccattatttgttctatatggtacgtcacgtcatctatttcaagtaacctatctaaagccattttaagaactttcaaccatcccatagctctcacagaattgcaatttcttgttagtgctgttctatgtgttggatttgcttccatcgtaaatttattccgactacctcgtttgaagcatacgaagttttcaaaggcactcaatagtttccctgacggtatccttcctgaatatctcgatggcaatttcaggagttctatcctgcacaagtttttagttccctcaaagctggttttgatgaccactttccctatgggaatattccaatttattggtcatatcacatcgcacaaggcggtatctatgataccagtatcactagtgcattccgtgaaggcattatccccaataataacagttggctactataaatttttcgaacatcgttattacaattccatgacttattataccttgttacttttaatttttggcgttatgactacttgctggtcaacacatggcagtaagagggcttcagataacaaaagcggatcttcattaatcgggttgctttttgcctttatttccatgataatatttgtagcacagaatatttttgcaaagaatattttaaccatcagaaggaaggtaggaatactgccgtcttcttctacggatgacgtcacgtcgaaggaagggcaaccgagtctagacaaaacaagattttctccattgcaagtggataagattaccatattgttctactgctcctgcattgggttttctttaaccctattaccttttttaaccggcgaattaatgcatggcggtagcgttatcaacgatttaacgctagaaacagtagcccttgtagcgattcatggaatagcccattttttccaagcaatgcttgctttccagttgatcggtttactatcttccattaattattcggtagcaaacatcatgaagaggattgttgttatatccgtggcactcttttgggaaacaaagttaaatttttttcaggtgtttggtgttatcttgacaattgccggattgtacggttatgacaaatgggggctttccaaaaaagatggacgtcaggcataa

SEQ ID NO: 46106 - DNA, 2103 bp, Saccharomyces cerevisiae
atggttgctcaatataccgttccagttgggaaagccgccaatgagcatgaaactgctccaagaagaaattatcaatgccgcgagaagccgctcgtcagaccgcctaacacaaagtgttccactgtttatgagtttgttctagagtgctttcagaagaacaaaaattcaaatgctatgggttggagggatgttaaggaaattcatgaagaatccaaatcggttatgaaaaaagttgatggcaaggagacttcagtggaaaagaaatggatgtattatgaactatcgcattatcattataattcatttgaccaattgaccgatatcatgcatgaaattggtcgtgggttggtgaaaataggattaaagcctaatgatgatgacaaattacatctttacgcagccacttctcacaagtggatgaagatgttcttaggagcgcagtctcaaggtattcctgtcgtcactgcctacgatactttgggagagaaagggctaattcattctttggtgcaaacggggtctaaggccatttttaccgataactctttattaccatccttgatcaaaccagtgcaagccgctcaagacgtaaaatacataattcatttcgattccatcagttctgaggacaggaggcaaagtggtaagatctatcaatctgctcatgatgccatcaacagaattaaagaagttagacctgatatcaagacctttagctttgacgacatcttgaagctaggtaaagaatcctgtaacgaaatcgatgttcatccacctggcaaggatgatctttgttgcatcatgtatacgtctggttctacaggtgagccaaagggtgttgtcttgaaacattcaaatgttgtcgcaggtgttggtggtgcaagtttgaatgttttgaagtttgtgggcaataccgaccgtgttatctgttttttgccactagctcatatttttgaattggttttcgaactattgtccttttattggggggcctgcattggttatgccaccgtaaaaactttaactagcagctctgtgagaaattgtcaaggtgatttgcaagaattcaagcccacaatcatggttggtgtcgccgctgtttgggaaacagtgagaaaagggatcttaaaccaaattgataatttgcccttcctcaccaagaaaatcttctggaccgcgtataataccaagttgaacatgcaacgtctccacatccctggtggcggcgccttaggaaacttggttttcaaaaaaatcagaactgccacaggtggccaattaagatatttgttaaacggtggttctccaatcagtcgggatgctcaggaattcatcacaaatttaatctgccctatgcttattggttacggtttaaccgagacatgcgctagtaccaccatcttggatcctgctaattttgaactcggcgtcgctggtgacctaacaggttgtgttaccgtcaaactagttgatgttgaagaattaggttattttgctaaaaacaaccaaggtgaagtttggatcacaggtgccaatgtcacgcctgaatattataagaatgaggaagaaacttctcaagctttaacaagcgatggttggttcaagaccggtgacatcggtgaatgggaagcaaatggccatttgaaaataattgacaggaagaaaaacttggtcaaaacaatgaacggtgaatatatcgcactcgagaaattagagtccgtttacagatctaacgaatatgttgctaacatttgtgtttatgccgaccaatctaagactaagccagttggtattattgtaccaaatcatgctccattaacgaagcttgctaaaaagttgggaattatggaacaaaaagacagttcaattaatatcgaaaattatttggaggatgcaaaattgattaaagctgtttattctgatcttttgaagacaggtaaagaccaaggtttggttggcattgaattactagcaggcatagtgttctttgacggcgaatggactccacaaaacggttttgttacgtccgctcagaaattgaaaagaaaagacattttgaatgctgtcaaagataaagttgacgccgtttatagttcgtcttaa

SEQ ID NO: 46107 - DNA, 1371 bp, Saccharomyces cerevisiae
atgtccagttcacaacaaatagccaaaaatgcccgtaaagcagggaatattttgaaaaccatctcaaacgagggcagatcagatattttatacaaaattcacgatgccctgaaggctaatgcgcatgccattgaagaagcgaataaaatcgatttagctgttgccaaagagactggcctagcggattctttattgaaacgtctcgacctatttaaaggggacaaatttgaagttatgttacaaggtattaaggatgtagccgaactagaagaccctgttggcaaggttaaaatggccagggaattagatgatggcttgacgttgtaccaagtaaccgctccagtcggcgttttgttagttatctttgaatcccgtccagaagttattgccaatattaccgcattgagtatcaagtctggtaatgctgcaattttgaagggtggtaaagagtctgtgaacacgttcagagaaatggcaaagatcgttaacgacaccattgcacaattccaaagtgagactggtgttcctgtgggctctgtgcaattgatcgaaaccagacaggatgtttccgacttgttggatcaagatgagtacatcgacttagttgttcctcgtggttccaatgccttagtcagaaaaatcaaggacactacaaaaattcccgtgttgggtcatgcggatggtatctgctcaatttacttggatgaagacgcagatttgattaaggcaaaaagaattagtttggatgcaaagactaactacccagctggttgcaacgctatggaaacgttgttgattaacccaaaattctctaagtggtgggaagttctggaaaacttaactttggaaggcggagtgactatccacgctacaaaagatttgaaaactgcgtattttgataaactgaatgagttagggaaattgacagaagcaattcaatgcaaaaccgttgatgctgatgaggagcaagattttgataaggaatttttatccttggatttggctgccaagtttgttacatctacagaatcggccattcaacatataaatacacactcttcgagacataccgacgctattgtaacggaaaataaagcaaacgctgaaaaatttatgaagggtgtcgactcctctggtgtttactggaatgcatcaactagatttgccgatggtttcaggtacggttttggtgctgaagtgggtatttctacctctaagattcacgcccgtggtccagttggcttggacggtctggtgagttatcaataccaaataagaggtgacggccaggttgctagtgactaccttggtgctggtggtaacaaagcttttgttcacaaggatttagatataaagactgtgacattataa

SEQ ID NO: 46108 - DNA, 1809 bp, Saccharomyces cerevisiae
atgaacttgctaattgaccggatggagaatcccggatcgaggaactgtaccctgttacctccttcattcccaagaggcttttgtaagggaagaagggcttccagtggcgacgcagtgaagataaaagaatccggtctacagccgcagccgcagccggaacctctacaagctaaaacaaatgttgcacacttttcgaaatcatcttctagattacctgtcatagcagtgaatgataatccggtggtcccaagaccaagcactgaagtaaacttgggatcgttgttacaaaaggaaagggagaaagaaaaggaggaacagcctgcgctgcatgataggagacatttatatgtgacaaagaatagggcacatggggtacgacaacgttcattggaaatgactagcttacctgtcctgggatcgaccaaaaccgggaagtttagcgattttttgtttgaagatgacatcgataacagagtaggtcgacacagtagatcatatagtggggcatccagtttggatgatccattcagagtgtcgccgaaaaccgacttcaactctaatagggccagattgtcttgccttagtaaaggacgtcgtggttcgatgtccgttttccaaagctgtcatactgggctagctttcaatcaaatacagggttcctcctcttcgcaacgtagatcatccgctggttcttttgattatgagaggaaacgattggttaaccaatttttacagccttctttgggaaattcagacccatttgatacgttgagggagtcggtagtgtttgagccctcatccaccgctggcggcattaaattagggaatatgcattctcaatcacaaatttccgtaaactcctcccccagcacatctttgttttatcatgatttggacggttctgctgtcaacgattcttcgtcatttctgtattcccgttctaatgtaccagcatttttgtcgtcatcagccttttcgtccacgtcatccacctcatcagattcagaagatgtggatagaagaagtttaaacggtgtatatccctctttaggatatttgactaaccagaggaaaccaaggaattcatcaggctcttccactgcacctggcaccgataccttgggatttaagtatttactgaataggcagaagtcagcggattcttccactaggttcaagagtgtactgaaggtgaacaataataatggctccgcagccactcctgattctagctcaaactctatttcgaagagcaactcaaatttgaatgataacattgatgaattgaattattatcaaaatcatatttcgacacttctagtgaagatcgagaatgagatgagaagaaatttaaacgatacaataatcaagaatgaaaacaacgttcaaaaaactatccaaaagtatgatcttctatcaggagagttaacccttttattagacgaaatgaccaccttgcgaaccacggtgattaatcaattcttggtcaagttgaaatcagactttgacgaggatgacaataaggcgtttattaatgaattaaagatatcagtcgaagaaagtgtagcgcaattacaaggattggaaaggagaatggaggtttgccaagagagattaaataaacaaaagtcctctctaagggaaatggatagtttgatagagctgaaaaacgtgttaaataaatcgaagaacaacacgaaatccatctacctgtataggtatttcatcattgacattattgcatttcttttgatgggcggctttatcgtttacgtcaagaatttgttaactcgtttttttactcgttaa

SEQ ID NO: 46109 - DNA, 4725 bp, Saccharomyces cerevisiae
atgtcttttgaagtgggtacacgatgctggtatccccataaagaattgggctggattggggcggaagtaatcaaaaatgagttcaacgacggcaagtaccacctggagttacaattggaagacgatgaaatcgtgtccgtggacacaaaagacttgaataacgataaggaccaatctctaccgcttcttagaaaccctcccattttggaagcaacggaagatttgacctctttatcttacttgaatgagccagctgttttacatgccatcaaacagcgctattctcaattgaatatctacacatactcgggtattgttctgattgctacaaacccttttgatcgtgtcgaccagctttatacacaagacatgatccaagcatatgcgggaaagcgcagaggtgaactggaacctcacttgtttgccattgccgaagaagcgtataggttgatgaaaaatgacaaacaaaatcaaaccattgtggtaagtggtgaatctggtgctggaaaaacggtttctgccaagtatattatgcgttattttgcttctgtagaagaggaaaattccgctactgtacaacatcaagtggaaatgtcggaaacagaacaaaagattctagctacaaaccctatcatggaagcatttggtaatgctaagactaccagaaatgacaattcttccagatttggtaagtatctagaaattttattcgataaggacacatctattattggagcaaggatccgcacatacttgttggaacggtccagattagtttaccagccgccaattgagagaaactaccacatattttatcaattaatggctggattaccagctcaaaccaaggaggaattgcatcttaccgatgcctcagattacttctacatgaaccaaggcggtgacaccaagatcaacggtattgatgatgccaaagaatacaaaattacagtagatgcattgacattagtcggaatcaccaaggaaactcaacaccaaatatttaagatcttggccgcacttctgcatatcggtaacatagaaattaaaaaaactagaaatgatgcatcactatcagctgatgagccaaacctgaaactggcgtgcgaattgctgggaattgatgcctacaactttgccaaatgggtcaccaaaaagcagatcattacaaggtcagagaaaattgtttcgaatctaaattatagtcaagctctggttgccaaagattccgtggctaagtttatttattccgcccttttcgattggcttgtggaaaatatcaacaccgtgttatgcaacccggctgtgaacgaccaaattagctcatttattggtgttctggatatttatgggtttgaacattttgaaaaaaattcatttgaacaattttgtattaactatgccaacgaaaaactacaacaagagttcaaccaacatgttttcaaattagagcaagaagaatacgttaaagaagaaattgaatggtcttttatagagtttaatgataatcaaccttgtattgatctgattgaaaacaagttgggtattttatcactgcttgacgaagaaagtaggttacctgctggttccgacgaatcttggacccaaaaactttatcaaactttggataaatctcctacgaacaaagtattttctaaaccaagattcgggcaaactaaatttatcgtgagccattatgctctagatgtcgcttatgatgtggaaggatttattgaaaaaaatagagacaccgtatctgacggacatttggaagtgttgaaggcttctaccaacgagacactaataaatatcttagagggattagaaaaagctgccaaaaaactggaagaagcgaaaaagcttgaattagagcaggctggcagtaaaaagccaggtccgataagaacggttaacaggaaacccactttaggttccatgtttaagcaatctttgattgaactaatgaataccatcaactcaactaatgttcattatattcgttgtataaagcctaatgcagataaagaagcttggcaatttgataatttgatggtgttgtctcaactcagagcctgtggtgttttggaaactattagaatatcttgtgctgggtttccttctaggtggacttttgaagaatttgtattaagatattacatcttgataccacatgagcagtgggacctaatcttcaaaaaaaaggaaactacagaagaagatatcatatcagtggttaaaatgatcctagatgctactgtaaaggacaaatccaagtaccagattggtaatacaaaaattttcttcaaagcaggtatgcttgcatatctggaaaaacttagaagcaataagatgcataattcaattgttatgatccagaagaaaattagagctaaatattaccgtaagcagtatttgcaaatatctcaggccatcaagtatttgcagaacaacatcaaaggtttcatcattcgtcaacgcgttaatgatgaaatgaaagttaactgtgcaactttattacaggccgcttacaggggtcattccatccgtgccaatgtgttcagcgtattgagaacaattacaaatttgcaaaagaaaattagaaaggaactaaaacaaagacaactgaaacaagaacatgaatataatgctgcggtaactattcaaagtaaagttaggacctttgagccgagatcgagatttttacgcactaaaaaagacactgttgttgtccaatctttgatcagaagaagagctgctcaaaggaaattgaaacaattgaaggcagacgctaaatcagttaatcatctgaaagaagtgagctataaattagagaataaagtgattgaactgacgcagaatctagcatccaaggtcaaagaaaataaagaaatgacagaaagaattaaagaactacaggttcaagtggaagaaagtgccaagttacaagagacattagaaaatatgaaaaaagagcacttaatagatattgataatcagaaatctaaggatatggaattacaaaaaactattgagaacaatttgcaatccactgaacaaactctaaaggacgctcaattagagttggaggacatggttaaacaacatgatgaattgaaagaagaatctaaaaagcaacttgaagaattagagcaaacaaagaaaacattggttgaataccagacattaaacggagacttgcaaaacgaagttaaatctttaaaggaagaaattgctaggttacaaactgccatgtcgctgggcaccgttactactagtgtactacctcaaacaccattaaaggatgtaatgggaggcggtgcttcaaatttcaacaatatgatgcttgagaattccgacttatctcctaatgatttgaatctaaagtctagatctactccatcgtccggaaacaaccacattgattcattgagtgtcgatcgcgaaaatggtgtcaatgctacacaaatcaatgaagagttatacaggttattggaggacactgaaattttgaatcaagaaatcacggaaggcctgttaaagggattcgaagtaccggatgctggtgtagctattcaactaagtaaaagagacgttgtttatccggctagaatactgattatagttttaagtgaaatgtggagatttgggctgaccaagcaaagtgaaagctttcttgcccaagtattgactacaattcaaaaagttgtcactcaattgaagggtaacgatttaattccaagcggtgtattctggttagcaaacgttagagagttatactcatttgtggtgtttgctctaaactctattttaaccgaagaaacgttcaaaaacggcatgaccgatgaggagtataaggagtatgtttcattggtcacagaactaaaggatgatttcgaagctctaagttataatatatataacatttggctgaagaaattgcagaagcaattgcaaaaaaaggccatcaatgctgtggtcatctccgaatcattaccaggtttcagcgcgggagaaaccagcgggtttttgaacaaaatttttgctaacactgaagaatatacaatggacgacattttgacctttttcaacagcatatactggtgcatgaaatcttttcatattgagaatgaagtgttccatgctgtagtcacaaccttattgaattatgtggatgcaatttgttttaacgaattaatcatgaaacgtaatttcttgtcgtggaaaaggggtcttcaattgaactacaacgttactagattagaggaatggtgcaagacgcatggcttgacagatggtactgagtgcttacaacatttgattcagaccgctaagctactgcaagtccgtaagtatactatcgaagacattgatatcttaagaggaatttgttattcgctaacacctgcacaattgcaaaaattgatttcacaataccaggtggcagactatgagtctccaattccacaggaaatcttaagatacgttgctgatatagttaagaaagaagctgcgttatcttcatcaggtaatgattctaagggtcacgagcatagcagcagtatatttatcactccagaaacaggtccatttactgacccattcagtttgataaagacaagaaaatttgaccaagtagaagcctatataccagcgtggttatccttgccctcaactaagagaatagttgaccttgttgcccaacaagtcgttcaagacggccactaa

SEQ ID NO: 46110 - DNA, 348 bp, Saccharomyces cerevisiae
atgtcgtcatcagtgccatacgatccatatgtgcctccagaggagagtaactcaggcgcaaacccaaattcccaaaacaagactgctgctttgagacaagagattgatgacacggtgggaataatgagagataatatcaacaaggttgctgaacgtggtgaaaggctaacatccattgaggacaaagctgataacttggctatctccgcacaaggattcaagagaggcgccaacagggtcagaaagcaaatgtggtggaaagatctaaaaatgagaatgtgtttattcttagttgttattattttactagtggtaattatcgttcctatcgtcgtccatttcagctaa

SEQ ID NO: 46111 - DNA, 4695 bp, Saccharomyces cerevisiae
atgttgcaagcgccctcaagttcaaactcgggtttgaatcaaggaaatgctgcgccggacggcccacctaacgaaacacagccgtacgaaggcctcgacgcggcagctcaagaagaaataaaagaattggcaagaacgctgacgagccaatcttcccttttatcgcaagaaaagcgtattaccggcactggcgacccgaatacactaactgctgcttcttcatcgtcattgagccggtcaattttcgctagtgatatcaagggagttaacccaatccttttggacgtcaatgatccagactacgatgagacattggatcctcgatcagaaaatttctcgagtgtcagatgggtacgaaatatggcacaaatatgcgagaatgattcggatttctataaaccgttttcattaggttgcgcctggaaagatttgagtgcctccggtgattctgccgatataacatatcagggaacatttggtaatatgcccatcaaatacttgaaaatgagttggaggtgcatatcccgacgtcttttccaccggacacatggcaagagtgaagataatgactccggtttccaaattttgaagccgatggacggatgcatcaatccgggggaactacttgttgtgcttggacgacccggtgcaggatgtactacgctgctgaaatctatatctgtaaatacacacggattcaagatttctccggacacaatcatcacgtacaatggattctccaacaaagagatcaaaaaccattaccgtggtgaagtggtctacaatgcagaatcagacattcacatcccgcacttgacagtattccaaactttatacacagtggcaagactgaagacaccaaggaaccgaatcaagggtgtcgatagggacacatttgccaaacacatgactgaagtggcaatggcaacttacggactgagccacactgcagatacaaaagtgggtaatgattttgttcgtggtgtatccgggggagaaaggaaaagagtttccattgctgaagtgtctatatgtggctcgaagtttcagtgctgggataatgccacgaggggcttagattctgctaccgcgctggagttcatcaaggccttgaaaacgcaagccactatcacaaagtctgcagccactgtggccatttaccaatgttctaaagatgcctatgatttgttcgataaagtctgtgttctttacgatggttaccaaatcttctttggcccaagtaagcaggccaaaaagtactttcaaagaatgggatatgtgtgtcccgaaaggcagaccacagcagattatttgacctctattactagtccttctgaaagaattaaggacaaagacatggtcaaacatggaattatgatcccacaaacggcctatgaaatgaaccagtactggattcaatcagaggaatacaaacaattacaggtgcaggtgaacaaacatttagatacagactcttcccagcaaagagaacaaataaaaaatgcacatattgccaaacaatctaagagagcacggccctcctctccttatacagtaagtttctttttgcaagttaagtatattctaatcagggatatatggaggattaagaatgacccaagtattcaacttttcacggttttgagtcatgcagcaatggctcttatcttgggatcaatgttttatgaagtcatgctttccactaccacaacaaccttttattaccgaggcgcggctattttttttgctattctgttcaatgcgttctcatcacttttagagatcttttcactctatgagacgaggcccattaccgaaaagcacaagacttactcgttatatcgcccaagtgctgatgccttcgcctctacattttctgatgttccaacaaaattagccacggcagtaactttcaacataccatattattttttaatcaatctaaaaagagatgccggtgcttttttcttttactttttaataaacattataacagtttttgctatgtcgcatttgttcagatgcattggctcagtgtcgaaaactttacctcaggcaatggttcccgcatctgttcttctgttagcttttgcaatgtacactgggtttgccatcccaagagtccaaatgcttggctggtcaaaatggatttcttatatcaacccattgtcttacctttttgaatcgctaatgattaacgaatttcatggtagaaatttcccatgtgctcagtatatacctagtgggccaaattatgtcaacgcaacaggtgacgaagtcacctgctccgccctcggttctatcccaggaaataattatgtaagtggtgatgatttcattcaaacgaactacggctatcgacataagaacaaatggcggtctgttggtattggtttagcatacattatttttttcttatttctgtatttattcttttgtgaatacaatgaaggagcaaagcaaaatggtgagatgttagtatttccccatagtgtggttaaaaagatgaagaagaagggtattgtctctgagaagaaaaagaaaaaccaaccaacgttgtcaacatctgatgctgagaaagatgtagagatgaacaacaattcaagtgcgactgattcaagatttttacgcgattctgatgcagctataatgggtaacgataaaactgtcgccaaggagcattattcatctccttcatcttctgcgtctcaaagcaatagttttagtaaaagtgatgacattgaattgtccaaatcacaagcgatttttcattggaaaaacttatgctacgatatcccgattaagaatgggaagaggagaattttggataatgttgatggttgggtcaagcctggtacactaactgccttgattggcgcatctggtgcaggaaaaacaacgttattagattgtcttgccgagagaaccacgatgggtttaatcactggtgatgtattcgtagatggtagaccgcgggaccagtctttccccagatcaattggttattgtcagcagcaggatttgcatttgaaaaccgcaactgtgagagagtcattaaggttttccgcgtacctgcgtcaagccgatgatgtatccatcgaggagaaagataaatacgttgaagaagtcattgaggtattggagatgaaactttatgctgatgccatagtaggcgttcctggtgaaggtttaaatgtggaacaaagaaaaaggttaaccataggtgtggagttagctgccaaaccaaaactgttggtatttttagatgagcccacgtctgggcttgattcccaaactgcatggtcaacttgtcaattaatgaagaaattggctagtcgcggacaagcaattttatgtaccattcatcaaccttctgctctcttaatgcaagagtttgataggttactatttttgcaagagggcggacaaactgtatattttggagagctagggaaaggttgcaaaacaatgattaactatttcgaagctcatggtgcccataaatgcccaccagatgccaatccagccgaatggatgttagaaatagtaggtgctgcaccaggaactcacgctagtcaagattattttgccatttggagagattctgaagaatatagggaaatgcagaaagagttggactggatggaacgagaattgcctaaacggacggaaggttcgtcaaatgaggagcagaaggagttcgctacgtcaactttgtaccagatcaaattggtgagttatcgattattccatcaatattggagaacaccattttacttatggtcaaaatttttttcaacaattgtgtctgaactcttcataggcttcacttttttcaaggcgaatacatcattacagggcctacagaatcaaatgctggccatttttatgtttacagtggtattcaacccaatattgcaacaatatttaccacttttcgttcagcagagggaactttatgaagctagagaaaggccatcaagaaccttttcgtggaaagcatttattgtatcgcagattctcgtggaaatcccttggaatttactggccggtactatagcttttttcgtctattattatcctgttggattttacagaaatgcttcttatgcaaatcaacttcatgaacgaggagctttattttggttatttgcgtgcgcgttttacgtctacatcagttcaatgggggtattagtgatttcatgcattgaaattgcagaaaatgctgcgaatctcgcttcacttttctttataatgtcattatctttctgcggtgttctggctacgccaaatattctaccaagattctggatttttatgtatagagtatcgccactgacatacctcattgatgctctgctatcggtaggactggccaatgctagtgtcgtttgttccagcaacgaacttttaaaaattgttcctccaagcggtatgacatgctcggaatatatggaaccttatatgcaatccaccgggacgggttatctgctcgatgggagttccgaaactgaatgtcacttttgtcaattcagttctaccaatgattatctggcgactgtgagttcttcgtattcacgtagatggatgaactatggcatttttagtgcatatattgtctttgactattgtgcagcaatatttttatactggctggtgcgggttccaaagaaaagcaaaaaattaaagaaataa

SEQ ID NO: 46112 - DNA, 702 bp, Saccharomyces cerevisiae
atgtcctccgctattactgctttgacaccaaaccaagtgaacgatgaattgaacaagatgcaagctttcatcagaaaggaagctgaagaaaaagcgaaggaaatccaattgaaggctgaccaagagtacgaaatcgagaagaccaacatcgtaagaaatgaaaccaacaacattgacggcaacttcaagagcaagttgaagaaggccatgctttcgcaacagattactaagtcaacgatagcaaacaaaatgaggttgaaggttctttctgctcgtgaacagtcgctagacgggatattcgaggaaaccaaggaaaagttgtcaggaattgccaacaaccgggacgagtacaagcccattttgcaatcattgatcgtggaggcacttttgaagttgttggaacctaaggcgattgtcaaggctcttgaaagagacgtcgatttaatcgagtcgatgaaggacgacattatgcgtgagtatggggaaaaggcccagcgcgcaccattggaagagattgttatctccaatgattacttgaacaaagaccttgtttccggcggtgttgtggtctccaatgcatcagacaagattgaaattaacaacactttggaggaaagattgaaattgttaagtgaagaggcattgcccgccatcagattggaattgtatggtccttccaagacaagaaagttctttgattga

SEQ ID NO: 46113 - DNA, 1092 bp, Saccharomyces cerevisiae
atgctagataacatgcaatttcattctccagcaccggaacatcctcaattgaatgggggtattaacaaaattcccgcttcccacaaaataggttacaaattaaaccagcaagtgcagagattggctgtggtcaggaataatattgaagagagattgaactcgatggaatcctcacacggacagatatccgatagtagcgttgtccgtgctatcgatgcaagtatcgatgacttcctaataccttcacctccattatcgccaaagctgaggcaatgccccataataagccagcctcagctggttaatgtggaaagcgaccatagggagctgatcatgttgacccccgtttgggaagcgggcttgaactctcagaagtacaaccataatacaaggaatttcttatcgcaatatagcttcttccgagatatgaaaacaacgaaaaggattcctaacaaagaaaataggaaattgaaagtggtaaaatctgttgtgaactcagaagctctgcccaagagaagaagatacgataggaaaattaagagaagatcaagggagttgtacgaagatgatggaaacaggtcagaaaactatgatgaagaaagtgctcaagaagttccagttagatcagtgactccgatacgtcaagttaaaaggtctcttcatactatttcttcgccattggcctcacagggcgtagtgaataatgtccccaagtatattccaagcatgtcgtgggaaaagttgccggattactcacctcctcttcacactttgccgaatagtaataataaagttttaaaagtggaatggaaaggctctccaatggacttgaatcatgatcctctcaaacagcgtctgcatcctgcagaactagttctcgcacagattctgagacttccatgtgatctttatttggactctaaaagaagatttttcttggaaaaagttcatagattcaaaaaggggttgccgttcaggagaacggatgctcaaaaggcttgtagaatagacgttaataaagcatcaaggctatttgcagcatttgaaaaggtaggttggttacaagataaacattttgaaaagtatttgtaa

SEQ ID NO: 46114 - DNA, 471 bp, Saccharomyces cerevisiae
atggcagtagaagagggtggttgcgtgacgaaacgtttacaaaatgagctgctacagctacttagttctacaacagaaagtattagtgcgtttcccgtagacgataatgatttaacatactgggtagggtatattacaggccctaaagacacaccgtatagtggacttaaattcaaggtttcattgaagtttcctcaaaactatcctttccatccgccaatgattaaatttttgagtccaatgtggcatccaaacgtggataagagtggcaacatttgtttggacattctgaaagagaaatggtctgcagtgtataatgtagaaacaattctattgtcattgcagtcattacttggcgaaccaaataacagatctccgctgaacgctgtggcagcagaactttgggatgcagatatggaggaatacagaaaaaaggtcctggcctgttatgaagaaatcgacgattactga

SEQ ID NO: 46115 - DNA, 4995 bp, Saccharomyces cerevisiae
atggatatttctaaaccggttggttctgaaatcacatccgttgatttcgggatcctaacagctaaagagattagaaatctatcagcaaagcaaattaccaatcctacggttttagataacttaggtcatccagtatcaggcggtttatatgacttagccttaggtgcattcttaaggaatctgtgttctacttgtggtttggatgaaaaattctgtccaggtcaccaaggtcacattgaattacctgtcccttgttataatccattgttctttaaccagctatatatttatttgagggcatcatgtttattctgtcatcatttccgtttaaagtcagtagaggttcatcgttacgcatgtaaattgagattgttacaatacggtttgatagacgaatcttacaaactagatgaaataactttgggctctcttaatagcagtatgtacactgacgacgaagctattgaagataatgaggatgaaatggatggtgaaggaagcaagcaatcaaaggatatttcctccactctcttaaatgaactgaaaagtaagcgttcagaatatgttgacatggccatcgctaaagctttgtcagacggcagaactactgagagaggctctttcacagctactgtaaatgatgaacgaaagaaattggtccatgagtttcacaaaaaactattatctagaggtaagtgtgataactgtggtatgttttcgccaaaatttagaaaggatggttttacaaaaatcttcgaaactgcgttgaatgaaaaacaaattacaaataacagagtaaaaggtttcattcgtcaagatatgattaagaagcaaaaacaggctaagaaattggacggttctaacgaagcatctgcaaatgacgaagaaagttttgacgttggtagaaatcctaccaccagaccaaaaaccggctcaacatatattttatctactgaagtgaagaatattctggacactgttttcaggaaggagcaatgtgttttacaatatgtttttcattcgagacccaatttatcaagaaaattggtcaaggctgactctttttttatggatgttcttgttgtgccaccaactagattccgtttgccttccaagcttggtgaagaagttcatgaaaactctcaaaaccaattgttgtccaaggttcttactacgtcattattaattagggacttaaatgatgatttatctaagctacaaaaggacaaagtttctttggaagatagaagggtgatcttcagtaggttaatgaatgcctttgttactattcaaaatgacgtcaatgcttttatcgactctaccaaagcacaaggtagaaccagtggtaaggttccaattcctggtgttaaacaagcactggaaaagaaagaaggtttattcagaaaacatatgatgggtaagcgtgttaactatgccgctcgttctgttatttctccagacccaaatatcgaaactaatgaaattggtgtcccacctgtttttgctgttaaattgacttatccagaaccagtaacggcttataacatagcagagttgcgtcaagctgttattaatggccctgataaatggccaggtgccactcaaatacagaacgaagatggttctttggtctctttgatcggtatgtctgtagagcaacgtaaggcattagctaaccaactattgacaccatcttcaaacgtttctactcatactttgaataaaaaggtttaccgtcacatcaagaacagagatgttgttttaatgaaccgtcaaccgaccttacataaagcctccatgatgggtcacaaagttagggtgttaccaaacgaaaagactttgagattacattatgctaatacaggtgcttataatgcagatttcgatggtgatgaaatgaacatgcattttccacaaaacgaaaatgctagagcagaagcactaaacttagctaatactgattctcaatacttgacaccaacttctggttctccagttagaggtttgattcaagatcatatttctgcgggtgtttggctaacaagtaaggacagttttttcaccagagaacaataccagcaatatatttacggttgcatccgtcctgaggatggtcataccacaagatcgaagatcgttaccttacctccaactatcttcaagccatatccattatggacaggtaaacaaatcatcacaacagttttgttgaatgtcacccctccagatatgcctggtatcaatttaatttctaaaaataagattaaaaacgaatattggggcaagggatctctggaaaacgaagttctcttcaaagacggcgcattgctatgtggtattttagataagtcacaatacggtgcctctaagtatggtattgttcattcattgcatgaagtttatggcccagaagtcgctgctaaagtcttatccgtcttaggtagactatttaccaactatatcactgccacggcattcacttgtggtatggacgatttacgtctaacagcagaaggtaataaatggaggactgacatcttgaagacgtctgttgatacaggtcgtgaagccgctgcagaagttactaatttagataaagacacgccagcagatgacccagagttattaaagaggctacaagaaatactgcgtgataataataagtcaggtattcttgacgctgttacatcctccaaggtcaatgctattacttctcaagtcgtctccaaatgtgttccagatggtactatgaaaaagtttccatgcaattctatgcaagctatggcactttctggtgctaaaggttctaacgttaatgtttctcaaattatgtgtttgttgggtcaacaagctttagaaggtagaagagtgccggtaatggttagtggtaaaactctgccttctttcaaaccttatgaaacagatgccatggctggtggttatgttaagggtcgtttctactctggtataaagccacaggagtattacttccattgtatggctggtcgtgaaggtttaattgatacggccgttaaaacatctagatccggttatttgcaacgttgtctaacaaaacaattagaaggtgttcacgtatcatacgataacagtataagagatgcagatggtacgttagtgcaattcatgtatggtggtgatgccatcgatataaccaaagaatcacacatgactcaattcgagttctgtttagacaattactacgcattattgaagaaatacaacccatcagcactgattgaacatttggatgttgaatcagctttgaagtactctaaaaagactttgaaatacagaaagaagcatagcaaggagcctcattacaaacagtctgtaaaatatgatcctgttttagctaagtataatcctgccaaatacctgggttccgtttctgagaacttccaagataaactagaatctttcttagacaagaactctaaattgttcaaatcatcggatggtgttaacgaaaagaagttcagggccttgatgcaattgaagtatatgcgttctctaattaatccaggtgaagctgttggtattattgcttcacaatctgtcggtgaaccctcaacacagatgacattgaataccttccactttgctggtcacggtgccgctaatgtgacactaggtattcctcgtttaagagaaattgttatgactgcctctgctgccattaaaactccgcaaatgactttgcctatctggaatgatgtttctgatgagcaagctgacactttctgtaagtctatctcaaaagtcctattatccgaagtgatagataaagtgatagtcactgaaactaccggtacttcaaataccgctggtggaaatgcagctcgttcgtatgttatccatatgagattcttcgacaataatgaatacagtgaagaatacgatgtttctaaagaagaattacaaaacgtcatatctaatcaattcatacacttgctagaagctgctattgtaaaagaaatcaaaaaacaaaagagaactacaggaccagacattggtgttgcagtaccaaggctacagacagatgttgcaaatagttcttcgaactctaaaaggttggaagaggataatgatgaagaacaaagtcataagaaaactaaacaagcggtttcgtatgacgagccagatgaagatgaaattgaaactatgagagaagctgaaaagtcttctgacgaagaaggtatcgattccgataaagaaagtgattctgactctgaggacgaagacgttgacatgaatgaacaaattaataagagtattgtggaagctaacaataatatgaacaaagtgcagcgtgatcgtcaatcagcgattatttctcatcatagattcatcaccaaatacaatttcgatgatgaatctggtaaatggtgtgaatttaagctagaattagcagcagacacagaaaagttgttgatggttaatattgttgaagaaatctgtaggaagtctatcattagacagattcctcatattgaccgttgtgttcatccagaacctgaaaacggaaaacgtgtccttgtcacagaaggtgttaatttccaagctatgtgggatcaagaggcatttatcgacgttgatggtattacatctaatgatgttgctgctgtgttgaaaacgtacggtgtagaagctgctagaaatactattgtgaatgaaattaataacgtcttctctcgttatgctatttctgtttctttccgtcatttagaccttattgctgacatgatgaccaggcaaggtacttacttagcctttaacagacagggtatggaaacatccacttcatctttcatgaagatgtcctatgaaactacatgtcaattcttgaccaaggctgttctagataatgagcgtgaacaattggacagtccttccgctagaattgtggtgggtaaattgaacaatgttggtacgggttcatttgatgtgttagcaaaggttccaaatgcggcttag

SEQ ID NO: 46116 - DNA, 960 bp, Saccharomyces cerevisiae
atgactattctagaggagcttaatgattcaagcattcctcagaggctagataatcacatatttttcggctccgtacattcactgacgcatacagatttcctagtagaaaataacattaggtttttcataaacgttgatttatcgactgaactaatatcacatatctatcatgaggtccgctcaaagtttgcccatgaaatagtaattgtcaacatcgacaatgactctcaaataccaatagaaagcgatttggtgcgttccttccattggcacaacacttcccttttgcaacaattgatccatcatctcgattttctcagcggtattaataatcacggcgaaccattaactccaccaccagaatctcattacagaaatgcgtatgttcaattcgaccatccaagtgactcagtatcgatattagataaacttttatatggtaataagtcagaatactcgcgtacaaatattttccaagttaccaacgaagcgaagtttcaagtcttcaacgacctaattacaattttcaaatactctatcgctcaaggcgggaataccaatagtaacatacttgttctctcagaaaacggcagcaccgatgaaaatttgataagtttactgatgtctaccgtattgaaagaaaacccaactttcaacgtttaccaggccctccaattcgttaagtctattgcagtaattcctgatacggtaagagatgaaaaaatcttatgggtcacaggatttatcaactatcaagaattaatcaagaaaaatgaaatgtattggggcctaggttcgcaaaagggtcgcaaacttacgtcctttgcgtccccaatatcgaaagtggaaagaaaacaaagaagacgtgacgaccagaatatcatgcgatcaaagctaccacaacagagacaaaaccccttctgctcaacagagagacctaaaagggctcgctgcgattag

SEQ ID NO: 46117 - DNA, 1521 bp, Saccharomyces cerevisiae
atgccagagtccagattgcagagactagctaatttgaaaataggaactccgcagcagctcagacgcacctccataataggtaccattgggcccaagacaaatagctgcgaggccattactgctctgagaaaagctggtttgaacatcattcgattgaacttttcccatggctcctacgaattccatcaatcagtaatcgaaaatgctgtgaaatcggaacagcaattccctggcaggccgctcgccattgccctggataccaagggtcccgagatcagaacaggtcgcacgttaaatgaccaagatctttatatccccgtagaccaccaaatgatctttaccactgacgcaagttttgcaaacacctccaatgataaaatcatgtatatagactatgctaacctgacaaaagttatcgttccggggagatttatatacgtggacgacgggattctctcttttaaagtgctccaaatcattgacgaatctaatttaagggtgcaagcggtaaactcgggttatatcgcatctcataaaggtgttaatctgcctaataccgacgttgatttgccccccttgtccgccaaagacatgaaggacttgcaattcggagtccgcaatggcattcacatcgtatttgcctctttcataagaacttcagaagatgtgttgtctatcagaaaagcgttgggttctgaagggcaagatatcaagattatatccaagatagaaaaccagcaagggttggataattttgacgaaatcctggaagtcacggatggtgttatgatagcgagaggcgatttaggaattgaaatcctggcacctgaagtattagccattcaaaaaaagctgattgcaaaatgtaatttggcgggcaaacctgtcatttgcgcgactcagatgctggattcaatgacacacaatccgagaccgacaagggctgaagtatcggatgtgggtaacgctgtgttggatggtgctgattgtgttatgctttctggagaaacggcgaagggtgattatccggtgaatgcagttaatattatggcggcgaccgctctgattgctgaaagtactatcgctcatttggctctttatgacgatctcagagacgccactcccaaacctacttccactacggaaactgtagcagctgcagctaccgcagcaatcttggagcaagatggtaaggccatcgttgtattatctactacagggaacacggcaaggctactgtcgaagtatagaccaagctgccctatcatattagtaacaagacacgcaagaacggcaagaattgcgcatttgtatagaggtgttttcccatttctgtatgaaccgaaacgcctagacgactggggtgaggatgttcataggcgcctaaagtttggtgttgaaatggcgaggtctttcggaatggtggacaacggtgatactgttgtttccattcaaggattcaaaggaggagtcggccattccaataccttacgcatttctactgttggtcaagaattctag

SEQ ID NO: 46118 - DNA, 1884 bp, Saccharomyces cerevisiae
atggtaaatatactgcccttccacaagaacaatagacacagcgcgggagtcgtcacctgcgcggacgatgttagcggcgacggtagcggcggcgacaccaagaaggaggaggatgttgtccaggtaacggaatcaccatcgtccgggtcgcgcaataatcatcgcagcgacaatgaaaaagatgacgccatccgtatggagaaaatatctaagaaccagtccgcgtcgtccaacggcaccatccgcgaggatttgattatggacgtggacttggagaaatcgccctccgtcgatggcgatagcgagccgcacaaactaaaacaaggtttgcagtcgcgccatgtgcaactgatcgcgctgggcggcgccatcggtaccggtttgctggtggggacttcatccacgcttcatacgtgcggtcccgcggggctgttcatatcgtacattattatttccgcggtgatctacccgatcatgtgcgcgctgggcgaaatggtgtgctttttgcccggtgatggttctgacagtgccgggtcgacggccaatctggtcactaggtacgttgacccttcgttgggcttcgccactgggtggaattacttctactgctacgtcattttagtggccgccgagtgtacggcggcatccggtgtggtcgaatactggaccaccgcggttcccaagggcgtttggatcacgatctttctatgcgtggttgttatactaaacttttccgcggtcaaagtgtacggcgaatccgagttttggttcgcgtctatcaagatattatgcattgtgggactgatcattctgtcctttattttgttttggggtggtggccccaaccatgaccgtcttggcttcagatactggcaacatccgggcgcttttgcgcatcacctcacgggcggatcgctgggtaacttcacagatatctacactgggattatcaagggcgccttcgccttcattcttggtccggaactggtgtgcatgacttccgcggaatgcgcggaccagcgtagaaatatcgctaaggcttcgcgccgctttgtatggagactgatcttcttctacgttctggggacgctggccatctccgttattgttccatacaatgacccaacattggtaaatgcgctggcgcagggcaaaccgggagccggctcgtcaccctttgtgatcggaattcaaaacgccgggattaaggttcttccccacattatcaatgggtgtatcttgaccagcgcgtggtctgccgccaatgcgtttatgtttgcgagcacgagatcactgttgaccatggcgcaaacgggacaggcacccaaatgtttgggcagaatcaacaaatggggtgttccatacgtggctgtgggtgtttccttcttgtgttcttgtttggcatatctgaacgtgtcttcatccacggcagacgtgtttaattggttttccaatatcagcaccatttccgggtttctgggctggatgtgcggctgcatcgcgtacctgagattccgcaaggctattttctacaatggcctctacgacagattgcctttcaagacgtggggacagccttacaccgtgtggttctctctcattgttataggcatcatcaccattaccaacgggtatgccattttcatccctaagtactggagagtagcagatttcattgctgcctacatcaccctacccatcttcctggttttgtggttcggccataagctgtatactcggacgtggagacaatggtggctccctgtgtccgagatcgatgttactacagggttagtcgagatcgaggagaaatcaagagaaattgaggagatgagattaccccccaccggtttcaaagacaagttcttggacgccttgttgtaa

SEQ ID NO: 46119 - DNA, 1494 bp, Saccharomyces cerevisiae
atgagaccgttgtatagctgcaaccttgcaaccaaagatgatattgagatggcaggtggcgtagctcctgctcacctggaagttaatgtaggcggctataatacagagcagacaatacctatagtaaagcatcagctcgtgaaagttgggagaaatgataaggaatgtcaactcgttctaacgaatccctctatctcctctgttcattgcgtgttttggtgtgtcttttttgatgaggatagtattccaatgttctacgttaaagattgttctcttaatggaacgtatttgaacggtttgcttttgaaaagggacaaaacgtatcttttaaaacattgcgacgttattgaattatcgcagggaagtgaagaaaatgacattaaaaaaacacgactagtttttatgattaatgatgatttacaatcttctctggacccaaaacttttagatcaaatgggttttctgagggaagtagaccaatgggaaataacaaatagaatagtgggtaatggcactttcggtcatgttctgatcacgcataactcaaaagaacgtgatgaagatgtctgttatcaccctgaaaattatgctgtgaagatcattaaactaaaaccaaataaattcgataaagaggctcgaatccttttgagactggatcacccaaatattatcaaagtctaccatactttctgtgacaggaacaatcacctttacatattccaggatcttatccctggtggtgatttgttttcttacctagctaaaggcgactgtctaacttccatgtcagaaactgaatcgctattgatcgtctttcaaattttgcaagctttaaactaccttcatgatcaagacattgttcaccgcgatttgaaactagacaatattttgttatgtacgccagaaccgtgcactagaatcgtcttggcagactttggtatagctaaagatttaaattccaacaaagaaagaatgcatactgtcgtaggcactccggaatactgcgctccagaagttggattcagagcaaacagaaaagcatatcaaagcttctcaagagcagctacgttagagcaacgaggttatgacagtaaatgtgatctttggtctttgggtgtcattacacacattatgttaacagggatctcgcctttttatggagatggttctgagaggagtattattcaaaatgcaaaaattgggaagctgaatttcaaactgaagcagtgggatattgtttcagataatgccaagagttttgtcaaagaccttttgcaaactgacgtagttaaacgattaaatagtaagcaaggtctcaaacatatttggattgcaaaacacttaagtcaattagagagattatattacaaaaagatattgtgcaataacgaaggccctaaactagaaagtataaattcagactggaaaaggaagttacccaaaagtgttatcatttctcaggcaataccgaaaaagaagaaggttttggagtaa

SEQ ID NO: 46120 - DNA, 867 bp, Saccharomyces cerevisiae
atgacatcaattggtactggttacgatctttccaatagtgttttttcccccgatggtagaaatttccaagtagagtatgccgtcaaagcagtcgaaaacggtaccacatcaatcggtataaagtgtaacgacggtgtagtctttgcagtggaaaagctcattacgtctaaactgctggtcccacaaaaaaatgtcaagattcaagtcgtagaccgtcacatcggttgcgtttattcaggtttgattcctgatggtaggcacctggttaatcgtggtcgtgaagaagccgccagcttcaaaaagctgtataaaacgcccattcccattcctgcatttgcagaccgtttaggacaatatgtgcaggcgcacactttatacaacagtgttagaccgttcggggtcagtaccatctttggtggtgtagataaaaatggtgctcatctttacatgttggaaccaagtggctcttattggggctacaagggggctgccactgggaaaggtaggcaatctgcgaaggctgaattggaaaaattagttgaccatcatccagaaggtctttcagcaagagaggccgttaaacaagctgcaaagattatctatttggcacacgaggataacaaggaaaaggattttgaattggaaataagttggtgttcactgtcggaaacgaatggtctgcacaagttcgttaagggcgatctgctacaggaagctatcgattttgcccaaaaagaaattaacggcgatgatgacgaggacgaagatgacagtgataacgtcatgtccagtgatgatgaaaatgctccagtggctacgaatgcaaacgctaccactgaccaagagggtgatattcacctagaatag

SEQ ID NO: 46121 - DNA, 2991 bp, Saccharomyces cerevisiae
atgtactttacagacgaatcatcaccggcaatgaatagagtaggtaaaaaaaggaatagactttcttttgtttgccaagcttgtagaaaagcaaagacgaagtgtgaccaggaaaaacctagatgtggcagatgtactaaacaaaacctcttttgtatatatgatgtcgccagacaggcggcccctaggaatccgaataaggatgccaccatagcgagactgaaaaaggagattcgttactggagaaataaaaccgtggatttgactcaagaaaagaaagacttctacactgcattgaaaaggccgactgaagaattagctgctagaaggacatgtaaaagcttgcaggaaaatagctttccaataagtctttataagactcatcccagattgattatgaccaaagtgatgaaaagagaaatcaaccctttatctgagaagtacttaatatttcaagatacctttctgaagacattaattgcctccgtgcttctaagttgttccagaaactccatgattcctgctttaaatgcagatattagtaggtcgaggacacagccatgcgtaaagaataacgttgtaaaaatgagagaggttctattgaaaaactcaaaatacgaatcacaaagaaaatccattaacgagtttacggacaggctactacagagaaagaaccctgaagaacagattgcggtaaataaagtaatttctttattatacagtaacagggaatcgtcatatttagaggatacatgccccaccgaaaacgactattctgatttgttgaaaggctacatcaatgaaatcgagaaaacgctccctcccaaggcaatcattgaacagtacctctctcatttctttgagcatattttccacctaatccctttcgccagcaaggaaatgttggaggaatcaattcacacaacagtacagtataatgaattaggagaggtacgactatcgatgggcacaacccttatacgaaataaaatggagaatctgtgtatcttactgttaattttgaggatcgcgtatatctctttgacatttatagaagataagattgaagattacagtccgtatattaccaaagagatgctagagcaatatccgattcaaagcgaagtaattttcctagcgcagcagatacttgcatcggaaaattggtgtgcttgtgcaaatgaaaataccatttcatgcttactctatatctggtgtgcatttgttttttccccaactgagggtgattttctgttagaacaaccgtcggatgttataattaaccttgtcatactaatagggacgtctatcggattacatcgtgacccatctgactttccagccttgaaccaccccgaagcttcagacaaaaggctgctaaatttacgaaggatacagtggctatcaattatctctatggcaactctggagtcaagcctgaagggtagactattggtctcacccctttcaatgattgatcttttcattgacgttcgggatcccaattgtgtagaaatctataaaaaaagggttaagaaggatctaacaggttccgaatcggatgagcaactgctcgaaatccatgagatttttttccatagggctcaattagcattattcttgtctgatttgaataatataaccatttcatacagtggttcggttccaatggatacactagaaactttacgcgttaaagccaatgaacttttaaaaaacaaatttcagctaagaagtgtggatattaacatctacgacgaagagaagacatttcaaaaactaacgttcaattcaattttgaattctataagtttatcgggccagatcttgggtaaattaatgatgttaagggcctcaatagcgctgatgttatattttgaaacacttgcaatggagagaagcgaatgcttatccttcttctataagtatttttttcaatgttgtgccgacaccatttccctaatcagattttttttcctgtatttcaatggcagttacgagaaagttctttcttctttagtttgtttcatcactacaaaagttattcaattggctgttcctaccacgatgtttacccttttggtcatcatcatgcgggtagagctggccaaaaatatgcttctggtcaaatgtaacgaatgcaatgccagaggtgacattagtgacctcccagaaataaaggagaaaataaagtcattggacactatcaaggagaacttcgagaggcttttgttggaagtatatttacttgcgtcccaaaacctgagatttaaatatttctacattttcaagatgttgaccttgtttgacgtattcattcaaaggctgaggaaaggtcaattattttctggtttgtttgtcaaagtagacaaagacttgactaccaaaaaaattgccacaatgttggagttgacacttggaattaacttggacaagtctgaccatttaattgatagactaaagggcaaaaatctcactgttaactttacccttgatcaattataccaaatcatcaaagaatttgacagaataaaaaacatcggtgttgctgacccacaaaattctctgaatccatcaaaaccaaacatgaaagataatacacccacaattgaacttttactcaactccagcgtggaaaatgagagtgtaccaccgtacagcagctcaaatgaccctacaaatgttggtaatgcctccacttatagcttagcacacaatattagtaaccaaaataatgaggaaaacatgcctccgtcaattggttcgagtgaaagtaaccgtgccgctcctaatctaaactttatgccgataaacaataactacaataacagtggttcgaacattaataacaatgacaatgttaagttaccgagtaattttaaaaactactatgaccctcccatgtcttctttggacatatccatggatgttcccgatatttttggtagccttgatttcttcgattatgacctacttttccagaacgactag

SEQ ID NO: 46122 - DNA, 2112 bp, Saccharomyces cerevisiae
atgcttcccattaaagtcttctctttatctcggatttttgttttgctagcaatcttccgacaaatacacgctatttccattaacagctctactttccaggtttctaactcttttacactactgaacaacgcatcgactctattcccagtaccatttgatgcatatactaaagaatatctaaggacttcggctctgttgacttgtgctaaagactcacagttttctgcatcgtatttcgaagctgcttttttcccgagaaataatactctattctttaatgttgaagcacaaacaattatgagcgaaaacataaccatcaaggcagaattgattgcatatggtctcaatgtttataccaaagtttttgatctatgtggaatccaagataatttattatgtccgttgaagccgggaaatatagaactcatgggaagttattatgttgaggccgcggtagctagccaaataccaagcataacatataatatacctgacttagacgcatatattgtggtgacagcatactccactattgataaagaatttaccaaacctctagcatgtgtacaagtgatgttatcaaatggtagaacagtccaaacagagtatttatcgtggaatctagtgatattgacaatttccggaattatgttttcagtggtttattctttgcaaggttatacggttacttcaacaagactggcgtcttattcaatatcgctacttttatatttccaaaatttggctattttagctatgattagtgtatcatttttaccgcctattgtcgccgcttggactcaaaatttccaatggtcaatgggaataataaggataaattttatgcagcggttatttgactggtatgttgtcgcaacatctgggtcccccaccgttgtataccgcaataaagaagttttatcgatcagtgttcaaaaaagatccttgaacagtaaaatcatatcagcgtcaagtaatttaaatggtattgaaagttcccaaaaaaatgatttattatacacttcaaatttgagaaattcaaatgactatctgtcaaaaattttagtattaagaggtattaaaagggtgtcttacaaagctggaattgagatatcaaatttctttttaacgggattttccttctttatcatattcatttgtatgataatattggcgtttattatcttcaaaacatttttgaaagtacttcagaagtttaaagttaagacaattagatatttacacttccacacacattggagtgcacttttacaggggacactatatcgagcggtgttcataatttattctgagatatctcttttagcactttgggagttcactcaaacagactcagcagctaccttagtggaggcaatcgttgttttcattttgattacagtcttgttatcatccgcaagcgtaagaatatggaggaagatgatcaagtctaagaaaatatttggccagccaagctatttactcttcagtagctcgaaattcttaaacaagttcggctttctttcctctcaatttaagtctacaaaagtctggtggttaatggcgacctctgcacacatgcttattaggtctatactagtgggttctctacaagcgcacggaaaatctcaatctattggtatctttttgaatgaagctatctatctcatccttttgtgctggatgcaaccttacatggataaaacaaccaacttcttcaatattagtatccattcactgaatttagtgaacgcattttttttcttatttttcagtaacttatttcagcagcccatagctgtgtcttcttttatgggactaattttcttttttctaaatgcagcgttttctttgtatctcttcattttcatattgatatgctttacgatggcaatatactacaaacaccctgatacaagatacaaacctattgatgatcaaagacgatcctttttgaagggtgaaatggatgatgatgcggtttacgaatcggtcccggaactgcacgaaatgaagaaagccgttcttgaatgcaacggtattcaaaagccgcagatcaataagattgacctttgtaaacaaaattcgaactgtgaatatctgtatatgtga

SEQ ID NO: 46123 - DNA, 603 bp, Saccharomyces cerevisiae
atgagttacgataagaaggcagatgtcacatccttagatgaagatttgagacaactaagagaaagcaaattttcaccggaagcaattcaaaatatcaaaatatgggtatataaatctgtcctaaaagagatagctcctcctggagacttattggaatgcttgaaagatggaacagtcctatgtaagctggcaaatattttatatgaagcagacacaggagaagctaaccatattagttggaagagctctaaaatgccatttgttcaaatggatcaaatttcccaatttttatcattttcgagaaaatatggtgtgcctgaagatgaactgtttcagacaattgatctttttgagaaaaaggatcctgccattgttttccaaacgttgaagtcactatctcgttacgccaacaaaaaacatacagatagatttccagttctaggaccacaactgtcaacaaagaagccaagacccccggttaagtctaaaccaaaacatctacaagatggtactggatggagcacttttgaatacggttatatgaaaggtgcatctcaggctactgaaggagtggtgttaggacaacggagagatatagtttag

SEQ ID NO: 46124 - DNA, 2694 bp, Saccharomyces cerevisiae
atgcctcaagcaagcacattcggatcgcacagtctagaagctcatcccttacacattcagccagctgttcatatcaaactcagtaaagaggaaaggtctcactacagggagcaatacgattcattaaagtatatttcaaattatgtttctgttttcgaccaagcgttaagcgacaatattgactctaggattagaaaagaaaatgaagccttactgaaaaaatattatgaatcaagaaaaccttttacttttaccagctttaggcaaggaagtgtaatcagttcttctgattcttctacaggcttcactgagagaacaaagacctactgttttttgaacgatttcgtcagtaattgcgtaaatgaggtagatccatatacgctgaaaatgacagtaagaaatagaaacactgccttgaatatggagaacctcgatgatgaacgtaagagcaaagatgatatatacgattttgaagataatactgacgacgagtgtaatgccaagtgccatggtgctttccattattcgtcagaaagattggaaattcttcgctcacgttcgacaatatcgtactttaagtattataaaaagcttttgacggtagacctaagggacagtgatgttttaaaaaggcataatttatggatgccaatgatcactagaagatttagatttttattagtatcaagttcgaaaccggaagatgtaaggttaacaacgccgattccaacattctcggaatcagatttagacattttcaagaacaagacatgtccactctttatcaatggtacagactgtgttcctagaagttatgacactttttcgggttcttctgtaatcgcttcaatattttcagaatataaacttccatccctttcatatcattgttctgtcgagttgaacgaccaattatttattgtcggtggtttgatggcatgtcatagatatgatgaggaagcgcctgatctaaaggatttttacgtggatggcataaagaatttaccgccaccactaataccagagctaattaataacccatccatgattcctaatcctcacttgtactgtttttccttgacttcttccagactaacaagacctgatatttctggttacattccgcccccactggtgtgcacccagggctgtaaattaactgaaaggcatatctttttgtatggcgggtttgaaatcaagtcggaaacccaagttgatgataagggaagatattttataagaaaaagagcttttttgaacaatactggttacattctagatacagtgacgttcaatttctcaaagattgaattagtcgctcctccgtaccagtttgcaatttacaataatttctcgccaagatttggtcacatgcaggcatcaataagtaattccaacaacaatgtatccaatgaaaataccacaacaagtgcgaaaggaagaaggtcgataagcccatatcgccaaggtaatggggatcacaaaatagatgatttggttggttcaccaggaagtacggactatttagaggatgatgcaattccacctgtaacaaacccaaggtctacagatagtctctcttccaaacattgtagcacagcaacacacatttgctcatctgttaataccattctgatctttggagggtatagtcagactggtgacgacaagtatgaagctatgaatgacatgtggaagataaatatccctgtagtttctcgtgggaaacgtaattattataaatttgcagatactgtaactgctactaagatccctattattgatgatccagaattatggccgagcagaagagccttttcagcgtgctgtgtaccagattattttaccaaggatgttgaacccatagaaacgagattactgaggaacttgaaaaatgacttctccatcgatttggaaatacgcccaggaaataagccttctcaaccactttttccgaatatcccacattcaaggaaggagaagaagagtggtcgcgatagtatgcatatttccaattctaataatagtactagtgaagacacttcttcaaagtctaccaggaataccacatccagtcctcccacaagccctaaacatacaccaccattgaatccatcaaaaaaatgtgcatcaatcggaagaactattgcgttccacggaggttcagatggctatgacgtttgcagcgatatgtggtggtttgacttcgattccgaaacctggactaaaatagacctttatgccaaaacacaagaggaatctgatggtttggtacctatcaacttatgtatggtaggacactcaatgacaactgtaggccacaaggttgtgcttatcgggggtctacgacaaggtgatgttgaccgaatataccgggacgaaactcttcctgaagaagtaatatcgggtgttccactcggaagtggcgttataaatgtcgtggatttaaatacacaatgccttcaaggttgcaagctaatacgaaatgatggagatactaaagaatctgtcattatggatcctcatgtcggcacaccccaccaagtattggccgtcgcaggtactatagaactggtcaaaggaaccatgaccttaataggaggtgtagtagccggtcgcgaagacatttcgagcctttacttgagaggagctgtcttacaattcattctaccaagcatgaatctagccaactaa

SEQ ID NO: 46125 - DNA, 1560 bp, Saccharomyces cerevisiae
atgttcagtagatctacgctctgcttaaagacgtctgcatcctccattgggagacttcaattgagatatttctcacaccttcctatgacagtgcctatcaagctgcccaatgggttggaatatgagcaaccaacggggttgttcatcaacaacaagtttgttccttctaaacagaacaagaccttcgaagtcattaacccttccacggaagaagaaatatgtcatatttatgaaggtagagaggacgatgtggaagaggccgtgcaggccgccgaccgtgccttctctaatgggtcttggaacggtatcgaccctattgacaggggtaaggctttgtacaggttagccgaattaattgaacaggacaaggatgtcattgcttccatcgagactttggataacggtaaagctatctcttcctcgagaggagatgttgatttagtcatcaactatttgaaatcttctgctggctttgctgataaaattgatggtagaatgattgatactggtagaacccatttttcttacactaagagacagcctttgggtgtttgtgggcagattattccttggaatttcccactgttgatgtgggcctggaagattgcccctgctttggtcaccggtaacaccgtcgtgttgaagactgccgaatccaccccattgtccgctttgtatgtgtctaaatacatcccacaggcgggtattccacctggtgtgatcaacattgtatccgggtttggtaagattgtgggtgaggccattacaaaccatccaaaaatcaaaaaggttgccttcacagggtccacggctacgggtagacacatttaccagtccgcagccgcaggcttgaaaaaagtgactttggagctgggtggtaaatcaccaaacattgtcttcgcggacgccgagttgaaaaaagccgtgcaaaacattatccttggtatctactacaattctggtgaggtctgttgtgcgggttcaagggtgtatgttgaagaatctatttacgacaaattcattgaagagttcaaagccgcttctgaatccatcaaggtgggcgacccattcgatgaatctactttccaaggtgcacaaacctctcaaatgcaactaaacaaaatcttgaaatacgttgacattggtaagaatgaaggtgctactttgattaccggtggtgaaagattaggtagcaagggttacttcattaagccaactgtctttggtgacgttaaggaagacatgagaattgtcaaagaggaaatctttggccctgttgtcactgtaaccaaattcaaatctgccgacgaagtcattaacatggcgaacgattctgaatacgggttggctgctggtattcacacctctaatattaataccgccttaaaagtggctgatagagttaatgcgggtacggtctggataaacacttataacgatttccaccacgcagttcctttcggtgggttcaatgcatctggtttgggcagggaaatgtctgttgatgctttacaaaactacttgcaagttaaagcggtccgtgccaaattggacgagtaa

SEQ ID NO: 46126 - DNA, 1365 bp, Saccharomyces cerevisiae
atgtcagagccagaatttcaacaagcttacgaagaagttgtctcctctttggaagactctactcttttcgaacaacacccagaatacagaaaggttttgccaattgtttctgttccagaaagaatcatacaattcagagtcacctgggaaaatgacaagggtgaacaagaagttgctcaaggttacagagtgcaatataactccgccaagggtccatacaagggtggtctacgtttccatccttccgtgaacttgtctatcttgaaattcttgggtttcgaacaaatcttcaagaactccttgaccggcctagacatgggtggtggtaaaggtggtctatgtgtggacttgaagggaagatctaataacgaaatcagaagaatctgttatgctttcatgagagaattgagcagacacattggtcaagacactgacgtgccagctggtgatatcggtgttggtggtcgtgaaattggttacctgttcggtgcttacagatcatacaagaactcctgggaaggtgtcttaaccggtaagggtttgaactggggtggttctttgatcagaccagaagccactggttacggtttagtttactatactcaagctatgatcgactatgccacaaacggtaaggaatctttcgaaggtaagcgcgtcaccatctctggtagtggtaacgttgctcaatacgctgccttgaaggttattgagctaggtggtactgtcgtttccctatctgactccaagggttgtatcatctctgaaactggtatcacctccgaacaagtcgctgatatttccagtgctaaggtcaacttcaagtccttggaacaaatcgtcaacgaatactctactttctccgaaaacaaagtgcaatacattgctggtgctcgtccatggacccacgtccaaaaggtcgacattgctttgccatgtgccacccaaaatgaagtcagcggtgaagaagccaaggccttggttgctcaaggtgtcaagtttattgccgaaggttccaacatgggttccactccagaagctattgccgtctttgaaactgctcgttccaccgccactggaccaagcgaagctgtttggtacggtccaccaaaggctgctaacttgggtggtgttgctgtttctggtttagaaatggcacaaaactctcaaagaatcacatggactagcgaaagagttgaccaagagttgaagagaattatgatcaactgtttcaatgaatgtatcgactatgccaagaagtacactaaggacggtaaggtcttgccatctttggtcaaaggtgctaatatcgcaagtttcatcaaggtctctgatgctatgtttgaccaaggtgatgtattttaa

SEQ ID NO: 46127 - DNA, 1314 bp, Saccharomyces cerevisiae
atgtccatcacgaaggtacatgctagaacggtgtatgattctcgcggcaatccgactgttgaggttgaaattacaacagagaatggtctcttcagagcgatcgtcccatctggtgcctccaccggcattcacgaagctgttgaacttagagacgggaacaagtccgaatggatgggaaaaggggtgaccaaggcagtcagtaacgtcaatagtatcatagggcctgctttaatcaagtccgaattatgtgtaaccaatcagaagggcatagacgagctcatgatatcgttagacggaacttctaacaagtcaaggttgggcgccaatgctatccttggtgtttccttgtgcgttgctcgagctgctgccgcacaaaagggaattactctctacaagtatatagccgagttagcggatgctagacaggacccctttgttattcctgttccttttttcaatgttttgaatggtggagcccacgccggtggctctttagctatgcaagaattcaagatcgcgccagtcggggctcagagctttgcagaagccatgaggatgggttcggaagtttaccatcatttgaagatattggcgaaggagcaatatggaccttccgctggaaatgttggtgacgagggtggagttgcccccgatattgacactgccgaagacgccttggacatgattgtggaagccattaacatatgcggttacgagggtagagtgaaagtaggaatcgatagtgctccttctgttttttataaggacgggaaatacgacctaaatttcaaggaaccgaactctgacccatctcactggctcagtccagcccagttagcagaatattaccattcattgctaaagaaatacccaatcatttccctggaagatccctacgccgaagatgattggtcctcgtggtctgccttcctaaagactgtcaatgttcagattattgcagatgacctgacatgcaccaacaagaccaggatcgcccgtgctatagaggagaaatgtgcgaatactctgttgctgaaactcaaccagatcggtactctgactgagtctattgaagccgccaatcaggctttcgatgctggatggggtgtaatgatatcgcatagatcaggtgaaaccgaagatccgtttatcgctgatttggtcgttggtttaagatgtggtcaaattaaatcgggcgctttgtcgagatcagaaagactggccaagtataatgaacttttgcgtatcgaagaggaactgggggacgattgtatatatgctggtcataggtttcatgatggaaacaaactataa

SEQ ID NO: 46128 - DNA, 1314 bp, Saccharomyces cerevisiae; identical to SEQ ID NO: 46127

SEQ ID NO: 46129 - DNA, 1764 bp, Saccharomyces cerevisiae
atggatatactcaagaggggaaatgaatcggacaagtttacgaaaatagagacagaatctactacgataccaaatgactcggatagatctggttcactgatcagaagaatgaaggattccttcaagcaaagtaacctgcatgtcattccagaagaccttgaaaacagcgaacagacagagcaggaaaaaatccaatggaaactagcttctcagccctatcaaaaagtcttgagccaaaggcacttgaccatgattgccataggtggtactttggggacgggactgttcattggtttaggttattctttggcatctgggccagccgctttgctaatcggttttttgttagttggtacttcaatgttctgtgtcgttcagagtgccgcagagctttcctgccaattcccggtttctggctcatatgccacacatgtcagtaggttcatagatgaatcggttggctttactgtggctacaaactatgctttggcttggctgatttcttttccaagcgaattaattggttgtgcacttactatttcatactggaaccaaacggttaatccggctgtttgggtggccattttttatgttttcattatggtactgaacttgtttggtgtgagaggctttgccgagactgagtttgctctgtcaatcattaaggttattgctatatttattttcatcattattggtatcgtccttattgccggaggggggcctaactctactggttatattggcgccaaatactggcacgacccaggtgccttcgcaaaacctgtcttcaagaatttgtgtaacacattcgtttctgctgctttttcctttggtggtagtgagttagtgctgttaactagtacagaatctaaaaatatttcagctatatcacgtgctgccaaaggtacgttctggagaatcgcgattttttacattactaccgttgtcattattggatgtctcgtaccttataacgaccccagactgctcagtggttcgaacagtgaggatgtatctgcctctccctttgttattgctttgagtaatacaggatcaatgggtgcaaaagtttccaactttatgaatgtcgttatccttgttgcggttgtgtcagtttgcaattcttgcgtttatgcttcttcaagactaattcaagctttaggtgcatctggccaacttccttcggtatgttcctacatggacagaaagggtaggcctttggttggcattgggattagtggtgcatttggtcttttaggttttcttgtggcctcgaaaaaggaggacgaggtcttcacttggcttttcgccctttgttccatttcatcattcttcacctggttctgtatttgtatgtcacaaattagatttaggatggctttgaaagctcaaggaagatccaatgacgaaatagcttacaaatccatactgggtgtttatggtggaattttggggtgtgtgctaaatgcattgctaattgcgggtgaaatatacgtatcggccgccccggtcggtagccctagctccgctgaagccttctttgaatactgtttaagtattccaatcatgattgttgtttattttgcacataggttttatcgaagagattggaaacacttctacatcaagaggagtgagatcgatctggatactgggtgttccgtggagaatctagagcttttcaaagcacaaaaagaagctgaggaacaactcattgcttctaagccattctattacaaaatctacagattttggtgttag

SEQ ID NO: 46130 - DNA, 978 bp, Saccharomyces cerevisiae
atggcacgtcttcctctaaagcagttcttagcggataaccccaaaaaagttcttgttcttgacggtggtcaaggaacagaactggaaaacagaggtatcaaagttgcaaatcccgtgtggtctactattccatttattagcgaatcattttggtctgatgagtcatctgctaacagaaaaattgtcaaagaaatgttcaacgatttcttgaatgctggcgcagaaatattgatgactacaacataccaaacgagttataaatcagtttctgaaaacaccccaatcagaactttatccgagtacaataaccttttaaacaggattgtcgatttttctcgtaattgtattggcgaagacaaatatttgattggctgtattggcccatggggtgctcatatttgtcgtgagtttacaggcgactatggtgctgagccagaaaatattgatttctaccaatacttcaagcctcagttggagaatttcaataaaaatgacaaattggatttgattgggtttgaaaccattcctaacatccatgaactgaaagctatcttatcttgggatgagagtatcctgtctagacccttctatatcgggttgtctgtgcatgagcacggtgtcttgagagacggcactaccatggaagaaatcgcacaagttattaaggacttgggcgacaaaataaatcctaacttctcgttcttaggaatcaactgcgtcagcttcaaccaatcacccgacattcttgagtctctacatcaagcactaccaaatatggccttgcttgcttatccaaacagtggtgaagtttatgatactgaaaagaagatatggttgccaaatagcgataagctgaacagttgggatacggttgttaaacagtacattagcagcggtgcccgtatcattggtggttgttgcagaacaagtccaaaagacatccaagagatttctgcagccgtcaagaaatacacgtaa

SEQ ID NO: 46131 - DNA, 2463 bp, Saccharomyces cerevisiae
atgaaaacttacgtacttttatacgggaaactaataatgactacaatgatattgaatactggccgcttcgaagagtggtataaagtttgtatcattgcattaaaagaaaaagaaatatatgtcccatcatcgccaatcgcaatgttgaatggtcgtttaccacttttgcggctgggcatatgcagaaacatgctgtcccgtccccgactggctaaactgccatctataaggtttcggtctttggtcaccccttcttcatcgcagctcattcctctcagtcggttgtgtttaaggtcacctgcagttggaaaatcactaattttacaaagttttagatgtaattcatccaaaacagttccagaaacttctctgccttcagcctctcccatatctaaaggatcagcaaggtcggcacatgcaaaggagcaatctaaaactgatgactataaagatataataaggttatttatgttggcgaaacgggattggaaactgcttcttacagccatacttcttttaaccatatcatgttccataggcatgtctattcctaaagtcataggtattgtccttgacacacttaagacgtcatctggatcagatttttttgatttgaagataccgattttttctttgcctttatatgagtttctttccttttttactgttgctttactgattggttgtgctgctaattttggtagatttatattattgaggatactaagtgagcgtgttgttgcacgcctaagggcaaatgtcattaaaaaaacgcttcatcaagacgcagaattcttcgacaaccataaagttggggatttaatttctcgtttaggatctgatgcttatgttgtttcaagatcaatgacccagaaggtctcggatggggtcaaagccctaatttgtggggttgttggcgtggggatgatgtgttctttgtcacctcaactatcaatattgttactattcttcactccacctgttctttttagtgcctcagtgttcgggaagcaaattagaaacacctctaaagaccttcaagaagctactggtcaattgactagagtcgctgaagaacaactctctggtatcaagacggttcagtcgtttgttgctgaaggtaatgaattgtctaggtataacgttgcaattagagatatttttcaggtgggaaaaactgcggcatttacaaacgcaaagttttttactacaactagtctcttaggtgacctaagttttttaaccgtccttgcgtatggctcctatcttgttttacaatcacagctctccattggtgatctgactgcatttatgctgtacacagaatatacggggaatgcggtattcggcctttctaccttctattcggaaattatgcagggtgctggggccgcttccaggttgtttgaattaacagataggaaaccttccatttcaccgactgtgggacacaagtataaaccagatcgtggtgttatcgaatttaaagatgtttcatttagctaccctacaaggccttctgttcaaatattcaagaatttaaattttaaaattgcgccaggatcgagtgtttgtattgtgggcccttcaggtcgtggtaaatctacaattgcactcttactgctaagatattataatcccactactgggactattacgatagataaccaagatatctctaaattgaattgtaaatccctaagaaggcatattggtatcgttcagcaagagccggtactgatgtcaggtactattagggataatatcacttatgggttgacatataccccaacaaaggaagaaatcaggtcagtagcaaagcagtgcttttgccataactttatcacaaaatttccgaacacatacgatacggtaattggtcctcacggcaccttactaagtggaggacaaaagcagcgtattgcgattgcaagggctctaatcaaaaagccaactattttgattcttgatgaagctacatcagctttagatgttgaaagtgaaggagccattaactatacgtttggtcaactaatgaaatcaaaatcgatgactattgttagcatcgcgcacaggctaagtacgatcagaagatcagagaatgttattgtccttggccatgatggatcagtggtagaaatgggcaaattcaaagaattgtatgcgaatccaacaagtgctttatcgcaattacttaatgagaaagcggctcctgggccatctgaccaacaactgcaaatagagaaggtcatcgaaaaggaagatttgaatgagagtaaggagcatgatgaccagaaaaaggacgataatgacgataatgataataatcatgataacgacagcaataaccagtctccagagacgaaagacaataattcagatgatattgaaaaatctgtcgaacatctcctgaaagacgcggcaaaggaggctaatccaattaagatcacaccacaaccgtga

SEQ ID NO: 46132 - DNA, 1935 bp, Saccharomyces cerevisiae
atggataatgatggacccagatctatgaccattggggatgacttccaagagaacttttgtgaacgtttagaaagaattcacaatacattacattcaataaacgattgcaactcattgaatgagagtaccacaagtatatcagagacattgttagttcaattttatgatgatttggagaacgttgcctcggtaattcccgacttagtcaacaagaaaagactgggaaaagacgatattttgttgtttatggactggttattattgaaaaaatatatgctatatcaatttattagtgacgttcataatattgaggaaggttttgctcatttgttggatttactagaggatgaattctcgaaggacgatcaggatagcgacaaatacaatcgatttagcccgatgtttgacgtcatagaagaatctacacaaattaagactcagttggagccatggcttactaacttgaaggaattattggatacgtcattggaatttaacgaaatttcaaaggatcatatggatacattacataaaatcattaatagcaatatatcgtattgtctggaaattcaggaagaaaggttcgcgtccccgatacggcatactccatcatttaccctagaacaactagtcaagttattaggaacgcatacggagacaactgagccaaaggtaccaaaattttctccggcagaagatattttatcaagaaagttcttgaacctaaaaaaaaatatccctccaattgaaaaaagtttgactgatatcctacctcaaagaattgtgcaatttgggcaccggaatataacaaacataactactttgcaaacaatcttgcaaaaaaaatacgagctgataatgaaagattatagatttatgaattcagagtttagggaattgaaagtcgaactaatcgacaaacgttggaatatactctttattaatttaaatcatgaactattatacattcttgatgagatagaaaggttgcagtcgaaattactgacaacaaagtataccaaagatatcactataaggctcgagaggcaattggagagaaaatcaaaaactgtttctaagacattcaatattatttacagagcattggaattctcacttttggacgctggcgtcgcatcgaagacaaatgaattagctcaaagatggctgaatatcaagcctacagcggataaaattctaatcaaatcctccgcttcaaacaaaatagctactagcaagaagaagattccaaaaccgaaatcattaggctttgggcgaccgaatagtgttattggaactataacccaggatttccaggagagagtcgccattaatgaaggtgacagtaataaaacaccggaaaattcaactacagtggctttgaaaggtaaaaagcttggtaaagcgttactgcagaagatgaatattaaacctgcaacaagcccaaattcatcaaatgcgattaatccattttttgatccggagtcgccaaacaaaggaaaactgatactaagtagtgttcctcccttaccttatgacgaaaccgatgaaaccaccctccgtgtttctcgtggggaaaatgaaaagtcaccagactccttcattacatctcggcatgaaaataaagtacagattacagaaactcctttgatggcaaagaataagtctgtgcttgacatcgaaaaagataaatggaatcattaccggtccttgccctctaggatccctatatacaaggataaagtggtgaaagtcaccgtagaaaacacaccgatagcaaaggttttccagactccgccaacaaaaatcacgacacctaatagtcaagtttgggtcccttcgacaagaagaagaacccgattgaggcctcccacccccttatcacagttactttcaccaagagaagggcgtttagataaaaccccaacttattga

SEQ ID NO: 46133 - DNA, 2610 bp, Saccharomyces cerevisiae
atgactgaaagtgctatagatgaccaaaggtttaatcttacaaaggagttacaacgacactcatgcagagatcaagggaaaataacacaaaaggatgatgctttagattttataagttacagttcttttcaatcctcttttaatactgaccaaaaaagcgcgaacaatggaagtactgtgagaagaagcataaggtcgatttttagaagagcagccgaattgcctagagtccatatggggcctcttacttattcacatgggataaatgagcttgttaacaagaaattaagaaaagactgtgatctcagcacgctatgtcgcgtattgcaaagaggaatcaggatgattaggatgacaagaagaagaaggaagttctatgaatttaaattaatcaataacaacgggcaaataatatggaaagatggttcgaagtatctggaattagactccgttaaagacatcagaatcggtgatacggcgagtacttatcaagaggaagtagatccgaaaagattgagatcggacagtaaactttggattgctattatttataaggtttccaacaaattgaaagcgttacacgtagttgctttgaatgaattggactttaacacattcttaagctgcatttgcggtttagtgaagttaaggagggaattaatggaaagcatacttttgcctgataattcgcaattcgctaggatacattggcaaattactgtttctgaaaaagaggaagatgagaaaaaggacacattgagctttgcagatgtgaagaaactatgtgataaatttcatatttatgtgtcaactggtcaattgttagagtttttccaattagcagacatcaatcataacggactattaaattattttgaatttgaaaagttcattaaaatcttaaagaataggaaagaggtaaatatgatttggtctaaatttacaaaacctccacactcccacttatcatttgaaaatttttttcaatttttaattacagagcagcatgagcaagtggatcgtcaaactgcatggtcatattttattaagtacagagaaccgactcagctgacgatggggcaagatggttttaccaagttcttgaaggagcaaccatatttggtggaggttaaagaggagttatattcaaagccattaaaccattattttattgcatcttcacataatacttatttattggggaaacaaattgcagaaactccatctgtggagggatatattcaagtcctacaacaaggttgtaggtgcgtagaaattgatatatgggatggtgaaaatgggccagtggtatgccatggatttttaacgtcagctattcccttaaaaacagttatacgcgtgataaagaagtacgcttttataacgtctccgtatcctttgattatttcactggaaataaactgtaacaaggataatcaaaaattggcaagcctgataatgagagaggttttagcagaacagctgtactttgttggcacaagaactgataaactgccatcaccaagggaattaaaacataaaatactgttgaaatccaagaagacgagtgaagcaactagaggtcttagcgttaatgagccatttccatcttcttttagttcttcttacgaatcagctaatgaacaggaattaagaatgaaagatgactccacgaacagtagtagcgcaacaaattcttctagtatgcaacgcatcaaaagaattggattaaaaaagcacgctgatataattaatgatgtttctaacatttctggaatacatggcatcaagttcaggaatttctctttaccagagtccaaaacgatagcgcattgtttttcactgaatgagcgcaaagtagaatacatgataaaagacaaacacttaaaattatcgttggataaacataatagaagatatttgatgagagtctatcctcacgttttacgatacaaatcatcaaattttaacccaatacctttttggaaggccggtgtacaaatggtggctacgaattggcaaactaatgatattggacagcaacttaatctggcaatgtttcaaatattagatcaccaacctgatggaagttttaaatcaggatacgtgctaaaaccaaaaaagttgctacctgtagtaacaaaggcgaaaatgattccattaatttacgaacattttgaaaatggtagtgatcctgttactgttaaaattcgaattttatctacacagttattgcccagattgaatgatacatcgccaagcagaaataacaccaattcctttgttaaagtggagtttcataccgatgacgagccgacaatgcccatctcaatcgataagggtacaaggatttctgccactgaagcatccactaagagttctcaagggaatggattcaacccaatatgggatgctgaagtttctatcacattgaaagatacagacctcacatttataaaattcatggttatctctgaagagacccagattgcatctgtttgccttaagctgaactatttgaggatgggatatcgtcacattccgttgtttaacatggagggggaacaatacatattttgcactttatttattcatacacaaattttatag

SEQ ID NO: 46134 - DNA, 1827 bp, Saccharomyces cerevisiae
atgaagatgcctctaaagaagatgtttaccagcacgtctcctcgtaactcttcttctcttgacagtgatcatgacgcttactattcgaaacaaaatcctgacaatttccctgtaaaggagcaagaaatctataacattgacctggaagaaaacaatgtgtcctctcgttcatccacctctacatcaccttcagcaagggacgactctttcgcagttccagatggtaaagacgaaaacacgcggttgaggaaagatttaaaggcaagacatatttctatgatcgccattggtggttcattaggtacaggtctgcttataggtacaggtaccgccttattgacgggtggtccggttgcgatgttaattgcatatgcctttgtcggccttttagtcttttacaccatggcctgtcttggtgaaatggcttcttacattccattggatggttttacaagttatgcctcacgttacgtggatcctgcattaggttttgctattggttatacttaccttttcaaatatttcatcttacctcccaaccaacttactgctgctgctttggtcattcaatattggatcagcagagaccgtgttaaccctggtgtgtggattactatattcttggttgttattgtcgctatcaatgtcgtcggtgtaaaattctttggtgaatttgaattttggttgtccagtttcaaagtcatggtaatgttgggtctaatcctgttactatttattattatgcttggtggaggtcctaaccatgaccgcctagggtttagatactggcgtgatcctggtgcgttcaaagaatattcgacggctatcactggtggtaaaggtaaatttgtttcgttcgttgctgttttcgtttacagtcttttcagttacacgggtattgaattgacaggtatcgtttgttctgaagctgagaatccaagaaaaagtgttccaaaggcaattaaattgacagtttaccgtatcattgttttttacctatgcaccgttttccttttgggtatgtgcgttgcatacaatgaccctcgtttactttccacaaaaggtaagagtatgtctgctgcggcatctccattcgtggttgccattcaaaactcaggtattgaagtcttacctcatatcttcaatgcttgtgtcttggttttcgttttcagtgcttgtaactcagatttgtacgtttcttccagaaatttatatgcgttggcaattgatggtaaagcgccaaagatcttcgctaagacaagtagatggggtgttccttacaatgctttaatactctccgtgctgttttgtggcttggcgtacatgaatgtgtcttcaggatcagcaaagattttcaactactttgttaacgttgtttctatgttcggaatcttgagttggatcaccattttaattgtttacatctacttcgataaagcctgccgtgctcaagggattgacaaatcaaaatttgcttatgtcgctcctggccaacgttatggtgcttattttgctttattcttctgcattttgattgctttaatcaaaaacttcactgttttcctaggtcataaatttgattataaaacattcatcaccgggtatattggcctgcctgtctatatcatttcttgggctggttacaaattgatatacaaaaccaaagtgataaagtctaccgacgtggatttgtacacatttaaggaaatatacgatagagaagaagaagagggaagaatgaaggaccaagaaaaggaagagcgtttaaaaagtaacggtaaaaatatggagtggttctatgaaaaatttttgggtaatatcttctag

SEQ ID NO: 46135 - DNA, 1467 bp, Saccharomyces cerevisiae
atgttgagatttaccaattgtagttgcaagactttcgtaaaatcgtcatataagcttaatataagaagaatgaactcctcgttcagaactgaaaccgatgcatttggtgagatacacgtgcctgctgataagtactggggtgcccaaactcaaagatcctttcaaaacttcaagattggtggcgctcgtgaaagaatgccattgcctttggtgcatgcatttggtgttttgaagaaatctgccgcgattgtgaatgagtctctggggggattggatcccaagatctccaaggctattcaacaggccgctgacgaagtggcttctggtaagctagacgaccactttccattggttgttttccaaacgggttccggtacccagtctaacatgaatgctaatgaagttatttccaatcgtgccattgagatcctaggaggcaagattggatctaaacaagtccatccaaacaatcattgcaaccaatctcaatcatccaatgatactttccccactgtcatgcatatcgctgccagtttgcaaattcaaaacgagttgatacctgagttgaccaatttaaagaacgcccttgaagccaaatccaaggaatttgaccatattgtgaagatcggtagaacacacttgcaagatgccacgcctttgacactaggtcaagagttttccggttacgtgcaacaagttgagaacggtatccaaagagtggcacattctttgaaaacattgagtttcctggcacaaggtggtactgccgttggtacagggttgaacaccaagcccggattcgatgtcaagatagccgagcaaatttccaaagaaactggactaaagtttcaaaccgcccctaataagttcgaggctttggctgctcacgacgccattgtcgaatgtagcggtgctctaaacacccttgcttgttctcttttcaaaatagcgcaagatataagatacttagggtccgggccacgttgcggctaccatgaactaatgctgccagagaatgaaccaggttcctcaatcatgcctggtaaagttaacccaacccaaaacgaggcattgactcaagtgtgtgtgcaagtcatgggtaacaatgcagctatcacgtttgccggctctcaaggtcaattcgagttaaatgtcttcaagccagtcatgatcgccaatctattgaattcgatcaggttaattactgatgccgcatattcatttagagtgcactgtgttgaaggtatcaaagccaatgagcctcgtattcatgagttgttgactaaatctttaatgttagtcaccgctttgaaccctaagatcggttatgatgccgcttccaaggtcgccaagaatgctcataagaagggcattaccttgaaggaaagtgcattggaattgggtgtattgactgaaaaggaatttgatgaatgggttgttcctgaacacatgctaggtcctaaataa

SEQ ID NO: 46136 - DNA, 1638 bp, Saccharomyces cerevisiae
atggctagtgctgaaccaagaccccgtatgggactcgtcatcaatgctaaaccggactactatccgattgagctatctaatgcagaattactttctcacttcgaaatgctgcaagaataccaccaagaaatctccaccaatgttattgctcaatcatgtaagttcaaacctaatccaaaactaatagaccagcagcctgaaatgaaccccgtggaaacaaggtccaacattatcacttttttgttcgagctgtctgtggtcactcgagtgacaaatggtattttttttcattcagttagattatatgaccgctattgttccaagagaatcgtgttacgggaccaagccaaattggttgtcgctacttgtctctggttggctgctaaaacttggggcggttgtaatcacatcatcaataatgtagtcatccctactggcggaagattttatggtcccaacccaagggcacgtatacctcgactctctgaactagttcattactgtggtgatggtcaggtctttgatgaatcaatgtttttacaaatggaaagacatatactagacactttaaattggaacatttatgaaccaatgatcaatgattacgttttaaatgttgatgaaaattgtttgatgcaatacgaactttatgaaaatcaagttacttatgacaaacaatgctctgaaaaacgtcagtctcaattatcccaggatagtgatgccactgtagacgagaggccctaccaaaacgaagaagaagaagaagaagacttaaaactaaagatcaagttgattaatttgaaaaaattcttgattgatgtatccgcgtggcagtacgacttacttagatatgaacttttcgaagtatcgcacggcatattctccattatcaatcaattcaccaatcaagaccacggtccttttttaatgactccaatgacatcagaaagcaaaaatggtgaaattttgagtaccttaatgaacggcattgtttccattcctaactccttgatggaagtgtataaaacggtcaatggtgttctacccttcattaatcaagtgaaagaatatcacttggatctacaaagaaaactgcaaattgcatccaacttgaacatttcgagaaagcttaccatatcaaccccatcatgctctttcgaaaattcaaatagcacatccattccttcgcccgcttcctcatctcaaagccacactccaatgagaaacatgagctcactctctgataacagcgttttcagccggaatatggaacaatcatcaccaatcactccaagtatgtaccaatttggtcagcagcagtcaaacagtatatgtggtagcaccgttagtgtgaatagtctggtgaatacaaataacaaacaaaggatctacgaacaaatcacgggtcctaacagcaataacgcaaccaatgattatattgatttgctaaacctaaatgagtctaacaaggaaaaccaaaatcccgcaacggcgcattacctcaatgggggcccacccaagacaagcttcattaaccatggaatgttcccctcgccaactgggaccataaatagcggtaaatctagcagtgcctcatctttaatttcttttggtatgggcaatacccaagtaatatag

SEQ ID NO: 46137 - DNA, 1944 bp, Saccharomyces cerevisiae
atggcgtcacagcaaaacaaacacgcttttctttcaaagaatagaatctttcacaatcccgataatgtgtcctcatcaaaatctcgaaaccttatggatatcacaaacacgacaaacaccatgaatggctctagaccttcgtctatgaagagttcattggctcttccacccgtaaaggattccttcccatctgtatctcgatctgcatcattaaacatcaacatgagcaaaattaaggacttaaaagaccgccaagacaaaataaggttccaaagacatactctcaggactcaattgattgagtgcgaaagagaaatcaaaaccatcaagtttcgagatctcaataagtccaggtttgaactttataagaaaaaatccaaacaagcaaagtatctcaaacaggttagagatttgacgcaaaatctgaactccaaggacggtgaacgcgctgatttaattaagaagaacaaatccgctttggcaaccttgcaggctgaactcgaccagaatctgatcttgaaaaggcaggaatctcaagaattgtacaataataagcttatcttttgggaaaatgagctgcaaataatggaaaatgtcgagcctgaccacgaaatcacagaggaaatatctcagttgaagaaaacgctgcaagagctcaacataaattgggcgaatttacagaagcaaaacttggaaagacaagtaaaccacgaatcacaattgaggaaggattttattgcattcaaagaagctaagttaaaatccatggaaaatttgacaaacaaacatcgtgaattacttgatcagatagccactctacaatcggaaagtgagaagttacacaaggagatcatggatatagatagacaagctgaatattcggaacaaaacatctcagaaataaatgaaaatataaaacaattggaattggcaaacaacccactaataagcaaatccttacaaaactcgcaagatttggaacatttacaaaaccaaatggaaaatttgaaagaaatggcctctaaacaggaaaaattttataatgatacctataacactgtggaaaaagaactcctgcggagtaggagacttgaaaactctattattgaacaaaaaggcacgatgcgctgttacgcttacgtgatggagcaaaatttgcctgagaaccttttatttgattacgaaaatggcgtaataacccaaggtctaagcgaacatgtttacaaatttaatagggtgataccgcatttaaaagtttctgaagataaatttttcactcaagagtatagcgtttaccatgatatgtgcctgaaccaaaaaaaaaatttcaacttaatatctctaagcaccactccacatggctcattgagagagtctctaataaaatttttggccgaaaaggatacaatatatcaaaaacaatatgtgatcaccttacagtttgtatttttatcagatgacgaattttctcaggacatgctcttggattattcccacaatgataaagatagcataaagttgaaatttgaaaaacactcaatttctttggattccaaacttgtcatcatagaaaatggactcgaagatttgcccttaaattttagttgtgatgaacacccaaatttacctcattctgggatgggtataatcaaggtgcagttttttcctcgagattcaaaaagcgatggcaacaatgaccccgtaccggtggacttttattttatcgagttaaataatctgaagtccattgaacagtttgataaaagcatctttaagaaggaatcatgcgagacccctattgcacttgttctgaaaaaactaatttctgatactaaatcctttttcttgctaaacttgaacgattcaaaaaatgtcaataaattattaacgatttcagaagaagttcaaacacaactttgtaaaagaaagaaaaagctcacttaa

SEQ ID NO: 46138 - DNA, 2646 bp, Saccharomyces cerevisiae
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattatttgtacaagataatgtgaataaagatgccgtcacagatagattggcttcagtggagactgatatgcctctaacattgagacagcatagaataagtgcgacatcatcatcggaagagagtagtaacaaaggtcaaagacagttgactgtatcgattgactcggcagctcatcatgataactccacaattccgttggattttatgcccagggatgctcttcatggatttgattggtctgaagaggatgacatgtcggatggcttgcccttcctgaaaacggaccccaacaataatgggttctttggcgacggttctctcttatgtattcttcgatctattggctttaaaccggaaaattacacgaactctaacgttaacaggctcccgaccatgattacggatagatacacgttggcttctagatccacaacatcccgtttacttcaaagttatctcaataattttcacccctactgccctatcgtgcactcaccgacgctaatgatgttgtataataaccagattgaaatcgcgtcgaaggatcaatggcaaatcctttttaactgcatattagccattggagcctggtgtatagagggggaatctactgatatagatgttttttactatcaaaatgctaaatctcatttgacgagcaaggtcttcgagtcaggttccataattttggtgacagccctacatcttctgtcgcgatatacacagtggaggcagaaaacaaatactagctataattttcacagcttttccataagaatggccatatcattgggcttgaatagggacctcccctcgtccttcagtgatagcagcattctggaacaaagacgccgaatttggtggtctgtctactcttgggagatccaattgtccctgctttatggtcgatccatccagctttctcagaatacaatctccttcccttcttctgtcgacgatgtgcagcgtaccacaacaggtcccaccatatatcatggcatcattgaaacagcaaggctcttacaagttttcacaaaaatctatgaactagacaaaacagtaactgcagaaaaaagtcctatatgtgcaaaaaaatgcttgatgatttgtaatgagattgaggaggtttcgagacaggcaccaaagtttttacaaatggatatttccaccaccgctctaaccaatttgttgaaggaacacccttggctatcctttacaagattcgaactgaagtggaaacagttgtctcttatcatttatgtattaagagattttttcactaattttacccagaaaaagtcacaactagaacaggatcaaaatgatcatcaaagttatgaagttaaacgatgctccatcatgttaagcgatgcagcacaaagaactgttatgtctgtaagtagctatatggacaatcataatgtcaccccatattttgcctggaattgttcttattacttgttcaatgcagtcctagtacccataaagactctactctcaaactcaaaatcgaatgctgagaataacgagaccgcacaattattacaacaaattaacactgttctgatgctattaaaaaaactggccacttttaaaatccagacttgtgaaaaatacattcaagtactggaagaggtatgtgcgccgtttctgttatcacagtgtgcaatcccattaccgcatatcagttataacaatagtaatggtagcgccattaaaaatattgtcggttctgcaactatcgcccaataccctactcttccggaggaaaatgtcaacaatatcagtgttaaatatgtttctcctggctcagtagggccttcacctgtgccattgaaatcaggagcaagtttcagtgatctagtcaagctgttatctaaccgtccaccctctcgtaactctccagtgacaataccaagaagcacaccttcgcatcgctcagtcacgccttttctagggcaacagcaacagctgcaatcattagtgccactgaccccgtctgctttgtttggtggcgccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtaa

SEQ ID NO: 46139 - DNA, 2130 bp, Saccharomyces cerevisiae
atggctagtgaaacttttgaatttcaagctgaaattactcagttgatgagtttgatcatcaacaccgtctattctaacaaggaaattttcttgagagaactgatatctaatgcctcggatgcgttggataaaattagatacaaatctttgtctgatccaaagcaattggaaacagaaccagatctctttattagaatcactccaaagccagagcaaaaagttttggaaatcagagattctggtattggtatgaccaaggctgaattgattaataacttgggtaccattgccaagtctggtaccaaagccttcatggaagctctatctgctggtgccgatgtatccatgattggtcaattcggtgttggtttttactctttattcttagttgccgacagagttcaggttatttcaaagagcaacgacgacgaacaatacatctgggaatccaacgctggtggttctttcactgttactctagacgaagttaatgaaagaattggtaggggtaccatcttgaggttattcttgaaagatgaccaattggagtacttggaagaaaagagaataaaggaagttatcaagagacattctgagttcgtggcctacccaatccaattagtcgtcaccaaggaagttgaaaaggaagttccaattccagaagaagaaaagaaagacgaggaaaagaaggatgaggaaaagaaggatgaagacgacaagaaaccaaaattggaagaagtcgatgaagaagaggaaaagaagccaaagacgaaaaaagttaaagaagaagttcaagagatagaagaactaaacaagactaagcctttgtggactagaaacccatctgatatcactcaagaagaatacaatgctttctataagtctatttcaaacgactgggaagacccattgtacgttaagcatttctccgttgaaggtcaattggaatttagagctatcttattcattccaaagagagcaccattcgacttgtttgagagtaaaaagaagaagaataatatcaagttgtacgttcgtcgtgttttcatcactgatgaagctgaagacttgattccagagtggttatctttcgtcaagggtgttgttgactctgaggatttaccattgaatttgtccagagaaatgttacaacaaaataagatcatgaaggttattagaaagaacattgtcaaaaagttgattgaagccttcaacgaaattgctgaagactctgaacaatttgaaaagttctactcggctttctccaaaaatatcaagttgggtgtacatgaagatacccaaaacagggctgctttggctaagttgttacgttacaactctaccaagtccgtagatgagttgacttccttaactgattacgttaccagaatgccagaacaccaaaagaacatctactacatcactggtgaatctctaaaggctgtcgaaaagtctccatttttggatgccttgaaggctaaaaacttcgaggttttgttcttgaccgacccaattgatgaatacgccttcactcaattgaaggaattcgaaggtaaaactttggttgacattactaaagatttcgaattggaagaaactgacgaagaaaaagctgaaagagagaaggagatcaaagaatatgaaccattgaccaaggccttgaaagaaattttgggtgaccaagtggagaaagttgttgtttcttacaaattgttggatgccccagctgctatcagaactggtcaatttggttggtctgctaacatggaaagaatcatgaaggctcaagccttgagagactcttccatgtcctcctacatgtcttccaagaagactttcgaaatttctccaaaatctccaattatcaaggaattgaaaaagagagttgacgaaggtggtgctcaagacaagactgtcaaggacttgactaagttattatatgaaactgctttgttgacttccggcttcagtttggacgaaccaacttcctttgcatcaagaattaacagattgatctctttgggtttgaacattgatgaggatgaagaaacagagactgctccagaagcatccaccgcagctccggttgaagaggttccagctgacaccgaaatggaagaggtagattag

SEQ ID NO: 46140 - DNA, 858 bp, Saccharomyces cerevisiae
atgtcctccgatttagctgctgagttaggattcgaccctgcactaaagaagaaaaagaagactaagaaggtgatcccagatgattttgatgctgccgtaaacggcaaagaaaatggttcaggagatgatttatttgccggattaaaaaagaaaaagaagaagtccaagagcgtttctgccgatgctgaagctgaaaaagagcctactgacgacatagcagaagccttgggtgaactatccttgaagaagaaaaagaaaaagacaaaggacagcagtgtagacgcgtttgagaaagaactagctaaagctggtctagataatgtggatgctgaaagcaaagaaggcactccaagtgctaattccagcattcaacaagaagttggcctaccttattcagagttattatctagatttttcaatattctaagaactaacaatccagaacttgctggtgatagaagtggtccaaagttcagaattcctcctcctgtttgtttgcgtgatggtaagaagactattttctcgaatatccaagatatcgccgaaaaattgcatagatctccggaacatttgattcaatatctcttcgcagaattaggtacgtccggttctgttgacggtcagaaaagattagtcattaagggtaagtttcaatccaaacaaatggagaatgtcttaagaagatacattttggagtatgtcacttgtaaaacttgtaagagtattaacaccgaattgaagagagaacagtcaaacagactgttctttatggtctgtaaaagttgtggttctaccagatccgtctcttctattaaaaccggtttccaagctaccgttggtaagagaaggagaatgtga

SEQ ID NO: 46141 - DNA, 495 bp, Saccharomyces cerevisiae
atgtcaacgcaactcgcaagtaacatatatgctccattgtacgctccctttttcgggttcgcaggttgtgcagctgccatggtgctttcctgtttgggagctgccattggtacagctaagtcaggtattggtatcgccggtataggtactttcaagccggaattgatcatgaagtctttgattcctgtggttatgagtggtatcttagccatttatgggcttgttgtggccgttttaattgcaggtaatttatctcctaccgaagactatactctcttcaatgggttcatgcacttgagttgtgggctctgtgtgggatttgcctgtttgagtagtggctacgccattggtatggtcggtgacgttggtgttagaaagtatatgcaccaaccaaggctttttgtcggtatcgttttgattctaattttctctgaagttttagggttatatggtatgattgtagctttgattttgaacactagaggctctgaatga

SEQ ID NO: 46142 - DNA, 5664 bp, Saccharomyces cerevisiae
atgaagccggaagttgagcaagaattagctcatattttgctaactgaattgttagcttatcaatttgcctctcctgtgagatggattgaaactcaagatgtttttttgaaggattttaacactgaaagggttgttgaaatcggtccttctccaactttggctgggatggctcaaagaaccttgaagaataaatacgaatcttacgatgctgctctgtctttacatagagaaatcttatgctattcgaaggatgccaaagagatttattataccccagatccatccgaactagctgcaaaggaagagcccgctaaggaagaagctcctgctccaactccagctgctagtgctcctgctcctgcagcagcagccccagctcccgtcgcggcagcagccccagctgcagcagctgctgagattgccgatgaacctgtcaaggcttccctattgttgcacgttttggttgctcacaagttgaagaagtcgttagattccattccaatgtccaagacaatcaaagacttggtcggtggtaaatctacagtccaaaatgaaattttgggtgatttaggtaaagaatttggtactactcctgaaaaaccagaagaaactccattagaagaattggcagaaactttccaagataccttctctggagcattgggtaagcaatcttcctcgttattatcaagattaatctcatctaagatgcctggtgggtttactattactgtcgctagaaaatacttacaaactcgctggggactaccatctggtagacaagatggtgtccttttggtagctttatctaacgagcctgctgctcgtctaggttctgaagctgatgccaaggctttcttggactccatggctcaaaaatacgcttccattgttggtgttgacttatcatcagctgctagcgctagtggtgctgccggtgcaggtgctgctgccggtgcagctatgatcgatgctggcgctctggaagaaataaccaaagaccacaaggttttggcgcgtcaacaactgcaagtattggctcgttatctaaaaatggacttggataacggtgaaagaaagttcttgaaagaaaaggacactgttgctgaacttcaagctcagttggattacttgaatgccgaattaggtgaattctttgttaacggtgttgctacttctttctctagaaaaaaggccagaaccttcgattcttcctggaactgggctaaacaatctttattatcattatactttgagataattcatggtgtcttgaaaaacgttgatagagaggttgttagtgaagctatcaatatcatgaacagatctaacgatgctttgattaaattcatggaataccatatctctaacactgatgaaacaaaaggtgaaaactatcaattggttaaaactcttggtgagcagttgattgaaaactgtaaacaagttttggatgttgatccagtttacaaagatgttgctaagcctaccggtccaaaaactgctattgacaagaacggtaacattacatactcagaagagccaagagaaaaggttaggaaattatctcaatacgtacaagaaatggcccttggtggtccaatcaccaaagaatctcaacctactattgaagaggatttgactcgtgtttacaaggcaatcagtgctcaagctgataaacaagatatttccagctccaccagggttgaatttgaaaaactatatagtgatttgatgaagttcttggaaagctccaaagaaatcgatccttctcaaacaacccaattggccggtatggatgttgaggatgctttggacaaagattccaccaaagaagttgcttctttgccaaacaaatctaccatttctaagacggtatcttcaactattccaagagaaactattccgttcttacatttgagaaagaagactcctgccggagattggaaatatgaccgccaattgtcttctcttttcttagatggtttagaaaaggctgccttcaacggtgtcaccttcaaggacaaatacgtcttgatcactggtgctggtaagggttctattggtgctgaagtcttgcaaggtttgttacaaggtggtgctaaggttgttgttaccacctctcgtttctctaagcaagttacagactactaccaatccatttacgccaaatatggtgctaagggttctactttgattgttgttccattcaaccaaggttctaagcaagacgttgaagctttgattgaatttatctacgacactgaaaagaatggtggtttaggttgggatctagatgctattattccattcgcggccattccagaacaaggtattgaattagaacatattgattctaagtctgaatttgctcatagaatcatgttgaccaatatcttaagaatgatgggttgtgtcaagaagcaaaaatctgcaagaggtattgaaacaagaccagctcaagtcattctaccaatgtctccaaaccatggtactttcggtggtgatggtatgtattcagaatccaagttgtctttggaaactttgttcaacagatggcactctgaatcctgggccaatcaattaaccgtttgcggtgctattattggttggactagaggtactggtttaatgagcgctaataacatcattgctgaaggcattgaaaagatgggtgttcgtactttctctcaaaaggaaatggctttcaacttattgggtctattgactccagaagtcgtagaattgtgccaaaaatcacctgttatggctgacttgaatggtggtttgcaatttgttcctgaattgaaggaattcactgctaaattgcgtaaagagttggttgaaacttctgaagttagaaaggcagtttccatcgaaactgctttggagcataaggttgtcaatggcaatagcgctgatgctgcatatgctcaagtcgaaattcaaccaagagctaacattcaactggacttcccagaattgaaaccatacaaacaggttaaacaaattgctcccgctgagcttgaaggtttgttggatttggaaagagttattgtagttaccggttttgctgaagtcggcccatggggttcggccagaacaagatgggaaatggaagcttttggtgaattttcgttggaaggttgcgttgaaatggcctggattatgggcttcatttcataccataacggtaatttgaagggtcgtccatacactggttgggttgattccaaaacaaaagaaccagttgatgacaaggacgttaaggccaagtatgaaacatcaatcctagaacacagtggtatcagattgatcgaaccagagttattcaatggttacaacccagaaaagaaggaaatgattcaagaagtcattgtcgaagaagacttggaaccatttgaggcttcgaaggaaactgccgaacaatttaaacaccaacatggtgacaaagtggatatcttcgaaatcccagaaacaggagagtactctgttaagttactaaagggtgccactttatacattccaaaggctttgagatttgaccgtttggttgcaggtcaaattccaactggttggaatgctaagacttatggtatctctgatgatatcatttctcaggttgacccaatcacattattcgttttggtctctgttgtggaagcatttattgcatctggtatcaccgacccatacgaaatgtacaaatacgtacatgtttctgaggttggtaactgttctggttctggtatgggtggtgtttctgccttacgtggtatgtttaaggaccgtttcaaggatgagcctgtccaaaatgatattttacaagaatcatttatcaacaccatgtccgcttgggttaatatgttgttgatttcctcatctggtccaatcaagacacctgttggtgcctgtgccacatccgtggaatctgttgacattggtgtagaaaccatcttgtctggtaaggctagaatctgtattgtcggtggttacgatgatttccaagaagaaggctcctttgagttcggtaacatgaaggccacttccaacactttggaagaatttgaacatggtcgtaccccagcggaaatgtccagacctgccaccactacccgtaacggttttatggaagctcaaggtgctggtattcaaatcatcatgcaagctgatttagctttgaagatgggtgtgccaatttacggtattgttgccatggctgctaccgccaccgataagattggtagatctgtgccagctccaggtaagggtattttaaccactgctcgtgaacaccactccagtgttaagtatgcttcaccaaacttgaacatgaagtacagaaagcgccaattggttactcgtgaagctcagattaaagattgggtagaaaacgaattggaagctttgaagttggaggccgaagaaattccaagcgaagaccaaaacgagttcttacttgaacgtaccagagaaatccacaacgaagctgaaagtcaattgagagctgcacaacaacaatggggtaacgacttctacaagagggacccacgtattgctccattgagaggagcactggctacttacggtttaactattgatgacttgggtgtcgcttcattccacggtacatccacaaaggctaatgacaagaacgaatctgccacaattaatgaaatgatgaagcatttgggtagatctgaaggtaatcccgtcattggtgttttccaaaagttcttgactggtcatccaaagggtgctgctggtgcatggatgatgaatggtgctttgcaaattctaaacagtggtattattccaggtaaccgtaacgctgataacgtggataagatcttggagcaatttgaatacgtcttgtacccatccaagactttaaagaccgacggtgtcagagccgtgtccatcacttctttcggttttggtcaaaagggtggtcaagctattgtggttcatccagactacttatacggtgctatcactgaagacagatacaacgagtatgtcgccaaggttagtgccagagagaaaagtgcctacaaattcttccataatggtatgatctacaacaagttgttcgtaagtaaagagcatgctccatacactgatgaattggaagaggatgtttacttggacccattagcccgtgtatctaaggataagaaatcaggctccttgactttcaactctaaaaacatccaaagcaaggacagttacatcaatgctaacaccattgaaactgccaagatgattgaaaacatgaccaaggagaaagtctctaacggtggcgtcggtgtagatgttgaattaatcactagcatcaacgttgaaaatgatacttttatcgagcgcaatttcaccccgcaagaaatagagtactgcagcgcgcagcctagtgtgcaaagctctttcgctgggacatggtccgccaaagaggctgttttcaagtccttaggcgtcaagtccttaggcggtggtgctgcattgaaagacatcgaaatcgtacgcgttaacaaaaacgctccagccgttgaactgcacggtaacgccaaaaaggctgccgaagaagctggtgttaccgatgtgaaggtatctatttctcacgatgacctccaagctgtcgcggtcgccgtttctactaagaaatag

SEQ ID NO: 46143 - DNA, 2382 bp, Saccharomyces cerevisiae
atgcaagtactagtgacgctctggtgtctaatatgcacatgcctggtactaccagtggccgccaagaaaaggacactgacagcgagttcactggtcacgtgcatggagaactcacagctttcagccaatagtttcgatgtgtcgttttctccagacgatcgatcgctacattacgatctggatatgaccacgcagatcgactcttacatctacgcttatgtggacgtgtatgcctacgggttcaagattattacggagaacttcgacgtgtgttcaatgggttggaagcagttttgccctgtgcacccaggtaacatacaaatcgactccattgaatacattgcccagaagtacgtgaaaatgattccgggaattgcctaccaagtgcccgatattgatgcgtacgtaagattgaacatttataacaacgtaagtgaaaatttggcttgtatccaggttttcttttccaatgggaaaactgtatcacaaattggggttaaatgggtgacagctgttatcgccggtattggtttattaacttccgctgtcttgtccaccttcgggaactccacagcagcatctcacatttctgcaaacaccatgtcactgttcttatatttccaatctgtcgctgtggtcgcaatgcaacatgtagacagtgttccacccattgctgctgcctggtctgaaaaccttgcctggtcgatgggcttgatccgtattacatttatgcagaaaatcttccgttggtatgtagaggcgactggaggctccgcatctctatatttgaccgcgacaacaatgtcagtgctcactcaacgaggtctggattaccttaaaaatacttcggtttacaagagggcggaaaatgtcttgtacggtaactcaaacactttaatctttcgaggaattaaaagaatgggataccgtatgaagattgaaaatacggccatcgtttgtactgggttcacattctttgtgctgtgcggttattttttggccgggtttatcatggcctgcaaatacagtatcgagttatgtataagatgtggttggatgcggagtgataggttttaccaatttaggaaaaactggaggtcagttctgaaaggatcgttgttaagatacatctatattgggttcacgcaactgacaattttaagtttttgggagttcactgaacgggattccgccggtgttattgttattgcatgcctattcattgtattgtcatgcgggttgatggcgtgggctgcgtacagaaccatttttttcgcaagtaaatctgtggaaatgtacaataacccagctgctttattgtatggtgatgagtacgtcttaaacaagtacgggtttttctacaccatgttcaacgcaaaacattattggtggaatgctcttttaacgacgtatattcttgtaaaagctttatttgtcggattcgcacaggcatcaggtaaaacgcaagcattggctattttcattattgacttggcgtattttgttgccatcatccgttataaaccatatttggaccgtccaacgaatattgtcaacatttttatttgcactgtcaccttggtcaactctttccttttcatgtttttctcaaacttgtttaaccaaaagtatgctgtctctgccatcatgggctgggtgtttttcattatgaatgctgcgttttctttgcttctactgttgatgattctggcctttaccacaatcattctgttttctaagaatcctgactccaggttcaagccagcaaaggatgacagagcatctttccaaaagcatgctattcctcatgaaggtgccttgaataagtcagtggccaacgaattaatggccctaggtaatgtggcaaaggatcataccgaaaattgggaatacgaactgaagagtcaagaaggtaaaagtgaagataatcttttcggagttgaatacgatgacgagaaaacaggaactaattcagagaatgctgaaagtagcagtaaggaaaccacccgtccaaccttttctgaaaaggttttacgttcattatcaatcaaaaggaataagagtaaactgggcagtttcaagcgcagcgctccggataagataacacaacaagaggtttctcctgaccgcgccagctcttcgcctaacagcaagtcataccccggtgtctcgcacaccaggcaagaatctgaagcgaataatgggctaatcaatgcatatgaagatgagcaattcagtctgatggaaccaagcatactggaagacgctgctagttccacccaaatgcatgctatgccagcccgagatttgagcttgagcagtgttgcaaacgcccaagatgttactaaaaaagcaaacatcctggatcctgattatttgtaa

SEQ ID NO: 46144 - DNA, 1479 bp, Saccharomyces cerevisiae
atggctaatgatcaagatcccaacaagtctctcattaatgacgctttgactcggagtatgtccgaattttatgatgatgatgatgataacgacagtgacatgtgtagggcaaatgatgagggagaagacgtttttgaccttccacttaaggtaggcgtttctcaaagcaggaacttttcagaagtaaatgacgtgttagacccgctttctagtttgcatggtccgtccaagaaggtgagatttgaacagcaaaagcagcaacagcaacatcagcaacttcacaatgacttcaatacagatttcaacctgaaaagcccgtccagtaaaaaaatgggggtagaacagctgatccagtcagccaatgaaatcaacgattacctcgctaacaacattgacaaggtaaatagctttaactcagagctattgagcggcagtggcaagttacctgggagagtaaagagtgacacagcaactcaaggtaccggacgcttagattccatgtccaactttgctcttagcgatacggagttggacaatgatgacgataattatctcctggatccccttgcaaatgctagctctactacacccactgtggaacaccacggttacagcttattagacaaggctttatccacgtctgataaggaaaaaatatatacgaataaagtgaattcgaatagtcagatagatactgataatcactctcacgaaagtggaaacactaccaataacgaaacagatgaaaatgagagttcggagatcctggactacacaaaatttgattctttcccctatcccccgtcttctgcccccaatggggaaccaccagatttgaaagtgctaagcattgaatgtgagcaggaaaatgaaaaagagctacgacgaatatctttattattggatcattacgaatcaataccgaaaataccagaattgtcagacgatgaagcactatctaagttccgtgagaatatcgaattaattttacaactatctaagaaaattaacgataatgcgaacactttagcgatttcctccgaagatcctcaaaaatttgttaattttgtgatgaagaacccaccttccttatcattcagagattttatcgacagaatccagaataaatgcatgtttggtgccgtagtctatcttggagccacctatctacttcaacttgtgtttcttacgagagacgaaatggacggtcccataaagttgaaggctaaattacaggaggaccaagcccataggatcatcatatctacaataagaattgccaccaagctattagaagactttgtccactcacaaaactacatttgcaaagtcttcggtatttcaaaaagactgctgaccaaactggaaatttctttcatggcgagtgttaatttcgatggattaatgattacttgtgaaaaattagaaaaaacattgcatatccttgatgatacaagacaggcattaggaaacacatga

SEQ ID NO: 46145 - DNA, 712 bp, Saccharomyces cerevisiae
atggctggttgggatatttttggttggtgtatgttatcaccctgttcacgtttttcggatacttagttttattcaatgtggtaaacattgaatgttttcagcttaagatctatttttttttttctagaagaaattgcgtcctttactaactttattttactgtacagtcagagatgtgttggcttcccttggtctgtggaacaaacatggtaaactacttttcttgggtttggataatgccggtaagaccacattgctacatatgttaaagaacgatagattggcaaccttacaaccaacatggcatccaacttctgaagaactggctattggtaacattaagtttacaactttcgatttgggtggtcatattcaagctcgtcgtttatggaaggattatttcccagaagttaatggtatcgtctttttagtcgatgctgctgaccctgaaagatttgatgaagcacgtgtcgaattagatgctttattcaacattgccgaattgaaggacgttccttttgtaattcttggtaacaagatcgatgctccaaacgccgtttctgaagcggagctacgttctgctttaggattattgaataccactggctctcaaagaattgaaggtcaaagaccagttgaagttttcatgtgttccgttgttatgagaaatggttatttagaggcgttccaatggttatctcaatatatttaa

SEQ ID NO: 46146 - DNA, 1104 bp, Saccharomyces cerevisiae
atgcaacgcaatagtttagtaaatatcaaactaaacgctaattcgccatcgaaaaagaccacaacaagaccaaatacgtccaggatcaataaaccatggagaatatcccattcgccgcagcaaagaaacccgaattcaaaaataccttcacctgtaagagaaaaattgaacagattacctgtaaacaataagaagtttttggatatggaaagctccaaaattccatcacctataaggaaagcgacttcttccaaaatgatacacgaaaataagaagctacctaaatttaaatccctatcactcgatgactttgaactggggaagaaattaggaaagggtaaattcggtaaagtttattgcgttcggcacaggagtacaggatatatttgcgcactgaaagtaatggagaaggaagaaataataaagtataatttacagaaacaattcagaagggaggtagaaatacaaacatcgctaaatcatccgaatctaactaaatcatacggctattttcatgatgaaaaaagagtgtacctgctaatggaatacttagtcaatggggaaatgtataaactattgaggttacacggacccttcaacgatattttagcatcagattatatttatcaaattgccaatgccctagattatatgcataaaaagaatattattcatagagatattaaacctgaaaatatactaatagggttcaataatgtcattaagttaacggacttcggatggagtataataaatccgccagaaaatagaaggaaaactgtctgtgggacaattgactacctttctccagaaatggtggagtcaagggaatatgatcacactatagatgcatgggctcttggcgtcctggcgtttgaactactgaccggtgcccctccgttcgaagaagaaatgaaagatactacatataaaaggatagcagcactggatatcaaaatgcccagtaacatttctcaggatgcgcaagatttaatacttaaactactaaaatacgaccccaaagatagaatgcgccttggagacgtaaaaatgcatccttggatactaagaaacaagcccttttgggaaaataagcggttatag

SEQ ID NO: 46147 - DNA, 1485 bp, Saccharomyces cerevisiae
atggacttaagagtaggaaggaaatttcgtattggcaggaagattgggagtggttcctttggtgacatttaccacggcacgaacttaattagtggtgaagaagtagccatcaagctggaatcgatcaggtccagacatcctcaattggactatgagtcccgcgtctacagatacttaagcggtggtgtgggaatcccgttcatcagatggtttggcagagagggtgaatataatgctatggtcatcgatcttctaggcccatctttggaagatttattcaactactgtcacagaaggttctcctttaagacggttatcatgctggctttgcaaatgttttgccgtattcagtatatacatggaaggtcgttcattcatagagatatcaaaccagacaactttttaatgggggtaggacgccgtggtagcaccgttcatgttattgatttcggtctatcaaagaaataccgagatttcaacacacatcgtcatattccttacagggagaacaagtccttgacaggtacagctcgttatgcaagtgtcaatacgcatcttggaatagagcaaagtagaagagatgacttagaatcactaggttatgtcttgatctatttttgtaagggttctttgccatggcagggtttgaaagcaaccaccaagaaacaaaagtatgatcgtatcatggaaaagaaattaaacgttagcgtggaaactctatgttcaggtttaccattagagtttcaagaatatatggcttactgtaagaatttgaaattcgatgagaagccagattatttgttcttggcaaggctgtttaaagatctgagtattaaactagagtatcacaacgaccacttgttcgattggacaatgttgcgttacacaaaggcgatggtggagaagcaaagggacctcctcatcgaaaaaggtgatttgaacgcaaatagcaatgcagcaagtgcaagtaacagcacagacaacaagtctgaaactttcaacaagattaaactgttagccatgaagaaattccccacccatttccactattacaagaatgaagacaaacataatccttcaccagaagagatcaaacaacaaactatcttgaataataatgcagcctcttctttaccagaggaattattgaacgcactagataaaggtatggaaaacttgagacaacagcagccgcagcagcaggtccaaagttcgcagccacaaccacagccccaacagctacagcagcaaccaaatggccaaagaccaaattattatcctgaaccgttactacagcagcaacaaagagattctcaggagcaacagcagcaagttccgatggctacaaccagggctactcagtatcccccacaaataaacagcaataattttaatactaatcaagcatctgtacctccacaaatgagatctaatccacaacagccgcctcaagataaaccagctggccagtcaatttggttgtaa

SEQ ID NO: 46148 - DNA, 1143 bp, Saccharomyces cerevisiae
atggaattcgttgcagaaagggctcagccagttggtcaaacaatccagcagcaaaatgttaatacttacgggcaaggcgtcctacaaccgcatcatgatttacagcagcgacaacaacaacaacagcagcgtcagcatcaacaactgctgacgtctcagttgccccagaaatctctcgtatccaaaggcaaatatacactacatgacttccagattatgagaacgcttggtactggatcttttggtagggttcatttggtgcgctctgttcacaatggtcggtattatgctataaaagttttaaagaaacaacaagttgtcaagatgaaacaggttgaacataccaatgacgaacgacgtatgctaaagcttgtggagcatccgtttctgattagaatgtggggtacgtttcaagatgctaggaatatctttatggtgatggattatatcgaaggtggtgaacttttctcgttactgagaaagtcacaaagatttcctaatcctgtagcaaaattttacgctgcggaagtcatactggcattagagtacttgcatgctcataatatcatctacagggatttaaagccagaaaatatcttgctggatagaaatggccacattaaaataaccgattttgggttcgccaaagaggtacaaactgtcacatggacgctttgtgggactcctgattacattgctcctgaagttattaccacaaagccatataataagtcggtggattggtggtctctaggtgttctaatctacgaaatgttagctggttatacacccttttacgatactactccaatgaagacgtatgaaaagattttacaaggtaaagtagtatatccaccatattttcatcccgacgtcgtggatctactaagcaaactgatcactgcagatttgacaagaagaatcggtaatttacaaagcggttccagggacatcaaagctcacccatggtttagtgaagttgtatgggaaagattgttagcaaaggatattgaaactccatacgagcctcctatcacatcaggtatcggtgacacgtctttattcgatcaatatcccgaggagcagctagattatggtattcaaggcgatgatccatatgctgaatactttcaagatttctaa

SEQ ID NO: 46149 - DNA, 2409 bp, Saccharomyces cerevisiae
atgtcagatgaaaaccataacagtgatgttcaagatattccttcacctgaactatccgtcgatagtaactctaacgagaatgaattgatgaataactcaagcgcagacgatggaatcgaatttgacgccccagaggaagaaagagaagccgaaagggaggaggaaaatgaagaacaacacgaactggaagatgtgaacgatgaagaggaggaagataaggaggaaaaaggagaggaaaacggggaagtaataaacacagaagaagaagaagaagaagaacatcaacaaaaaggcggaaatgatgatgacgatgatgataatgaagaggaagaagaggaagaagaggatgatgacgatgatgatgatgacgacgatgatgatgaagaagaagaagaagaagaagaagaagaaggcaacgacaacagttcggtaggctcagatagtgccgctgaagacggtgaggatgaggaagacaaaaaggataaaaccaaagataaagaggtcgaacttcgccgtgaaacattggaaaaagaacaaaaggacgtagatgaagctataaaaaaaataactcgtgaagaaaatgataatactcactttccaactaatatggaaaatgttaattacgatcttttacaaaagcaagtcaagtacattatggacagtaacatgctaaatttgcctcagtttcaacatttacctcaagaagaaaagatgtctgcgattttagcaatgttaaattcaaattctgacacagctctttccgtacctcctcatgatagtactatctcaacaacagctagcgcctcagccacaagcggcgcaagaagcaatgatcaaagaaaacctccattgtcagatgcccaaagacgtatgagatttcctagggcggatttatctaagccgattaccgaagaagaacacgaccgttatgcagcctatttgcacggtgaaaataaaatcaccgagatgcacaatattcctccgaagtcaagattattcattggtaatttgccgctaaagaacgtttctaaggaggatttatttaggattttctctccatacggtcatatcatgcaaatcaatatcaaaaatgcctttggattcattcagtttgacaaccctcaaagcgttagagatgcaattgaatgcgagtctcaagaaatgaactttggcaaaaagttgatcctggaagtttctagctcgaatgctcgtcctcaatttgatcatggtgatcacggtacaaacagtagttctacttttatttcttccgcaaaacgaccatttcaaactgaatctggtgacatgtacaatgacgacaatggtgctggctacaagaaatccagaagacacaccgtttcttgcaacattttcgttaaaagaaccgcagatcgtacgtatgccattgaggttttcaacaggtttagggacgggactggtttggaaactgatatgattttcttgaaaccaagaatggaactgggaaagcttatcaatgatgccgcatataatggggtgtggggcgttgttttagttaataaaacacacaatgtagatgttcaaactttctacaaaggctcacaaggtgaaacgaaatttgatgaatatattagcatatccgctgatgacgcagttgccatttttaataacatcaaaaacaacagaaataattctcgtcctactgattaccgtgctatgagccatcagcaaaacatatatggcgctcctcctcttcctgttccaaacggcccagctgtcggacctcctcctcaaacaaactattaccagggttacagtatgcctcctccacaacaacaacagcaacagccatatggtaattatgggatgccaccaccatcccatgaccaaggatatggttctcaacctccaattccaatgaatcagagctacggtcgctaccagacttctattccaccaccacctccacaacaacaaattcctcaagggtatggtcgttatcaggctggtccgcctcctcaaccaccttctcaaactccaatggaccagcaacaactattatctgccattcaaaaccttccacctaacgttgtatcgaatttgctttcaatggcccaacaacagcaacaacaacctcatgctcagcagcaattggttggtttaatacaatcaatgcaaggccaggctcctcaacaacagcaacaacagttgggtggatattcctctatgaactcatcctctccccctcctatgagtaccaattacaatggtcaaaatatatctgcaaaaccctctgccccaccaatgtcacaccaacctccgccacctcaacaacaacaacaacaacaacaacagcaacagcaacagcaacagcaacctgctggcaataatgttcaaagtctattagatagtttagcaaaactacaaaaatag

SEQ ID NO: 46150 - DNA, 1650 bp, Saccharomyces cerevisiae
atgagaagaagcccgtccagatcaaataataactttgcagtaccgaattgctcaactaattcaaactctagtcagcaacaattaactacaccttcagatgatctcaacagtaacgaacctaatgacccagatgatagtaggtctctacctactatcaagaaattcaataataaacattctataaacaattacaacactttagcatcggccgggaaaaacaacaacaataaacgagctagcaatgataatttgctcattcctggtgagaatgcccataaacagaaaatatacactaaggatgaaaacttgaagagcttgtacctagatatcgatgtttctgtcgctaaagccctatcctcatcagcaactgctccgaagctgatcaataccgcaagaacttcctctactaccactgccactacctcaaataatatcctgacatcaccctcttatcgtgaatcaaattattcttctccatcctcatattctttttcctcctactactcatccgctacgtctgcttcctcatcaacctcatcatttttaaaatcttcagggttatcgtccagagttaagtctccttcatcttcggttaaggcaggttcttttggtgcgccttcgtccccaacatctgggatacctaatcctaaaagtagcaagaagcctatatttttgagacggtattctcatgatacctcttcaaatgaaggtcttgatatcgatgttgcgatcgaaaaattactacaagtgggtgagtcaagagaaattacaaaaacgtccaaaaaaaagaactttccattccattcttgggaaattcaactcatttgctatcatgcaagagaaatttttttgaatcaacctactcttttgagattacaagcgcctatcaaagttgtcggtgatgttcatggacaatttaatgatttattgagaattttgaagttgtctggtgtgccatctgatactaattatctgttcttgggtgattatgtggaccgtggtaagaactcattggaaacaatactattgttattatgttacaaaataaagtacaaagacaacttttttatgttaaggggtaatcacgaatctgctaatgtcacaaagatgtacggtttctatgatgaatgcaaaaggcgattgagctcgaaagtatggaaaatgttcgttgacgtatttaatactttgccattagcagcaattattcaagataagatcttttgcgttcatggaggtatatcgcccgatttacatgacatgaagcaaatcgaaaaagtcgcaagaccaacggatattcctgaaagcgggctggttacagacttactgtggagtgacccagaccctcaagtaactgattggtcagaaaatgatcgtggtgtttcatacacattttctaagaggaacgttcttgatttttgtgctaagtttaaattcgatttaatacttaggggacatatggtcgtagaagatggttatgaattctttgccaggaaaaagtttgtcacaatcttttcagcaccaaattattgtggagaatttcataattggggggcagtaatgagcgttacaacgggtatgatgtgtagctttgaactgttaaagccgcgtgcattgaaaaataaaaagaagttatacaaaaccaaagtgtag

SEQ ID NO: 46151 - DNA, 1440 bp, Saccharomyces cerevisiae
atgtctagctcacagcatgtgttccaaatacattaaagaagatctcttttgttgttgatactaaccagtaaagttgagagttataacaatgaaaataggatgctgtgcgactttttttatccacagttaggtggagtcgaattccatatatatcatttatcgcagaaactaatcgatttgggccattctgtcgtcattataactcacgcttacaaagatcgagtcggcgtacgacatcttaccaacggtctaaaggtctatcacgtaccattttttgtgattttcagagaaaccactttccccactgttttttcaacatttccaataataaggaatattcttctcagagagcagatccaaattgttcattctcatggtagcgcttccacgttcgctcacgagggaattcttcatgctaatactatgggattgagaactgtgttcacggaccattcactctacggttttaataacttaacgtcgatttgggtgaataagttgctaacatttaccttgacaaacatagatcgggttatatgtgtttctaatacatgcaaagaaaatatgattgttagaacagaattaagtcctgatataatctcagtaattcccaacgcagtggtgagcgaagatttcaaaccaagggatcctactggtggcaccaagagaaaacaaagtagggataagatagtgatcgtggtcatcggaaggctctttccaaacaaagggtccgatttacttactcgcataattccgaaagtttgttcctcacatgaagatgtcgaatttatagtagcgggcgatggtccaaagttcatagattttcaacaaatgattgaaagtcatagactacaaaaacgtgtgcaactcttaggctctgttccacatgagaaagtcagggatgtattatgtcaaggtgacatatatttacacgctagtttaacagaagcatttggtacaattctagttgaggccgcatcttgtaatttgctaattgtaacgacacaagtcggaggaattcccgaagtgttaccaaatgagatgactgtttatgcagaacagacatccgtttctgaccttgttcaagcaacaaataaagctatcaatatcataagaagtaaagctttggacacttcctcttttcatgatagcgtgtctaaaatgtacgactggatggacgtagccaaaaggacagtagagatatatactaatatatcttctacttcttccgctgatgataaagattggatgaaaatggtagcaaatctttacaaaagagatggaatctgggctaaacatctttatctgttatgtggaattgtagagtacatgctttttttcctcttagagtggctataccccagggatgaaatcgatctagctccaaaatggcccaagaaaacagtgtctaacgagacgaaggaagcaagagaaacttaa

SEQ ID NO: 46152 - DNA, 2607 bp, Saccharomyces cerevisiae
atgcgcaatgcaggtgttcaagttgacacaaatatgcagaagataagcttacaggacacagttctagtcaacgagatgaaggggcgggtgaaattcattggggaaactcaatttgcaaaaggcatatggtacggcattgaactagataaaccgttaggaaagaatgatggaagcgctaacggtattcgttactttgatatcgacctgaagaaagctaattcaaatggtggttattatggtcttttctgcaagaaagatacgttgcagttttataaaccagatgacgatgagcatagtttgctaaatggtaatgcagcgcaagaaacaattaagaatctacaagtaaaatgtgaatcattggcgtccaaattaaataaaattaaaatagaaaatcatgagctgaaaacttccgttgaaaagctgagtactaatgaaactgttctattgtctaaaatctcaagattggataaactagtcaaagaactgaaagtggaaaatggtaatatgaaaactcatttggataatttcaatcacctattagatgcttcagatagtgtaatggcaccggatctcgacaaaggcacactgttagaaaggagccatcttcttcagggactactcgaccaaacaaagttgtcatatgataaagctatgaaggtgcaagaggacctgctcgaggagaatactcagttattagaagaaaatgcagtattatctaaaaaaatatcggatttaggtctgcaattgcaacagactaataatacaatcggcgaccttgccttgcagattgaagctcaaagtaaatcatctaatattgttgataaattgactaatgataatatcctactcacaagtaatataaaggctttaaacaatgagttggaggaactacaggcaaaagaaaaattggatgaaaatttaagaattacctatgagcaactcgagcaagaactgagactgcaattaagtaatttgcaatctgcattggaaaatgaaaaggagatagcaggcacatatatcgaagaaaattcaagattaaaagcaacattggaatctattgaagccaaaacatctcacaaatttcaaagtcttgaactaaaagtgaacactttacaggaggaattatatcaaaataaattgctaaagaaattttaccaaatatatgagccatttgcacaaccacatttggcggctctttcctctcaattgcaatatttagccgaagtaatcgaaagtgaaaattttggaaagttggagaatattgaaatccatataattctaaaagtgttgagctctatcagttatgcgcttcatatttacaccataaagaatactcccgatcacctggaaacgacattacaatgtttcaaagtaaatattgctccgatttcgatgtggctaagcgagtttttgcaaaggaagttttcttctaaacaggaaaccgccttttccatttgtcagtttttagaagataataagtttctagataaggatgtgaccttgatactaaaaatacttcatccgatattggaaacaactgttccgaagctgttggcttttcttagaacgaacagcaatttcaatgacaatgataccctatgtcttattggttccctttacgagagatcactttcacttattgccagaatagataaacttatcggaaaggaagaaatttcgaaacaagacaataggttatttttatatccttcctgtgatataaccctgtcctctatcttaacgatacttttttcagatgcactgtttttgcgacaagattacaaacgtatttcttctttgaaaaaactagaggtattttttcaaggaatagaaagtctcttagaaaacataactatatttcctgagcaacccagtcaacaaacaagtgattcagaaagtcaatgtaatattaaggagggcaatttttcaaactcgttattaagcgatcgcttgaatgaagagaacattcgactcaaagaagtactggtccaaaaggaaaatatgctaactgaattggaaacaaaaattaaaattattattgggagggatttagagaggaaaacccttgaagagaatatcaaaacactcaaagtagagttaaataacaaaaatgaggaaaattgtggcaaaacagaaattcttaacaagctgaaagaagaaaatttcaacctagtaaaccgtttgaagaatatggagctcaaactatatcaaataaaggataataatacgttgaacaaaatttatttagacagagagaaagtagatagagtaaatttagtttcggaaatcatggaattgagagaaaccataagacgacaaataaaagagcagaaacgagtgagcatcgatttcagctggttagacgagcttccagctgtggaaaataagcaaccattcaaagaacatatcaaccacagtttggacaccttggggatagaaatgttcaacttcgtgagtacctcacggattttagatttaaagcttgatcaacctttggcagaagatgaactctggcatgaaagagatcattcttacatttcgtatttaaagcgcaagaggaaaaatatacgactcaaatctcaaaatgttgttacatattacaaatga

SEQ ID NO: 46153 - DNA, 4515 bp, Saccharomyces cerevisiae
atgtcgagggagtcgaacgacacaatacagagcgatacggttagatcatcctctaaatcagactattttagaatccagctaaataatcaagactactatatgtcaaaacccacctttttggacccatcgcacggtgaaagcctgcccttaaaccagttttcacaggtcccaaacatcagggtgtttggtgctttacccacagggcatcaagtattgtgccacgtccatggcattctaccttacatgttcatcaagtatgatggacaaataactgacacgagtacattgagacaccaaagatgtgcccaagttcataaaacgctggaagtaaaaattagggcatcctttaaaaggaaaaaagatgataaacacgatttagccggcgacaaacttggaaatctcaattttgtcgctgatgtctctgttgtaaagggtataccattttatggttaccacgttggctggaatctgttttacaaaatttctttgcttaatccttcttgtctaagtaggatttcggaattgattagagatggcaagattttcggaaagaaattcgaaatttatgaatcacatattccttacttgctacaatggaccgcagattttaacttatttggatgttcatggataaacgtggataggtgttattttcgctctcctgttttaaatagtatactggacatagataagctgacaattaatgatgatcttcagttgttactagatcgattttgtgacttcaagtgtaacgtactcagtagaagggattttccacgggttggaaatggattgattgagatagatatactaccgcaattcatcaaaaatagagaaaagttacagcatagagatatacatcacgactttttggaaaaactgggagatatttctgacatacctgtcaaaccatatgtatcctctgctagggacatgataaatgaacttaccatgcaacgagaggagttgtccttgaaggaatataaagaaccaccagaaacaaagcgccatgtgagtggtcatcaatggcaatcttctggagagttcgaagcgttttataagaaagcacaacataaaacaagtacttttgatggtcaaataccaaattttgagaactttatagataagaatcaaaaattctcagccataaatacgccctatgaagcattaccgcaattgtggccaaggcttccacagattgaaataaacaataatagtatgcaagataaaaagaacgacgaccaagttaatgcatcgttcaccgaatacgagatatgtggtgttgataatgagaacgaaggtgtaaaaggaagcaatataaagtctcggtcttattcatggttaccggaaagcattgcgtctccgaaagattctactatactattagatcatcaaacaaaatatcacaatacgataaatttttcaatggattgtgctatgacgcaaaatatggcaagtaaacgaaaacttagatcatctgtttctgctaataaaacatcgttgctgtctcggaaaagaaagaaggttatggctgcgggattacgctatggaaaaagagcctttgtttatggtgagcctcctttcggttatcaagatattctgaataaattggaagacgagggattcccaaaaatagactataaggaccctttcttttcgaatccagttgatctagaaaataaaccttacgcgtacgcaggtaagaggtttgaaataagctcgacacatgtatcaacgagaatacccgtccaatttgggggagagaccgtatcagtttataacaagccaactttcgacatgttttcctcctggaaatatgcgttaaaaccacctacgtatgatgctgttcaaaaatggtacaataaagtaccctcgatgggaaacaaaaaaactgagtctcagataagcatgcacacccctcatagtaagtttttatacaaatttgctagtgacgtttctggaaaacaaaaaagaaaaaaaagtagcgttcacgattctcttactcatctgacacttgagattcatgcaaacacgagaagtgataaaattccagaccctgcaatagatgaagtttccatgattatatggtgtcttgaagaagaaactttccctttagatttggatatcgcttacgaagggattatgatagtccacaaagcttctgaggatagtacatttcctactaaaattcaacattgtattaacgaaattcccgtgatgttctatgaaagtgaatttgaaatgtttgaggctctaactgatttggtattacttcttgatcctgatattctttccggtttcgaaatacataatttttcgtggggttatataattgaaaggtgtcaaaaaatacatcaatttgacattgtcagggaacttgccagagtcaaatgccaaattaagacgaagttgtcagatacttggggatatgcccattcctcaggaattatgattaccggaagacatatgattaatatatggagagcgttgaggtccgacgtaaatttaacgcaatatactattgaaagtgctgcgttcaatatcctccataaacgattacctcacttttcatttgagtcattaactaatatgtggaacgctaaaaagagcacaaccgaattaaagactgtgttaaattattggttatcaagagctcagataaatatacaactattaagaaagcaggattacattgctcgaaatatcgaacaggcaagattgataggaatagatttccattctgtatattacagaggatcacaatttaaagttgagtcttttttaatccgaatatgcaagtccgaaagttttatccttctttctccaggcaaaaaggatgttcgtaagcaaaaagcacttgaatgtgtgcctttggttatggagccagaatctgctttctacaaaagtcctttaattgtgctggatttccaatcattgtatccatccattatgattggatacaactattgctattcgactatgataggaagagtgcgagaaataaacttaacggaaaataaccttggagtatctaagttttcattaccaagaaacattttagctttattaaaaaatgatgtaactatcgctccaaatggtgttgtttatgccaagacctctgttagaaaatcaacgttatccaaaatgttaacagatatccttgatgtcagagtgatgataaagaaaacaatgaacgaaataggtgatgacaacactaccctaaaaaggcttttgaataacaaacagttagcactaaaattattggcgaatgtcacctacggttatacatcagcttcattttctggacgaatgccatgctctgatttagctgatagcattgtacaaacaggcagagaaacattggagaaagcaatagatattattgagaaagatgaaacttggaacgccaaagttgtctatggagacacagatagtttatttgtatatctacctggaaaaactgctattgaggctttttctataggacatgctatggcagaaagagttactcaaaacaatccaaaaccaatctttttgaagtttgaaaaagtataccatccctccatattaattagcaaaaaaaggtacgtaggattttcctatgaaagtccttcgcagacccttcctatttttgatgctaagggtattgaaactgttagaagggatggtatcccagcccagcagaagattattgaaaaatgtattcgattactttttcaaaccaaagacctgtcaaaaataaaaaagtatcttcaaaatgaattttttaagattcaaataggaaaggtatctgcccaagatttttgttttgcaaaagaagttaaattaggagcgtataaaagcgaaaagacagcccctgcaggtgccgtggttgtaaaaagaagaataaatgaagaccatagagcagaaccccaatacaaggagcgtataccttaccttgttgttaaaggaaagcaaggacaactgcttcgggaaagatgcgtatcaccagaagagttcttagaaggtgagaatttagagttagattcggagtattatataaacaaaattctgatacctcctcttgatagattgttcaatttgattggtataaatgttggcaactgggctcaggaaatagtaaaatccaaaagggcgagcacaactactacaaaagtggaaaacataacaagagtaggaacttctgcaacatgttgtaattgtggtgaagaattgactaaaatatgttcacttcagttatgtgatgactgtttagagaaaagaagcaccacaaccttatcatttctcataaagaaattaaagagacaaaaagaataccaaacactaaagaccgtgtgcaggacgtgcagttatcgttacacttccgatgcaggcatcgaaaatgaccatatagctagtaaatgcaattcatatgactgtccagtattttactctcgtgtcaaagcagaaagatacttgagagataatcaatctgttcaaagggaagaagcattaatatctctaaatgattggtaa

SEQ ID NO: 46154 - DNA, 2148 bp, Saccharomyces cerevisiae
atgagccagcatattaggaaattagattctgatgtttctgaaagacttaaatctcaggcatgcacggtatcgctagcatcagcggttagagaaatagttcaaaattctgtagatgcacacgctaccactatcgacgtcatgatcgacctccctaatttgagctttgcagtttacgatgatggtattggtttgactcgaagtgacctaaatatattggccacacaaaattatacttccaaaatacgaaagatgaatgatttagtaacgatgaaaacctacggttacagaggagacgccctatatagcatttctaatgtctctaatctgtttgtttgttccaagaaaaaggattacaactctgcatggatgagaaaatttccatccaaaagcgtcatgttgagtgagaataccatactcccaatagatcctttttggaaaatttgtccttggagccgaacaaagtctggtactgttgttattgttgaagatatgctgtataatttacctgtccggcgcagaatactaaaggaagaaccccctttcaagacttttaacacaataaaggcagatatgctacagatactggtaatgcacccgatgatttcactcaacgtacaatatacagacaaactcagaatcaatacagaagttcttttccgctcaaagaacataactgaggggttaacaaagcaccagcaaatgtctcaagtactgagaaatgtgtttggggcaataataccaccggatatgcttaagaaagtttccttgaagtttaatgaatatcagattgaagggatcatatcgaagatgcccgttggattgaaggatcttcaatttatatatatcaatggcagacgttatgcggacagcgcctttcaaggatacgtcgattctttattccaagcacaagatttcggggagaaaggcatgagtttactcaaaactaaaagcgtgggaaaaccgtatcgatcacatcccgtcttcatccttgatgttcggtgcccccaaactatcgatgacctgttacaagatccagcaaagaaaattgttaagccttcccatatacgtaccattgaaccattgatcgttaagaccattcgctcctttctgacatttcaaggatacttaacgcctgataaatcagattcatctttcgaaatagtcaattgttcacagaagacggcaacattgcctgatagtcgaatccaaatcagtaaacgtaatcaagtattaaattcaaaaatgaagattgcacgcattaattcatacataggaaaacccgctgtcaatggatgtagaataaacaatagtacaataaactacgaaaaaatcaagaatataagaatcgacggtcagaaatcaaggttacggaataaactctcttccaggccctacgatagtggttttacagaagattatgacagtataggaaaaaccataacagatttttcaatatcaagatctgtcctggcaaaatatgaagtgattaatcaagtagataaaaaatttattctcatacgttgtttagaccaatctattcataattgcccactattagttctagttgatcaacatgcttgcgatgagaggataagactagaagagctattttatagcctgttgacagaagttgtaaccggaacttttgttgcacgagacctcaaggattgttgcattgaagttgatcgtactgaggctgacttatttaagcattatcaaagtgaatttaaaaagtggggaattggctatgaaacaattgagggaacaatggaaacctcacttttggaaattaaaacactgcctgagatgttaacttccaaatataacggggataaagactacttaaaaatggtcttgctgcaacatgctcatgacctgaaggatttcaaaaaacttccaatggatttatcccatttcgaaaactacacttcggttgataaattatattggtggaagtactcaagctgcgttccaacggtctttcatgaaattcttaacagcaaggcatgcagatctgctgttatgtttggagatgaattaacccggcaagagtgcataattttaattagcaagctctcgcgatgccataacccattcgaatgcgcccacgggagaccttctatggtacccattgcagaattgaagtaa

SEQ ID NO: 46155 - DNA, 1902 bp, Saccharomyces cerevisiae
atggattacgaagaaattttatttggtctgcaaccgatcctcaatgcgtcttcaataaaggatgttccgatgaacgatgtctacttaggaagctacctagcggtaatggaccaattggctgtttcgttgagagaaccaagtaatagagatattgttggtaaaactgggctgctactgaacctagtaagagtattagaacaagcgcttgatatctgctttcatgatacgagcatttcaattaatgataaaatagcgttttatgagatcagttctgaagtgattagatgtatcgctaacgcaataattgataatgatgataatcgggaaattctcttggattctggaggtaaaaagcttcttaattattatataggcggggttcttcagctggacgaaatttcttctgacaagagtgaggatagcttagtggataaattacagatgcggtcagttgtgctactaaggaatttttgcattggaaatctcaagtatacagaaaatttggctcccttcattagaggtccattatttgttttgttgaaaaccacacaatatagctatttgtcatctcccgaaaaagttgttttaggttcagatttattgaacgatattttaaaagtcaattactcaaatgttcaaataagcgatctctttttcttaagccagtacatcaaaaaaatctcttcaaatgtgcaaaataaagaattgcaggcaatggaagatggagcagtcgaagcatattcaaatactgaaactcagaagttcgctggccaaggaaatcaagagtacatcgaaaaagaggaagaagatgatgaggaggacgttaattgtgaattgctattaaatctgtcaacatgtcttgaaactattgtagccaaggatgaaactataaactttaccaatgaggagcagcttgtgctaagcatgcaaaaaaatttaatattgtccttagtttgcttagaatcaaaaaccttcaataataagctaattgtaatgagaagactcatatcgtgcgcaggcaacatctccgccaacctaacaaactctaacaaacgagagcaatcattatgtatcgaaactattaagagttccgcaagtagttatgccctagccgcagctttgatgatattatgtaactcagttgcatccaaaagtgacgctgtcgcgctactgaagctcatatctcttagtgaattgattcaagttggtagcttgctacaagacccactacaatatcaaggattcctagatttactgaggaagctgttaaatctggaaaataccatgtggctagatatcaaggacctcttcaccctatttcagattatgagaagatgtcacgagcaaactaaatattataacaacctgagatcgttattaacaaatttattaaacaaaactttaacggtgcttccaagttcaaaaatacacaattcaataagcagtgatccaacaattatctcttttatagcagagcatggaacgttaacgtcctgtattgcgatggataagctgcttgtgtccaagaaagcccttcctaaagaagctattacatccctatgggattcgatcttcaaattccaaaatttaggtcaagcagaacaactaagcatctcagatttatttcatatcacaaaaacggttggaatttatttaaaagattcaagtgtaacagctgacgtgaatccgattgaaaatatactattcaaggattacattcaaaagttaaccctgatattagagaccatactttcatttaaagaaaataaagataagggtagcgagagttgtttcaacaatgggaaatttatagcgggcataatactaaacattgtgaaaaatacgaaatgcttaacgccagaggaacaaaatttagaagcgcttgcaaaatcgttcttttag

SEQ ID NO: 46156 - DNA, 2121 bp, Saccharomyces cerevisiae
atgattcaaaaaatgagcccaagcttaaggaggccatcaacgaggtctagttctggttcaagtaatatcccacaatcgccctctgtacgatcaacttcatcgttttctaatctgacaagaaactccatacggagcacctctaattcgggttctcagtcgatttctgcatcttccactagaagtaactccccactaagatccgtatcagccaaatccgatcccttccttcacccaggtaggataaggatcaggcggagcgacagtattaacaacaactcgagaaaaaacgatacatatactgggtcaatcactgtgaccatccggccgaaaccacggagcgttggaacttcccgtgaccatgtggggctaaaatcgcccaggtactctcaaccaagatccaactcacatcacggtagcaatacatttgttagagacccctggtttattactaatgacaaaacaatagtgcatgaagaaattggagagttcaagttcgatcatgtttttgcttcccattgcactaatttggaagtttatgaaagaaccagtaaaccaatgattgataagttattgatggggtttaatgccaccatatttgcgtacggtatgaccgggtcaggtaaaacgtttacaatgagcggaaatgaacaagagctaggcctaattcctttatctgtgtcgtatttatttaccaatatcatggaacaatcaatgaatggcgataaaaagttcgacgttataatatcgtacctcgaaatttacaatgaaaggatttacgacctgttagaaagcggattagaagaatccggtagtagaatcagtactccttcaaggttatatatgagcaagagcaacagcaatggattgggcgtagaattaaaaatcagagatgactctcagtatggggtcaaagttatcggtctcaccgaaagaagatgtgaaagtagtgaagaattattgaggtggattgcagttggtgacaaaagtaggaaaattggcgaaactgactacaatgcaagaagctcacgatctcatgccattgtactgattcgtttaacaagtactaacgtaaagaacggcacctcaagatcgagtacattgtcgttgtgtgacctagcaggttcggaaagggctacggggcaacaagagaggagaaaggaaggttcattcatcaacaaatccttacttgctttggggactgtgatatccaaactcagtgccgacaagatgaactcagtaggctcaaacattccctcgccatctgcaagtggcagtagcagcagtagtggaaatgctaccaataacggcactagcccaagcaaccacattccatatcgtgattctaaattgactagattattgcagccggcactaagcggtgacagcatagtgacaacgatatgtacagtcgacaccagaaatgatgcggcagcggaaactatgaatacgctgaggtttgcatcaagagcgaaaaacgtcgcacttcatgtatccaaaaaatccatcatcagtaacgggaataacgatggagataaagatcgcaccattgagctactgagacgccaattggaagaacaacgtaggatgatctctgaattgaagaaccgttcaaacattggcgagcccttaaccaaatcttccaatgaaagtacttataaagacattaaagccaccggcaatgatggtgatccgaatttggctctaatgagagcggagaatcgagtattaaaatataaactagagaattgtgaaaaactactagataaagatgtggttgatttgcaagattctgagattatggaaattgtagaaatgcttccctttgaggtcggcacccttttggaaacaaagttccaaggtttggaatcacaaataaggcaatataggaaatacactcaaaaacttgaagacaagatcatggcgctagaaaaaagtggtcatactgcaatgtcgctaactgggtgtgacggcactgaagtgatcgaattacagaagatgctcgagaggaaggataaaatgattgaggccctgcagagtgccaaacgactgcgggatagggctttgaaaccactcattaatacacagcaatcaccgcaccctgtcgtggataacgataaatga

SEQ ID NO: 46157 - DNA, 1218 bp, Saccharomyces cerevisiae
atgttcagcttgaaagcattattgccattggccttgttgttggtcagcgccaaccaagttgctgcaaaagtccacaaggctaaaatttataaacacgagttgtccgatgagatgaaagaagtcactttcgagcaacatttagctcatttaggccaaaagtacttgactcaatttgagaaagctaaccccgaagttgttttttctagggagcatcctttcttcactgaaggtggtcacgatgttccattgacaaattacttgaacgcacaatattacactgacattactttgggtactccacctcaaaacttcaaggttattttggatactggttcttcaaacctttgggttccaagtaacgaatgtggttccttggcttgtttcctacattctaaatacgatcatgaagcttcatcaagctacaaagctaatggtactgaatttgccattcaatatggtactggttctttggaaggttacatttctcaagacactttgtccatcggggatttgaccattccaaaacaagacttcgctgaggctaccagcgagccgggcttaacatttgcatttggcaagttcgatggtattttgggtttgggttacgataccatttctgttgataaggtggtccctccattttacaacgccattcaacaagatttgttggacgaaaagagatttgccttttatttgggagacacttcaaaggatactgaaaatggcggtgaagccacctttggtggtattgacgagtctaagttcaagggcgatatcacttggttacctgttcgtcgtaaggcttactgggaagtcaagtttgaaggtatcggtttaggcgacgagtacgccgaattggagagccatggtgccgccatcgatactggtacttctttgattaccttgccatcaggattagctgaaatgattaatgctgaaattggggccaagaagggttggaccggtcaatatactctagactgtaacaccagagacaatctacctgatctaattttcaacttcaatggctacaacttcactattgggccatacgattacacgcttgaagtttcaggctcctgtatctctgcaattacaccaatggatttcccagaacctgttggcccactggccatcgttggtgatgccttcttgcgtaaatactattctatttacgatttgggcaacaatgcggttggtttggccaaagcaatttga

SEQ ID NO: 46158 - DNA, 1521 bp, Saccharomyces cerevisiae
atggcttcaatgttcagaccaccagaatccaataggagtcaccaaaagactccaaaattaacgcttccagtaaatttagttcaaaatgcgaaatccactaatgatgggcaacatctcaaccggtcaccgtactcgtcagtgaacgaaagcccatactccaacaatagcacttcagctacttccactacgtcatccatggcttcaaattccactttgttgtacaatagatcatctactacaactattaaaaatagaccggtaccacctccattacctcccctagtactaacgcaaaaaaaagacggtatagaatatagagttgccggcgatagtcagctttctgaaagattttctaatttgcatgttgatataacttacaaggaactactatctagtgctccaatttccactaagttatccaacatagataccacttttatcaagaaagatctcgacacaccagaaggcgaggattcatacccctcgacacttctttctgcgtacgacttcagcagtagcgggagcaactccgcccctttaagtgcaaataacataatttcttgttccaacttaatacaaggaaaagacgtagaccagttagaggaagaagcatggaggtttgggcatctcaaggatgagattactacactaggaattctaggagaaggcgcgggtggttctgtagccaagtgccgattaaaaaatggaaaaaaggtttttgcgttgaagacaatcaacactatgaatactgacccagaatatcaaaagcaaatattcagagagctacaatttaataagagttttaagtccgattatattgtgcagtactatggtatgtttaccgacgaacagagttcttcaatatacattgccatggaatatatgggaggaaaatcactggaggcaacgtataaaaatttgttgaaacgtggcggtagaataagtgagagggtgataggaaagatagcagaatctgtcttaagaggtttatcatacttacacgaaaggaaagtcatccacagggacattaaaccccaaaacattcttcttaatgaaaaaggggaaatcaaattatgcgatttcggtgtcagtggggaggctgttaactctttagcgatgacatttactggaacgtcattttatatggccccagaacgaatacaaggccaaccatacagcgtaacctgtgatgtatggtccttaggattaactcttctggaggttgctggagggagatttccatttgaatctgacaaaataacgcaaaacgtggctcctatagaattattgacgatgatcctgacgttttctccccagttgaaagatgagccagaactagacatatcctggagcaagacatttagatcttttatcgactattgtttaaaaaaagatgccagagagaggccttctcccaggcaaatgttaaagcatccctggattgtagggcaaatgaaaaaaaaagtcaacatggaacggtttgtaaagaaatgctgggaaaaggaaaaggatgggatataa

SEQ ID NO: 46159 - DNA, 933 bp, Saccharomyces cerevisiae
atgacatctatagataatagacctttgccgttcatataccagttcacagccggtgccattgccggcgtctcggagctattggtgatgtatccattggacgtggtgaagacaagaatgcaattacaagtgacaaccaaaggtcatcccgctgttgttgcagcgaaagcagcagtagatcactacacgggcgtgatggattgtcttacaaaaattgtgaagaaggaaggattttcgcatctttacaagggtatcacatcgcctatattaatggaggctccgaaaagagcaattaagttctccggaaacgatacattccaaacgttttataaaaagattttccccacgcccaatggggagatgactcaaaaaatcgccatatacagtggtgcgtccgctggcgccgtggaagcctttgtcgtcgcgccttttgaactagtgaagattagattacaggatgtgaattcacagttcaagacacccattgaagttgtaaagaatagtgttgtgaaaggtggtgttttgtcacttttcaatgggttggaagccactatctggagacacgttctttggaatgccggttatttcggtataatattccaaattcggaagcttttgccggcggctaaaacaagcacggaaaagaccagaaatgatttgatcgcaggtgctattggtggcactgtcgggtgcttgttgaatacaccatttgacgtggtaaaatctaggatccaaagaagttccgggccgctgaggaagtacaactggtccctgccttcagtgctgttagtttaccgtgaggaagggtttaaagcattgtataagggatttgcgccaaaggtcatgagacttgcccccggtggtgggttattgttggtagttttcacgaacgtcatggattttttcagagaagtcaagtatggtaaaaaacaatga

SEQ ID NO: 46160 - DNA, 2691 bp, Saccharomyces cerevisiae
atgacgcaatccctaggtatcgaacagtataaactgtcagtcgtatctggtgggaaacccgctttgaataatctcagttcagtaaccggcaataagaatatcgcccgcctatcacaagaccaacgaaactatattataccctttaacaatcagatcaaggtgtattctgtggaaactagacaatgtgttaagactctaaagtttgcaaataactccttgttatccggaatatttctgcaagaagaagagaataatgaatcgattgtaaagattctgctgggtgatataaccgttccgcaacaagaagacgctcatctgattaccgtattcaccaataatggtcatgtaattgttttaaattataaggggaagctggtcgagtcccctaagcatttcaaaatctctttggcagatgaaaagcttgcaaatgttttccatagcgagggcaactatagaattttgacaacgttcaaggaccctagtcaaaaggcacataactctttgcaatcgtacaggttatatgcattaacctttgacgatgctaaaaagcaatttgaagtggctcatcaggcagaatggcacaacgttatcttgtcaaatatttcttccaatggtaaactgctagcgcatatgtgcaaagacgtctcaacaaaagatcacgaacacaaatccatctcagttgtttcgctttttgatgattctgtaaatttaagctttcccctcggttccatcctttcttcacagactcaatccctatcctataacacaaggtacgtttctagcatggccatagacaatatgggtcaacaactggctgttggatttgcctccggagttataagtatcgtaagcctggccgatctacaaataagactgctcaaatggcatatagactctgtgctgtcactctcattctctcacgatggatcctatttgctatctggtggttgggaaaaagttatgagtttatggcaattggaaacaaactctcaacaattcctgcctcgtttgaacggtattataatcgactgtcaggtattgggacctcaagggaactactactctttaatcctacaaatgactgaaaacaattcaaattctgactaccaatttttacttttgaatgcttctgatttgacctccaaattgtcgattaacgggccattaccggtgttcaatagcaccataaaacacattcagcaaccaatctcggccatgaataccaagaactccaactcaattacctctctcaatcactctaagaagaaacaatctagaaaactaattaaatcgagaagacaagatttcaccactaatgtagaaataaaccctattaacaagaacttgtatttcccacacatttctgctgttcaaatttttgacttctataaaaatgagcaagttaactatcagtatttaacatcaggtgtcaacaattctatgggtaaagttagatttgaactgaatttacaagacccaataataactgatttgaagttcaccaaagatgggcaatggatgattacatacgaaattgagtatccgccaaatgacctcttatcttccaaggacttaactcatatcttgaaattttggaccaaaaacgataatgagacaaattggaatttgaaaacgaaagtaataaatccacacgggataagtgtcccaattaccaagatattgccttcaccaagatcagttaataatagtcaaggctgtttaacggctgacaacaacggtggactgaaattttggtccttcgactctcatgagagcaactggtgcttgaaaaaaatttctttaccaaactttaatcatttcagtaactccgtttctttagcttggtctcaagacgggtctctaatattccatggtttcgatgacaagttgcaaattttagatttcgacacttttaaaaagtttgaatcattggaaaatacaaagacggtcagtgagttcacgttagactctgaaatccaaaccgtcaagttgattaatgacacaaatttaatagtggccaccaggactacattaaacgccatcaacttattgcggggtcaagtcataaatagttttgacttatatccgtttgttaacggagtgtataaaaatggtcacatggataggcttattacttgtgacgaaaggacaggcaacattgccctggttataaatcaacaactaactgatctcgatggcgtaccaactatcaattacaaatcccgtattattatattcgattctgacttatctacaaaattgggtaattttacgcatcatgaatacatatcttggattggttggaattatgatactgatttcatatttttggacatagaatcaacactaggtgttgtcggaaccactgtgaatactcaactatctgatgaagttaataacgaaggaatattggatggcctggtaagtaacaccatcacaacttcggcatccaatagcgatatttttgcagaacaattgcataaactgtcgtctaggggcaaaaaaagtgacactagagataaaaataccaatgataacgacgaagatgaagaagatatcgctttggaatttataaatggcgaaaagaaagataagctagtcaatatgaatagttttacgagcatgtttgacaacattcaaaacgtgcaaatggatacattttttgatcgtgtgatgaaagtattaacatag

SEQ ID NO: 46161 - DNA, 3099 bp, Saccharomyces cerevisiae
atggcctcgtctcttaacgagttaaacttggttcaagtacttgaacaagcaagtaacccacaacatattaggtcagatgttcaaaaattagccgaacaacaactaagacaatgggagactcaagcgggatttcattacttattacagtcaatctaccttaatttatctaattctttacaaattagatggttggcggtaattcaatttaagaacggcgtggataaatactggagatccactagaattaacgctatacctaaagatgaaaaagcctcgataagaggtcgtctttttgaaatgatcgatgaacagaataatcaactttgtattcagaatgcccaagcttccgcaaggattgcaaggctagattttcccgtagagtggccaaccttatttgaggatctagaaaacctattgaacgatgagatcatcagaaaagattcagttaagatttacaatatattgatgcatataaatcaaatcgttaaagtattaggtactgcgagaataggaaggtgccgacccgctatgcaaagtaaagttcctttgatattaccactaattgtcaggatttatttacaatcatttgaagaatggacgacatcctccaatctcaactacgaggatctttccagtttacaagtttcttacctagctttgaaagtgctcagaaggataatttgtgaaggatacgaccgccctcaaaccgatcagtctgtttgcgattttattaaactatccgtttcacactttgagatgttaatttcaaaccatgaaaacttcaaaaagtttgatatttacgaaaagtttatcaaatgcctaggaaagttatatttcaatttagtcactggctctccggctaatttcatattactgccatgctctacgcaaattctaatcacttatactaggctaattttcgataaggcccctaaagtatatagagagaattctgatgtcacgggggacttttgggaacagactgctattagagggcttttaattttgaaaagggtcattaatttcattcacaaaaagggggcaattacgttaaaagcaagaagtgataaactaaccatagatgcttctatcaacaaaatcaacacagaatttctgaatgagaatttgataacaaggttggttgacactttaatggaatggtacttgaggttaagaccaactgaattagaaaattggtttatggatccagaagaatggataaacgaacaaatggccacgagttacgaatatcaaatcagaccatgtgcagagaacgtttttcaagacttaatgaatactttctctgagctgttggttccctacctgttaaagaaaattgaaaatgatgcttcaaagctatcaaactcattagacgattttttaaggaaagacgcaatttatgcaagtttccaattaagtgcatccgctgttagtgaaatggtagattttgacaggttactaattcaggtttttttaccagaagctacaaatacaaacatatcaggcgacgaattaaggattatcagaagaagagttgctttaattataaacgaatggtctactgtgaagtgttcggaagaatctaaaagtttatgttacaagttatttacaaacttcctgacagatgaagacgacaaagttgttttgttaaccacagtccagactgtcagaaccatggttgatgactggaacttcaacaaggatacttttcagccatttttaactgaaaatgttcatttattgttgaggaaaattttaccatctgtgtcgttaaccgagacaaggctatatgttttaaacaccttgagcgatatcataattcaaacaaaacctttaattagcagggatctattagtcgaaattttgcaaatcataccaaacctttgggaaatagcaacaaataatgctagtgaggctattttggcaaacgcattgttaaggttattgagaaatttggtatcatctttgggatcacagtcacatttaacgtgggatatcgccatacctgtggttgcattagcctgtgatccctcttctatgcaatatcagttgttaagcgaagacgggtatgaactatggggcatgcttcttcaaaatttttcatcccacgatcaagagtttgacgataagttcgttgaattggtgccatttctaaagtatggtattgagacacacacagagattctcccaactttacttgaaattatcaaaagttatgctctgattctgaatcctgtggattttttctctaacaacacatttcaagatatttttaaacaaatgtctaaatatcttttaaagttaagggaagattcatttcagttggttttagaaatctgggaaattttgatattatccaatgagtcggattacgaaaatctgttattgcaaaaattctatgaaaccggagtattatcagcattattcgatgccattttcctggaagaagctccttcatcttatttatgctcgcaaatcattcaaatcatcgctagaatatcctacgtgaatccagacgccttaatgacttttttagctacatatcatgacaatctaccaacttctaacgaaaatgcacgcatgccggaatcaataagaaaaattgtgtctaaggatcagacgtatgattccgttgtaaacaagcttttaaccggatggatagtatgttttagagatatctttgatcctaaattcaaaaaagttcacatattaggtatttcaagtttactaaggactggtttagttcctattttgactgagttttcatccatcgcatctttatggatcgaaatgctcgaagaaattaatgaaactaatcgtggggattgcgaaaaataccacttgaatgatattgttacagagcaatcaattgcattccatcctttaactgccgaacaattaagatatcatcaattatgcaaaaacaatgatccagtgcataacattagtttaaaagattttatttcccaatcaatggaatatctagaatcacatttaggagtagaaaggtaccaagaatttttgaagactattaaccctagtttactagagaacttacaaatgtttttatccatccagcctcaagaggctcgtccatga

SEQ ID NO: 46162 - DNA, 762 bp, Saccharomyces cerevisiae
atggattatagtaactttggaaacagtgccagtaaaaagtttcaagacgatactctaaacagagtaagaaaagagcatgaagaagccttaaaaaagttgcgagaagagaacttcagttcaaacacgtcagaattgggaaacaagaagcactatagagcacaggaaaggatgagttcgccattacatagattgtctcccacaggtaaatcagacgataggaaagtgaagagcccgctagatgataagctaaggaggcaattaagggaaggtaatacgcgactacctcctccaccattttccagctacgggatgccacccaccaaccgatctaatttggatagaataagaagaaggactagctcaccagtaagaactgataaatttgcatcacaaaatgtgatagatgaccaaagattagaaataaaatatttagaacgaatcgtatatgaccaaggcactgtcattgataatctaacatcaagaataacaagactggaatcattcatactgaattcgatctcagacagaggagataaaaattttgcctctctcgaacactcccgctctttttctgggtttccgaccaacaagacgtatggcttacaaatgggtggactgtatgagaatgatatgccctatcgaagaagtagcgacaacattaataaagaaggagcaagagaagatcgatcgtcacaaatccatattgaaaatgaaagtacggaggatatactaaaaatattgtcttcgtcttttcacaattga

SEQ ID NO: 46163 - DNA, 1305 bp, Saccharomyces cerevisiae
atgttactgaaaaacttacacagtctcttacaactaccaattttttcgaatggagcagataagggtatagaaccaaactgccctataaacattccattatcatgttccaataaaactgatatagacaactcgtgttgttttgaatatccaggtggaatatttttacaaacccaattctggaattactttccaagcaaaaacgatttaaatgaaactgaattagtgaaggagttagggcctctagattcatttacaattcacggattatggccagataattgtcatggtggctaccaacaattctgtaataggtccttacaaattgacgatgtttactacttattgcatgacaagaaatttaataataatgatacatccctgcaaatatcgggcgaaaagctgcttgaatacctagacttatattggaagagtaataacgggaatcatgagtccttatggatacacgagtttaataaacatggcacgtgcattagcacaattagaccagagtgctatactgagtggggtgctaatagtgttgacagaaaaagagcggtctatgattattttagaataacttataatctattcaagaaattggacacattttcaacactagaaaaaaataatattgtcccaagtgtggacaattcctattctttggagcagatagaggcagcactaagtaaagagtttgaaggaaaaaaagtcttcataggctgtgatagacataattccttaaacgaagtatggtattataaccacttgaagggttcccttttgagcgaaatgtttgtgcccatggactcacttgccattcgaacaaattgtaaaaaagatggtattaagttttttccaaaaggttatgtcccaactttcaggaggagacctaataagggagcaagatacagaggagtcgttcgtctatcaaatattaataatggagatcagatgcaaggctttctaatcaagaatggacactggatgagtcaaggtacaccagcgaattacgagttgattaaatctccctatgggaattactacttgagaactaaccaagggttttgtgacattatttcgtcttcatctaatgaattggtctgcaaattcaggaacattaaggatgcaggtcaattcgattttgatccaacgaaaggaggagacggatatattggttattctggtaactacaactggggcggtgacacctatccaaggagaaggaatcaaagccccattttctctgtagacgatgaacaaaattccaagaaatataagtttaaattaaaattcatcaaaaattaa

SEQ ID NO: 46164 - DNA, 1542 bp, Saccharomyces cerevisiae
atgagtgactattccctgaagcattcggtcactcagtatttggaagaaattcctcaacaagttcaaaataggctttatacctcaccagctacatgtctggctatctatagaattttaccaccactagctaaattttttatcatggcaatggttttcaacgaaaatgaagtacctttgttggatttagataaatgggttaactctaatggtaaattgcagtttcagaatgcaatcaaatcgatgaagtctttgcatcttcttataccaaataaatcatctggtactttgatgatcaacctaaacccaacattcaaaatcagcctgaggaacgcattaacgggtggggaagttcaaaactcattcggtgtggttgtagaggaaaacgtagttagcctggacttgttggatgaatattcagctaataaatgggaaacaatattacatttcatggttggcactcccctcgctaaaatcccatctgaaaaagtactgaaccttttaaaacacagtaaactaatggaagaggtaaactctactggagagttcaaaatcactaatgaaggcttccaatttcttttacaagaaatcaactcccaattatggacattattattgcaatatttaaaaatgatcgaaacgtccaaaatggatttagtcgatgttttacattttattttcatgttaggcgcattggaagttggcaaagcctataaaatcgatgcattaagcgaaacacaaagaattatgttacaagatatgcgagactatggtttggtattccagaagcattcaaatgatagcattttttatccaacaaaattagctttgatgctgacttccgataccaagacaatcagatctgcctccaatgcgatggatagtgtactgagacagaatagagaagagccgtcagtaaatgaagacggcgccaacgggaaatccacaacagatatcactacatcagatgatttgaacaaagcaggtctaaaaaatcaagatatacccgatggctcattgattgtagaaacaaatttcaaaatctattcatattctaattcacctctgcaaattgctgttttgtctctttttgttcatttaaaggcaagatttgtgaatatggtattgggtcaaataacaagggaatccataagaagagcattgaccaatggtatcactgccgaccaaatcattgcctatctggagacacatgcacatcctcaaatgagaaggttggcagaagagaaactagaaaaaaaattagagctggaccccaactgtaaggagcctttacaagttttgcctcctaccgtcgtagatcaaatcagattatggcaattagagttagatagagtcattacatatgaaggttccttatattctgattttgagactagtcaagaatacaacttactaagtaagtacgctcaagatatcggtgttttgttgtggaaagacgacaaaaagaagaaatttttcatctcaaaggaaggtaattctcaagtacttgatttcgctaaaagaaagttgaaaaagaaacaataa

SEQ ID NO: 46165 - DNA, 669 bp, Saccharomyces cerevisiae
atgcacaatcaggaagagtggctagacaaggacaaaactttggtgaacgaagaagaaaatacttgcatcaaccattcttatacaaaaaaggacactaataactatcgggtcggtaaaagcggtattaaggacttgaagaagcctacgaaccagaaggaaattgcgataaaaaatagggagttaacgaaacaacttactcttctcaggcaagaaaataatcacttacagcaggcttgtaaaattctcagcgaaaacaagatcattgagaacagaaaatccatagaaaaatggaggacaatttgtgagatggaactgtcttttattttaaattccactttaatcaaaatcaatagaatgggcggctataaagattttctagaaaaagaaatggaggctaaaaagagaagattggaatatcagattgacaacggtatggaagatcaaatctgtgaaataaaggaaagtgatgactttagacaactttcagaagttgagaaacaagagtgggagagtcaaatgaatgaacagctgaaagagttggaaaaaaaaaaaatagcggagctggaaaaattgaataaggtgctgcatgatagcgaagggaaagattttggaatggctgaactatgcactaggttaaaacttgactacagcttaatctttccacaatga

SEQ ID NO: 46166 - DNA, 1674 bp, Saccharomyces cerevisiae
atgaagtgccaaacatgtcacttacccctgcaactagacccatctttagaaggtcttagtttaacccaaagaaatttgctactttcaaataattcaattatcactgcaacgaatgaaaatgtcatcagcaacaagggcatcgaagccgcagataattgtgggcctcaaataccgaaggagaggctgaggcgattaggggagattcagaacataaaagacttgaatttaaaagatgataaattaatcactgattcgtttgtttttcttaatcacgatgatgatgataatgctaatattacgagtaatagcagagaggaccagcgttatggaaatgccaacggaaatgataataaaaaagctaatagtgatacttccgatggaaccagtacctttcgagatcatgacgaagaggaacaagaagctacggatgaggacgaaaaccaacaaatacaattgaattccaagactttgtccacacaagtcaacgcaatgactaatgtatttaacattctatcttctcaaacaaacatagactttcctatctgtcaggactgctgtaacatcttgataaacagactaaaaagtgagtatgatgatgcaataaaagagagagatacttacgctcaatttttatcgaagttagagagtcaaaacaaagaaatatcagaaagcaataaagaaaagcagtattcccataatctttcggaaaaagaaaatttgaaaaaggaagaggaaagactcttggatcaattattacgtttggaaatgacagatgatgacttagatggagaactagttcgtttacaagaaaagaaagttcaactggaaaatgagaaactccaaaaactgagtgatcagaatttaatggatttaaataacattcaattcaacaaaaatttacagtcattaaaactgcaatacgaattatccttgaatcaattagataagttgaggaaaatcaatattttcaatgctacattcaaaatctcacatagcggcccctttgccactataaatggattgagattaggcagtataccagaatcagtggtaccttggaaggaaatcaatgcagcactgggccaattgattcttttactggctaccataaacaaaaacctgaagataaatttagtagactacgaattacaaccgatgggttcattttccaaaatcaagaaaagaatggttaacagtgtcgaatataataattccactacgaacgctcccggtgattggttgattctgcctgtctactatgatgagaatttcaatttggggagaatcttccgcaaggaaacgaagtttgataaatcattagaaacaacattagaaataataagcgaaatcactcggcagctttctacgatagcgtcatcatattcatctcaaacactcacaacaagccaagatgaatcttcaatgaataacgcaaatgacgttgaaaatagtacttccattctcgagctaccctatatcatgaataaggacaagattaatggattatccgtcaaattgcatggtagcagtcccaaccttgaatggacaacggctatgaaatttttattaaccaatgtaaagtggttgttagcgttttcttccaatttactatccaagtcaattaccttaagccctacagtgaattacaatgataagaccatcagcggaaactaa

SEQ ID NO: 46167 - DNA, 1854 bp, Saccharomyces cerevisiae
atggcagacttgccacagaaggtatctaatttaagcatcaacaacaaagagaatggtggtggtggcggcaaatcatcttatgtcccaccgcacttgagaagtagaggaaaaccatcattcgaaagaagtaccccaaaacaggaagataaggttacgggtggtgattttttcagacgtgctggaaggcaaactgggaacaatggcgggttttttggcttttctaaggaaagaaatggagggacgagtgcgaactataaccgcggaggcagctcaaattacaaatcatctggaaatagatgggtaaatggcaagcatataccggggcctaagaacgcgaaattagaagccgaactgtttggtgtacacgacgatcccgattaccattcatctggtataaagtttgataattacgataatattcccgtagatgcatctggaaaagatgttcctgaacctatactagattttagttctccccctctggatgagctgttaatggaaaatatcaaacttgctagtttcaccaaacctactccagtacaaaaatattctattccaatagttaccaaaggtagggatttgatggcatgcgcacaaacgggctcaggtaagacaggtgggtttttgtttccgctcttcacggagctattcaggtctgggccctctccagtacccgagaaagcacagagcttttattctagaaagggatatccatctgctttagtacttgcaccaactagagaattggctacccaaatttttgaagaagcaagaaaatttacgtatagatcttgggttaggccatgcgttgtttatggtggcgcgccaatcggtaaccagatgagggaggttgaccgcggctgtgacttattggtggctacaccagggcggctgaatgacttattagaacgcggaaaagtttctttggctaatatcaaatacctggtattggatgaggctgatagaatgctagatatgggattcgaaccccaaattcgccatatagttgaagaatgtgatatgccctctgtggaaaatagacagaccttgatgttttccgccacattcccagtagatatccagcatttggcacgcgatttcttagataattatatttttttatcagtaggaagagtcggttccacctcagaaaatatcacgcaaagaatattatatgtcgatgacatggacaaaaagtctgcgttgttagatttactgtctgcagagcataagggattgacattgatttttgttgaaacgaaaagaatggcggatcaactcacagattttttgatcatgcaaaatttcaaagctacagccatacatggtgaccgcacacaggctgaacgtgaacgtgccttatctgctttcaaagctaacgtagctgatatcctggtcgcaacagctgtagcagcgagaggtttggatataccgaatgtcacacatgtcattaattatgatttgccctccgacatcgatgactacgttcacagaattggtagaacaggccgtgctggtaacacaggcgtggctacttcattcttcaatagtaataatcagaatattgtgaagggtttgatggaaattttaaatgaagcgaatcaagaagttcccacgtttttaagtgacctgtcaagacagaattcaagaggtggaagaactaggggaggaggaggttttttcaatagtcgtaataacggttcaagagactaccgtaaacatggtggaaatggctcatttgggagcacgaggccaaggaatactggaacatcaaattggggttcgattggaggtgggtttagaaatgataatgagaaaaacggttacggaaatagcaacgcttcatggtggtaa

SEQ ID NO: 46168 - DNA, 1035 bp, Saccharomyces cerevisiae
atgacattggcagagttgcttggacggtcgagaatagctcaagtagctaacaatcataaaccattgacatacactggcaaaaaatttcatccaacacatcaaatcatcgaaactaagccatcgacactatacagacaagaatgggggttgaaatccgctattccttcgaaaattaaatctcgatatttggtgtacaacgatttggatacgttggaaagaattaccacattcgaacctagaggcggtacgcaatggaataggctaagatttcaagaaatgggagtaccaattgtgtctaatataggcagacaaaatccatttttcaagtacatatctcgtcctgaggatgagtctcatgctaaattgtccttattcaaagaaatgaaaggagatacagatatttcgcctgctgctatgaagaagcgtttgaagaagataacagcactaattagatcgtttcaagatgaatttaaagagtggctggtggaaaatcatccggatgaattgaaattgaattctaataagctggaagactatgtagtgaagtttctaaacaaaaagttggaaacaaaaacgaataaaaaatttaacactgaaatcattggtacaggtggattatcatacagcttgccaggaaagctaaaaaactcaccaaatggtgtcattcaaaggactgtagtacccggtagaatcttgaacgttgttaaggagaacaacgacaataaatggctggcagctattggtgggtttgtggccgatgtggtatttttccaatcaccacctagttcctttaactccatgggagatttcatcagaatgaaaacgttcttgttcgagatcttggaggcatctatggagaaaaatggttctgtttcgatgcacgctagattactcgaaccacaaaatgacaagaccagagaatttttcaataagagaccaatttataaaccattgacctctagaagggcacgtcgaccatcagtgggaaacattcaagaggccaataaccttttgaatataatcaagggaaattga

SEQ ID NO: 46169 - DNA, 867 bp, Saccharomyces cerevisiae
atgactgccgacaacaatagtatgccccatggtgcagtatctagttacgccaaattagtgcaaaaccaaacacctgaagacattttggaagagtttcctgaaattattccattacaacaaagacctaatacccgatctagtgagacgtcaaatgacgaaagcggagaaacatgtttttctggtcatgatgaggagcaaattaagttaatgaatgaaaattgtattgttttggattgggacgataatgctattggtgccggtaccaagaaagtttgtcatttaatggaaaatattgaaaagggtttactacatcgtgcattctccgtctttattttcaatgaacaaggtgaattacttttacaacaaagagccactgaaaaaataactttccctgatctttggactaacacatgctgctctcatccactatgtattgatgacgaattaggtttgaagggtaagctagacgataagattaagggcgctattactgcggcggtgagaaaactagatcatgaattaggtattccagaagatgaaactaagacaaggggtaagtttcactttttaaacagaatccattacatggcaccaagcaatgaaccatggggtgaacatgaaattgattacatcctattttataagatcaacgctaaagaaaacttgactgtcaacccaaacgtcaatgaagttagagacttcaaatgggtttcaccaaatgatttgaaaactatgtttgctgacccaagttacaagtttacgccttggtttaagattatttgcgagaattacttattcaactggtgggagcaattagatgacctttctgaagtggaaaatgacaggcaaattcatagaatgctataa

SEQ ID NO: 46170 - DNA, 2094 bp, Saccharomyces cerevisiae
atgtcttccaagcattcagatccattggagagattttataagcaatttcaagcatttgttcaaaataaccctaatgtcatatcggcagctcgagctgccgcacaaataccggaatctgcaaaagctgttgtagtactatccccatattctttacagcatgtgttcccgagagaatgggtaacaaaatcgtataggaaaactatagtcgaacgaccagaaagattattagcaagctcgatgggtatatcagctgcgattacaatgtatccatcccttttcaccttgaaatcctcgcatcaaaggaaaggttcattgatggcacctcatgtgcttaaagttcatggcagtagctggccggctgagttaattgaactttgccaaatggcagatgctaaattgctaaaaggcgaaatcgaagtcccagatacttggaactcaggtgatatatacttgagctcaaagacaattaaagctctacagggaacaattggggccattgaaactggtgttgactcaattttcaaaggaccatctgcagaacatattagtaacagagcttttgttgctatacggcctcctggtcatcattgccactatggtacaccatccggcttttgtctgttaaacaatgcacatgtagccatagaatatgcgtatgatacttacaacgtcacgcatgttgtcgtgcttgatttcgatctacaccacggtgatgggacccaagacatttgctggaaacgtgcgggtttcaaacctgaggaggaacctgaagattcatcttatgatgattttggtaagaaatttgccgaatttcccaaagtcggttatttttctatgcatgatataaattcatttccaacagagtcgggatttgccacaaaggagaacattaaaaatgcatctacctgtatcatgaactctcatgacctaaacatctggaatattcacttatccaaatggacaaccgaagaagaattcaatgtattatacaggacaaaatatagaactttatttgctaaagcagatgaatttttcaggagcgcaaaactagaaatgaatcaacaagggagaccattcaaaggtttggttgtcataagcgcaggtttcgatgcatcagaatttgagcaaacttcaatgcaaaggcatagtgtcaacgttcctacaagtttttatacaacgttcaccaaagatgcattgaaattagcacaaatgcactgtcatggcaaagttttgtctctaatggagggtggatattctgataaagctatatgttctggtgttttcgcacatttgatcggtttacaaaaccaagattgggttaaagaatgggggtctgaacaagtcgttaaagagattgttcgtggttgcaaaccggcttggaaaccctataagacaaaaagagcaaaagatgtcataagaatatgggcagaagaagttatcaggctgggacgagcaatgataccggaattcgatgatatcatttttaaagacgcagttaacagcgcaccttctaattctctactaaaggctactgtcgaaccagcatccacgtcgacaattgctcaaagaataatcagatctcatagaagcaacgcttccccagaaaaagaacttcatgaaaacaagccgagaagcacggaaaaacaggaacaaagggaaattagaagcgataccaaggtcaagcagctctcgtcaaataatagagcagctgaaacccaaattccgtttttgcaacaagaattttccagtgaggatgaagatgaagaatacgtttacgatgaagaattgaacaaaactttcaatcgcacggtggaggatattaccattgatgatatttctagacatttggagaccttagaaattgaaaaaaaaggtgatgaagattcagaccatgagctaaaagaaaaaaattggaaaaactcgcaccaacgccgtctacaaggtaatggaatgtataaaattccctccaatacgaaaccgcatcgcataagacagcctcaaaacgcaaatacaccaacttatgacgatagtgatatatcaatgatttctcatgtttcaagaaaacatacaacaagaagtggtggaagatggtga

SEQ ID NO: 46171 - DNA, 3387 bp, Saccharomyces cerevisiae
atgacagataatttgaccacaactcatggtggtagtaccacccttgaattgttggcgcagtacaatgatcatagatccaaaaaggacaaatctatagaacatatagaaaaaggaacatgttcaggaaaagaaagaaatccgtcctatgatgaaatttttacggaaaacattaagctaaagctacaagtccaagaatatgaaactgaaattgagagtttggaaaaggttattgatatgttacaaaaaaacagagaagcttccttagaagttgtgcttgagcaagttcaaaatgactcaagagattcatacgttaacgatcaatcatttgtgttacccccaagatctgctgaaaggaaagcgcatatcaagagtcttaatttgccaataccgacattgtcccctccattgcaacaaggttcagacgttgcacttgaaacaagtgtaacgcctacagtacctcaaataggtgttacatcaaatacttcaataagtaggaagcatttacagaacatgatactaaacgatgaaatagaagcaaatagtagcttctcatctcccaaaattatcaatagatctgtctcaagccctacaaaaatacattcagaacagttggctagcccagctgcctctgttacctatacgacgtctaggataaccataaaatcacctaataaaggttcgaaatctccattgcaagaacgtttgcgttcccctcaaaatcctaacagaatgacggctgttatcaacaaccatttgcattctccattaaaggccagtacctctaataatttagatgagctgactgaaagtaaaagtcaacaactaactaatgacgcgatacaaaaaaatgaccgcgtttattcttctataacatcctctgcatacactactggaactcctacttcagcagccaaaagtccatcatcccttttggaagtcaaggagggtgaaaacaaggctttgggtttctctccagcatctaaagaaaaacttgacgacttcacccaattacttgactcctcatttggcgaagaggatctagtcaatacggacagtaaagatcctctgtccataaaatccacgattaacgaatctttacccccacctccagcgcctccaacttttttctcacctacttctagtggaaatataaaaaactctactcctttatcaagccatttggcttctccggttatcttgaataaaaaggatgataattttggtgctcaaagtgcaaaaaatttaaagaaacctgtgttaacttcatcactccccaatctttctacaaaattgtcaacaacaagtcaaaatgcttctcttcctccaaatcctcccgtggaaagttcatcaaaacaaaaacaacttggagaaacggcatccatccattcaaccaataccttgaatacatttagctcaacaccccaaggttcgttgaagacacttagaagacctcatgcaagtagcgtgagcaccgtgaagtctgtggcccaaagtcttaagtcggatattccattattcgttcaaccggaggattttggcactatccagattgaagtactgagcacattgtacagggataatgaagatgatttatccattttaattgcaatcatagacaggaaatccggtaaggagatgtttaaattttcaaaatctattcataaagttcgcgaattagatgtatatatgaaatcacatgttcccgatttaccattgcccacgttacctgatagacaattatttcagactttatcacctacaaaagtggatacgcgaaagaacatattgaatcagtattatacaagcatattcagtgtccctgaatttcccaaaaatgttggtttaaaaatcgcccaatttattagtacagatacagtaatgacacctccaatgatggatgataatgtgaaagacggatcacttttgctgagaagaccaaagactctaacaggtaatagtacatggagagttcggtacggtattttgcgcgatgatgttttacaattgtttgacaaaaatcagttgactgaaactattaaattgagacaatcttctatagaacttatacccaatctccctgaagatagatttggaacgagaaatgggtttttgatcactgagcataagaaaagcggactgtcaacctcaacaaagtattatatttgtactgaaacgtcgaaggaacgtgaattatggctttctgcgtttagtgattacattgatccttcacaaagtttatcgttatctagctcgaggaatgcaaacgatactgattctgcatctcacttgagcgcaggaacacaccattctaaatttggaaacgcaactatctcagcaaccgatactccatcatatgtcactgatttgacccaagaatataataataataacaatattagtaatagtagcaataacattgctaatagcgatggtattgactcaaacccatcttctcactctaacttcctagcaagttcaagcgggaatgcagaggaggagaaggatagtaggagagccaaaatgagaagtttattcccttttaaaaaattaaccggcccggcgagtgcaatgaaccatataggtattacaatttcaaatgattcggattctccaacatctcctgactctatcattaagtcaccaagcaaaaaattaatggaagtatcctcttcgtcaaattcttctacgggtccacatgtgtccactgcaatatttggctcgtcactagaaacgtgtttaagattgagttcgcataagtaccaaaacgtttacgatttaccgagtgtagtttatcgttgcttagagtatctttacaaaaaccgtggtatccaggaagaaggcatatttagactaagcgggtccagtacagttatcaaaactttacaagaaaggtttgataaagagtacgatgtagatttatgtcggtacaatgaaagtattgaagctaaagatgatgaggcatctccaagtctttacattggtgtgaatactgtaagtgggttactaaagttgtacttgagaaagttgccccatttattatttggtgacgaacaatttttgtcgtttaaaagagtagttgatgaaaatcataataatcctgttcaaatatcattggggtttaaggaacttattgaatctggcctagttcctcacgctaacctatcgttgatgtatgctctttttgaactgctggtaaggatcaatgagaatagtaagtttaataagatgaatctaagaaatttatgcatcgtgttttccccaactctaaatattccaattagtatgcttcaaccattcatcactgactttgcgtgtatatttcagggtggtgaaccagttaaagaagaggaaagggagaaagtagatatacatattcctcaggtttga

SEQ ID NO: 46172 - DNA, 1191 bp, Saccharomyces cerevisiae
atgattacttcaattgacatagcagatgtaacttattctgccaaaccaagaattttggtgccttataaaacccaatgggaagtcgccagtcatcttcctgaatatcgcaaactggcagaaagggtagaattctataaatatgagatgtccacaaaggatgattttgttaaatttttggaaactcatagaataaacggcttttggctcactgaggagtttttcactgtgttaggaaacccttcgagttatattgaattcttccccgcatctttaaaagtaatccttgtaccatgggtcggctgtgactttattgacggtaagttattaagatcgaaaggtatcactttatgcaacattggaccacatgctgctgaccatgtcacagaattggctattttcctagcaattagctgctttagaatgacttcattttgggaatattgttttaaatacgtggaaaatggtaatgttgaacagtgtaagaaatatatctctagtgactcgtatgaaattgttacagatagttaccacggtcaggaaatgaaatttccctctcgaacagacaaatgcaagcctaacaaggataggaaagtggtacatttagcagaaaagtacacggttggcgggaaaaaaatggaatctccaatgaataaaaaagttctaatattggggtttggctccatcggacaaaatatagggtctaacttgcacaaagtgttcaacatgagcattgaatactacaaaaggaccggtcccgtccaaaagagtctacttgattacaacgctaagtaccattctgatctagatgatccaaatacttggaagaatgcggatttgatcattttggccttgcccagtacggcctctacaaacaatattatcaatcgtaaaagtttggcctggtgtaaagatggtgtcaggatagttaacgttgggagaggcacatgcatagatgaagatgtgctactagacgctcttgaatctggaaaagtggcaagctgtggtctcgatgtgtttaaaaatgaggaaacacgcgttaagcaagagttacttcgcagatgggatgttacagctttgccacatatcggcagcacagttgccgacatggtcataaagcagacactcatcacactcgagaatgtgcaggacatatttgtcgagggaggtgatggtaagtatgtgctcaactga

SEQ ID NO: 46173 - DNA, 1185 bp, Saccharomyces cerevisiae
atgagtcagtttggcacgacagatatcgtttccggttcagaaacaccaccttattctggggcaagttaccaggacgcccaggatgacaatacccatccacattcatcagacgccggtgcagagaagttcagtgcaggcagtggaagcgagtcgcatactgaatcctcgagaagtgatgatgaggattctcaagcaaaaacaaagatggtggataatattaccatcttaaaatatatattggattctctatctggtagagacaaattagccaaaattatcaaatacgctctggatatattaaaactgtttatcgaaaagtctaagcgaaatttaactgttttggacccttccgtattaacgtactataccaagattttgaaaaatctgactgtaaaagtcgcactaaggcatccaatcacggtaattaaagtacttctcctgtctcttttgagaaattttgacaagaaaattgattttatcagtcaacaattaagtacttttagatatattttaaggtttggcggcacaccattccgagtgtgcagtttcttggggaaattcaataaaaccagaaagtgcaactttcaaattgaccaaattaagaaaatatggtttaatgaagcttcattgagagaatttttggacttgtattatggtatctttgatgaattagacttgctatacaaattgaaaatatggacaaataaatcattctattcctttgtcagtagacaagagtctcttgcatggcaatacgacattcttttaagcttgaaggaccattggctcaacctgcaaagcttacagaagagacaattagaattggaagtgcaactaaaagttcaaaataacgcgttactactctcacccatactgatgcatcaggcccataaagacgatggctcacaatcgccaattaggaaacagttgttaaatgacctaaatgttaataacgacgcagaggtgttaatacacaaacaactaaaggccatcaaggatgaaaagacacttgtttatttagatattgcaagattatcgtttgattgcatggctaatacatcagatattctaaatttaaaaactccaaagggaacgtatgccgttctgtccctgggatccggcttaactggactggttaaactttggataacaacaaagaggtcactttgctcttcaaaagattga

SEQ ID NO: 46174 - DNA, 1002 bp, Saccharomyces cerevisiae
atggaaacaggacctcattacaactactacaaaaatcgcgaattgtccatcgttctggctccattcagcggcggtcagggtaagcttggtgtcgagaagggccctaaatacatgcttaagcatggtctgcaaacaagcatagaggatttgggctggtctacggaattagagccctcaatggacgaggcccaatttgtgggaaagttgaaaatggagaaggactccacaactgggggttcctctgttatgatagacggtgtcaaggctaaaagagcagatttggttggtgaagccaccaagttggtgtacaactccgtgtcgaaagtggtccaggcgaacagattccccttgaccttgggtggtgatcattcaatagccattggtactgtatccgcggttttggacaaataccccgatgctggtcttttatggatagacgcccacgctgatataaacaccatagaaagcaccccctctggaaacttgcacggctgtcccgtgtcattcctaatgggtttgaacaaggatgtcccacattgtcccgagtcgctcaaatgggttccaggcaacttgagcccaaaaaagatcgcgtatattgggttgagagatgttgatgccggagaaaagaaaatcttgaaagatctgggtatcgccgccttttccatgtaccacgttgacaaatacggcatcaacgctgtcattgaaatggcaatgaaagccgtgcacccagaaacaaacggtgaaggtcccattatgtgctcctatgacgtcgatggtgtagacccattatacattcctgctacaggtactccagtgagaggtgggttgaccttgagagaaggtcttttcttggtggaaagattggccgaatccggtaatttaattgcgctagacgttgttgaatgtaaccctgatctggctattcatgatatccatgtttcaaacaccatctctgcaggttgcgccattgcaaggtgtgcattgggtgaaaccttattgtag

SEQ ID NO: 46175 - DNA, 3672 bp, Saccharomyces cerevisiae
atgaagttcggaaaaacctttgccaatcatcgcattccagagtggtcaagtcaatatgttggctacaagtcgttgaagaaaatgattaaagaaattacaagacttcaagaagacatatatagggcacataacaagaatagctatgatgaaggcaggccaccaacaaaaatgagagattcatctaatagtgctcaaaattatttggactctccaaaaatccaaaagttattggcgtcgtttttctttgcagttgacagggatattgagaaggttgatacattttacaattcccagtatgcggaatataagaaaagatttgagagattgctttcttctaatcaattcaatgagataaaatcaacattagtggtcgatgccaacaaagaagatgcagtagcgcaaaccttactcacaaaggatacgagagagatgaatatgcttttaaagggaacaagtcaagccagccgtctatcttaccataaagatgacttaattgaaattcagtctatcttagctgagttaagaaaacaatttagaaacttaaagtggtacgctgaactaaataagagagcttttggtaagattttaaagaaactggataaaaaagtcggcacaaatcagcaaatgtcaactatgaaaactagaatcttgccgttacaatttgctaatgattctcttattaccaaagatttgagtttgctaaaaactatctgggaacaagtgacgttcaggataaattcttacgagagagtaatgaggagtacctcgccgaacgcaaatgctaatgataatacagaattctttaagattatttgcgtttttatagaagaagatgatagcaaaggattgattagagagctaacaaacctatattcggaattgtctttgattccaacaagaattatgataagtgttttaaacaaggcagcactgtctaaatcactggcatgtattgatgctatcttaaaggttattccgtctctaaatgactcggaagatattaacagaagaaattttttccatcatcacataattgcaatcgggaagttaatcagaaaacaggaaattttaagtaggaaaaagaagtcacaaccctcaaaatatactaatagtgagggagaaattgtaacagatttaagaaccctgcatacgaccctatctgccccggcagaatcagatagcattacagaggaggaaaaaagttcggcctgtacactctcttatattttagaggagttaccaattcatttaagaccatgcctttttcagcatgataattacaagagaacgcccttgcattattcttgccagtatggcttatctgaagttacgaagttgattatcaagttaatgaaagaatggaatatctggaatgaaatccctattgatgacgtttccgcgttcggagatgccgaatcattgacacctttacatttatgtgtgttgggtgctcatcccaaaacaacagaagtcttattgcaatctttggatccgaacgtgaaattaaaaagttcaagtttgttacatttggccactgagtggaataactatccccttttacatgttctcctatcatcaaaaaggtttgatattaattatcaagacaacgaattacatgaaacaccgctatatcttgcttgtagattaaattttttcgaagctgctgtgtgtttgttgtacaatggagccgaccttgaaataagagaaaaactttttggctggacagctatcttcgttgcagcagcagaagggtttacggacattgtaaagctcttgatagccaacaacgcgaactttgatattgaagatgaaggtgggtggacgccgatggagcacgcggtattgcgcggtcatttgcacattgctgatatggttcaaatcagagacgaactggtcacgcatccccattcacagttgaacagtggtagcgaagagaaagaaccactaaacgaaattagtgccggagaattaaatgagagaaatgaaaatggaaacggaggtaataaagggtccttgggaaaactggccggaccaataaagtcatatggacacagattcctggataataatgaatcacttatactaataacattgggaagtaatgacacaagaaacaaaagcccttcaatttcattaagctcggaagcactagcaaaagttattgggttggaaacagattgtgcattatcgttagtaatttcatgcaatgattcaattgataaatcttctgtaatcttagatttaccattagatgataatgtggacgcagtagacttcaaagtgcctttcaaagttgattattctcatacattatattttgatattgtgccaacatatggaacacgctcgttggagacccataatagaatagattgtcaaaaaaataacaataattacgtaatggcaaggggtgtttccatgttgaataagtcgtacagctcagtgggagttaatagaagtatattaaatggtagcgtgacggtccccatcatcgctaatcatacactggagatacttgggacgctgaaatttgaatatattattatcacaccatttgaacatccacaactgcccttagaaagaacagaaacgtactggaaatccttagtgtccactcgtgttataggacatagaggcctgggtaaaaataatcctaataaatcattacaaattggagagaacacagtcgagtctttcatcatggcagcctcattgggagcatcgtatgtagagtttgatgttcagttgacgaaggataacgtaccagtggtatatcacgattttctcgtagctgaaacaggtgtcgatatccccatgcatgaattgacgctggaacagtttttagatttgaacaatgccgataaagagcacattcaacgtggagcaggtcactcacctcatcatgtaaatggagcagatacagcactacaaaaatatagagggcgttcggtagatgattcagacgttagtacattgaggagagcttgggatttacacgacaacgacccgaatgggaagtccaacaatgctcattggtctgacaatcgaatgaggctaaccaaaacatttaaaaagaacaattttaagggaaacgctagaggacattcaatagcttcatcatttgttaccttgaaagaactattcaagaaaatccctgccaacgttgggtttaacatagaatgtaagtttcccatgcttgatgaggcagaagaggaagagttagggcaaataatgatggaaatgaaccattgggttgacaccgtgttaaaagtagtttttgacaatgcgaatggtagggacatcattttttcgtcatttcatccggatatttgcatcatgctttcgttaaagcaaccggttattccgatcttgttcctgacggaaggtggaagtgaacagatggccgatttgagagcctcatcgttacaaaacggtataagatttgctaagaagtggaatttattggggattgtatctgctgcagcacccattttaaaggccccacggttggtgcaagtggttaagtctaatgggctggtatgtgtcacttacggtgtggacaacaatgatcccgaaaatgccagtatacaaattgaagcaggtgtagatgccgtgatcgtcgatagtgtattggcaattagacgtgggttaaccaaaaagaatgaaaagtaa

SEQ ID NO: 46176 - DNA, 1632 bp, Saccharomyces cerevisiae
atgggcctctacgtttcctcagaaaacgaattgcaggaaaagcttaaatctttcaggtctgctaagatcactgaatcacgaaataaattaataagatatctaagaatcttttggttcggttttaatgataatattgttgagcctgtatgcacgattttaaggtttttagaaatttcagctatttttttacctcttctcctattataccccatatcatggtttggtcataaactcaaaattacggacaccaatataactgaaactcgaggttcattgatttggtgtcaactactgcgtaaagcattggaattggctggcccgagtttcattaaactcggacaatgggcaggatcgagaaccgatatattctctcacgcactgtgtcatgagttgggtaaattgcatagtaacgttacagctcactctctaagctttactctggaaaaactttctcaagcattaaaggttgacaagatcgaagatgcttttgatgaatttaatcgaacaccaattggagttgggtccatcgcacaagtttacgtgggtgaactatcccaaaagtacatcgataaatatgacaatatacaaattggtaaggatggaaatcgttggtgtgccatcaagatcttgcatccaaatgtaagatctcagatccggagagatttgaaaataatgaaattctgtgctgacgcaataaattggattccgactatggaatggctgtctttacccagcgaagtcgatcagttttccatattaatgaatattcagttggatctaagaattgaggcgttaaacctggaaagattcaatgagaactttaaaaattctattcaggtgaaatttcctaaaccatttctccccttgtcaaatagggatgttatgttcgaagagcatgtatatggtctttccatggaaaagtttttatctacgaagaagcaaattaacgacgttgaactttgtaaaaaagtcagtgatcccttcgttgacgcgtttctacaaatgctaattcttgatgattttgttcatgctgatttgcatccaggcaatgttataatcagatttgtgaagacgaacaaatacggcacaaacattatatcctccgaacttgaatcgtacagaataacgcacgacctgaggaagaagatagaggaggaccaagatcaggactttgttggaaaactgaagtctgtattaactaattacactccccaaatttgttttatcgatacaggaataattacagaattgaatgaaaaaaacagaattaatttcatagctctattcaacgcattggcccgatttgatggttatagagctggtgagttgatgattgagagatcaagaactccagaaacagctattgataaggaagtatttgcgtttaaggtagaaaagctagtggataaagttaaacaaagaacatttacattgggaaccgtctcaattggcgatttactcgatcaaatgcttagtatggtaaggtcgcaccatgttagaatggagtccgactttgtttccgtggtggtcgctattttacttctagagggtattggacgccagttagatccaaacttggacttatttgaaaggttcgtattttacgcatggattaacggttttaaagaataa

SEQ ID NO: 46177 - DNA, 2082 bp, Saccharomyces cerevisiae
atgagtactccatttggtttagatttaggtaacaataactctgtccttgccgttgctagaaacagaggtatcgacattgtcgttaatgaagtctctaaccgttccaccccatctgttgttggttttggtccaaagaacagatacttgggtgaaactggtaagaacaagcagacttccaacatcaagaacactgtcgccaacttgaaaagaattattggtttggattaccaccatccagatttcgagcaagaatctaagcacttcacctctaagttggttgaattggatgacaagaagactggtgccgaagttagattcgctggtgagaaacatgttttttcagctactcaactagctgccatgttcatcgacaaagtcaaggacaccgtcaagcaggacacaaaggcaaatattaccgatgtttgtattgctgtcccaccttggtacaccgaagaacaacgttacaacattgctgatgctgctagaattgctggtttgaaccctgttagaattgtcaacgacgttactgctgccggtgtttcttacggtatcttcaagactgatttgcctgaaggcgaagaaaagccaagaattgttgcctttgttgatattggtcactcttcctacacctgttctatcatggccttcaagaagggtcaattgaaagtcttaggaactgcctgcgacaagcattttggtggtagggacttcgatttggctataacagaacatttcgccgatgagttcaaaactaaatacaagattgacatcagagaaaatccaaaggcttacaacagaattctaactgctgctgaaaagttgaagaaagttttgtctgctaatactaatgccccattctctgttgaatccgtcatgaacgacgttgatgtttcctctcaattatctcgtgaagaattagaagaattggtcaagccattgttggaacgtgttactgaaccagttaccaaagctttagctcaagccaaattatctgctgaagaagttgattttgttgaaattattggtggtactactcgtatcccaacattgaaacaatccatttctgaagccttcggcaagccattgtccaccactttgaaccaagatgaagccatcgccaagggtgccgcctttatttgcgccattcactctccaactctaagagttagaccattcaagtttgaggatatccatccttactctgtctcttactcttgggacaagcaagttgaggacgaagaccacatggaagttttcccagctggttcatccttcccatctactaaattgatcactttgaaccgtacgggtgacttttcaatggctgctagctacactgacatcacacagttaccaccaaacactccagaacaaatcgctaactgggagatcactggtgttcaattaccagaaggtcaagactctgttcctgttaagttaaagttgagatgcgacccctctggtttacacacaattgaagaggcttacactattgaagatattgaagttgaagaacctattccattaccagaagatgctccagaagatgctgagcaagaatttaagaaggttactaaaactgtaaagaaggatgacttaaccatcgttgcacacacctttggcctagacgctaaaaagttgaatgaattaattgaaaaagaaaatgaaatgcttgctcaagataagctagttgctgagacagaagaccgtaagaacactcttgaagagtacatctacacattgcgtggtaagttggaagaagagtatgctccatttgcttccgatgctgaaaagacgaagttacaaggtatgttaaacaaggccgaagagtggttatacgatgaaggtttcgattccatcaaagctaagtacattgccaaatacgaagaattggcttctctaggtaacattattagaggtagatacttggctaaagaagaagaaaagaagcaagctataagatctaagcaagaagcatcccaaatggctgctatggctgaaaagttggctgctcaaagaaaggcagaagctgaaaagaaggaagaaaagaaggacactgaaggtgatgttgacatggactaa

SEQ ID NO: 46178 - DNA, 1452 bp, Saccharomyces cerevisiae
atgctttctgcaaccaaacaaacatttagaagtctacagataagaactatgtccacgaacaccaagcattacgattacctcgtcatcgggggtggctcagggggtgttgcttccgcaagaagagctgcatcttatggtgcgaagacattactagttgaagctaaggctcttggtggtacctgtgttaacgtgggttgtgttccgaagaaagtcatgtggtatgcttctgacctcgctactagagtatcccatgcaaatgaatatggattatatcagaatcttccattagataaagagcatttgacttttaattggccagaatttaagcagaaaagggatgcttatgtccataggttgaacggtatataccagaagaatttagaaaaagaaaaagtggatgttgtatttggatgggctagattcaataaggacggtaatgttgaagttcagaaaagggataatactactgaagtttactccgctaaccatattttagttgcgaccggtggaaaggctattttccccgaaaacattccaggtttcgaattaggtactgattctgatgggttctttagattggaagaacaacctaagaaagttgttgttgttggcgctggttatattggtattgagctagcaggtgtgttccatgggctgggatccgaaacgcacttggtaattagaggtgaaactgtcttgagaaaatttgatgaatgcatccagaacactattactgaccattacgtaaaggaaggcatcaacgttcataaactatccaaaattgttaaggtggagaaaaatgtagaaactgacaaactgaaaatacatatgaatgactcaaagtccatcgatgacgttgacgaattaatttggacaattggacgtaaatcccatctaggtatgggttcagaaaatgtaggtataaagctgaactctcatgaccaaataattgctgatgaatatcagaacaccaatgttccaaacatttattctctaggtgacgttgttggaaaagttgaattgacacctgtcgctattgcagcgggcagaaagctgtctaatagactgtttggtccagagaaattccgtaatgacaaactagattacgagaacgtccccagcgtaattttctcacatcctgaagccggttccattggtatttctgagaaggaagccattgaaaagtacggtaaggagaatataaaggtctacaattccaaatttaccgccatgtactatgctatgttgagtgagaaatcacccacaagatataaaattgtttgtgcgggaccaaatgaaaaggttgtcggtctgcacattgttggtgattcctctgcagaaatcttgcaagggttcggtgttgctataaagatgggtgccactaaggctgatttcgataattgtgttgctattcatccgactagcgcagaagaattggttactatgagatga

SEQ ID NO: 46179 - DNA, 735 bp, Saccharomyces cerevisiae
atgagcatgagtatgggtgtccgtggcctagcgttaaggtccgtttctaaaacattatttagccaaggtgttcgttgtccttcgatggtgattggagcccgttatatgtcttccactccagaaaaacagacagatccaaaagcaaaggctaactctatcatcaatgccattccaggtaataatattttgacaaagacgggggttttggggacttctgctgccgctgtcatttatgccatttccaatgaattgtacgttatcaacgatgaaagtattttattgctgacttttttgggtttcactggtttagtggcaaagtatttggcgccagcatataaagattttgccgatgcaagaatgaagaaagtctccgacgttttaaatgcctcgagaaacaagcatgtcgaagctgttaaagatagaatcgactctgtctctcaactacaaaatgttgctgaaactacaaaggttttgtttgatgtttccaaggaaactgttgaacttgaaagcgaagcctttgaattgaaacaaaaggtagaattagctcacgaagcaaaggcagtcttagattcgtgggttagatatgaagcttccttgcgtcaattggaacaaaggcaactagcaaaatctgtcatctccagagttcagtcagaattgggtaatccaaaattccaagagaaagttttgcaacagtctatatctgaaattgaacaattgctttctaaattgaagtaa

SEQ ID NO: 46180 - DNA, 1500 bp, Saccharomyces cerevisiae
atgtcttggataaaaaatgtaacagaatctccgacttcactgattaaaaaagtttcatgtggtttgataattgctgcttctctatatgccattgcacccagcctaagtgcgctagtctttggggattctaagcagagtattgggaagtacacgacagtgggcttaattaatcgtgggaatgattgcttcataacatcatctttgcaaggcctggctggaatacctcgatttgtagaatatttgaaacggataagaacggtccttctagaattagaaactaagctgtcaaataatgcaaaaggcgacaatcctacagttgataacactacaaggcatagtcgacttgaaaactcgtctaattcacttgcccccttacacgaaagtcttaccagtttaattttggatttgatatctgtaaaagatcgtaagacgtcaatttctccgaaaatagtgataaacacattagagtccatctttaaatcaaagatctcatccaaacaaaatgatgcacatgaatttacattaatattactacaaacattacaggaagaacgatcaaaattgatcgattacagtaaacagatatgtaatttgaatataccaaagtttccatttgagggcgagacttccaagtttctagtatgccttaaatgcaagggtctatcagaaccatcatacaaacagactttcatccgcgaactgtccgtaccacaacaaacatcagagaatctatccaatattctagcacacgatgaaacagaaatcatagacgactattcatgcctgatctgccaaataagagcaatcttaaaccatgaagaatatagaaatttcaaggactgtaccccggatgaaattttaatgttggacagattgaaaaattatgccactaaagccccaattaacgaaaatttaccattcgaagtagaacagtacgtcaagcgttactcaaagggcaatttgcaggtatctaatataaagggaaaggtcatcaaaaaagatgtagtagtacaactgccagacatattaattgttcacttatcgagatccacattcaatggtattacatattctagaaatccctgcaatgtcaaatttggagaaagaataacactttctgaatatacattggctgagagtgggacaataacagaaaacaggcaagtcaaatataatttgaaaagtgttgtgaaacacaccggttctcattcgagtggacactatatgtgttacagacgcaagactgaaattcgtttcgggaaggaggatgaatcttccttcagaagagcaccagttgtcaacaatgaagttaacaagaatcgcgagcaaaacgttgcacataatgattacaaaaaaagcagatataaaaaagtcaaaaacgccctgcggtatccttattggcaaatatctgataccgccataaaggaatctaccgcttcaactgtcttgaatgaacagaaatatgcttatatgctatactacgaacgtgtaaataaataa

SEQ ID NO: 46181 - DNA, 1008 bp, Saccharomyces cerevisiae
atggaggccaagatagatgagctgatcaataatgatcctgtttggtccagccaaaatgaaagcttgatttcaaaaccttataatcacatccttttgaaacctggcaagaactttagactaaatttaatagttcaaattaacagagttatgaatttgcccaaagaccagctggccatagtttcgcaaattgttgagctcttgcataattccagccttttaatcgacgatatagaagataatgctcccttgagaaggggacagaccacttctcacttaatcttcggtgtaccctccactataaacaccgcaaattatatgtatttcagagccatgcaacttgtatcgcagctaaccacaaaagagcctttgtatcataatttgattacgattttcaacgaagaattgatcaatctacataggggacaaggcttggatatatactggagagactttctgcctgaaatcatacctactcaggagatgtatttgaatatggttatgaataaaacaggcggccttttcagattaacgttgagactcatggaagcgctgtctccttcctcacaccacggccattcgttggttcctttcataaatcttctgggtattatttatcagattagagatgattacttgaatttgaaagatttccaaatgtccagcgaaaaaggctttgctgaggacattacagaggggaagttatcttttcccatcgtccacgcccttaacttcactaaaacgaaaggtcaaactgagcaacacaatgaaattctaagaattctcctgttgaggacaagtgataaagatataaaactaaagctgattcaaatactggaattcgacaccaattcattggcctacaccaaaaattttattaatcaattagtgaatatgataaaaaatgataatgaaaataagtatttacctgatttggcttcgcattccgacaccgccaccaatttacatgacgaattgttatatataatagaccacttatccgaattgtga

SEQ ID NO: 46182 - DNA, 1503 bp, Saccharomyces cerevisiae
atgactaagctacactttgacactgctgaaccagtcaagatcacacttccaaatggtttgacatacgagcaaccaaccggtctattcattaacaacaagtttatgaaagctcaagacggtaagacctatcccgtcgaagatccttccactgaaaacaccgtttgtgaggtctcttctgccaccactgaagatgttgaatatgctatcgaatgtgccgaccgtgctttccacgacactgaatgggctacccaagacccaagagaaagaggccgtctactaagtaagttggctgacgaattggaaagccaaattgacttggtttcttccattgaagctttggacaatggtaaaactttggccttagcccgtggggatgttaccattgcaatcaactgtctaagagatgctgctgcctatgccgacaaagtcaacggtagaacaatcaacaccggtgacggctacatgaacttcaccaccttagagccaatcggtgtctgtggtcaaattattccatggaactttccaataatgatgttggcttggaagatcgccccagcattggccatgggtaacgtctgtatcttgaaacccgctgctgtcacacctttaaatgccctatactttgcttctttatgtaagaaggttggtattccagctggtgtcgtcaacatcgttccaggtcctggtagaactgttggtgctgctttgaccaacgacccaagaatcagaaagctggcttttaccggttctacagaagtcggtaagagtgttgctgtcgactcttctgaatctaacttgaagaaaatcactttggaactaggtggtaagtccgcccatttggtctttgacgatgctaacattaagaagactttaccaaatctagtaaacggtattttcaagaacgctggtcaaatttgttcctctggttctagaatttacgttcaagaaggtatttacgacgaactattggctgctttcaaggcttacttggaaaccgaaatcaaagttggtaatccatttgacaaggctaacttccaaggtgctatcactaaccgtcaacaattcgacacaattatgaactacatcgatatcggtaagaaagaaggcgccaagatcttaactggtggcgaaaaagttggtgacaagggttacttcatcagaccaaccgttttctacgatgttaatgaagacatgagaattgttaaggaagaaatttttggaccagttgtcactgtcgcaaagttcaagactttagaagaaggtgtcgaaatggctaacagctctgaattcggtctaggttctggtatcgaaacagaatctttgagcacaggtttgaaggtggccaagatgttgaaggccggtaccgtctggatcaacacatacaacgattttgactccagagttccattcggtggtgttaagcaatctggttacggtagagaaatgggtgaagaagtctaccatgcatacactgaagtaaaagctgtcagaattaagttgtaa

SEQ ID NO: 46183 - DNA, 4536 bp, Saccharomyces cerevisiae
atgtcttcgactgacgaacatattgagaaagacatttcgtcgagatcgaaccatgacgatgattatgctaattcggtacaatcctacgctgcctccgaaggccaagttgataatgaggatttggcagccacttctcagctatcccgtcacctttcaaacattctttccaatgaagaaggtattgaaaggttggagtctatggcgagagtcatttcacataagacaaagaaggaaatggactcttttgaaattaatgacttagattttgatttgcgctcactattacattatttgaggtctcgtcaattggaacagggaattgaacctggtgattctggtattgcctttaaaaacctaacagcagtcggtgttgatgcctctgctgcatatgggcctagtgttgaagagatgtttagaaatattgctagtataccggcacatctcataagtaaatttaccaagaaatctgatgtcccattaaggaatattattcaaaattgtacgggtgtcgttgaatctggtgaaatgttatttgtcgtcggtaggccaggtgcaggttgctccactttcctaaagtgtctatctggtgaaacttcagaattagttgatgtacaaggtgaattctcctatgatggtctggaccaaagcgaaatgatgtctaagtataaaggttacgttatttactgtcccgagcttgatttccatttcccaaaaattactgtgaaggaaacaatcgattttgccctaaaatgtaagactcctcgtgttagaattgacaaaatgacgagaaagcaatacgttgataacatcagagatatgtggtgtaccgtttttggtttaagacacacatatgccaccaaagtcggtaacgatttcgtaagaggtgtttctggtggtgaacgtaagcgtgtttccttggttgaagctcaggcaatgaatgcctccatctactcttgggataacgccacaagaggtttggatgcctctactgctttagagtttgcccaagccattagaacggctacaaatatggtaaacaactctgctattgttgctatttaccaagctggtgaaaatatttatgaattatttgataaaactactgttctatataacggtagacagatttacttcggtcctgctgataaagctgttggatatttccaaagaatgggttgggttaaaccaaacagaatgacctctgcggaatttttaacatccgtcacggtcgattttgaaaataggacattggatattaaacctggctatgaagataaagttccaaaatctagttcagagtttgaggaatactggttgaactctgaggattatcaggaacttttaagaacttatgatgattatcaaagtagacaccctgttaatgaaacgagagatagactggatgtggccaagaagcaaagactgcaacaaggccaaagagaaaattctcaatatgttgtcaattattggacacaagtttattattgtatgattcgtggttttcaaagggttaagggtgattcaacgtatactaaggtctacttaagttcttttttgatcaaagctttgattatcggttctatgttccacaaaattgatgacaaaagtcaatccaccacggcaggtgcttattctcgtggtggtatgttattctatgttttattgttcgcttctgttacttccttggccgaaattggtaactctttttctagtagacctgttattgtcaaacacaaatcatattccatgtaccatttgtctgcggaatcgttacaagagattatcactgagttccctactaaatttgtcgctattgtgatactatgtttgattacttactggattccatttatgaaatatgaagctggtgctttcttccagtatattttatatctactgactgtgcaacaatgtacttctttcattttcaagtttgttgctactatgagtaaatctggtgtggatgcccatgccgtcggtggtttatgggtcctgatgctttgtgtttatgctggttttgtcttgccaattggtgaaatgcatcattggattagatggcttcatttcattaatcctttaacttatgcttttgaaagtttagtttccactgaatttcaccacagggaaatgttgtgtagcgccttagtcccatctggtcctggttatgaaggtatttctattgctaaccaagtctgtgatgctgctggtgcggttaagggtaacttgtatgttagcggtgactcttacatcttacaccaatatcatttcgcatataagcatgcttggagaaattggggtgtgaacattgtgtggacttttggttatattgtgttcaatgtcatcttatcagaatatttgaaacctgttgagggaggaggtgacttgctgttatataagagaggtcatatgccggagttaggtaccgaaaatgcagatgcaagaaccgcttccagagaggaaatgatggaggctctgaatggtccaaatgtcgatttagaaaaggtcattgcagaaaaggacgttttcacctggaaccatctggactacaccattccatacgacggagctacaagaaaattattatcggatgtctttggttacgttaagcctggtaagatgaccgccttgatgggtgaatccggtgctggtaaaactaccttgttaaatgttttagcacaaagaatcaatatgggtgtcatcactggtgatatgttagtcaatgccaagcccttgcctgcttctttcaacagatcatgtggttatgttgcgcaagccgataatcatatggccgaattatctgttagggaatccctgagatttgcagccgagttaagacagcaaagttccgttccgttagaggagaaatatgaatatgttgaaaaaattatcacattgctaggtatgcaaaattacgctgaagccttagttggtaagactggtagaggtttgaacgttgaacagagaaagaagttatctattggtgttgaactggttgctaaaccatcattattattgtttttggatgagcctacctctggtctggactctcagtctgcttggtcaattgttcaattcatgagagccttagctgattctggtcaatccattttgtgtacgattcatcaaccctctgctaccttgtttgaacagtttgacagattgttgttgttaaagaaaggtggtaagatggtttactttggtgacattggtccaaattctgaaactttgttgaagtattttgaacgtcaatctggtatgaagtgtggtgtttctgaaaatccagctgaatatattttgaattgtattggtgccggtgccactgctagtgttaactctgattggcacgacttatggcttgcttccccagaatgtgccgctgcaagggctgaagttgaagaattacatcgtactttacctggtagagcagttaatgatgatcctgagttagctacaagatttgctgccagttacatgactcaaatcaaatgtgttttacgtagaacagctcttcaattttggagatcgcctgtctatatcagggccaaattctttgaatgtgtcgcatgtgctttgttcgtcggtttatcatatgttggtgtaaatcactctgttggtggtgccattgaggccttttcgtctattttcatgctattattgattgctctggctatgatcaatcaactgcacgtcttcgcttatgatagtagggaattatatgaggttagagaagccgcttctaacactttccattggagtgtcttgttattatgtcatgctgctgttgaaaacttttggtccacactttgtcagtttatgtgtttcatttgctactactggccagctcaattcagtggacgtgcatctcatgcaggtttcttcttcttcttctatgttttaattttcccattatattttgtcacatatggtctatggatcctgtacatgtctcctgatgttccctcagcttctatgattaattccaatttgtttgctgctatgttactgttctgtggtattttacaaccaagagagaaaatgcctgccttctggagaagattgatgtataatgtatcaccatttacctacgtggttcaagctttggttacaccattagttcacaataaaaaggtcgtttgtaatcctcatgaatacaacatcatggacccaccaagcggaaaaacttgtggtgagtttttatctacctatatggacaataataccggttatttggtaaatccaactgccaccgaaaactgtcaatattgcccatacactgttcaagatcaagttgtggctaaatacaatgtcaaatgggatcacagatggagaaactttggtttcatgtgggcttatatttgcttcaatattgccgctatgttgatttgttactatgttgtaagagttaaggtgtggtctttgaagtctgttttgaatttcaagaaatggtttaatgggccaagaaaggaaagacatgaaaaagataccaacattttccaaacagttccaggtgacgaaaataaaatcacgaagaaataa

SEQ ID NO: 46184 - DNA, 1149 bp, Saccharomyces cerevisiae
atgagaaaagaattaaaataccttatctgcttcaacatactcctcctgttatctataatatactacactttcgatttgctaacgttgtgtattgacgatactgttaaagatgctatacttgaggaagacttaaatccagatgcacctccaaagcctcaactaatacctaaaatcatacatcagacttataaaacggaagacatccctgagcactggaaagagggtagacaaaaatgtctcgatctacatccagattacaagtacatcctatggacggacgagatggcctatgagtttataaaggaagaatacccgtggtttctcgatacttttgagaactacaaataccccatagaacgtgccgatgccattcgttactttatcctgtcccattatggtggtgtatacatcgatttagatgacggctgcgaaaggaaactagatcctttgttagctttcccggccttcttaagaaagacttcacctttaggtgtctcaaacgatgtcatgggttctgtgcctagacatcccttctttttaaaggctttaaagtctttgaaacactatgacaagtactggtttatcccttacatgactattatggggtctactggtccgttgtttttaagtgttatttggaagcagtacaaaagatggcgcatacctaagaacgggacagtaagaatcctacaacctgcttactacaagatgcatagttattcatttttctccattactaaaggctcttcatggcatttagatgatgcaaaattgatgaaagcactagaaaaccacatcttatcctgcgtcgttaccggatttatttttggcttctttatcctatatggtgaattcacgttctattgctggttgtgttccaagaatttcagtaatctaaccaaaaattggaaacttaatgctataaaagtaagatttgtcacaattctaaattcattaggcttaagactaaagttgagtaaaagtaccagtgatactgccagtgccactttgctggcaaggcagcagaaacgattgaggaaagattccaatacaaacatagtgttactaaaatcttcaaggaaaagtgatgtttacgatttagaaaagaatgattcttctaagtactcactgggaaataacagctcgtaa

SEQ ID NO: 46185 - DNA, 1341 bp, Saccharomyces cerevisiae
atgcacgtactgctgagcaaaaaaatagcacgctttctgttgatttcgtttgttttcgtgcttgcgctaatggtgacaataaatcatccaaaaacaaagcagatgtctgaacagtatgttacaccataccttccgaaatctttgcaacctattgcaaaaattagtgcagaggaacaaaggcgtatacaaagtgaacaggaagaagccgaattgaagcaatctttagagggagaggccattagaaatgccaccgtgaatgccattaaggaaaagatcaaatcttatggtggtaatgaaacgacgctagggttcatggtgccatcgtatatcaatcatagaggatcaccaccaaaggcgtgctttgtctcactaattactgaaagggattccatgacccaaatcttacaatctattgatgaagtgcaggtgaagtttaacaaaaattttgcttatccttgggtttttattagtcagggggagcttgacggaatgaagcaagaaatgattcgtcaagccataactgattctatgaatggtgatcctgagttaattaatattaaatttgctgaaattcctgcagacgaatgggtataccctgaatggattgatgaaaataaagcagcagaatcgctaatttcattagcaaatgtaccggatggtgattctagagctgtaagatatcaagctagatattttgcagggtttttttggaggcatccagttctggatgagtttgattggtactggagagtagaccctggtattaaattgtactgtgatattgatcatgacctttttaggtggatgcaagatgaaggcaaagtgtttggtttcacattgagtatgagtgaagctaaggaagccaatgagaagatttgggatgttacgaaaaaatttgcaaaggattttccaaagtttatttccgagaataatttcaagtcatttattacaaaaaaggactctgaagattttaacaactgtgaattcacatcaaattttgaaattggtaatttgaacttttatagatcgccagcttacaggaaattttttaattacatcgacgaagagggcggtattttctactggaaatggtctgattccatcatccacacaattgggttatcgatgctgttgccaaaggataaaatacattttttcgaaaatataggattccattatgacaagtacaataactgtcccctaaacgatgatatatggaaccaatataattgtaactgtgaccagggtaacgatttcacgtttagaagtggttcatgtggcggacattacttcgacattatgaagaaagataagccagaaggttgggataggttaccataa

SEQ ID NO: 46186 - DNA, 597 bp, Saccharomyces cerevisiae
atgtttcatttagtcaagggactttacaataattggaataaaaaggaacaatattcaattctaatattaggtctagacaatgcaggcaaaacgacgttcttggagacattgaaaaaggaatactctctggcgttcaaagccttggaaaagatacagcctacggtaggacaaaatgtggcgacaatacccgttgacagtaaacagatcttgaagttttgggatgtaggtggtcaagaatcactgagatcaatgtggtccgaatactattccctatgtcatggtataattttcattgtggatagttcagatagagaacgattagacgaatgttccacgaccctacagtcagttgtaatggatgaagaaattgaaggtgtacccatcttgatgctggccaataaacaagatagacaagatagaatggaagtacaagatataaaagaagtatttaataagattgcggaacatataagcgctagagatagtagggttttaccaataagcgcattgactggagaaggtgttaaagacgctatagaatggatgattgttagactagaaaggaataaaaagtcaagaccaccgatttataaatga

SEQ ID NO: 46187 - DNA, 1668 bp, Saccharomyces cerevisiae
atgtataatggcaaggatagagcacaaaactcctatcagccaatgtaccaaaggcctatgcaggtacaaggacaacagcaagctcaatcgttcgttggaaagaaaaacacaatcggaagtgtgcatggaaaagccccgatgctaatggccaataatgatgtttttactattggaccttatagggcaagaaaagatagaatgcgggtatctgtcttagaaaagtacgaagttattggctacattgctgcgggcacatatggtaaagtttacaaagcgaaaagacaaatcaactccggtaccaattccgctaatggttctagtctgaatggtaccaatgcgaaaattccgcagtttgacagcacgcaaccaaaatcaagctcttcaatggacatgcaggcaaatacaaacgcattaagaagaaacttgttaaaggatgaaggagtgacccccggaagaatacgaactacgagggaagatgtatccccgcactataattcccaaaaacaaaccctcattaaaaaaccgctgacggtattttatgccattaaaaagttcaagacagagaaggatggcgtcgaacaattgcattatacgggaatatctcagagtgcctgtagagaaatggcattatgtcgagaattgcacaacaagcatttaaccacattagtggaaatttttttggaaaggaaatgtgtccatatggtatacgaatatgcggagcatgatctgctacaaattatccacttccattcccatcccgaaaaaaggatgataccaccaagaatggttcggtctattatgtggcagcttttagacggcgtatcgtatcttcatcaaaattgggtgcttcatcgagatttgaaacccgcaaatataatggtgaccatagatggatgtgttaaaattggtgatttaggtttggccagaaaatttcataatatgctgcaaaccctctatactggggataaagtggttgtcactatatggtaccgtgcacctgagttgctattgggagcacggcactatacccctgcggttgatttatggtccgttggctgcatttttgcagaactgataggattacagcccatatttaaaggtgaagaagctaaactagactctaaaaagactgttccatttcaagtgaatcaactacagagaattttggaagttcttggcactcccgatcaaaaaatttggccttatttggagaagtatccagaatatgatcaaattacgaagtttccaaagtatagggataaccttgctacatggtatcattccgcgggaggaagggacaagcatgctttaagcttactttaccacttgttaaattatgatccaattaaaagaatagatgcatttaatgcgttggaacataagtacttcacagaaagtgatattcctgttagtgaaaatgtatttgaaggtctaacttacaaatacccggcaagaagaattcacacgaacgataatgacatcatgaatcttggatcaagaacgaaaaacaatacacaagcttcaggaatcaccgcaggtgccgctgcaaatgcgttaggtgggcttggtgttaaccgtagaattctggccgcggcagcagcagccgctgctgcggtgtcaggaaacaatgcatcagatgagccatctcgaaagaaaaacagaagatag

SEQ ID NO: 46188 - DNA, 2478 bp, Saccharomyces cerevisiae
atgtcgtcttcctcacttcgagttttagctattgggaacaacccgaatatcttgttctacacctcaaggtttcaactggccaagaatatagacctctaccacgtcaacgattcaaaatcatgtcaatttgaaattgaaactgaatactacggcaaagaccggttcgaattggaaaatcatttcacctctatcgagcacttgactgaagctttgagctccaaatcaagtgaagccgtcttcgacataatcatcatgagtgctccatctttacaggaattatcctcgttagcgtccaagttaacgtccataatcgattcgaacaccaaaattttcttagaaagcagtggtttcatccaattggaaccgtttgtcaaattatcgatggaatctccgcatgtaaacgttttcagtattttgactgatttggatattcgtcaaatcggtccaaaccatttcaaacactttcctagtactgcaaaggagaacacgatttacctcggcgaaagtaagtccagcactgagaaatattcatcaggcgttataacattattaaccacttttgaaaaactgtttgctaaattgttttccaacataaaaatcaatttgtgcaatttctcatcaattgagtttctatcacaacaatggaagctggcgatttccagaatttgttttgatccgttgttaatcatgtttgaacaagaaaacccaagtgatctagaccagcagatcattgccaaacctttaatatcaggtctggtaactgaaatcatcactgtagcaaaaacaatgggagccagactaaacagtagtcatgataatgaaaactctcttttatctctatggaagaattcttatcattcaaccaataagccacctgcattggtttatcatttcattcatcaaacaacgcctttgaacatcgatatcctgttgttacaaactattttattagccgatgactttggtatcaaaactccgtacttagaatttttatactctgttttgtcccaatttgaaagattgaatagtggcaaatctaaatggtttattaggtcagatgaaaaaactcaaatcttacaaagcttgcaaaaatcacaaaaaaatgaatctgctttacagactcaaattacctccttacaaggtcaaattagtaaactaagacaagagttgcttatgcaggccaagcaacatgaaatggaaactaatgagttaaaggagaaacatcaagtcgctctaaaagcccaggcccaagcccaagctcaagcccaatctcaagctcaaacatcaattgaagcactaacgccaactgaagcaacaaaccaatccgatacaaatgaatataaagcaacaggaactccgaatttgagggacatcgaagatatggcactatatagtgtaaactacggagactctccagtgagatctccaccacctgttgtaagctctcagccacaaatgaactcaccattatcctcacattcacaaactttcggagagaataatggcacgaatgacaaattactacaagaacgcgaattgcaactccgtaaaaaggaattagagctacaagaacgtgaactggagttccagaaaagagcattacagcaacaaagatttaataatagcaataattcaattccaagaaagccttccttccctcaattacagcagtctgcaaacgttcgttctaacagcagaggaatgcatggcaccaatggcgctatgtctcaacctgcatccgccggaaattttgtagacccaatttcttcaagtatcgctgcatatgacccgcaacaacctccttccttacccctacagcagccacaacaatcggtacaagtacaaccttttcactcacactctatcaagcccacaagtaggaagaatagaaatagtaatatgcctaatattggtaatccttccagtataaatatgagtgattttggcagaccaccgaacaattcaagtcaaactcgcttaaattccatgccaacgcatagcatcgtaaaccagaatagattgagatcacaacaatcgaaaaacaaactgaatatgccacatgccaccaacccaaacaatacttttaaccaagtccctgctcctagtttaaacaatcacgttcccacacaaaggcaatttagctccagtaccatgatagaagttacaaataataacaacaaagttaataacagtagtagcaaccctgatatttccaccaactcggtagttcataacgcaatgcaatttacaaatacaaacaacaatacaagtagcactgtggatataaacgatcccaaaaatattgcaccccctcctacaacctctgtttcagccccaagcactccaaccttgtcctcatcaagtcaaatggcgaatatggcttcgcctagtaccgataatggtgacaatgaggagaaaaatggtggtaagaagaagagatttggcctattcaaaaaaaaaaataaatcaaagaaataa

SEQ ID NO: 46189 - DNA, 909 bp, Saccharomyces cerevisiae
atgaacagatttaagcagttagaaaagcttggcaatggtacgtatgccacagtgtacaagggactgaacaaaaccacaggggtatatgttgccctgaaagaggtaaaactggattcagaggaaggtacaccctctacggccatccgtgagatctccctaatgaaagaattgaaacatgagaacattgttagactttatgacgttattcacacagagaacaagttgactttggtttttgaattcatggacaacgatttaaagaaatacatggattcccgcaccgtgggcaacacaccaagagggctagaactaaacttggttaaatacttccagtggcaactactgcaagggctggccttttgccatgaaaacaagattctccaccgtgatttaaaacctcaaaacctattaatcaacaagagaggccagttgaaattgggtgatttcggtctggcccgtgctttcggtattccggtcaacacattttcaagcgaagtcgtaacgttgtggtaccgtgctcctgatgtgctaatgggttctaggacgtactccacatccattgatatatggtcgtgtgggtgcattcttgcggaaatgataacgggtaagcctttgtttcctggcaccaacgacgaagaacaactgaaattgatcttcgacatcatgggcactcctaatgagtccctatggcccagtgtaacaaagttacccaaatacaacccaaatatccagcaacgaccaccaagagacctacgtcaagtattgcaaccacacaccaaagaaccgctagacgggaatctcatggatttcttacacggactcttgcaacttaatccggatatgaggctgagcgccaagcaggctctgcatcacccttggtttgcagagtactaccaccacgcttcataa

SEQ ID NO: 46190 - DNA, 1197 bp, Saccharomyces cerevisiae
atgtctcagaacgtttacattgtatcgactgccagaaccccaattggttcattccagggttctctatcctccaagacagcagtggaattgggtgctgttgctttaaaaggcgccttggctaaggttccagaattggatgcatccaaggattttgacgaaattatttttggtaacgttctttctgccaatttgggccaagctccggccagacaagttgctttggctgccggtttgagtaatcatatcgttgcaagcacagttaacaaggtctgtgcatccgctatgaaggcaatcattttgggtgctcaatccatcaaatgtggtaatgctgatgttgtcgtagctggtggttgtgaatctatgactaacgcaccatactacatgccagcagcccgtgcgggtgccaaatttggccaaactgttcttgttgatggtgtcgaaagagatgggttgaacgatgcgtacgatggtctagccatgggtgtacacgcagaaaagtgtgcccgtgattgggatattactagagaacaacaagacaattttgccatcgaatcctaccaaaaatctcaaaaatctcaaaaggaaggtaaattcgacaatgaaattgtacctgttaccattaagggatttagaggtaagcctgatactcaagtcacgaaggacgaggaacctgctagattacacgttgaaaaattgagatctgcaaggactgttttccaaaaagaaaacggtactgttactgccgctaacgcttctccaatcaacgatggtgctgcagccgtcatcttggtttccgaaaaagttttgaaggaaaagaatttgaagcctttggctattatcaaaggttggggtgaggccgctcatcaaccagctgattttacatgggctccatctcttgcagttccaaaggctttgaaacatgctggcatcgaagacatcaattctgttgattactttgaattcaatgaagccttttcggttgtcggtttggtgaacactaagattttgaagctagacccatctaaggttaatgtatatggtggtgctgttgctctaggtcacccattgggttgttctggtgctagagtggttgttacactgctatccatcttacagcaagaaggaggtaagatcggtgttgccgccatttgtaatggtggtggtggtgcttcctctattgtcattgaaaagatatga

SEQ ID NO: 46191 - DNA, 1974 bp, Saccharomyces cerevisiae
atgtccatcagagatttatatcatgcgagggcttccccttttatatcgttagaattcttccctccaaagactgaattagggacgagaaatttgatggaacgtatgcatcgtatgactgctttagatccactgtttatcacggttacttggggagcaggtggtactactgcggaaaagactctgacattagcttccttggcacagcagacactaaatataccagtttgtatgcatttgacctgtacaaacacagaaaaagccatcattgatgatgcgctggatagatgttataatgcaggaatcaggaatattttggctcttcgaggtgacccacctattggggaagattggctagattctcaatcgaacgaatcaccttttaaatatgcggttgatttagttcgttatatcaagcaaagctacggagacaagttctgcgtcggtgttgcagcatatccagaaggtcattgtgaaggtgaagcagaaggtcacgagcaagacccattgaaggatttggtatatttaaaagaaaaagttgaagctggggccgattttgtgataacacaactgttttacgacgttgaaaaattcttaacttttgaaatgctatttcgggaacggatttcgcaagatttgccccttttccctgggttgatgcctattaactcctatctgcttttccacagagcagcaaagttatcacatgcatctattccacctgcaatactgagtaggttccccccagaaatccaatcggatgataatgccgtgaagtccattggtgtggacattcttatcgaattgattcaggaaatatatcaaagaacatctggtagaattaaagggtttcatttctatacattaaatttggaaaaggctattgctcaaattgtctcgcaatctcccgtcttatcccatatcgtaaatgaatctagcgaagaagagggagaagatgaaaccagtggcgaaataggaagcatagaaaatgtgccaatagaagatgctgacggggatattgtgttggatgattcgaatgaagaaactgtagcaaaccggaaaaggagaaggcattcaagtcttgattcggccaagttgattttcaatagggctatcgtcactgaaaaaggcttacgctataataatgagaatggttccatgccatctaaaaaggctttaatatctatttctaaaggtcacggaactttgggtcgtgatgccacttgggatgagttccccaatggtagatttggtgactccaggtctcccgcatatggtgaaatagacggttatgggccatccatcaaggtaagcaaaagcaaagcgcttgaactatggggtataccaaagacaattggcgatttaaaagatatttttataaaatatttggaaggttcaacggatgcgattccctggtctgacctgggtttatcagctgaaacggcgttaatacaagaagaactaatccaactaaactatcgcggatatttgactttggcatcgcaacctgccacaaatgctacattgagtagtgataaaatattcggctgggggcccgcgaaagggaggttgtatcagaaggcattcgtagaaatgtttattcatagacagcaatgggaaacaactttgaaacccaagctagaccattacgggcgtcggaaattcagttattacgcgggcgattcatctggttcatttgaaacgaacctagacccgcacagctctagcgttgtaacatggggtgtttttcccaacagtccggtcaaacagactacaatcattgaagaagagtcattcaaggcatggagagatgaagcgtttagtatctggtccgagtgggccaagttatttccaaggaacaccccagccaatattcttctaagactagtgcataaagactactgtcttgtctcaattgttcatcacgacttcaaagaaaccgacgagctatgggaaatgttactcgaccaagcctaa

SEQ ID NO: 46192 - DNA, 3303 bp, Saccharomyces cerevisiae
atgtctcagttattttatcagggcgactctgatgatgagctccaggaggaacttacgaggcagacaactcaagcatctcaaagttctaaaattaaaaatgaagatgaacccgacgactccaatcatcttaatgaggtggaaaatgaagatagcaaagttttagatgacgatgcagtgttataccctcttatacctaatgagccagatgacatagaaacgtctaagcccaatattaacgatattaggccagttgatattcaattgactttaccattgccgtttcagcaaaaagtggtagagaattcattaattactgaagatgcattaatcataatggggaaaggactaggattgcttgatattgtggccaatttattgcatgttttagctacaccaacatccattaacggacaactaaagcgagcgctcgtcctagtgttgaatgcaaaacctatagataatgtaagaatcaaggaggccttagaagagctgtcgtggttctctaatactgggaaggacgacgacgatactgctgtcgagagcgatgatgaactttttgaaaggccttttaacgtagttaccgcggactcgctgagcattgaaaagagaagaaagctatatatttctggcggaatcttgagcattacttctagaattctcattgtggatctcttatccggcattgttcacccaaatagggttacgggtatgctggtattgaatgcagactcacttcgacataattcgaatgaatcgtttatattagagatttacaggtctaaaaatacttggggttttattaaagccttttctgaagcaccagagacgtttgtcatggaattttcacccctcaggacgaaaatgaaagaattacggctaaagaacgttttgctatggccgaggttcagggtagaggtctcttcctgtttgaatgccactaataagacgtcacacaataaagtcattgaagtcaaggtctccttaacaaattccatgtctcagatacagtttggcttgatggaatgtttgaaaaaatgtattgctgagttaagcagaaaaaatcctgaactagctctggactggtggaatatggaaaatgtcctggatataaactttatcaggtcaattgactcggtgatggtgccgaactggcaccgaatttcttatgaatcaaaacaactggttaaggatataagattcctacgccaccttttaaagatgctcgtaacttcagacgcagttgacttttttggagagattcaattaagtttggatgccaataaaccgtcagtatcccgaaaatacagcgaatcaccgtggctattggtcgatgaggcacaattagtcatatcgtatgcgaagaaaagaatattttacaaaaatgaatatactttagaagaaaatccaaaatgggaacaacttattcatatattacatgatatttcacatgagagaatgaccaatcaccttcaggggcctactttagttgcctgttccgacaaccttacatgtttagaactagcaaaggtcttgaatgcctcaaacaaaaaaagaggagtacgtcaagtgcttctgaataaattgaaatggtacagaaaacagagggaggaaacgaaaaaattggtcaaagaagtgcaaagtcaggacacttttccagagaatgcaacattaaatgtaagctcgacattttccaaagaacaagtgaccacgaaaagaagaaggacaagaggtgcttcacaagttgcggccgttgaaaagctaaggaatgcaggtaccaatgtagatatggaggtggtttttgaggatcataagttatctgaagaaattaagaagggaagcggtgatgatttggatgacggtcaggaagaaaatgccgcaaacgattcaaagatttttgaaatacaagaacaggaaaatgaaatccttatcgatgatggggatgctgaatttgacaacggagaattagagtatgtgggcgaccttccgcagcacatcacaacccatttcaataaggatttatgggcagaacattgcaacgagtatgaatatgttgatcgtcaggacgaaattttaatctctacgtttaaaagtctcaatgacaattgctcattgcaggagatgatgccctcttacattataatgtttgaaccagatatatcgtttatcaggcagattgaagtttataaggccatagtgaaggatttgcaaccaaaagtatacttcatgtactacggtgaaagtattgaagagcaaagtcatttgactgctatcaagagagagaaagatgctttcacaaagttgattagagagaatgcaaatctgtcccatcactttgaaacgaatgaagatctttctcactacaaaaatttagctgaaaggaagttgaagctttcaaaattacgaaaatctaataccagaaatgcgggtgggcagcagggattccataatcttactcaggatgtcgtcattgtggatacacgtgagtttaatgcctcattaccaggcttactctaccgatatggcataagggttattccttgtatgttgacagtcggcgattatgtgataactcctgatatttgtctcgaaagaaaatcgatttctgacttaattgggtcattacagaataacagattagccaaccaatgtaaaaaaatgttaaaatactatgcatatccgacactattgattgagtttgatgaaggacagtcgttttctttagaaccttttagtgaacgtagaaattataagaataaagacatatcaactgttcatcctatatcaagcaagttatcccaggatgaaattcagctaaaactagccaaattagtattgcggtttcccactttaaagattatatggtcttcctcacccctgcaaactgtaaatataatcctagagttgaaattaggacgtgagcaacctgaccctagtaatgcagttatattgggaacgaataaagttagatcggattttaatagcactgcaaagggcctgaaggatggtgataacgagtctaaattcaagagactgttgaatgttcctggagtgtcaaaaattgattatttcaatctccgcaaaaagatcaagagcttcaataagcttcaaaagctttcatggaatgagattaatgaacttattaatgacgaagatttgacggatagaatatactacttcttgagaacagaaaaagaagaacaagaacaagagtcaacagatgaaaatcttgaatctcctggtaagaccactgatgataacgctttacatgatcatcataatgatgttcctgaagcacctgtgtaa

SEQ ID NO: 46193 - DNA, 1500 bp, Saccharomyces cerevisiae
atgggaggtgaagacgaaatattaagcacgatggaggattttgcggcagtttacgatgtcctggtaattggttgcgggcctggtggctttactgcagcgatgcaggcttcgcaagcaggcctgctcacagcatgtgttgaccagcgtgcctcgctggggggcgcctaccttgtagacggggcagtcccgtccaagaccttgttatatgagtcttatctttatcggctgctacaacagcaagaacttatcgagcaacgtggcacgcggctgtttcctgcaaaattcgatatgcaggcggcccagagtgcactcaaacataatatagaagagttgggcaatgtgtataaacgtgagctatctaaaaataatgttactgtgtataaaggcacggctgctttcaaagatcctcaccacgttgagattgcgcagcgcggcatgaaaccgttcatcgtagaggcgaaatatattgttgtggcgaccggatctgcggttattcagtgtcctggtgttgcaatagataatgacaagataatttcatctgataaggcattgtcactggattatataccttcacgttttactatcatgggaggaggtacaattggactagaaatcgcatgcatattcaataatttgggctctcgggttactatcgttgaatctcaaagcgagatctgtcaaaatatggacaatgagttggcttctgccacgaagaccctcttgcagtgtcagggtatagcttttcttttagacactagagtgcagctcgcggaagccgatgctgccggtcagctgaacatcaccttgcttaacaaggtgtcaaagaaaacatatgtacatcattgcgacgtcttgatggtttctattggtagacgtcccctgctaaaaggtttagatatttccagcattggtctagacgaacgggattttgtagaaaatgttgacgtacaaacccaaagtctgctaaagtaccctcatattaaacccataggagacgttacattgggccccatgctggcgctgaaagcggaagaacaagctataagggccattcaatcaataggctgtacaggctccgacggaacctcgaattgtggcttcccaccaaatgtgctgtactgtcagcctcagattggctgggtcggatacactgaggaggggttggcaaaggctcgcatcccatatcaaaaaggcagggttttgttctcacagaacgttagatataacacgttattaccacgggaagagaatactacagtttctcctttcattaaagttctgatagattctcgtgacatgaaaatactaggcgttcatatgataaacgacgatgcaaatgaattgctgtcgcaagcatcgatggcggtgtcgcttggccttaccgcccatgatgtctgtaaagtaccgttccctcatccgagcttatcggaatcgtttaagcaagccgtccagttggcaatggcaaatggaacatcacctggcgtacatgtccgggaatag

SEQ ID NO: 46194 - DNA, 2586 bp, Saccharomyces cerevisiae
atggacaaaaaggaatattcggagactttctatcatccttataagccctatgatattcaggtacagttaatggaaactgtatacagagtgctatccgaagggaagaaaatagctatcctggaaagccccactgggacaggcaagacgctgtccttaatctgtgccacgatgacttggttgagaatgaataaagcagatattttcacccgcatggaaactaacatcaaaacgaatgaagatgatagtgaaaacctaagcgatgacgagccagactgggttattgacacttatcgaaagtctgttttacaagaaaaggtggatttgctaaatgattatgagaagcatttaaacgaaattaacacgaccagttgtaagcagttgaaaactatgtgtgatttagataaagaacatggaagatataaatcagttgatccattaagaaagaaacgcaaaggcgctaggcaccttgatgtatcacttgaagaacaagattttattccgcgcccgtacgaatcagattctgaaaacaatgatacctccaaaagcacaagaggaggaagaatatctgataaagattacaaattgagtgaactaaattcacaaataataacacttttagacaaaattgatgggaaggtttcgagagatccaaacaatggcgatcgctttgacgttacaaatcaaaatccagtgaaaatatattatgcatccagaacttattcacaattaggtcaatttacttctcagttaagattaccctcgttcccatcatcctttagggataaggtcccagatgaaaaggtgaagtacttaccacttgcttcgaaaaagcagctttgtattaatccaaaagtgatgaagtggaaaacattggaagctattaatgacgcatgtgcggaccttagacatagtaaagagggatgtatcttttatcaaaatacaaacgaatggcgtcattgtcctgatacgttagctctcagagatatgattttttcagaaattcaagatattgaagatttagttcccctgggaaaatctttgggaatttgtccctattacgcctcgagggaggcacttcctattgcggaggtagtgactttgccatatcaatacttactttctgagtccacccgttcaagtcttcaaataaaccttgaaaattctatagtaattattgatgaggctcataatttgatagaaacaataaattctatatattcctctcagatctcgttggaggacttaaagaattgccataaggggatagtaacttatttcaacaaatttaagtccaggctcaatcccggtaacagagtaaatctattaaagctcaattcacttttgatgactctgattcaatttatagttaaaaatttcaagaagataggacaagaaatagatcctaacgatatgttcacaggaagtaacatcgataccctaaacattcataaactattgagatatataaaagtctccaaaattgcttacaaaattgacacgtataaccaggcactaaaagaggaagaatcgtcaaaaaatgaaaatccaataaaagaaacgcataaaaaatcagtttcttctcagccattacttttcaaggtttctcaattcctatattgtttgacaaatttgacgtcagaaggacaatttttttttgagaaaaattattcaataaagtacatgcttctagaaccaagtaaaccttttgagtcaatactaaatcaagcaaaatgtgtagtccttgcaggtgggacaatggaacccatgtcagagtttttgtcgaatttgctacctgaagttccttctgaagacattacgaccttgtcgtgcaatcatgttataccgaaagagaatttgcaaacttatatcacaaaccagcctgagcttgagttcacattcgaaaaaagaatgtctccctcccttgtaaataatcatctttttcaattttttgttgatctgagcaaagcagttcctaaaaagggtggtattgtagctttttttccaagctatcagtatttggcgcatgtaattcagtgctggaaacagaatgacaggtttgctacattaaataacgtgaggaaaatattctatgaagcaaaagacggcgatgatattctatctggatattctgattcggtagcagagggaagggggtctcttttgctggctattgttgggggaaaattatcagagggaataaattttcaagatgatttatgtagggctgtggtgatggtgggcctgccgttcccaaatatttttagtggagaactaatagttaaaaggaagcatttggccgctaaaataatgaagtcaggcggaacggaagaggaagcttcacgagcaacaaaggagtttatggagaatatttgtatgaaagctgtcaaccaaagtgttggacgtgctatacggcatgcaaatgattacgcaaacatttacttgctcgatgtgcgatataataggcccaatttccggaaaaaattgtcacgttgggtgcaagattctatcaattccgaacatacaacacatcaggtcatttcttcaacacggaagtttttttcaatgcgcagcctgaattcacgctaa

SEQ ID NO: 46195 - DNA, 1461 bp, Saccharomyces cerevisiae
atggtacaaaggcttctaccgggcgcacatatatgcagaaggtccttcaattcgtctgcaattataaagtcttctgcattgactctcaaggaagcattagaaaacgtgatacctaagaaaagagatgctgtgaagaaattgaaggcctgttatggcagcacgtttgtcggaccgattaccatttcatcagttctaggtgggatgagaggtaatcagtcaatgttttggcaaggaacatcattagatcccgaacatggcattaaatttcaaggtttaacgattgaagaatgtcaaaatagattacctaatacaggtattgatggcgataatttcctgccagaatcaatgttatggctgttgatgacaggtggtgtgccaactttccagcaagctgcttctttcaggaaagaattggctattcgtggaaggaaattgccacattatacagagaaagttttgtcaagtttacccaaagatatgcaccctatgacccaacttgcaattggtttagcatcaatgaacaaaggatccctctttgctacaaactaccaaaagggcctcataggaaagatggaattttggaaagatactcttgaagattcgctaaatttaattgcttcactcccgctgctgactgggagaatttattcgaacattacaaatgagggacacccattaggtcaatatagtgaggaggtggattggtgtacaaacatatgttccctgctcggcatgacaaatggaacgaactcttctaatacatgcaaccttacttcccagcaatccctggacttcataaacttgatgcggttatataccggtatacatgtagaccatgaaggtggtaatgtttctgctcacaccacccacttggttggaagtgcgttgagtgacccgtatctcagctattcatctggaataatgggattagcgggtcctttgcatgggttagcagcacaagaagtagtaaggtttctcatagagatgaactctaatatttccagcattgcacgagaacaagaaatcaaagattatctttggaaaattttgaattcaaaccgtgtgatccccggttatgggcacgcagttttgcgtaaaccggatcctcgatttacagcaatgcttgaatttgcgcaaaagaggcctattgaatttgagaacgacaagaacgttttgttgatgcaaaaattggcagaaatagcgcctaaggttttgttggaacacggaaagagtaagaatccatttcccaatgttgactctgcatcggggattttgttttatcattatggaatcagggaattattattctttaccgtcatttttgggtgttcaagggccatgggacccttgacacaacttgtttgggatcgcattctaggtttaccaattgaaaggcccaagagtttgaacttggagggtctggaagcacttaccaaagcaagcaatgttaacaagttgtaa

SEQ ID NO: 46196 - DNA, 3612 bp, Saccharomyces cerevisiae
atgagcaaagtgattaagccgcctggccaagccagaactgctgatttccgtaccttagaacgtgaatctaggttcatcaatccacctaaggataaatcagcatttccactattacaggaagctgttcaacctcatattgggtcttttaacgcattaacagaaggtccggatggaggtttgttaaatcttggtgttaaagacatcggtgaaaaagttatatttgatggaaaaccactcaattctgaagacgaaatatccaacagcggatacctcgggaataagctttctgttagtgtggaacaagtgtctattgcgaagccaatgtctaacgatggtgtttcttctgcagtagagagaaaagtttacccaagtgagtcaagacaaaggcttacttcttacagaggtaaattacttttaaagttgaagtggtccgtgaacaatggcgaggagaacttatttgaagtaagagattgtggtggtctaccagttatgctacagagtaacagatgtcacttgaacaagatgtcaccatatgaactggtacaacacaaggaagaatccgatgaaataggtggttatttcattgttaacggtatagaaaagcttattagaatgctgattgtgcaacgtagaaatcatcctatggctatcatcagaccttccttcgctaacaggggtgcatcctattctcattacggtattcaaattagatctgtcaggccggatcaaacttcccaaactaatgttttgcattacttaaatgacggtcaagttacatttagattttcttggagaaaaaatgaatatttagttcctgttgttatgattttaaaagccttgtgtcataccagcgatagggaaatttttgatggtattattggtaatgacgttaaggattcctttttgaccgatcgtttagaattactgttacgtggttttaagaaaagatatcctcatttacaaaatcgcacacaagtcttgcaatatttaggagacaaatttcgtgttgtctttcaagcttcccctgatcaatctgatttagaagtcggacaagaagtccttgatcgcatcgttctcgtgcatttgggtaaggatggcagccaggataaattcagaatgttattgttcatgatcagaaagttgtattccttggttgcaggcgaatgttctccagataacccagatgctacgcaacatcaagaagttcttttgggtggtttcttatatggtatgatcctaaaagaaaagattgatgagtacttacagaatattattgctcaagtcaggatggatattaaccgtggtatggccattaatttcaaagacaaaaggtacatgtcaagagttttaatgagggttaatgaaaacattggttccaaaatgcaatactttttatcaactggtaacctggtgtcccagtctgggttagatttacaacaagtttctggttatactgtggttgcagaaaaaattaacttctaccgttttatctctcattttagaatggttcatagaggctccttttttgcgcaattgaaaactaccacagtcagaaagttgctacctgagtcgtggggattcctgtgccctgttcatacaccagatggttctccttgtggtttattaaaccattttgcgcacaagtgtcgtatatcaactcagcaatctgacgtctcaagaattccttctatattatactcacttggtgttgctccggcatctcacacctttgctgctggtccttctctgtgttgtgttcaaattgatggtaaaattattggctgggtctctcatgaacaaggtaagatcattgcggatacattgagatattggaaagttgaaggcaagacgcctgggttaccgattgatctagaaattggatatgttcctccctcaactcgtggtcaatatccaggtctctacctatttggtggtcattctaggatgctgcgtcctgttcgttacctgcctttggataaagaagacattgttggaccttttgagcaagtgtacatgaacattgctgtcactcctcaagaaattcaaaataacgttcatacacacgtagaatttacgcccacaaatattctttctattttggctaatttgactccattttctgatttcaaccagtctccaagaaacatgtatcaatgtcagatgggtaaacaaacaatgggtactccgggtgtagctttgtgccatcgttccgacaataagctgtataggttgcaaacaggtcaaacgcctatcgtaaaagctaatttatatgatgattatggcatggataactttccaaacgggtttaatgctgttgttgcggtcatctcgtatactggttatgatatggatgatgcaatgattataaacaaatcagcagatgaaagaggtttcggttatggtactatgtataagactgagaaagtggatttagcacttaacagaaaccgtggtgacccaattacacagcattttggtttcgggaatgacgaatggccaaaggagtggcttgagaaattagacgaggatggtttgccatacattggcacttatgttgaagagggtgatccaatctgcgcatactttgacgatactttaaataagaccaaaatcaagacatatcactcctctgaaccagcatatatcgaagaggtaaatttaatcggtgatgaatccaataagttccaagaactacaaactgttagcataaaatatcgtattagaagaacgcctcaaattggtgataaattttcttctagacacggtcaaaaaggtgtttgttcaagaaaatggccaaccattgatatgccttttagcgaaacaggtatccaaccagacatcatcattaaccctcatgctttcccttcgcgtatgaccattggtatgttcgtcgaatctttagcaggtaaagcgggggcattgcatggtattgcacaggactctacaccttggatctttaacgaggacgataccccagccgattactttggtgagcaactagcgaaggcgggttacaactaccatggtaatgagccaatgtactcaggtgctactggtgaagaattaagggcagatatttatgttggtgttgtctactaccaaagattacgtcatatggtcaatgacaagttccaagttcgttccactggtcctgtgaatagtttgactatgcagcctgtcaaaggtagaaagagacatggtggtattcgtgtcggtgaaatggaaagagatgctttgattgggcatggtacatcttttctattacaagatcgtctgctaaattcatcagactacacacaggcatccgtatgtcgcgagtgtggttctattttgaccacgcaacagagtgtgccaagaattggttcgatttccaccgtttgttgccgtcgttgttccatgagattcgaagatgcaaagaagctattgactaaatcagaagatggagagaaaatttttattgacgactctcaaatttgggaagatggacaaggtaacaaatttgttggtggtaatgaaacaactacggtggccataccatttgtgttgaagtacttggactctgagctatccgcaatgggtataagattgcgttataatgtagagcccaaatag

SEQ ID NO: 46197 - DNA, 981 bp, Saccharomyces cerevisiae
atggcagaagtactgaccgtcctcgagcagccgaactcaattaaagattttctcaagcaggattcaaatattgcgtttctagctggtggagtagctggcgcggtttcccgaaccgttgtttcaccttttgagagagttaaaatactgctgcaagttcaaagttcaaccacttcttataaccgaggtatctttagctctatacggcaggtttaccatgaggagggaaccaaaggtttattcagaggaaatggtttgaactgcataagaatttttccctatagtgcagtccagtttgtagtatacgaagcttgtaagaaaaagttattccatgtaaatggcaataatggacaagaacaactaacgaacacccaaagactattcagtggtgcattgtgtggtggttgtagtgtggtggctacttacccgttggacttgatcaaaacaagactatcgattcagacagcaaatttgagcagtttaaaccgctcaaaggcaaaaagtatatcaaagcctccggggatctggcaattactaagcgaaacttacagactcgaaggcggtctcaggggattatataggggtgtatggccaacgagtcttggtgttgttccatatgtagcactaaactttgcagtttacgaacaattgagagaattcggtgtcaattcctccgatgctcagccttcctggaaaagtaacctctataaattaacaattggcgccataagtggaggggttgcgcaaacaatcacttatccctttgatctgctaagaagaagatttcaagttctcgcaatgggcggaaatgaactgggatttagatacacgagtgtctgggatgcgctcgtgacaatcggcagagcagaaggcgttagcggttactacaaaggcttagctgcaaacctttttaaagttgttccttcaactgcagtgagttggctagtttacgaagttgtatgtgattctgtaagaaattggtga

SEQ ID NO: 46198 - DNA, 2802 bp, Saccharomyces cerevisiae
atgtctcaacagtctagctctccaacaaaagaggataataactccagctcccccgttgtgcctaatcctgattctgttccaccacagctttcttccccagctctattttatagctcctcttcatcacaaggtgatatctatggtcgcaacaatagccagaacttaagtcagggagagggaaacatcagagctgctataggttcttctccactaaattttccatcttcttcccaaagacaaaattccgatgttttccaatctcaaggcagacagggcagaattcgttcttctgcgagcgcttctggaaggtctagatatcattctgatctgagaagtgatagagcactgcctacttcttcctcttctttaggccgtaatggtcaaaaccgtgtacacatgcgaagaaatgatattcatacatctgatttatcctctccaagaagaattgtggattttgatactagatccggcgtgaatactttggatacttcttcttcttctgctcctccatcggaagccagtgaacccttgagaataatttggggtaccaacgtcagtatccaggaatgtacaactaattttcgtaattttttgatgtctttcaagtataaattccgtaaaatattggatgaaagggaggaattcattaacaatactaccgacgaagaactatactatatcaagcagcttaatgaaatgagagaacttggtacctctaatttaaacttggatgctagaaacttacttgcttacaagcaaacagaagacttataccatcaactattaaattatcctcaagaagtgatttctatcatggatcaaactatcaaggactgtatggtttccttaatagtagacaacaatttggattacgatttagatgaaatagagaccaagttttataaagtaaggccttacaatgtaggttcttgtaaaggtatgcgcgaattgaatccaaatgatattgataaattgataaacttaaagggtcttgtcctgagatcaactccggttatccctgatatgaaggtagcgtttttcaaatgcaacgtctgcgatcatacaatggcagtggaaattgatagaggagttatacaagagcccgctaggtgtgaacgtattgattgtaatgaacccaattccatgtcactgattcacaacaggtgttcattcgcagataaacaagtcattaagttacaggaaactccagactttgtgcctgatggacaaacgcctcactctatctcattatgtgtttacgatgaattagtggattcttgcagggcgggcgatcgtattgaggtgactggcacgttcaggtccatccccattagagctaattccaggcaacgcgtactaaagtcgttgtataaaacatacgtcgatgtggtccacgttaaaaaagtttcagataagaggttagacgtcgatacttctactattgaacaagaattaatgcagaacaaggtagatcataacgaggtcgaagaagtaagacaaattactgatcaggatttagcaaaaattcgcgaggttgcggcaagagaagatttatacagtttattagcccgctctattgccccaagtatttacgagctagaagatgtcaagaagggtatattacttcagctatttggcggcacgaataaaacctttaccaagggtggccgttatagaggtgacataaatattttactttgtggggatccttctacttccaaatcgcaaattttgcaatacgttcacaaaattactcctcgtggtgtgtatacttcgggtaaaggttcatctgccgttggtttaactgcttatattacaagggatgtcgacacaaaacaacttgttttggaaagtggtgcattagtattgtctgatggaggtgtttgttgtattgacgagtttgataaaatgagtgattctacaaggtccgtcttgcacgaagtcatggaacagcagactatttcaatcgcaaaagcgggaattatcacaacacttaatgccagaagttctattttggccagtgctaacccaattggttcacgctacaaccccaatttgcctgtgactgaaaatattgatctaccgcccccactactttcgagattcgatctggtctatcttgtccttgataaggttgatgagaaaaatgacagagaactagccaaacacttaacaaatctttacctggaagataagcccgaacatatttctcaagacgacgtgctaccagttgaatttttaacgatgtatattagttatgcaaaggagcacatacacccaataatcaccgaggccgctaagactgagcttgttcgtgcttatgtaggaatgagaaagatgggtgacgattcgagatccgatgagaagagaatcacagctaccacaagacaacttgaaagtatgattcgtttggctgaggcgcacgccaaaatgaaattgaaaaacgtcgtagagctggaggatgttcaagaagccgttagattaattagatcagccataaaagattatgcaacagaccctaaaaccggtaaaatcgacatgaatttagttcaaacaggtaaatcagttattcagagaaaactacaggaggatttgtcaagggaaattatgaatgttttgaaggatcaggcatcagactcaatgtcattcaatgagcttataaaacaaatcaatgaacactctcaagatagagttgagtcttctgatatccaggaagccttgtcaagattgcaacaagaggacaaggtcattgtccttggcgagggtgtaaggagatcagttcgcctgaataaccgtgtctga

SEQ ID NO: 46199 - DNA, 2244 bp, Saccharomyces cerevisiae
atgaacgtttcaaaaatacttgtgtcgcccacggtcacgacaaatgttttacgcatatttgctcccaggctacctcaaatcggtgcttctttgttagttcaaaaaaaatgggccttaagatcaaagaagttctaccgtttttattctgaaaagaatagcggtgaaatgcctcctaagaaggaagctgatagctctggaaaggcatccaataaatccacgatatcttcaatcgacaattcgcaaccaccacctccatcgaacactaatgataaaaccaaacaagcgaacgtagctgtgtcacatgctatgctagcaactagagaacaagaggccaataaagacttaacgagtcctgatgcacaagcagccttttacaaacttctcttacaatcaaactacccgcaatacgtggtctctaggtttgagacccccggtattgcgtcatcgcctgaatgcatggaactgtacatggaggccctgcagaggataggcagacactcggaggctgatgccgttagacaaaacctactgacagccagctctgctggcgcagttaacccatcattggcgtcatcttcatcaaaccagtcaggttatcatggtaactttccatcgatgtattctccgctttatggatctcgcaaagagccactacatgttgtcgtatctgaatcaacttttactgttgtatcgagatgggtaaagtggctgcttgttttcggtatcttaacctactctttttctgaaggttttaaatacatcacagaaaatacaacgctactaaagtcgtcagaagtagccgacaaatcagttgatgtagctaagacaaatgttaaatttgatgatgtctgcggttgtgatgaggcccgtgcggaattggaagaaattgttgatttcctgaaagatccaactaagtacgagtccttgggtggtaaactaccaaagggtgtactgttgactggacctcctggtacaggtaaaactttgttggctagggccactgccggagaggctggtgtagattttttctttatgtcaggttctgaatttgatgaagtttacgtcggtgttggtgctaaacgtatccgtgatttgtttgctcaagcgcgttctcgtgcaccagctattatttttattgatgaattagatgccatcggtggtaagcgtaatccaaaggaccaagcttacgccaaacaaacgttgaatcagttattggtcgaattagatggtttctcacaaacaagtggaattattattattggtgccacaaatttccctgaggctttagataaggcgttaactagaccaggtagatttgataaggttgtgaatgtggatttgccagatgttcgtggtcgtgctgatattttaaagcatcacatgaagaagattacattggcagacaatgtggatccaactattattgcgcgtggtacccccggtttatcaggcgctgagctggcaaatttagtcaaccaagcagcagtttacgcgtgtcaaaaaaatgctgtttccgttgatatgtcccacttcgagtgggctaaggataagatattgatgggtgctgagagaaagactatggtcttaacagatgcagccagaaaggccactgctttccacgaggctggacatgccattatggccaaatacaccaatggtgctaccccgctatacaaggccacgatattgcctagaggtagggcattgggtattacttttcaattgccagaaatggataaggtcgacatcaccaaaagggagtgtcaagccagactggacgtgtgcatggggggcaaaattgcagaagaattaatttatggtaaagataacaccacaagtggttgtgggtctgacttgcaaagcgccaccggcacagcaagggctatggttactcaatatggtatgagtgatgatgtaggtcccgttaacttgtcagaaaattgggaatcttggtctaataagattcgcgatattgctgataatgaagtgattgaacttttgaaggactccgaggaaagagcaagaagactattaactaagaaaaatgttgagctacatagacttgcgcaaggtcttattgaatatgaaactctagatgcccacgaaatcgaacaagtttgtaaaggtgaaaaactggacaaactgaaaacttccaccaatacagtcgtagaaggaccagacagtgatgaacgtaaagatataggcgatgataaacccaaaattcctacaatgttaaatgcatga

SEQ ID NO: 46200 - DNA, 1182 bp, Saccharomyces cerevisiae
atgacggatattcaactaaatggaaagagtacattagatactccttctgctaccatgtcagcaaaagaaaaagaggcaaaattaaaatcggctgatgagaataacaagccaccgaactacaaaagaatttctgacgatgatttatataggcactcttctcagtatagaatgtggtcatacactaaagatcaacttcaggagaaaagggtagataccaatgcccgagcgattgcttacattgaggaaaatttattaaaatttagagaagcacacaatttaacagaagaagaaataaaagtactagaagcaaaggctatccctttgacaatggaagaagaactcgatttggtgaatttctacgcaaaaaaagttcaggtaatagcacagcatctaaatttgccaaccgaagtagtggccactgcgatatccttttttaggcgttttttcttagaaaattctgttatgcaaatagatcctaaaagtattgtacatactactatctttctagcctgcaaatcggagaactattttattagcgtggactcgtttgctcaaaaggccaaatctactagagatagtgttctcaaattcgagtttaagttgttagaatcattgaaattttcactgttgaaccatcatccttacaaaccgcttcatgggtttttcttagatatccagaacgtcctttatggtaaggttgatttaaattacatgggccaaatatacgataggtgtaagaagagaataactgccgcattattaaccgatgtcgtatatttctacactccaccccaaataacactagcaacattattgattgaggatgaagccttggtcacaaggtatttagaaacaaaatttcccagcagagaaggtagccaggaatcagtaccgggaaacgaaaaagaagaaccacaaaatgatgccagtacaactgagaaaaacaaagagaagtccacagagagcgaagaatattcgatagactccgcgaagttactaaccataatacgcgagtgtaaaagtattattgaagattgtaaacctccgagtactgaagaggccaagaaaattgcggcaaaaaactattattgtcaaaatccatcaacactgattcagaaattaaaaaggaagttgaatggagaagatacttcgtccaccgttgagaaaaagcaaaaaacatga

SEQ ID NO: 46201 - DNA, 3636 bp, Saccharomyces cerevisiae
atgaaaagaataagatcgctttggttcaatgcggaggcttcttattcaaaccttaacaattctcctagtttgaggaacaaaaatagtaccggtaataactctcgctctaaaaattatcgttctttctcaaggtttgacttgatcaactctatacttttactgatgatgctatttttattagctatcttcgtcactgcattatatttaacaaagagttccaggcttacatactcacatgcctcgagggctgccctatttaaccctctgggtgtgatatcgccgtcattgggaaatcatacgttgaactacgatccagaagcaagggaatcttctaaaaaactttatgaactcctttctgatttcaacacggcatattatgatgatgagaacatgattttgggaagtaacttgttctcaaagaatacatactcgagacaaccatatgttgctaacggttatataggtagtcgtattcccaatattgggttcggctatgccttagacaccctgaatttttacacagacgcaccaggcgctttgaataacggttggcccttaagaaatcatagatttgccggtgcgtttgtatcggacttttattgtctacaaccaaaactaaattcaacaaacttcccagaattggatgatgtaggatattccactgtcatttcatctattccacaatggaccaatctacagttctcattagtgaatgattctaagtggttcaatccacaaaatgttacgttggatgacgtaactaattatagccaaaacttatcaatgaaggatggtatcgtaactacggagttagattggctaaacagtcaaatacatgttaaaagtgaaatctgggcacatcggcacattcatccactgggagtggtttctttggaaatttccctgaatacggaccatttaccttcggattttgattcattagatgttaatatatgggatatacttgatttcaacacatcacataggactgttctacatagcacgggaacagacgaaaaaaataatgcggttttcatgattgttcagccagataacgttccatcttctaattgcgctatttactcaacgtgtactgtaaagtatgaaaattccaccaatccaataaattctagtgaatcttttgaagaaaaagatgtttcttctaatatttataatgttattttgacagaggaccaacccaagataatcgttcataagtatgttggtattatgtctactgagttcaataagaacaaagaacaacaagacaatactaatattggtttggccaaaatgatagctctaaacagtaaaggcaattacgagaagcttctgtcaagtcacaaacgtgcgtggtatgacctttacaacgacgccttcattgaaattccttctgacagtcttttagaaatgacagcaagatcgtccctattccatttactagcaaatacaagagattacaatgtctcgagcgataggggtcttcccgtgggagtttctggtttgtcatcagattcctatggtggtatggtgttctgggacgcagatatatggatggaacctgccctattgcctttcttcccaaatgtggctcaaaatatgaataattacagaaatgctacacattcgcaggcaaagttaaatgcagagaaatatggataccccggagcaatatacccctggacatctggtaagtacgctaattgtacttctacgggaccttgtgtcgattacgaataccatattaacgttgatgtcgctatggcctccttttccatatacttgaatggacacgaagggattgatgacgagtatctgagatatactacatggccaattatcaaaaacgcagcccaattttttactgcttatgttaagtacaattcttccctaggattgtatgaaacatataatttgacagatcccgacgagtttgctaatcacatcaataacggggctttcacgaatgctggcattaaaacacttctaaagtgggcaacagacattggcaatcatctcggcgaggtcgttgaccccaaatggagtgaaatttccaaagatatttatatccctagatcctcatctaacatcactttggaatattctggtatgaatagctcagtggagattaaacaggcggatgtgactttaatggtttacccacttggatatatcaatgatgaatccatattgaacaatgcaattaaagatctttattattattcagaaagacagtctgcgtctgggcctgcaatgacatatccggtttttgtggccgcagctgctggtctgctgaatcacggctcttcttctcaaagttacttatataaatcggttcttccatacttacgggctcctttcgctcaatttagtgagcaatcagacgacaactttttaacaaacggattaacccagccagcattcccctttttaacagctaacggtggatttctacagagcattctgtttgggttaacaggaatccgatattcttatgaggttgatccagatactaaaaaaattaaccgtttgttaaggttcaatccaatagaactaccgttgctccctggtggtatcgctattagaaacttcaaatatatgaaccaagttttagatataataattgacgaccacaatggtacgattgttcataaatcaggagatgttcctattcatataaagataccaaacagatctctaatacatgaccaggatatcaacttctataatggttccgaaaacgaaagaaaaccaaatctagagcgtagagacgtcgaccgtgttggtgatccaatgaggatggataggtatggtacctattatcttttaaaaccgaaacaagagcttacagtccaactgttcaagcctggcttaaacgcaagaaacaacatagcggaaaataagcaaataacaaacttgacggccggcgttcctggtgacgttgcattctctgctctagatgggaataattacacgcattggcaacccttagacaaaattcaccgtgcgaagctattgattgatttaggtgaatacaacgagaaagagattaccaagggaatgattctttgggggcagaggcccgcaaaaaacatttccatatctattttgcctcattctgaaaaagtcgaaaatttatttgcgaacgtgacagaaattatgcaaaattcgggaaatgatcaacttcttaatgaaaccattggtcagcttttagataatgccggaattcctgtcgagaacgttattgattttgatggcatagaacaagaggatgatgaatctttggatgatgtgcaagccttattgcactggaagaaggaagacttagccaagctaattgaacaaatacccagacttaactttctaaaaagaaaatttgtgaaaattctggataacgtgccagtgagcccaagtgagccatactacgaagcaagtcgcaaccagtcgttaatcgagatattacccagtaatagaacgactttcactattgattatgataaattgcaggtgggtgataaagggaacacagattggaggaaaacaagatacatagttgtggcagtacaaggagtgtatgatgattatgatgatgataacaaaggagctacaatcaaggaaattgttctcaatgattaa

SEQ ID NO: 46202 - DNA, 1434 bp, Saccharomyces cerevisiae
atgacattgaataggaagtgcgtagtgatacataacggatcgcacagaacggtggctggatttagtaacgttgaattgccacaatgcattataccctctagctatattaaaagaacagatgaggggggggaagctgagtttatattcggaacctacaatatgatagacgctgcggcagaaaaacgcaatggtgacgaggtgtatacattggtagatagccaagggttaccgtacaattgggacgcattggagatgcagtggagatatctgtacgacacccaattgaaagtttcacccgaggaactgccactggtgattacgatgcctgccaccaatggtaaaccggacatggccatattagagcgctactatgagctggcgttcgacaaattaaatgtaccagtattccagattgtaatcgagccattggcaattgccctatccatgggcaagagttctgcattcgtgattgatatcggcgcgtcaggctgtaacgttactcccatcattgacggtattgtggtgaagaatgctgtagtgagatctaaatttggcggtgatttcttggattttcaagtacacgaaaggttggctccactgattaaagaagagaacgacatggaaaacatggccgacgagcaaaaaaggtccaccgacgtttggtacgaagcaagcacgtggattcagcaattcaagtctactatgttgcaagtaagcgaaaaggacttgtttgagttggaaaggtattacaaagagcaagcagatatatacgctaagcaacaggagcagttaaaacaaatggatcagcaacttcagtacacggcgttaacgggaagccccaacaatccgttggttcaaaagaaaaattttctattcaagccattaaacaagactttaaccttggaccttaaggagtgctaccaattcgcagagtatctcttcaaacctcaactgatatcagacaaattctcaccagaggacggactgggaccgctaatggcaaaatcagtcaagaaggccggcgctagtataaattcaatgaaggccaatacctccaccaacccaaacggattgggtacaagccatataaacaccaatgttggcgataataacagtactgccagcagcagcaacatatcaccagaacaagtatactcgctactgttgacgaacgtcatcatcacaggatctacctctctgatcgaaggtatggagcaacgcataataaaggagctgtcaatcaggttcccgcaatacaaattgacaacttttgccaaccaagtcatgatggaccgtaaaatccagggatggctgggcgcccttacaatggccaatctgccatcatggagcttgggaaaatggtactctaaggaagattacgaaacgctgaaaagagacagaaagcagtcgcaggctacgaacgcaacaaactag

SEQ ID NO: 46203 - DNA, 598 bp, Saccharomyces cerevisiae
gatcgaagctcactacagagcttgtttgtatgccggattagaaatttctggtattaacgctgaagtcatgccatctcaatgggaattccaagtcggtccatgtaccggtattgacatgggtgaccaattatggatggccagatactttttgcacagagtggcagaagagtttggtatcaagatctcattccatccaaagccattgaagggtgactggaacggtgccggttgtcacgctaacgtttccaccaaggaaatgagacaaccaggtggtacgaaatacatcgaacaagccatcgagaagttatccaagagacacgctgaacacattaagttgtacggtagcgataacgacatgagattaactggtagacatgaaaccgcttccatgactgccttttcttctggtgtcgccaacagaggtagctcaattagaatcccaagatccgtcgccaaggaaggttacggttactttgaagaccgtagaccagcttccaacatcgacccatacttggttacaggtatcatgtgtgaaactgtttgcggtgctattgacaatgctgacatgacgaaggaatttgaaagagaatcttcataa

SEQ ID NO: 46204 - DNA, 1437 bp, Saccharomyces cerevisiae
atgggcgcaaccaaaattttaatggacagtactcatttcaatgagatccgtagtataatccgttcgaggtcagtggcatgggacgccttagccagatctgaggaattgagcgaaattgatgcgtctactgcaaaagcgttagaatccattctggtgaagaagaacattggtgacggtttatcatcttcgaacaatgcacattccgggttcaaagtgaatggcaagacgttgataccattaattcacttactttccacctcagacaacgaagactgcaaaaaatctgtgcagaacctaatagctgaattgttatcgtctgacaagtatggagacgataccgtgaagtttttccaagaagaccccaagcaattggaacaattatttgatgtgtcactcaagggagacttccagactgtgctaatctctgggttcaacgtggtctcactcttagtgcaaaatgggttgcacaatgtgaaactagtggaaaagctgttgaaaaacaacaacttgatcaatatcttgcaaaacattgagcagatggacacttgttacgtgtgcatcagactattgcaagaactggccgtgataccagagtatcgtgacgtgatatggttgcatgagaagaagttcatgcccaccttattcaagatcctgcaacgtgccacggactctcaattggccacgcggatagttgcaacaaactccaaccacctgggtattcaattgcagtaccactctttactattgatatggttgctgacctttaacccagtttttgcaaacgagctagtccagaaatacttgagtgatttcttggacctcttgaaattggttaagataaccataaaggagaaagtgtccagattgtgcatatccatcatcctgcaatgttgctccacgcgcgtcaagcagcacaagaaggtgattaagcaacttttgttgctcggcaacgcgttgcccaccgtacagagcttgagcgaaagaaagtattccgacgaagaattgcgtcaagacatcagcaacctcaaggaaatcctagaaaacgagtaccaagaattgacctccttcgatgaatacgtcgccgaattggactccaagttgctgtgctggtctccaccacatgtcgacaacggtttctggtccgataacattgacgagttcaagaaggacaactacaagatctttagacaattgatcgaactcttgcaagcaaaggtccgtaacggcgacgtcaacgcgaaacaagaaaagatcattatccaagtcgccttgaacgacatcactcacgtggtcgagcttctaccagagagcatcgacgttctcgacaagactggcggcaaagccgacatcatggagttgctgaaccattcagattctagggtgaaatacgaggccctcaaggccacgcaggcaatcattggatataccttcaaataa

SEQ ID NO: 46205 - DNA, 1425 bp, Saccharomyces cerevisiae
atggaggtaacttcaatgtttctcaatagaatgatgaagaccaggactggtctttatcgcttatattcaacccttaaagttccacatgtagaaatcaatggcataaaatacaagaccgacccacagactaccaatgttacagattcaataataaagcttaccgacagatcattacatttgaaagaatcacatccagtaggcattcttcgcgatctaattgaaaagaaattaaactcagtcgacaacacatttaagatctttaataatttcaagcccgtggtaaccacaatggaaaacttcgattctttagggtttcctaaggatcatcctggaagatcaaaatctgacacatattatataaatgagacgcacctactgagaacacatacttcagcccacgaattagagtgctttcaaaaaataagaaacgattcagataatattaaaagtggatttttaatatctgcagatgtgtacagaagagatgaaattgacaaaactcactatccggtattccaccaaatggaaggagccacaatttggaaacgaacgaaggctgatgtgggcgtaaaggagccaatgtatatcgagaaaatccgtgaagatatcagacaggtagagaaccttttaaataaagaaaatgtaaagattacggttgacgatgatactatacctttgaaagaaaataatcctaaacaagagtatatgtccgatctggaggttgatttgtgctctcaacatttgaagaggtccattgaactgatagtttctgaagtttttaacaaaaaaatatctagcatgatcaagaacaaagcgaataatacacccaaagagctaaaagtccgttggattaacgcttacttcccctggaccgcgccctcatgggaaatagaggtttggtggcagggcgaatggctcgaactctgcggatgcggattgattcgtcaagatgtgctactaagagccggatataaaccttctgaaacaattgggtgggcttttggcttgggtttggaccgcattgctatgcttctttttgaaattccagatattagactgctttggagtcgtgatgaaagattttcaagacaattctccaagggattaattacttccttcaaaccttattcaaaacacccgggatcatttagggatgttgcgttttggttaccagaagataaaccagatattcatcaagttcatgaaaatgatttgatggaaattatcagaaatatagctggcgatttggtagagagtgtcaagctagtcgatagctttacgcatccgaaaactgggagaaaatctatgtgctacaggatcaactatcaatcaatggacagaaatttgacaaacgccgaagttaacactttgcaagacatggtgtgttctaaattggtaaaagaatacagcgtagaactcagatag

SEQ ID NO: 46206 - DNA, 531 bp, Saccharomyces cerevisiae
atggaaatagtgtacaagccattggacatacgtaacgaagagcagtttgctagtattaaaaaactaatagatgcggatctatcagagccgtactcgatatacgtatataggtatttcttgaaccaatggcccgagttaacgtacattgccgttgacaacaagagtggaacgcctaacatacccattggttgcatagtgtgtaagatggacccgcatagaaacgtgagactgagaggatatataggaatgctagccgtagagtccacataccgcgggcatggcatagcaaagaaactagtggaaattgccatagataaaatgcaaagggaacattgcgatgagatcatgttagaaacagaggtggaaaattcggcggctctaaacttatatgaaggaatgggtttcatcagaatgaaacggatgttccgctactacttgaatgaaggggacgcctttaaactgatattgccgttgactgaaaagagctgcactcggtctacgttcctaatgcatggccggctggccacataa

SEQ ID NO: 46207 - DNA, 1167 bp, Saccharomyces cerevisiae
atgaattgcacacttacagataataccagagccataaatgtggcctccaacctcggtgctcctcaacagaggacgatttttgccaaggagagaatatccatcccaggatactacgagataatccaattcctgggcaagggagcctatgggacagtgtgctcagtgaagtttaagggtcgaagcccagctgctaggatagcggtaaagaagatcagcaacatctttaataaggagatccttttgaaaagggccatccgtgagctaaaattcatgaacttcttcaagggccataaaaatattgtaaatctaatcgatctagagatagtgaccagctcgccctatgacggactgtattgctaccaggaactgattgattatgatttggcaaaagtcatacattcgtccgtgcagctctcggagtttcatatcaaatactttctttaccaaatcctgtgtgggctaaagtacatacacagtgcagatgtcatccaccgagatttgaagcctgggaacatattgtgcacattgaatggctgtttgaagatctgcgattttggtctcgctaggggtattcatgccggatttttcaagtgtcattccactgtgcagccccatataaccaactacgttgctacaagatggtatagggcgcctgagctgcttctttccaaccaaccgtatagtaagtccgtagacatatgggctgtagggtgcattcttgcagaattctatgctcgaaagcctgttttcatggggcgtgactccatgcaccagatatttgaaatcatcaaagtcttgggtactcctgataaagatattctgatcaagtttggcaccattaaagcttggaatctaggcaaaaacagtaataaccctgtatataaaaaaatcccatggtccaacattttcccctttgcctcgcatgaagcaatcaatctcatagagtcattacttcattgggactcaacacataggttaaacgtggaacaagctatatcacatccgttcctaaacgaggtgcggaagccagacgacgagcctgtttgccttcagggtcctttcgacttcacctatgaatccgagttgaattcaatgtccaaattaagagactacttggttgaagaagtgaaaaatttcaaaaccgatttgtcctcctcgtctttatag

SEQ ID NO: 46208 - DNA, 3198 bp, Saccharomyces cerevisiae
atggattacctaaaaccagcgcagaaggggagaagacgtggtctttccataaacagtctttcggagactcagcaatctgctatgaatagttccctggaccatcttcagaatgacttaaacaggataaatcttcaatggaatagaatactgtcggataacactaatcccttagaactagcgctcgcatttttggatgatacatctgtaggtctgggccaccggtatgaagaattcaatcaattaaagtcacaaattggtagtcacttacaagatgttgttaatgaacatagccaagtgttcaacactaatgtggcttcttacggaaaagcagtcagttcgatcatgcaggcccaagaacagactttaaatctgaaaaattgtttaaaggaagctaatgagaaaatcaccactgataaaggttctttacaggaattaaatgataataacttgaagtatacaaaaatgattgatgttttagtcaatattgaggagttattacagatacccgaaaaaattgaggagaacattagaaaggaaaatttccatcaggtgcaaattctcctagaaaggggtttcatattaatgaacaacaaatctttgaagacagtggagattttaaagcctataaaccaacaacttgagttacaagaacatttacttttcaacaatctgattgaagaaattcacgacattatgtactccaaatctaacaaaacaaattttactcgagtaaccaataatgatatattcaaaatcataagcatttcacataatggatttacgagtttagaaaattacctgtacaacatagtcaatattgatattatggaacactcaaaaacgataaacaagaaccttgaacaattcattcatgaccaatcgttaaataaaggaaatatcatgctacaagaaaatgctgcgactcaagcaccattggcaccatctagaaaccaagaaaacgaaggatttaacagaatagggttcctactaaaaaccataaataacatcaataaattacctgttgcattcaatataataacagaaagggctaaagaggagattcataatataattgttaaaagtaccgaatcaatacgttcgaagcacccttctctgcttaaaatggctactagtttaaagaatgacaaccattttggcctacccgtacaggatatactatcgatcattttaagggaatgcttttgggaaatatttttgaaattactgtatgctattcagtgccatagggctatttttgaaatgtcaaacattttgcagccaacgtcttccgcaaagccagctttcaagttcaataaaatttggggcaaactgttagatgaaatagaattattacttgtgaggtacatcaatgaccctgaattgatatccagcaataacggtagtattaaaccaattaatggcgcgacaaataacgcacccactttacctaaaaggaaaaatcctaaaattttttctttggagtataacattgaggacaattcttctgtaaaggatcaagcttttgaactaaaggctttgttgaaagatatattccctggattttctgtctcctcaaacatggatttagactctatttatgtaaaagatgaatccttcgaacaagatgagcctctagtccctccttctgttttcaacatgaaggtaattttagatccgtttttgctgtttacgcaatcgacatctacaattgttcccagtgtcttaacacaaaatactatttcatccctaacctttttcgatgattatatgaataaaagttttctcccaaagattcagatgactatggattatttattcacggttgaagtagaatccaataatccgtacgccttagagctatccgatgaaaatcataacatttttaaaacagcattagattttcaaaggttattttacaatttattgaatgttttcaacacagcaaacacatttagagaaaaaatatcgtactgcattctagatcttttgaatcatttttataattactacttggggctatttaattccttgattggtacttctgatagacatttaactaggaaaataattacggcatggttgcagaatggtattttgatggatcaagaacaaaaaattctgaatggggatgagacactctttcatgaagaatccatagagttatttaaggaaatacctcatttctatcaagcgggtaaaggtttgagcaaatctgatttattcaataacttgacattggacacaattctgcagttttcggcaagcgtgttatggatattaaactggctgccaggcttaaaaaaggctatcaatattgatgaagtaagccaagaacccatgttagatgctgatagattaaggagcagctggacattttctgaatcaatggatttaaactattcgaaccctagttccagcccaaattcattaggaaatctaaaaattttattggatgataaagcctccaaaaaatttgatgagactatcgacggattcaaaaccttgaaattcaaactaatcactatactgaggttcaacattagggccttgtgtatatacgacatcgggtctttttttcaaaacaccaaaatttggaatatggatgtgggtagtattgaattagatcaaaatatagcttctctaatttccgaattaagaaggactgaaagcaaattgaaacaacagttaccagaaaaggaaaaaaactccatatttattggtcttgatatagtcaacaactacgccttgattaagggtgccaaatccataaaagttttgaaccataacgggataaagaaaatgttgagaaatgtaaatgtcttacaacatgcctatagaaatctttcttctgaaccatcaaaaattaatatgaacgtcacaatgaatttttactctttatgcggctccagtgaagctgaactatttgaatatataaaagacaatgaattaccgcattgttctgtcgaagatttgaaaaccatattgaggctgcagtttagcgaggaaatgcatcgtcaattgaagagacaaagcactagctcaactaagggttccataaaaccttccaataagaggtacactgaagctttggagaaactaagtaacctcgaaaaagagcagtcgaaagaaggagcccgcaccaagattggaaaacttaaaagcaaattgaatgctgtccatactgcaaacgaaaaatga

SEQ ID NO: 46209 - DNA, 924 bp, Saccharomyces cerevisiae
atgtctgaagaatttccatctcctcaactaatcgatgatttggaagaacatccacagcatgataatgctcgagtcgtgaaagatttgcttgcaggtacagcgggtggtattgcgcaagtgctagtgggccagccctttgatacgacaaaagttaggttacaaacatcgagcaccccaacaacagccatggaagtcgtcagaaagctgcttgccaatgaagggcctcgcgggttttacaaaggaactctgacgccattaattggtgttggtgcatgtgtttcattacaatttggtgttaatgaagctatgaagagattttttcatcatcgcaatgctgatatgtcatcgactttgtcattgccacagtattacgcatgtggtgtcacaggcggtatagtaaactcattcttggcgtccccaattgagcatgtcaggattcgcttgcaaacacagactggctcaggcaccaacgcagaattcaagggtcctttggaatgcatcaaaaaattaagacataacaaggccttgctacgtggtttaacacctacaatattgagagaaggtcatggatgtggcacatatttcttagtgtatgaagcgttgattgctaaccaaatgaacaaaagacgtggactagagagaaaggacattcctgcatggaaactttgtatttttggagcattgtctggcactgccttatggttgatggtatatccattagatgtcatcaagtctgtcatgcaaacggataatttacaaaagcctaaatttggtaattctatttccagtgtagccaagactttatatgccaatggagggataggcgcttttttcaaagggtttggtcctaccatgctaagagctgctcccgccaatggtgccacttttgctacttttgaattagcgatgaggttattgggttga

SEQ ID NO: 46210 - DNA, 1413 bp, Saccharomyces cerevisiae
atgtcgaaattggtcatatcaacgtcaatatttcagtctcaagtagcagatttactcccatgtaacaatcatcaaaaatcgcagctgacatattccctaataaacgcgtacgatcttctccagcactttgacgaagtgctaacatttccctacgccagaaaggatgatctgctggagttccattcgaaatcatatatcgattatttgataaatggcagattcaataaaatgatggcacaagatgtaaataatcccatggtagagtccaaatggagtgagttgagtgaattggccgataattggaacgaaaaaatcgactacaatccatcgcaagatcttcagagattcaccactagagagaatctctataattattatctgaatcactcacaagcgctcgaaaataatatggactgtattaataacagtgaggtgcccaccaatgataaaccaacagatacttatattttaaattctgaaacaaaacagtataatttagagggagattgcccgattttttcataccttcctatgtactgtcaagttattacaggtgcgactttaaacttgttggatcatctatcgcctacagaacgtcttatcggtataaattgggatggtggaagacatcatgcctttaaacagagggcaagcggattctgctatataaatgacgtggtactgttaatacagagattgcgcaaagcaaagctaaataaaatcacgtacgttgacttcgacttgcatcatggtgacggtgtagaaaaggctttccaatattctaaacaaatacagacaatttcagtacatctctacgagcctggtttttttcctggaactggttctttaagtgattcaagaaaggataagaacgtggttaatattcctttaaagcatggttgtgatgacaactacttggaattgatcgcatccaaaatcgtcaatcctctaatagaaagacacgaacctgaggccttaataattgaatgtggtggtgatgggcttctgggtgatagattcaatgaatggcagctaacaatacgagggctttctcgaatcatcataaatatcatgaaaagttatcctcgagcgcacatattcctacttggagggggtgggtacaacgatttactaatgagtagattttatacgtacttgacttggtgtgttacaaagcagttttccaacttaagatgtggtgacaataattcgttccaaatcgatccatttgatgtctgtgatggtgatgattctgaacaatttatacgtgaacatgatcttgttgaaatgtataatgaagagaactatcagtattggatatatgagatggaaggaagttctcgaatgaaaatgttaaggaatgacaataaggatagagatatggtcgaacttatgaagttttacgaactgtaa

SEQ ID NO: 46211 - DNA, 2043 bp, Saccharomyces cerevisiae
atgactcaattcactgacattgataagctagccgtctccaccataagaattttggctgtggacaccgtatccaaggccaactcaggtcacccaggtgctccattgggtatggcaccagctgcacacgttctatggagtcaaatgcgcatgaacccaaccaacccagactggatcaacagagatagatttgtcttgtctaacggtcacgcggtcgctttgttgtattctatgctacatttgactggttacgatctgtctattgaagacttgaaacagttcagacagttgggttccagaacaccaggtcatcctgaatttgagttgccaggtgttgaagttactaccggtccattaggtcaaggtatctccaacgctgttggtatggccatggctcaagctaacctggctgccacttacaacaagccgggctttaccttgtctgacaactacacctatgttttcttgggtgacggttgtttgcaagaaggtatttcttcagaagcttcctccttggctggtcatttgaaattgggtaacttgattgccatctacgatgacaacaagatcactatcgatggtgctaccagtatctcattcgatgaagatgttgctaagagatacgaagcctacggttgggaagttttgtacgtagaaaatggtaacgaagatctagccggtattgccaaggctattgctcaagctaagttatccaaggacaaaccaactttgatcaaaatgaccacaaccattggttacggttccttgcatgccggctctcactctgtgcacggtgccccattgaaagcagatgatgttaaacaactaaagagcaaattcggtttcaacccagacaagtcctttgttgttccacaagaagtttacgaccactaccaaaagacaattttaaagccaggtgtcgaagccaacaacaagtggaacaagttgttcagcgaataccaaaagaaattcccagaattaggtgctgaattggctagaagattgagcggccaactacccgcaaattgggaatctaagttgccaacttacaccgccaaggactctgccgtggccactagaaaattatcagaaactgttcttgaggatgtttacaatcaattgccagagttgattggtggttctgccgatttaacaccttctaacttgaccagatggaaggaagcccttgacttccaacctccttcttccggttcaggtaactactctggtagatacattaggtacggtattagagaacacgctatgggtgccataatgaacggtatttcagctttcggtgccaactacaaaccatacggtggtactttcttgaacttcgtttcttatgctgctggtgccgttagattgtccgctttgtctggccacccagttatttgggttgctacacatgactctatcggtgtcggtgaagatggtccaacacatcaacctattgaaactttagcacacttcagatccctaccaaacattcaagtttggagaccagctgatggtaacgaagtttctgccgcctacaagaactctttagaatccaagcatactccaagtatcattgctttgtccagacaaaacttgccacaattggaaggtagctctattgaaagcgcttctaagggtggttacgtactacaagatgttgctaacccagatattattttagtggctactggttccgaagtgtctttgagtgttgaagctgctaagactttggccgcaaagaacatcaaggctcgtgttgtttctctaccagatttcttcacttttgacaaacaacccctagaatacagactatcagtcttaccagacaacgttccaatcatgtctgttgaagttttggctaccacatgttggggcaaatacgctcatcaatccttcggtattgacagatttggtgcctccggtaaggcaccagaagtcttcaagttcttcggtttcaccccagaaggtgttgctgaaagagctcaaaagaccattgcattctataagggtgacaagctaatttctcctttgaaaaaagctttctaa

SEQ ID NO: 46212 - DNA, 1377 bp, Saccharomyces cerevisiae
atgggtaaagagaagtctcacattaacgttgtcgttatcggtcatgtcgattctggtaagtctaccactaccggtcatttgatttacaagtgtggtggtattgacaagagaaccatcgaaaagttcgaaaaggaagccgctgaattaggtaagggttctttcaagtacgcttgggttttggacaagttaaaggctgaaagagaaagaggtatcactatcgatattgctttgtggaagttcgaaactccaaagtaccaagttaccgttattgatgctccaggtcacagagatttcatcaagaacatgattactggtacttctcaagctgactgtgctatcttgattattgctggtggtgtcggtgaattcgaagccggtatctctaaggatggtcaaaccagagaacacgctttgttggctttcaccttgggtgttagacaattgattgttgctgtcaacaagatggactccgtcaaatgggacgaatccagattccaagaaattgtcaaggaaacctccaactttatcaagaaggttggttacaacccaaagactgttccattcgtcccaatctctggttggaacggtgacaacatgattgaagctaccaccaacgctccatggtacaagggttgggaaaaggaaaccaaggccggtgtcgtcaagggtaagactttgttggaagccattgacgccattgaacaaccatctagaccaactgacaagccattgagattgccattgcaagatgtttacaagattggtggtattggtactgtgccagtcggtagagttgaaaccggtgtcatcaagccaggtatggttgttacttttgccccagctggtgttaccactgaagtcaagtccgttgaaatgcatcacgaacaattggaacaaggtgttccaggtgacaacgttggtttcaacgtcaagaacgtttccgttaaggaaatcagaagaggtaacgtctgtggtgacgctaagaacgatccaccaaagggttgcgcttctttcaacgctaccgtcattgttttgaaccatccaggtcaaatctctgctggttactctccagttttggattgtcacactgctcacattgcttgtagattcgacgaattgttggaaaagaacgacagaagatctggtaagaagttggaagaccatccaaagttcttgaagtccggtgacgctgctttggtcaagttcgttccatctaagccaatgtgtgttgaagctttcagtgaatacccaccattaggtagattcgctgtcagagacatgagacaaactgtcgctgtcggtgttatcaagtctgttgacaagactgaaaaggccgctaaggttaccaaggctgctcaaaaggctgctaagaaataa

SEQ ID NO: 46213 - DNA, 1038 bp, Saccharomyces cerevisiae
atgatgactagggagagcatagataaaagagcaggaagaaggggtcctaatctgaatattgtgctgacgtgtccggagtgcaaagtctacccaccaaaaatcgttgaaagatttagtgaaggggatgttgtatgtgctctatgtggtctagtactatcagataaactggttgacaccaggtcggagtggagaacgttttcaaatgatgatcacaacggtgatgacccaagtcgtgttggtgaggcttcaaatcctcttttagatgggaataacctatctacaaggatcggaaagggtgaaaccacggatatgagattcaccaaagaactgaataaggcacaaggaaaaaatgtgatggataaaaaggataatgaagtacaagctgcatttgctaagattaccatgctatgtgatgctgctgaattaccgaagattgtgaaagattgtgccaaggaagcatataaactttgccacgatgaaaaaactttgaaggggaaatcaatggagagtataatggctgcatccatactgattggttgcagacgtgctgaagtggcaaggacttttaaagaaatccagtcattaatccatgtcaaaactaaagagtttggtaaaactttaaacataatgaagaacattttaagaggcaagagcgaagatggtttcttgaagattgataccgataatatgagtggtgcacaaaacctaacttatatacccaggttttgttcgcatctgggcttaccgatgcaagtcactacttctgctgaatataccgcaaagaaatgtaaagagatcaaagaaattgcaggtaaatcccctattactatcgctgttgtttccatctatctaaacatcctgctctttcagatccctattaccgcagcgaaagtgggccaaaccttgcaagttactgaaggtaccatcaaatctggttacaagatactttatgagcatagagacaagcttgtggatccgcagcttattgctaatggtgtagtgtctttggataacttaccgggcgttgaaaagaaataa

SEQ ID NO: 46214 - DNA, 864 bp, Saccharomyces cerevisiae
atgcaagctattgccgatagtttcagtgtaccaaacagattggttaaggaacttcaatatgacaacgaacaaaacttagagagcgatttcgtaacgggcgcctcccagtttcaacgtttggcaccatcgcttacggttccaccaattgcgtctccacagcagtttttaagagcacacacagatgattcacgaaacccagactgtaaaatcaagatcgcacatggtactacaaccttagcatttagatttcaaggcggtattattgtggcagtagattctcgtgccactgccggcaattgggttgcttctcaaactgtgaagaaagttattgagatcaacccatttttattgggtacaatggctggtggtgcggcagattgtcaattttgggaaacttggctaggttctcagtgtaggctgcacgagctgagggaaaaggaacgtatatctgtcgcagccgcatccaagattttaagcaatttagtataccaatataaaggggccggtttatcaatgggtactatgatctgtggttacactaggaaggagggcccaaccatttattacgtcgactcagacggtacaagattaaaaggtgacatattctgcgttggttcaggtcaaacatttgcatatggtgttctagactctaactataaatgggatttatccgttgaagatgctttatatctaggtaagagatctattttagctgctgcccatagagatgcttactctggtggttctgtaaatttatatcatgttaccgaggatggttggatatatcacggtaatcatgacgtaggtgaactattttggaaggtcaaggaagaggaaggatctttcaacaacgttattggctaa

SEQ ID NO: 46215 - DNA, 1695 bp, Saccharomyces cerevisiae
atgttttcacgaagtgatcgagaggtagatgatttggctggtaatatgagtcatttagggttctatgatttgaatattcctaaacctacttctccacaggcgcaatataggcctgctagaaagagcgaaaatggaagattaactcccggacttccaagatcatataagccgtgtgattcagatgatcaagataccttcaaaaatcgcatttcattgaatcactcaccgaagaagctacccaaggattttcacgagcgtgcttcccaaagtaaaacccagagagttgttaatgtatgccaactttactttctcgactattactgtgacatgtttgattatgttattagcagaagacaacgtacgaagcaggtgctaagatatcttgaacagcaaagaagtgtcaaaaacgtttctaataaggttttaaatgaagaatgggctttgtatttgcaaagagaacacgaagtactgagaaaaaggaggttgaaacctaagcacaaggattttcagatactgacacaagttggacagggtggttatgggcaagtttatcttgcaaaaaaaaaagacagtgatgaaatttgtgctttgaaaatattaaacaagaaacttttattcaaactaaacgagacgaatcacgtccttactgagagggacatactaaccacaactagatctgactggcttgtgaagttgctttatgcatttcaggatccagagagcctatatttagcaatggaatttgtacctggtggtgattttcgcacattgttaataaatacaaggatattgaagagcggtcacgcaaggttctatatcagcgaaatgttttgtgccgtgaacgcgttgcatgaacttggttacactcaccgggatttaaagccggagaatttcttgattgatgctacagggcatatcaagctgaccgattttggtctagcagcagggaccgtatcaaatgaaagaatcgaaagcatgaaaatacgcttagaagaagtaaagaatttggaatttcctgctttcacagaaaggtctatcgaggatagaaggaaaatatatcataacatgaggaagacagaaattaattacgctaactctatggtcggttcgcctgattatatggccctagaagttctggaaggtaaaaaatacgattttacagtggattattggtcattaggctgtatgctttttgaaagtttggttggatatacaccttttagtggttcttctactaatgaaacttacgagaatttaagatattggaaaaaaactttaagaaggccccgtactgaggatagaagagcagcattctcagatagaacctgggatttaattacaagactaatagctgaccccatcaacagagtacgatcttttgagcaagttcgcaaaatgtcttatttcgcagagatcaattttgaaaccctaagaacaagttctccaccatttattcctcaattagatgatgaaacggatgcaggttatttcgatgacttcacaaatgaagaagatatggctaaatatgcagatgtcttcaaaagacagaacaaattatctgcaatggtcgatgactctgccgttgattccaagcttgttggatttacttttaggcatagagatggaaaacaaggttcaagcgggatactttacaatggttcagaacattcagaccctttttcaactttttattaa

SEQ ID NO: 46216 - DNA, 663 bp, Saccharomyces cerevisiae
atgagttcgaattcaacaccagaaaaggttactgcagaacacgttctgtggtatattcccaataagatcggttatgttcgtgttatcaccgccgccctttcttttttcgttatgaagaatcatcctacggcctttacatggttgtatagtacatcatgtctactggatgcgctagacggaaccatggcaagaaagtacaatcaggtttccagtctgggtgccgttctggacatggttaccgacagatccagtaccgctggcttgatgtgtttcctttgtgtgcagtatccccaatggtgcgttttcttccaattaatgctgggcttggatattactagtcactacatgcatatgtatgccagtttaagtgctggtaagacttctcataaaagtgtgggcgagggtgagtccagattgttacacctgtactacacgagaagagacgtactgttcactatctgtgcgtttaacgaactattttatgctggattgtacttgcagttgttctcaaattctgcaacctttggtaaatggactacaatcataagtttccctggttacgtgttcaagcagaccgcaaacgttgtccagctaaaaagggcagccttgattttagcagacaacgatgccaagaatgccaacgagaagaacaagacttactga

SEQ ID NO: 46217 - DNA, 1476 bp, Saccharomyces cerevisiae
atgtccaacccaatagaaaacacagaaaactcacagaatactagttcatcaaggtttttgaggaatgtacaaaggttggccttaaacaatgtaacaaatacgacatttcaaaagagtaatgcgaataatccagccctaacaaatttcaaatctacactaaactcagtaaagaaggagggaagtcggattcctcaatttactagagaaagcgtatcaagatcaacagccgcacaagaggagaaaagaaccctgaaagaaaatggtatccaactccccaaaaacaatcttttagatgataaagaaaaccaagacccaagtagtcagcaatttggtgcgctaacttctataaaggaggggagagctgagctgcctgcaaatataagtttacaagaatcctcctcagcgaaggagataatccagcatgatcccctaaaaggcgttggatcaagcactgaggtagtccataactcggtagaaaacgaaaaacttcatccagctagaagtcaacttcaagttagaaataccgaaagtgaaactgatagtggaaaaaaaagaccaatttctacaattgttgaacaagaactgcccaaaaagtttaaagtgtgcgatgaaaatggcaaagaagaatatgaatgggaagacctagatgcagaagatgtaaatgatccattcatggtcagcgagtacgtcaatgatatattcgaatatctccaccaactagaggtcattactcttccaaagaaggaagatctctatcagcatagaaatattcatcaaaatcgagatatcctagttaattggttggttaaaatccataataaattcggcttattaccggagactttgtatcttgccattaacataatggacaggtttttaggtaaagagctagttcaactggataagttacaattggttggcacatcatgccttttcattgcctctaaatatgaagaggtctattctcctagtataaaacatttcgcatcagagacagacggtgcatgtacggaagatgaaatcaaagaaggggagaaattcattttaaagacattgaaatttaacctaaattatcccaatccgatgaattttctgagaagaatttcgaaagcagatgactacgatatacagtctcgaactcttgccaaattcttattagagatatcattggtagatttcagatttattgggatactaccctcattgtgtgcagcagctgcgatgtttatgtcgagaaaaatgttaggtaaaggtaaatgggatggaaatctaatacactatagcggcgggtatactaaagaagaacttgcgcccgtgtgtcacatgataatggattatctagtgagtccaattgttcatgatgaatttcatagaaaatatcaatctagaagatttatgaaagcttctataatttccgtccaatgggctttaaaggttagaaaaaacggctatgatataatgaccttgcatgaatga

SEQ ID NO: 46218 - DNA, 1308 bp, Saccharomyces cerevisiae
atgggagagaaccacgaccatgagcagagtattaaaagaaattctatgatttataatgaaaatgagaggcagttgtgcaattcaaacctaaagattcttcaaaataaaagggccctttcaaaaaatgacagctctagtaagcagcaggttcaggattctaaaccaagaagggctttaacagatgtaccagtgaacaataatcctttaagccagaacaagagaatagtagcagggagcaaggcggccaaagtacgaagagaagaaaacattagacctattgttagcgccgttcaaaaaagacagatatataacgatcgaacggcagcagagcaagaagaagaagaagaagaagaaggagaagatgatgatgctgcttcgatagtgaacaaaaaacgcagaatagacgctgaaggagtgagtgaaatagtaggctggcaggacctagattatgttgaaaaagatgatactgcaatggtagcagaatattctgctgaaatttttgcatttttatatagaagagaattagaaacgttaccatcgcacaactatttactcgacaaaacgtccaagtattatttgaggccttccatgagaacaatattagtggattggctggtagaggtgcacgaaaaatttcaatgctatccggaaacgttattcctatccataaacttaatggatagatttttagctaaaaataaagttacgatgaacaagttacaattattggcagttacctcacttttcatcgcggcaaaatttgaagaggtaaatttgcccaaactagctgaatacgcttatatcactgacggcgcggcttctaaaaacgacataaaaaatgcggaaatgttcatgctcacttccttagaattcaacattggttggcccaacccactcaatttcctaaggaggatctccaaggcagatgattacgatccggttaatagaaatattggtaagtttattttagagtatgcctactgctgccaccaattcattcatttacctccatctaccgtaagcgcaatggcaatgtatatagcgagaagaatgaccaacagaaacaagaacgagctatggaatggaacactacagcattacagtggtggtatcgatccaatacacgatgaagcgtttcagtctctctgcattgatctagtcaaagacatcgctagttccaaaactcatttagattcattgattttgaagtacaagaaaccaaggtatggctctgtttatttccaaactttcaagtggtgtacatccgaaatgcatagcaactttcaaaatctatttaatcttaagtag

SEQ ID NO: 46219 - DNA, 3627 bp, Saccharomyces cerevisiae
atgtccttgagagaagtaactaattatgaagtctcgttttacatcccgttgtcttacagcaacaggactcataaagtttgtaaactgccaaacggaattttagcattaataatatcggatccaacagatacttcaagctcatgctcactgactgtttgcacaggttcccataacgatccaaaggatattgccggtttggcgcacctttgtgagcacatgattctttctgccggttccaaaaaataccctgatcctggtttattccacacactaatcgcaaaaaacaacggctctcaaaatgcctttaccacaggggagcaaacgactttttattttgaattgcccaatactcaaaataacggcgaatttacatttgaatctatcttagatgtgtttgcctcattcttcaaagaaccgctcttcaaccctttactgataagcaaggagatatatgcaatacaaagtgagcatgagggaaacatatcatcaaccacaaaaatattctaccacgcagcaagaatattggccaatcccgaccatcctttcagtcgcttttccactgggaacatacactcgttatctagcattccacaactgaaaaaaataaaactaaagagctcattaaacacttacttcgaaaataatttttttggggagaatataaccttgtgcataaggggaccgcagtctgttaatattcttacgaaactagctctatcaaaatttggcgatataaaacccaaaagcgctgtaaaggaaaggagtatatcgattaggacgaggtcatttcgaagatcgaagtctttaaaaaaacgccaagattcttccaaaaacgactacagtgacttgaaaacctttaaaatactgaacacaacgtgggaaaaaaaatacaaaaatacgatgtgttttcaacaatttcctgaatgcaattcgatatttatcaattcaaataaggtacctataatgagacttctctttcctgttagcgataaaaacactcggtttacaaaggatgacattaaaatatacagtcatctttggtgtgaacttttcggcgatgagtctccaggatctttgagctattacttagcttcaaaaggctggctcacaggctgttttgcctttacctcagaattcgctattggtgacataggattaattttggaattagaactgacaaacagtggctgggaaaatattaagagaattacgacaatagtacttaatagactcttgccttccttttacgtaatgaacatcgattacttaatcacttttttgaaagaacagaatttgatcgacctcgttagctttctgtaccaaagttcagaggatcttccaatggaagagtgctcaaaattaagcggtattcttcaggacgatttagaatgtttaaccccccctaatatattcaaaggatttaaatctcttatagaaatagatgatcccaacatcgaaaaatatgaaaacacaaaggccaatatacaatggtggacagggcaagctattaagttccaaaattttttaaaatctttcatgaatcatgacaacatgcgccttttactcttagggaatataaaatctggtaatatatttgataaaatgaaaaataaaagtgatatatgcaccgattttttctatgaatttgagtattatacggcaaacgttcatctagcaagtgataataaatttcattcaaacagctcgtatgaatttaattttcccacaggtaatctttttttaccagattgcgtcagcgatcctttaaaactacaacagctcttcttagaatgctcgttaaaatcgaaatttgctacgcttagacctcaaatttatagtgagcccactaggacaaagcctcaattagtcagtgagaaccagaattatgagatgtggatcttaaaagaagacccaaattttgcctcagacaataaatccgtcgtatcatttgaagttttggggttaggcatcaaacctagtccggaggcaacaatccacctggaagtactagcacaggcattatttatcatcacctcttcattcctttatcccgctctgagaattggttacacatatgagattgcctcatctagtaagggcaacgtaacactgcgatttactatttctggattccctgagggtgttttcacaatagtaaagacgttcgtggatacgctaaaacttattgcaacagatccaacgtttctttctaaagataccttgagaaaggcaaggattttagttagaaataaatacaagaacgcgtcatcggacaactgcgtgaagctagctagcgttggattgctgattgttttagagaaatatatatggactttagaggatagaattaatgcattagagcttaccgagttggaatccttcgaaaaattttgttttttattctggaggaatcctaaacatttggtcttgttcatgcagggaagccttgaatatgctgacgcaatcaaccgttacttaaataacaattttacgcagcacctaaaaatcagcaatgaagggagcaaaccgaccatacgtctctaccctcctcccagtacaaaagatctagatcaaggcacaaatgcctttatatcatataatggtcaccaggatgatcccaacaatagtattgtgtattttattcagactgcacaaagagatgacatcaaaaatctgacactaacctttcttaccgaatatctattttcactaacgctagtgcctgatctaagaaataaaaagcaaattgggtacattgttttgggaggactcagggttttaacagacactgttgggattcatataaccgtaatgtctggcagctcggggcacaatctggaaactaggatcaatgagtacttatcttacttgcagctgcaggtgctaaatagattcaccgagtttgattttcgaaggatacttctagagccgttcttaaatcttttaaaacagaacagtacgaaacagtttgaagggtcggctggtcctgtagacctattaaatgagatagtggcaaatgtgcaaaatggtgataattacactctcaacaataaacaaatgagacaacataggaaggtaagaaataaaattgcggaaggaaggcttaattttcaagaagatcatgaaatgattgatatctcatttttgcaaaaattaactctaaagaaatatttagcattcttcgagtccaaaatctctatatattccgctcaaagaagtaagctatcaataatgatcacaagtccaatggcagagaaggaaattgcaagcaggaaaatgttccttcagctagaggcctttctgaaaataaacggattcgccataaaaaatgaagacttgaagaaaattgtcgaacattcaaagggaaatcctattttacttgtaaagaacctttttacttattttcgtaggagaaatgaagttttcaagctcggaaccgttgtattgcaggaaatattgaaaatcatcggaatgaatcttaagcagagatacggctctatattagggttttcttcccaagatggtgaaggacaagaaatagaaaaattttggaacaacgacacaagtccgattgttcctcttcaggagcttcctgaaccaaactttttccgcaaggccgcattttga

SEQ ID NO: 46220 - DNA, 959 bp, Saccharomyces cerevisiae
atgttaactctagagtctgcattaactggcgctgtggcttcggcaatggccaatattgcagtttatccgctggatttatcgaagacgatcattcagtcacaagtatctccttcttcaagtgaggatagtaacgaaggtaaagttttgcccaataggagatataagaatgttgtagattgcatgataaacatattcaaagaaaagggtattttgggtctgtatcaaggtatgacagtcactacggtggccacatttgtccagaattttgtttatttcttttggtacacatttatcagaaagtcctacatgaaacataagctgttaggactgcaatcactgaaaaaccgcgatggtcctatcacaccttctacgattgaagaattggtacttggggtagcagctgccagtatatcgcaactttttactagtcccatggctgtggtagctacaagacaacaaacagtccattctgcagagtctgccaaatttaccaacgttattaaggacatttaccgtgaaaataatggggacataactgctttttggaaaggtttaagaacaggtttagcattgacgataaatccttccatcacatatgcctcttttcaaagacttaaagaagtttttttccatgaccattccaacgatgctggcagtttgtcagcagtgcaaaatttcattttgggtgtcctttccaagatgatttcgactctagttacgcaacccttgattgtcgctaaagcaatgcttcaaagcgctggctctaaattcactactttccaagaagcgctactatacttgtacaaaaatgaagggttaaaatctctttggaagggagttcttcctcaattgacaaagggtgtcattgtgcaaggtctgttgtttgctttcagaggagaattgacaaaatctttaaagaggctaatattcttgtactcttcttttttcctaaagcacaa

SEQ ID NO: 46221 - DNA, 2784 bp, Saccharomyces cerevisiae
atggtttcagttatagacaagcttgtttttgactttggtgggaaaactctggtctctctcgcaccagataataatactttgtgtgtagccaataaaaatggcttaaccaagattctgaagacaaataacccagaagaagagccagagactttagattcttccaaattggtctcgtctataaaatgctattcaaactcgcactttctgatgactacaatgcaaggtgatgctcttaggtataacatcgattctagtcaagaagaattattggctagatttgctttacccctacgtgactgctgtgttattcattcaggtaaaatggccgtatttggaggagacgacttagaactaatccttttggaattggacgatgaaacacacaaaaaacatgccattaaaatcgatgaacaagtttctcaaatttcttacaattcacagatgaatattttagcagtttcaatgataaatggtaaggtacaaattttttctctgacatctactattccaaacaaagttcatgagttaaatgattacatagtggccaattcatatgatgatacacacagagataagatactctcgaatatgatggatgatatagataaagacaatgataatgacctgagtgaaacggctgatccagatgagaacaatgtagctgatccagaattctgtgctgctaatagaatttgcacgagagtggcttggcatccgaagggtctgcattttgcgctaccatgtgcagatgatacagtaaaaatattctctataaagggatattccctacaaaagacgttgtccacaaatctctcatcaacaaaggctcatttcattgatttgcaatttgacccgttacgtggaacttacattgcggcagtagatttaaataataagttaacggtatggaattgggaaacttccgagatccactacaccagggaattcaaaagaaaaattactaatattgcctggaaaatccaagcggactcaaaaactctagaccttgttttaggtacctggtccggtagtatagccattgtccaaaatttggcagagtccgtagtatctaatatacctgaccaatctgttgctgaatcttcaactaaacatgggctttttgtagactccgaatctgacttggaaaacttagagggaaatgatgatataaacaaaagcgataagctattttcagatattactcaagaagcgaatgcggaagatgtgttcactcaaacacacgacggccccagtggattaagtgaaaagagaaaatacaacttcgaagatgaagaagactttattgatgatgacgatggtgctggttatattagtggcaaaaaaccacataatgaacattcttattcgagagtacacaagactcattcgtttccaatcagtttggcaaacacaggaaaatttcgttatatgcctttttctccagcgggaacaccttttggctttactgacaggcgttatttgacaatgaatgaagtgggctacgtatctactgtcaagaatagtgagcaatacagcataactgtctctttttttgatgttggacgttttagagaataccatttcgaggacttatttggctacgatttatgcttcctaaatgaaaaaggcactttatttggccaatccaaaactgggcagatacaatataggccacacgatagcatacattcaaactggaccaagattattcctttgcaagctggtgagagaataacaagtgtggcagccaccccggttcgcgttattgttggtacatcattaggctatttcagaagtttcaatcaattcggggttccatttgctgttgaaaagacatccccaattgtagcgcttactgctcagaattatagggttttttcagtacattattcgcagtttcatggcctttcatactctttatctgaattgggtacttctagtaaaaggtactataaaagagagtgtccacttccaatgagtttaccaaacattaattctgatatgaaaaaagacgcaaatcttgactactacaattttaatccgatgggcatcaaaagtttgttcttttcaagctacggagatccatgcatttttgggtccgacaacacgcttctattgttatcaaagtggagatcaccagaagaaagtaaatggctccctattctagatagcaacatggaaatatggaagatgtcaggagggaaggaaacgacagatatacatgtctggcccttggctttggcgtatgacacattgaattgtatcttagttaagggcaagcatatatggcccgagtttccccttccgttgccatccgaaatggagattagaatgccagtatttgttaagagtaaattactagaggaaaacaaagctatattaaataaaaagaacgaaattggagctgacaccgaagcggaagaaggggaagaagacaaagaaatacagattcctgtttctatggcggcggaagaagagtatctgcgcagcaaggttttgtcagagctgttgacagatacactcgaaaatgacggtgaaatgtacggcaacgaaaatgaggtattggcagcattgaacggtgcatatgataaggctttgttacgtttatttgcgtctgcatgctcagaccaaaatgttgaaaaggctctttcgcttgctcatgaattaaaacaagatagagcacttactgcagccgttaagatatcagaaagagctgagctgccctctctcgttaaaaaaattaataatataagggaagctagatatgaacagcaattgaaataa

SEQ ID NO: 46222 - DNA, 2190 bp, Saccharomyces cerevisiae
atggaatcacttccacgtactcccacaaaaggcagatctacgcagcatctctcgacaccatcgccgaagaatgatattttagctatgaatggccacaaaagaagaaatacaacaactccaccgcctaagcacactcttctgaagccgcaacgtacggatattcatagacactcattagctagtcagagtcgcatatccatgtcacctaatcgcgagcttttaaagaattataaaggtacagcaaatttgatttatggaaaccagaaaagcaactccggtgtaacttccttttataaagaaaatgttaatgaactcaatagaacacaagcaatcttatttgagaaaaaggcaacactagatttactcaaagatgaactaacagaaacgaaagagaaaatcaatgccgttaatctcaaatttgaaacccttcgtgaagaaaagataaaaattgaacagcaactgaatttgaaaaacaatgaacttatctcgattaaagaagaatttttgtcaaagaagcagttcatgaatgaaggacatgaaatacatttaaagcagctagcggcatctaataaaaaagagctgaaacaaatggaaaatgaatacaaaacaaaaattgagaaattgaaatttatgaagattaaacagtttgaaaatgaaagagcgtcgcttttagataaaatagaagaggtaagaaataaaatcaccatgaacccttccactttacaggaaatgttgaacgatgttgaacaaaagcatatgcttgaaaaagaagaatggcttacagagtaccaatcgcagtggaaaaaggatatagagctgaataataaacatatgcaagaaatcgaaagcataaaaaaggaaatcgaaaatacattaaaacctgagttggcagaaaaaaagaagctcttaacagaaaagcgtaacgcgtatgaagctatcaaagtaaaagttaaagaaaaggaagaggaaactacaaggctgagagatgaggtggcattaaaacagaaaactaatttagaaactttggaaaagatcaaagaacttgaggaatatataaaagacactgaactgggtatgaaggagttgaatgaaattctgattaaagaggaaacggttagacgcacattgcataatgagttacaagagttaagaggaaatatacgagtttattgtaggattcgtccagctctaaaaaatttggaaaattctgatactagccttattaatgttaatgaatttgatgacaatagtggtgttcaatctatggaagtgacgaaaatacaaaacacagcgcaagtgcatgaattcaaatttgataaaatatttgatcaacaggatacaaatgtggatgtttttaaagaagttggtcagttagtgcaaagttcattagatggatataatgtttgtatcttcgcatacggacaaacaggatctgggaaaactttcacgatgttaaatccaggtgatggtatcattccgtccacaatatctcatatatttaactggatcaataaattaaagacaaaaggatgggattataaagttaactgcgaattcattgagatctacaacgagaacatcgtagacttattgagaagtgataataataataaagaagacacaagcattggcttaaagcacgaaatacgtcatgatcaggaaactaagactaccacgataacgaatgttacgagttgcaagcttgagtcggaagaaatggtggaaataatcctgaaaaaagcaaataaattaagatccaccgctagcacagcatcaaatgagcattcctcccgttcacacagtattttcataattcatttgtctggatcaaatgcaaaaactggagcacactcgtatggcacactaaatcttgttgatttggccggttccgaaagaataaatgtctctcaagttgtaggggatagattaagagaaacacaaaatataaataaatctttaagttgcttaggtgacgttattcatgctttaggtcagcctgatagtaccaaaagacatataccgttcaggaactcaaaactgacatacctactgcaatattcactcactggggattcgaaaacattaatgtttgtaaacatttcaccaagctcctctcatattaatgagactctcaattcgttaagatttgcgtctaaagtgaattctaccagattggttagtagaaaatga

SEQ ID NO: 46223 - DNA, 2709 bp, Saccharomyces cerevisiae
atgccgccagctagtactagtactaccaatgatatgataaccgaagaacctacttctccacaccaaatcccaaggcttacaaggagacttacggggtttcttccccaagaaatcaagtcaattgacacgatgattcctttaaagtcaagagcgttatggaataagcatcaagtcaaaaaatttaacaaggcagaagattttcaagatagattcattgaccatgtggaaactacattagcacgttccctatataattgtgatgacatggctgcttatgaagctgcttcgatgagtattcgtgacaatttggtcattgactggaacaaaactcagcagaaattcaccacaagagacccaaagagagtttactatttgtctttggagtttttgatgggtagggctttggataatgccctgattaatatgaagattgaagatccggaagaccctgctgcctcaaagggaaaaccaagagaaatgattaaaggggctttggatgatttaggtttcaagttagaggatgtcttggaccaagaaccggacgcaggtttaggtaatggtggtctaggtcgtcttgcagcttgcttcgtcgactcaatggcaacggaaggcatccctgcctggggttatggtctacgttatgagtatggtatctttgctcaaaagattattgacggttaccaggtggaaactccagattactggttaaattctggtaatccatgggaaattgaacgtaacgaagtgcaaattcctgtcaccttttatggttatgttgatagaccagaaggcggtaaaactacactgagtgcgtcacaatggatcggtggggaaagagttcttgctgtcgcgtatgatttcccagttccgggtttcaagacttccaatgtaaataacttaagactatggcaagcaaggccaacaacagaatttgattttgcaaaattcaataatggtgactataaaaactctgtggctcagcaacaacgcgcagagtctataaccgctgtgttgtatccaaacgataactttgctcaaggtaaggagttgaggttgaaacagcagtacttctggtgtgctgcatccttacacgacatcttaagaagattcaaaaaatccaagaggccatggactgaatttcctgaccaagtggctattcagttgaatgatactcatccaactttagccatcgttgaattacagagagttttggtcgatctagaaaaactagattggcacgaggcttgggacatcgtgaccaagacttttgcttatactaaccacactgttatgcaagaggccctggaaaaatggcccgtcggcctctttggccatttgctacccagacatttggaaattatatatgatatcaactggttcttcttgcaagatgtggccaaaaaattccccaaggatgttgatcttttgtctcgtatatccatcatcgaagaaaactctccagaaagacagatcagaatggcctttttggctattgttggttcacacaaggttaatggtgttgctgaattgcactctgaattaatcaaaacgaccatatttaaagattttgtcaagttctatggtccatcaaagtttgtcaatgtcactaacggtatcacaccaaggagatggttgaagcaagctaacccttcattggctaaactgatcagtgaaacccttaacgatccaacagaggagtatttgttggacatggccaaactgacccagttgggaaaatatgttgaagataaggagtttttgaaaaaatggaaccaagtcaagcttaataataagatcagattagtagatttaatcaaaaaggaaaatgatggagtagacatcattaacagagagtatttggacgacaccttgtttgatatgcaagttaaacgtattcatgaatataagcgtcaacagctaaacgtctttggtattatataccgttacctggcaatgaagaatatgctgaagaacggtgcttcgatcgaagaagttgccaagaaatatccacgcaaggtttcaatctttggtggtaagagtgctcctggttactacatggctaagctgatcataaaattgatcaactgtgttgctgacattgttaataacgacgagtcaattgagcatttgttgaaggttgtctttgttgctgattataatgtttctaaggctgaaatcattattccagcaagtgacttgagtgagcatatttctactgctggtactgaagcgtctggtacttctaatatgaagtttgttatgaacggtggtttgattattggtactgttgatggtgccaatgtggaaatcacaagggaaattggtgaagataatgtcttcttgtttggtaacctaagtgaaaatgtcgaagaattgagatacaaccatcaataccatccacaagatttaccatctagtttggattctgttttatcctacattgaaagtggacaattttctccagaaaatccaaatgaattcaaacctttagtcgacagtattaagtaccacggcgattattacctggtcagtgatgactttgaatcctatctggccacccatgaattagtggaccaggagttccacaatcaaaggtcagaatggttaaaaaagagtgtcctgagcgttgcaaacgtcggcttctttagcagtgatcgttgtatcgaggaatactccgataccatttggaacgttgaaccagtgacttag

SEQ ID NO: 46224 - DNA, 1974 bp, Saccharomyces cerevisiae
atgagtgataatggttcccccgcggttcttccaaaaaccgaatttaataaatacaaaatcggcaaagtgaagagtacaccagccatccagcgagatgcgaagactaacttaacatacatcaaactaagaaaaagaagtagtgagaaagtttacgggtgtacagttttccagaatcattatcgtgaggatgaaaaattaggacaaggaacatttggtgaggtttataagggaattcatttagagactcaaagacaagtggcaatgaaaaaaattatagttagcgttgaaaaagatctgtttcctataactgcacaacgagaaattactattttaaagcgtttaaaccacaaaaatattattaaactaatcgaaatggtgtatgaccattcaccggatattacaaatgcggcatccagcaacctacataagtcattctacatgatcctgccgtatatggtagcagatctgtcgggcgttttgcataatccgagaatcaacttagagatgtgcgatataaagaatatgatgctacaaatattagaaggcctaaattatattcattgtgcaaaattcatgcatagggatataaagacagcaaatattttgattgaccacaacggtgttttaaagcttgctgattttggtttagcaagattatattatggctgtcctccaaacttaaagtatcctggtggtgcaggttccggcgccaaatatacatcagtagtcgtaacgagatggtatagagcacctgagttggtgcttggtgataaacagtatacaacagctgttgatatatggggtgtcggatgcgttttcgcagaattttttgagaaaaaacctattttacagggaaaaacggatattgatcagggacatgttattttcaaactacttggtacaccgacagaagaagattgggccgtggctagatatttgccaggtgctgaactaacaacaactaattacaagccaacgttgagggaaagatttggtaaatatctaagtgaaacaggtctagattttttaggacagttgttagcgttagatccttacaagaggttgaccgctatgtctgctaaacaccatccttggtttaaagaggaccctttaccatcagagaagataacattaccgacggaagaaagtcatgaagctgatattaagaggtacaaggaagaaatgcaccaatcattgtcccaaagagtacctactgcgccaagaggtcatatagttgaaaagggtgaatcacctgtcgtgaaaaatcttggggcgatcccaagaggccccaagaaagatgacgcaagttttttgcctccatcaaagaacgtattggctaagccgcctccttcgaaaataagagaactacatcaaaatcctagaccgtatcatgtgaacagcggatatgctaaaactgcgattccaccgccagcagcccctgcaggagttaatagatacggacccaacaatagttccagaaataatcgcttcagcggcaacagcactgcacccaacaacagcaggaatcccgtaaatcgatttcatcctgagacaaatgtcagctctaaatataataaagtacctttgccattggggcctcagtcaagataccagggtaattcaaatgagtcccggtacaaaaactcgccaaatgactctagatatcataaccctaggtacgtgaacaagccggaaaccaacttcaataggcaaccacagaaatatagtcgccaagaatccaatgcgccaatcaataaaaattataatccttcaaacggttctcgcaatatggctggtgatcatcatcaaggctcgagaccttctcatccacaattcccaatctcgccctcacaggggcagcatcagcttacgagtaaaccaatagagaaaaaaaatggaagctttaaggatgaaagagcgaaaccagatgagtctaaggagttccaaaatagtgatattgcagatctatattag

SEQ ID NO: 46225 - DNA, 630 bp, Saccharomyces cerevisiae
atgtcacaacaagttggtaacagtatcagaagaaagctggtaatcgttggtgatggtgcctgtggtaagacatgtttattaatcgtcttttccaagggccaatttccagaagtctacgtaccaactgtctttgaaaactatgtagcagatgttgaagttgatgggcgtcgtgtagagctagcgctatgggataccgctggtcaagaagattatgatagactaagaccattgtcatacccagactccaatgtcgtattaatttgtttctctatcgatcttccagattctttagagaatgtacaagaaaaatggattgccgaagtattacatttctgtcaaggtgtgccaattattcttgttggttgtaaagtggatttgagaaacgacccacaaaccattgaacaattaagacaagaaggtcaacaacccgttacatcacaggagggacaatctgtagcagaccagattggcgcaaccggatactacgaatgttcggccaagactggttatggtgtcagagaagtgtttgaggccgccactagagcttcattgatgggtaaatctaaaacgaatggtaaagctaagaagaacactactgaaaagaagaagaagaagtgtgtcttgttatag

SEQ ID NO: 46226 - DNA, 786 bp, Saccharomyces cerevisiae
atgaagacctatcatttgaataatgatataattgtcacacaagaacagttggatcattggaatgaacaactaatcaagctggaaacgccacaggagattattgcatggtctatcgtaacgtttcctcaccttttccaaaccactgcatttggtttgactggcttggttactatcgatatgttgtcaaagctatctgaaaaatactacatgccagaactattatttatagacactttgcaccatttcccacaaactttaacactaaaaaacgagattgagaaaaaatactaccagcctaaaaatcaaaccattcacgtatataagccggatggatgtgaatcggaggcagattttgcctcgaaatacggggatttcttatgggagaaagatgatgacaagtacgattatctggccaaagtggaacctgcacatcgtgcctacaaagagctacatataagtgctgtgtttactggtagaagaaaatcacaaggttctgcccgctcccaactgtcgattattgaaatagacgaacttaatggaatcttaaaaataaatccattgatcaattggacgttcgagcaggttaaacagtatatagatgcaaacaatgtaccatacaacgaacttttggaccttggatatagatccattggtgattaccattccacacaacccgtcaaggaaggtgaagatgagagagcaggaagatggaagggcaaggccaagaccgagtgtggaattcatgaagccagccgattcgcgcaatttttaaagcaagatgcctag

SEQ ID NO: 46227 - DNA, 1314 bp, Saccharomyces cerevisiae
atgagcacgggagattttttaactaagggaatagaactggttcaaaaggccattgacctggacacagccacgcagtatgaggaggcgtatacagcatactataacggattagattatttgatgttggctttgaaatacgagaaaaaccctaagtcgaaggatttgataagagcgaagtttacagagtatctaaaccgtgcagagcagttgaaaaagcacttggaaagtgaagaggcaaacgcggcaaagaaatctcctagcgctggtagtggttccaacggtggtaataagaaaatctctcaggaagagggtgaggataatggtggagaagacaacaaaaagctaagaggtgccttatcgagtgctattttgtctgagaagcccaatgttaagtgggaagacgtggctggactggaaggagccaaagaggcccttaaagaagccgttattttacctgtcaagttcccacatttgttcaaaggtaaccgtaagcccacttcgggaatcttattgtacggaccaccaggtacaggtaaatcatatttggcaaaagcagtggccaccgaggccaattctacctttttcagtgttagttccagtgatttggtttctaagtggatgggtgaatctgaaaaacttgtcaaacagttatttgcgatggcaagagaaaataaaccttctattatttttatagatgaagtggatgcgctaacaggtaccagaggagaaggagagagcgaagcaagtagaagaattaaaacagaattattggtacaaatgaatggtgttgggaatgactcccaaggtgttttggtccttggcgcaacaaatatcccatggcaactggacagtgccatcaggagaagatttgaaagaagaatatatataccattaccagatttggcggcaagaaccaccatgttcgagattaacgtcggcgacactccatgcgtattgaccaaggaagattatagaactttaggtgcaatgactgaaggttattccgggagtgatattgctgtagtggtgaaagatgcgctaatgcaaccgataagaaaaattcaaagcgcgacacatttcaaagatgtctctacggaggacgacgaaacaagaaaactaacaccatgctctccaggtgatgatggcgccatcgagatgagttggacggatattgaagctgatgaattaaaagaaccagatctcaccataaaggatttcttaaaggctatcaaatcgacgagacctaccgtgaatgaggatgacttgctgaagcaagaacagttcactagagattttggtcaagaaggtaactag

SEQ ID NO: 46228 - DNA, 2079 bp, Saccharomyces cerevisiae
atgtgtgaaatgtttggctctgggaatgttctgcctgttaaaattcagcctccgctgcttaggccactggcgtatagagttttatcaagaaaatatggtttatcaattaaatctgatggactgtctgctcttgcagaattcgttggcactaatataggtgctaactggagacaagggcctgctacaataaaatttctcgagcaatttgctgcagtatggaaacaacaagaaagaggccttttcatcgaccagagcggggttaaagaagttatacaggagatgaaagaacgtgagaaagtcgaatggagtcatgaacaccctattcaacatgaggagaatatcttgggacggacagatgacgatgagaacaacagtgacgatgaaatgccgatcgctgctgattcatccttacaaaatgtttcattatcttcacccatgcgacagcccaccgaaagagatgaatataaacagcctttcaagccagaaagctccaaggcgttggactggagggactacttcaaagttatcaatgcttctcagcaacaaagattctcatacaatccgcacaaaatgcaatttattttcgtccccaataaaaagcagaatgggctaggaggcattgcgggttttctaccagatatagaggacaaagttcaaatgttcttgacaagatattacctcacgaacgacagagtcatgagaaatgaaaacttccaaaacagtgacatgtttaatccattatcatctatggtgtctttacaaaatgaactgtccaatactaaccgacagcagcaatccagcagtatgagtatcaccccaataaaaaacctactaggtagggatgctcaaaactttctactattggggctcttaaataagaactttaagggcaattggtcactggaagatccgtctggatctgtcgaaattgacatttcccaaactatccctacacaaggccattactacgtgccaggttgcatggttcttgtggaaggaatatactattctgtaggaaataaattccatgttacctccatgactttaccccctggtgagagaagagaaattacattagaaacgataggtaatctcgatctcttaggaatacatggcatttctaataacaatttcattgctcgtttggataaagatttgaagattagattacaccttttggagaaagaattaacagatcataaatttgtaattctcggcgcaaatttgttcctagatgatttgaaaattatgactgcactcagcaaaattttgcaaaaattaaatgatgacccaccgaccctattaatttggcaaggttctttcacttcagttcccgttttcgcatcaatgagtagccggaatataagtagttccactcaatttaagaataatttcgatgccttggcgacgcttctgtcaagatttgacaatttgaccgaaaataccacaatgatatttattccaggtcctaacgatttatgggggtcgatggtgtcattgggggcaagtgggacattaccgcaagatccaattcctagtgcgtttaccaaaaaaatcaacaaggtctgtaaaaacgttgtatggagctcaaatccaactagaatagcatacttatcccaagaaatagtcattttcagggacgatttatccggaagattcaaaagacaccgtttggaattcccattcaacgagagcgaagatgtttatactgaaaacgataacatgatgtctaaagacaccgatattgtaccaatcgatgaattagttaaagaaccagaccagttaccacaaaaggttcaagaaacaagaaaactcgttaaaacaatactagaccagggtcatttatcgccatttcttgattccttgcgcccaatttcatgggatttggaccacactttgacactttgcccaataccatcgacaatggttctttgcgacactacttctgcacaatttgatttgacatacaacggttgtaaagtaattaaccctggaagtttcattcataatagacgtgctaggtatatggagtacgttccatcctcaaagaaaactatacaagaagagatatatatctaa

SEQ ID NO: 46229 - DNA, 978 bp, Saccharomyces cerevisiae
atgtcaggatctcttacgctacttaaggaaaagcatatacgttatattgaatcattggatacaaagaagcataattttgaatactggcttaccgagcatcttcgtttgaatgggatatattggggacttactgccttgtgtgtgcttgattctccagagacatttgtgaaagaagaggttatatcatttgttctgagctgttgggacgacaaatacggcgctttcgcaccatttccaagacatgatgcacatttattaactacattgtccgccgtacagatcttggccacttatgatgctttggatgttcttggaaaagatcgtaaggttcgcttgatttccttcatccgtgggaatcaattggaagatggttcgttccagggtgacaggtttggggaggtagatacaaggtttgtttatacagccttgagtgcactatcaattttgggtgaattaacgtctgaagttgttgaccctgctgtagactttgtactcaagtgttataattttgatggtggctttggattatgtcctaatgctgaatcccatgcagctcaagcttttacctgtcttggcgctttggcaattgctaacaaattggatatgcttagtgacgaccaactagaagaaattgggtggtggctttgcgaacgacaattaccagaaggtggactaaacggtaggccaagtaaactgcccgatgtttgctatagttggtgggttttatcttcattagctattattggtagactagattggataaattatgagaagctaactgagtttatactcaaatgtcaagatgagaagaagggtggaataagcgacaggcctgaaaatgaagtggatgtcttccatacagtttttggtgttgctggtttaagtttaatgggatacgacaatttagtccccatagatcccatatattgtatgccgaaatccgttacatcaaaattcaaaaagtatccatacaaatag

SEQ ID NO: 46230 - DNA, 1398 bp, Saccharomyces cerevisiae
atgagtaaatatattgcacttgaaaatcttccggtagatttgcaacataaaggagctacacaaaatgaaagcaccgctgatatactgaaacagttgccacatgaacgattacaagctgtcctggagaagataccagaagaagatcttgaggtgagacgattgctttcaattttaaagaagccggaagtagtggagaatgaagatgtacaacaaagaagaatacggttggctgaaattttaatggttgatgaaattgatcttgagaacattaataacatggaaaacataaatggggaagaagtagacgaagaggacgatgaggacttcttcactccagcaacatctgagctcatttttgcgagaagatttttgataaattattcacttgaaagatctcgaaagaggctacagaaagagatggaaagacatcaaaagttcaatacaagacaggaattactcagtcggcgtacagaattacagcgtatggctaatttagagcttgctggctctcaattagtatctacgaagcctatttccgcagtttctttatctaccgatgacatggttgtcgcaacgggaagctgggcaggtgatcttcaggtattaaattctcaaacactgcagccattgacacaaaaactcgactctcatgtagggaaaatcggagctatagattggcatcctgattcaaacaatcaaatgatttcatgcgcagaagacgggctcatcaaaaactttcaatactcaaacgaagagggcggccttcgattattgggagatcttgtgggacatgaaagacgtatttctgatgtgaaataccaccctagtggcaaatttataggtagtgcctctcatgatatgacttggagactttgggatgcgtcaacacatcaagaactgctgctacaagaaggccatgataagggagtgtttagtctgtcttttcaatgcgatggatctcttgtttgtagcggtggcatggactcgctttcaatgctatgggatataagatccggaagtaaggtgatgacactcgcaggacactcaaagcctatttacaccgtagcttggtcaccaaacgggtatcaagtagccactggtggtggtgatggaatcattaatgtttgggacatcagaaaacgggatgaaggccaactaaatcaaatattggcgcatcgtaacatcgttacgcaggtaaggttttcaaaggaagacggcggaaagaaacttgtctcttgtggctatgataatttgatcaatgtgtatagtagtgatacgtggttaaaaatgggaagtttagcaggccacactgataaaattattagcttggatatttcgaataattctcattttttagtgagcggcggatgggataggtctatcaagctctggaattga

SEQ ID NO: 46231 - DNA, 544 bp, Saccharomyces cerevisiae
atgtcagactacgaggaggcgtatgtgcattcatattggagaaattgcgtgctttagttttaattatatttactaacttctatcattgtgatacaggtttaacgacggtaatgagaacttcgaagattttgatgtagagcatttttctgatgaggagacttatgaggaaaaacctcaattcaaggatggtgaaacaaccgatgccaacggtaagaccatcgttactggtggtaatggcccagaagattttcaacagcatgagcaaataagaagaaagacacttaaggaaaaggccatcccaaaagaccaaagagcaactactccatacatgaccaaatatgaaagggcaagaattttaggtacaagagccctacaaatttccatgaatgcgccagtttttgtagatttagaaggtgaaactgatccattgcgtattgccatgaaggagttggctgaaaagaaaattcctttggttattagaagatatttaccagatggttcctttgaggactggagtgtggaggaactcattgtggatttgtga

SEQ ID NO: 46232 - DNA, 492 bp, Saccharomyces cerevisiae
atggaccatagtgaatcgctaacgtttaaccaacttacgcaggactacataaataaactcaaagatgctttccaaatgctggatgaggatgaggatggtctgattagtaggggagatcttaccaagatatatgcaacattggggaagacattgacagatgaggaatggtccaaaatggtacctgacaatgacaccagtaccgcggaagttggagaagaaggtgtaagctttcccatattcttatctatcatggggaagaacttatcgcagtttcccgagcgtgaagaattggaagaaagtttaaaagccattggaagaggacacgatttaaacgttcccttgaatgaggtcattgattctttaaaggaagccggttttgaaaatcctgaggaagaatttgctaaacttttcaaattgtttactacaaatcagcaagcgaccgaagagagaactttcagaggtaagcttttcttagattcaatcaccgattaa

SEQ ID NO: 46233 - DNA, 1107 bp, Saccharomyces cerevisiae
atgttgtcagcagctagattgcaatttgcccaggggtcagttagaaggttgaccgtttccgctagagacgcacctactaaaatatctacattggctgttaaggtccatggagggtctcgttatgcaaccaaggatggtgtggcccatcttttaaacagattcaactttcaaaacacgaacactagatcagctttgaaattagtcagagaatccgaattattagggggaacttttaagtctaccttggatagggaatacatcactttgaaagctacctttttgaaggacgaccttccctactacgtcaatgccctagcagacgtgctatacaagactgccttcaaacctcacgagctcaccgaatctgttttgcctgctgctagatacgattatgcggtcgctgaacaatgtccggtaaagagcgccgaagaccaattgtatgccattacattcagaaagggtttaggaaacccattgttatacgatggtgtggaaagagtcagtttgcaagatatcaaggactttgcggacaaagtctataccaaggagaaccttgaagttagcggtgaaaatgttgttgaggccgatttgaaaagatttgttgacgagtcactgttaagcactttgcctgcaggtaagtcattggtgagtaaatccgaaccaaaattctttttgggtgaagaaaacagggtaaggtttatcggtgactccgttgccgccattggtatcccggtaaacaaagcctccctagctcaatatgaagtattggccaactatttgacctctgccctatccgagctttccggtttaatcagctcggctaaacttgataaattcactgacggcggcctatttactctgtttgtaagagaccaggacagcgccgtggtatcttccaacatcaagaaaattgttgcggatttgaagaagggcaaggacttatcccctgcaataaattacacaaagttaaagaatgccgtccaaaatgaatctgtttccagcccaattgaactaaattttgacgccgtgaaggactttaagttgggaaaattcaactatgtagccgtcggtgatgtttccaacttgccatatttggacgaattgtaa

SEQ ID NO: 46234 - DNA, 2634 bp, Saccharomyces cerevisiae
atgagtgaaacagtcaaagataaagttataattgatgagaaggtatccacaaaaggtactgttgattacgccgagggtgctgagtattctgagaggctttcaaatcattcatcagacttttctcagtggtatacggatgaacagatactgcactttatgaagaagctgggttatgaaaatcgcactctttatgatattccggaagacgttgcgtatatcctcaaaaaaatgcctgaattgacacttgaggattccttcaaaatactaaaagactctatcatctatttcaaggatgatgagaacattccacacgatcaatatgaggagtggaagagattggttgacttggaggacttggattcaaaagaggggatagatgaatatgatagctttgacattagagcatttgcttctgctattaaatttcattcgccttaccaagaggttagagctgttgttgatccagaagatgatcccaccattccagtggagacattccgagcatattttctggcaataatttggtctgtcatcggttcaggatttaatgagtttttttcacacagggtggtttcaatttcactgaatactccaattatccaaatgtttttatatatctgtggtaaggcttgggctaaaactatcccctgttggactataaccatcaggggcagaaagtatggtatcaatatcgataaaccatggacccaaaaagagcaaatgttttcaaccttgttatatgcaatttgtcaaggcgcgttctatactcattacaatattctaacgcaaaaactcttttaccattctgctttctcgtttggctaccaatttttactttcgttatccgtacaatttattggatttggatttgctggcatccttagaaaattcgttgtttatccagcccgtgcactatggccaacagtcatgccaactattgctatcaacaaggcactattgggtaaagaaaagcatgaatctggaatgagcaggtataaattctttttcttgactttttttatcatgttcatctataactggtttcccacttacattattaatattctaaacactttcaattggatgacctggatcaagccaagtaacattaatctcgcaaacatcacgggaggagtcactggtcttgggattaatcctatctcatcttttgactggaatgttatttcgtttaattctcctttagtttacccattttggtcatacttaacacaatatcttggttgcatattagcagctttaattgttattgcagtatactatagtaattatatgagttgccaatacctgccaatattcacaaattctttgtatactaatactggccattcctttaaagttactgaggtattagacagtgacaataagctagatgtgaaaaaatatcaaagctactcgccaccatactatagtgctggaaatttggtatcatatggtgctttcatttgcgcatatcctctgatgattacatggtcgtttattgtacactcaaagttattgttcaatgctttcaaagattgggctttgaatttgtgggccatgagaaaacttaaatcttgggtcacaatgttcaaaagcgattacagggcgctcgacgattatgatgacccacattctaatgccatgaaaaactataaagaagttccagattggtggtattttgccatattgataggttcacttgttgttggaatagctgttgtagagcactacccaacaaatacaccagtttggggtctttttgtttgtttaggatttaattttgttttcttgattccaactactatccttcaagcaaccactggttattcgtttggtttgaatctactaattgaaatggtgatggggtacgctttaccaggtaatccaatcgccataatgattttgaaggcttttggttataacatcgacggccaagcagataattacgtttctaacttaaaaatagcgcattattgtaagattccgccaatggcgctattcaggggacaatgtgttatagttttcattcagatatttgtcaatctaggtgttctgaattggcaaatctccaatatcaaagacttttgcacacctcatcaaaacgcaaaattcacctgtcctgatgctgtgacctactataatgcttccgttgtctggggtgcaattgggccaaaaagaattttcaattacatttatccaatatttaaatggtgttggttgataggcgcatgcattggcatattttttggtgtttggaagcgctggggtaagttttatcccagatattttgacccaatgttatttgtaggtggaatgcttaatatgagccctccatataacctgatgtattacacttctggtatgattgttagttacatttcccagtactacatgaaaagacaccatttaaatctgtgggagaaatataattatgttttatcggcaggcttttcaacgggcttggttttatcagctattatcattttctttgctgtccaatataaagacacagcttttaattggtggggcaatacagttccgtatgctggtgccgatggcgttggctatcctctaaagaacataactgatacagcaaatggctatttcggctatgctccaggacactatccatga

SEQ ID NO: 46235 - DNA, 3312 bp, Schizosaccharomyces pombe
cgacagatcattttaaatgattattcagcaaaccatttcttacacaacgctgtgtcaacttgtaaatacagcgctttcacatttttaccaaaattcctaaaggaacaattctcaaaatatgcaaatctatttttccttttcacggctgttgtgcagcaaattcctggaatcacaccagttaatcgttatacaacgattggccccatgttaattgtactttcagtttctggtattaaagaaatcatggaggatataaagcgcaaaaaacaagatcaagaattgaatgaatcgccttgctacgttttacaggggactggttttgttgagaaacaatggaaggatgtagttgttggtgacattgttaaaatcgtttctgaaacttttttccctgctgacttagtacttttatcatcatctgagccagagggactatgctatattgagactgcaaatttggatggcgaaactaatttaaaaattaagcaagctctcccagaaacagcaggtcttctaaaaccagtagagcttggtcagctatcaggagaagttaaatcggagcaaccgaataataatttatatacttttgatgccactttgaagcttcttcccagtgatcgagaacttccattatctcccgatcagttattgcttcgtggtgctcagcttcgtaatacgccttgggtgtatggcattgttgtatttactggtcatgaatctaaacttatgaagaacactacagaaacacccattaaacgaacttccgtcgagaagcaagtgaactcacagattctgtttttattatgcatctttgtgtttctttgttttgcctcttcacttggagctctcattcatcgttcggtttatggatcagctttatcttatgttaaatatacttccaacagggccggcatgtttttcaaagggttgctgactttctggattctctactcaaatcttgtgccaatttctttgttcgttacttttgagttagtccgatatatacaggcacagctaatcagcagtgaccttgatatgtacaatgaggaaactgatactccagctgcatgccgcacatcttctctagttgaagaattgggtcaggttggatatatttttagcgacaaaacaggtacattgacgagaaatcaaatggaatttcgtcaatgcactatagccggtgttgcatatgctgatgttattcctgaagatcgtcagtttacctcagaagaccttgattctgatatgtacatatacgattttgatacgcttaaagaaaatctcaaacatagtgaaaatgcaagccttatacatcagttcttactagttctttctatttgccatacggttatcccagagtatgatgaatccactaattcaattaaatatcaagcttcttcaccggatgaaggtgccttagtgaaaggtgctgcatccattggttataagtttctagcgaggaaaccgcatttagtgactgtaagtatttttggaaaagatgaaagttatgaactattacatatttgcgaatttaattctactcgcaaaaggatgtcaatagtttttcgttgtcctgatggaaaaattcgtttatacgttaaaggtgctgacacagtcattatggaaaggttagcatccgataacccgtacttacaaactacgattcatcatcttgaagattatgctaccgtgggtttacgtacgctttgtattgctatgcgggaagtcccggaagacgaatatcaaaggtggtcaacagtgtttgaaactgcagcctctagtctggttgaccgtgctcagaagcttatggatgctgctgaagaaattgaaaaggatttaatcttgctgggagctaccgctatagaagatagactgcaagatggagttcctgatactatctcaactttacaaacagctggaataaaaatctgggttctgaccggtgatcgacaagagaccgcaattaatattggcatgagttgcaagttgattgatgaagacatgggtttagttatagtgaacgaagaaacgaaagaggctactgctgaaagcgtaatggctaagttatcttctatatatcgaaacgaagctaccactggaaatgttgaatcaatggctttggttatagatggggtttcacttacttatgcattagattttagcctagaacgccgattctttgaactggcttctttatgccgtgccgtgatatgttgtcgtgtctcacctttacagaaggctttgatcgttaagatggttaaaagaaatacaggtgaagtgctattagctattggagatggcgctaatgatgtgccgatgattcaagctgcccatgttggggttggaatcagcggtatggaagggttacaagcagttcgaagctctgatttttcaatttcccaattttgctatttaaaaaaattgttacttgttcacggatcttggtgttatcagcgtctcagcaaacttattttgtactcgttttacaaaaacattgctctctacatgactcagttttggtacgctttttgcaatgcattttccggccaggtaatttttgagtcttggtctatttcactgtataatgtgctttttactgttcttccaccggtggtaataggtatatttgatcagtttgtaagcgctggtcaactttttcagtatccgcaactttatcaattaggtcaaagaagtgaattttttaacttaaaaaggttttggtcttggataacaaatgggttttatcattcacttcttctatttctttgttccattgctgtgttttactatgatggtcctaataaggatggtctcgcgtcaggtcattgggtgtggggtactacactttacgctgcaatactagctactgttttaggtaaggctgccttaattagtaatcattggactcaatacactgtaattgctaccctcggatctttcttgctatggatagtgtttatgcccatttatgctgttgcagcacccgctatcggattttcaaaggagtactacggaataattccacatctttacgggaatctaaaattttgggcttccctacttgttttgccaacaatagcactgatgcgtgactttgtgtggaaatattcatccagaatgtattatcctgaggagtatcattacgttcaagaaattcagaaatataatgtcacagactatagacctcgtattgtcgggtttcataaagctatcaggaaaataagacagatgcagagaatgcgtaaacagagagggtatgctttttctcaaggtgaagaggaccagtcaaggattttagatgcatatgatactaca

SEQ ID NO: 46236 - DNA, 1367 bp, Schizosaccharomyces pombe
atgaaacgtgtggtaataactggactgggggccgtaacccctctaggcaatggagttaaaaccaattggcgaaatctaattcaaggaaaatcaggtatcgtatctcttaaaggatttcctgagtatgagcaaataccaagcaaagttgctggagtgataccaaggggaaaagaaaaggaagagtggaatgtattagactacgttgaccaagggaaattacgtgaagtagctacttttacccagttagctctcacttctgcagctgaagcattaaaagatgcaaggtggattgacatagatgaacaagaaaagctagcaacggtatgtgaatccagaaaactgtatactaacaaaaaagggagtttgctttggaactggcataggaaatcttgacgatgctttaaatgaaaacggtgtattaaataaggctggaataagaaaagtttcaccgagggtcatttctaaaatactaattaatatgccagcagggtatatttcacaaagatatggttttactgccttaaatcacacaacaactacagcatgtgcagcaggttgtcatgctataggagatgccttcaattttataaagcttggacatgcagatgttattattgccggtggttctgaatcctgtattaatccgctaaccgttgctggtttttcaaaagcaagaagcttgtcaaccaagttcaacgataatccaaaagcggcctcaagaccgtttgatgcaaatcgtgatggatttgtaattggagaaggctccgctgccttagtccttgaggaattggagcatgccaaaaatcgaaatgctcatatatatgctgaaatagtcggttatggtttggcatctgattcatatcatattacagctccaaatccaaatggggatgctgcttactatgctatgaagcgttccttaaaacaagctggtctttctgcaagtcaattggattatatcaatgctcatgcaacttcaaccaagcttggagatgtagcagaaagcatagcgattactaggttactttgtgatgtgaaccggaatcctgaggcatttcctgtatctagtagcaaaggctctattggccatcttttaggagcagcaggtgcaatcgaatctgtctatacggtcttgactgtccaaaaggtattttattctactcaaactttctattgctaacaaaactgtatagggcgtcttaccccctacgttaaatttcgaatactctgatattcctcagcagtttcagtgcgattatgtgccgaatgtggctaaagagagccgcattaatgttgctttgtcaaacagctttggatttggtggtaccaatgcgtctttatgctttaagaaattcttacagtaatac

SEQ ID NO: 46237 - DNA, 2459 bp, Schizosaccharomyces pombe
atgttttcgtgccaatctctttataaatttagtcactcttttaggaaacgtatccccgtcatgtttcaaagagctcagcagaaaagcagcttgcttcatacacaaaacgagtcatcgcatcaaccctccttgaacaaattgggcggtttttcgtccgcttctttaaacttcaattcctctcgctcctctactaatgatgatcagcaaacattttctagccagtctgataaccttccgtcatctccaataaccctaccagccaaaagaggtcgttctgctgctagcttaaaacaacttgataacaccgtgggattcgatgtttcgaaaccctcactgcccgtttttgaaaattctggcttgggtagtaaatactccactgaaatagcgaatggcgtctatattgatgaaaatgactttgatgatgatctacttttagaaaacgatattgaccaaaaaccaattccttggtcttcatcccctatcgagcatactaagttaactaaatcaatgctctcgagcgaaaagcggtcaaaaaatcatctctcaaaaatttacgaagaccatacttctgaaaaaggcgcaagtagcgtaatatctagtaatattacgaggcagggaataaaacgctcacgaacccttccttgggcagtggatccttacagatatggagatcctgatcctaaaagaaccagcacttcagctgatatcagtcaacacactgtatctaatgattcttcaaataagcttagcaatggacgaagcagttctttggatagtctggctaaaaaacgcatgagtaaatctaagtctaccccacagatatctaaaaaattttctgttcctttaaactctgcttccaaatcgccaataggatcttctttgtttaagacaagtgattctcgtaaaaaatctgtccctagcatattcctttccgatgagcaaaaaagaattttagacatggttgttgagcaacaacacagtatattttttacgggctctgctggaacaggtaaatctgttctcctccgaaaaataattgaagtcctaaaatctaaatatagaaagcaatctgacagagttgctgttaccgcttctacaggcttggcagcctgtaatatcggcggtgtaacacttcactcctttgctggggtaggccttgctcgtgaatctgtcgacctcctggtatctaaaataaagaaaaataagaagtgtgttaatcgttggttgcgcaccagagttttgatcattgatgaaggtaaacaatttaagtgagtttatatttactaataactatagtttctatggtcgatgctgaattaatggacaagttagaagaggttgcgcgtgttattcgcaaagatagtaagccatttggtggaattcagttggttttaactggggatttttttcagttacctcctgttccagaaaatgggaaagaatcgaaattctgtttcgaatctcagacatggaaaagcgcacttgattttacaataggattgactcacgtttttcggcaaaaggatgaggaatttgtcaaaatgcttaatgaattgcgcctcgggaaattatctgatgaatcggttagaaaattcaaagttcttaatagaacgattgaatatgaagatgggcttcttccgacagagttatttcccacacgttatgaggttgagcgttcgaacgatatgcgtatgcaacaaattaatcaaaatcctgtcacgtttaccgctattgactcgggtactgttcgagataaagaatttcgtgaccgattactgcaagggtgcatggctcctgccactttagtgttaaaggtaaatgctcaggtaatgcttataaagaatatagatgatcagttagtaaatggatctcttggaaaagttataggtttcatagatgatgagacctatcaaatggaaaaaaaggatgctgaaatgcagggaagaaatgcttttgaatatgatagtttagacatttcaccctttgatcttccagacgttaagcaaaagaaatataaattgattgcaatgcgtaaagcttcatccacggcaataaaatggccattagttcgttttaaacttccaaatggaggtgaacgtacaattgttgtacaacgggaaacttggaatattgagcttcccaatggtgaggttcaagcttctagaagccaaattcctcttattttggcttatgcgatatctattcacaaggcacaaggacagactttggatcgagtcaaggttgatttgggtcgtgtttttgagaaagggcaagcgtatgttgccttatctcgtgcaactactcaagaaggtctccaggttcttaatttttcgcctgcgaaggtgatggcacaccccaaagtcgtgcaattctataaacaactggcttctgttaatggtttgccgatacgtaatgaaaacaaggctccagttcaaatgaggggagtcaaaaataagtaa

SEQ ID NO: 46238 - DNA, 879 bp, Schizosaccharomyces pombe
atggttaccaccgttgaaatgttaactacctggaacccagtgaccgtttccttggtttctcctgtcatcatttactgggttgcttctgctttcttcggatttttgcattacattgaattacctgtctttgagaagtatcgcattcatcctccggaggagatagccagacgcaaccgtgttcctcagatggctgttgttaaagccgtgcttttccaacaactttgcgaagtcgtcgttggaatcgcattggccatgttcgagggctatcctgaacccattgacgaggctaagcaaatgttacgctacgaggctttcttcagcaagaatttgcctgctttgttacaagttgctccctttgcccctaaattggcttataactttattgttcccgcattccaatacttctttgctttcttcatcattgacagctggcaatacttctggcaccgttacctccactacaacaagaagctctacaacatgattcatgcccatcaccatcgtctccaagttccctatgctatgggtgccctttacaaccatccctttgaaggtttgattttggacacttttggcgctggtgttgcttatctcgccgccggtctttctcctcaacaagctgttattttcttcaccctttctaccttgaagactgttgatgatcactgtggatacgtattcccttatgaccctcttcaaatgttctttgccaataatgctcgttaccatgaccttcatcaccaaccttacggtttccaaaagaactttagccagcccttctttaccttctgggaccacgttttgggaacttacatgcctcccaagtctgaaactccttacgagaaaaagcaaaaggctaagaatgcaaagaaggttaac

SEQ ID NO: 46239 - DNA, 1506 bp, Schizosaccharomyces pombe
cagtgcttgatttttcctggtgttggaaactttggtttcgtatgcgattccttagcaaagcaaggatttttagaacccttgcgtcgctatgctttgtctggcaaaccttttatggctgtatgcgttggaatccaagcattattcgaggggtctgttgaagcaccacattctaaagggttgggcgtatttccggggttagtccaaaggtttgacaacgatgacaagaccgtccctcatattggttggaattcttgtgctgtacgatctgacacttcaaaagagttttttggtatgcgcccacatgacaaattttattttgtgcactcttatatgattccagaaaagggacttatccttcctccagagttcaaaattgctaccacgaaatatggaaatgaaacctttgtaggtgctattgtaaagaataattttttagctacccaatttcatccggaaaaaagtggatctgcaggtttgcgttgtttaaaggcatttttaaccggtaattatgagcaacctataagtggtgaagcatctaaacttatagagaactcctttggcggattaacaaagcgtattattgcttgcttagatgtccgttccaacgacgctggtgaccttgtagttacaaaaggtgatcaatatgatgtccgtgaaaaatcttctggaagcgaggttagaaatcttggaaaacctgtggagttatgtcaaagatattttcaagaaggcgctgacgaagtcgtttttttgaacatcacttcatttagaaattgtccaatggccgatgcacctatgttacaggttttagaaaaggcagctcaaacagtatttgtacctttaacagtaggtggtggaatcagagatgtatcagatcctgatgggacttttcatcctgctgtcgaagttgctggtatttactttagatcaggtgccgacaaagtatctattggaagtgacgccgtttatgccgcagaaaagtattacgaaaatgggaagaaattgagtggaaaaactgctatagaaacaatttctaaggcctatggtaatcaggcagttgttatttcggttgatcctaaacgtcagtatgtaaaagttcctgaagatactaaacaccatgttgtgaaaacatctcggcttggacctaatggagaagcatattgttggtatcagtgcaccgttaaaggaggtcgtgaatatcgtgatattgatgttgttgaacttactcgtgcttgtgaagcaatgggtgctggtgaagtactattaaattgtatggatcaagacggttcaaatgctgggtatgacatagaacttgttcgtcttgttaaaaactctgtgaatattccagtaatagcttcaagtggtgctggtattccccaacattttgaagaagtatttaaagaaacggattgtgatgcagctcttgccgccggaatttttcatcgacaaacttgtcgcatagaagacgtcaaagaatatctggcaatacacgacgttctggttcgcact

SEQ ID NO: 46240 - DNA, 2085 bp, Schizosaccharomyces pombe
atgagtaaattgtccgaaaaagaagcttttctttttgatcgttctatagatcaatttgaaaagggacaatattccaaaagtctcaaaactatccagtcagtattaaaaaaaaagcctaaacatcccgactccgtagctttgctaggtttaaatctttgcaaactgcatgatagtcgtagtgcacttttgaaatgtgggtatgcttcttctatcgatcctaaatctcaattttgttggcatgctttagctattgtttacagagaaaccaaagattacaacaactcacttaaatgctatcagaatgcattagcaatatctcctaacaatgaatctttgtggtacgatgccgcgtatttgcaagctcaacttggtttgtatcaacccctttttgataattggaatcgactattgcaactggattcaagtaatttagaatatcgattatgttttacgttgtctgcttttctttctgggaattataaagagtcgttggaacaaattcaatatttaatcagttcatgtaatttatcccctttagttgtttcgaggcttatttcatttttacctagaatatgcgagcatatcgaaaacggtagtcaaaccgtgttagaaattttattaatgaatcaaaattcattcttaaataacttcaactttgagcatattaaggctgactttgcatttcgccagaaaaactacgaagaatcgatatacctatacgctcgtttgctcatcaagtttccaaatcgcttagattattcagagaaatatttgaatagtttatggaatttttacaaaagtggaggtttagctcttgatctcttgctaaagagaactgattccttaattaaaacattttcagagattcttcagactggtatatctgttttaattttcttgctctccaaaaatctggactacgatttttgtttaaatcacttgatctcgtattccatgcatcattttattccttccttcatcagtttacttaaaatcccacttaaaacaaatgatgcgttctctaagaagttaattactatgttgagtaattttagagaaggcgattctgctaaaaatataccaacacataaactatggtgtacctattgcttatgcctcgcacactataagctaggtgattatgaagaatcgaattattggctcaatttagcaattgatcatacaccgacttatccagaactttttttggcaaaagcaaaaattttcttgtgcatgggtgaaattgaagaggcactgtgctcatttaaacggtcagtggaacttgataaaagtgaccgtgctctagcttctaaatatgcaaaatatttaatacgtatggatagaaatgaggaagcttatattgtcttgtctaagttctcacgattcagatttggcggggtatgcaattatttagcagaaactgaatgtgtttggtttttagttgaagatggtgagtccctattacggcagaaattatatgggctagctttgaaaaggttccattctatttatcaaatttacaaaaaatggtcatttttgaaatttgattatttcacacaatgtgcagaggacggtgaatttcaagaatacgttgaattagtagagtggtccgataacctgtggtcttcaacagattatttgagagctactcttggtgctcttaccatatacctattgttgtttgaatccaagtttaatatgtacggaaataaagctgaagagatatcccatatgtcggaagttgaacaaattgcgtacgctagagaggacaataagaaaatcatgaaattgcaaaaaatagaggaggataagattaaaagttacatcccttctgaaagtgaagagccgttggttattgatgaagactactttgggcataagctgctaatcactgatgatccattaacagaagctatgaggttcttacagccaatttgctggcataaaatcaaaggctggggattcttaaaaattttatcttctaaactttataaacttaaaggtataatattctgttattacgcactaactaacaacattgaaggattacaccaaaaagctaatagtctagaaacttcagtattg

SEQ ID NO: 46241 - DNA, 4334 bp, Schizosaccharomyces pombe
atgttcaacgaccagtcgaaaacaacttcatctgtgaaaggtatatgtgccactactgacaacaatcatggtaatttaaaaaaaactaattcaactcctttcaggaaaaactatttgctaaatgggagaactaaattgaagctggaaaattttgcgtacaatgcatctacagaaattagttcacctaaaatctctgaaaaaaagcattcttcattaccaattaaacgaaagaatacttttaatgaatcctcaacatctttttccccatttactaaagctcataaagaaattactgacgatttaaagcctgacaaatctttcacgcggaaatctgacttgaatagccaagacatgccaggtatgatttttcttgtattcagacgtgtattttaacttttagaagtatgttttcaagaaacttcgaaggatttgtgtcgtagctcttctactcaacatttgctggatcatcaaacgacggactcaacgattatagatatgaaaccagtgtcaacgaactcaaaatctgatgtgtttacattatatacggatgaaactgtcctattacgacgatgtgcttcagataataagccactgataaacaataatttgtcgagttcaaatgtttcggaaaaccagagtagaagcttcggatcgtatgatgaagtaaaaaaccaaggaaataacctgcataaagtccctagcttggtgtctataattcgtaatgcaagatcatctgagcaatcaagaattgctgcaaattccagttgtcttctcaaaggatcagataccgaaattgacgaggatgattttgccttagaagctgaagatctggcagcattagattcccttgaacgccaatactcacaattacctaattctacagtaactgcttctgcaaaggacatagaaaagacagctaaggtcaaccatgtgggaggtgatttgcaatcttattgttcagcaacaaaagcatctgatgctacaataaatgaagaacctgtgaaccttgctcttgataaagcttgtaattcattgccggatatcaatagcgactttatcgatgattgggatgattcgtgtgatggatgcactcctggtgaattgtgcgagttttcctccgaatacacagtattagaagttcacgaagacttcatttttcatgaagggaatcactttcgacaattaaagttgattttggaagcaaatgatatactgcatcagttatttttacgcggtgattggactgagactagtatttttgtaggggattctatccgtgttgaagctacatttgacaaagataataccgctatcgttgacaacgataaaggacttattatcatacatccgaaaattttaatgtctgctacggcagtggccagctcttttccttgtttgaggaaagccgtaatatctgacagggttggcatttatggacctcctacaaaagctatggtaactggaaacattttacatgatttttttcaacacgcattatacagaggtattgatgcccttgaaaatgttgatatcaaccttgaaacatcaataaaaacatacatctctgatatctattttgctgatttgtcgctcgatgaaattcgagaggaacttgatgcgaggcttccccttcttaaatctattgttgaaagatatttaataagtaaaaaaaatgacaacaacaatgaaagtattcacatttcaaggcttctcgatattgaggaatccatatggtcacccagatttggattaaaaggtaatatcgatgctacagttgaggtggttttaactgaaaaacctgagtcttcgtcaaccctcacacttccgttagagcttaaaactggccgatatgtcgacaatattagccattttgctcaaagtttgctttatacattactcatttcagatcgttatggtatcaatactaatcaggcattattatgctatttggaaaatagtactatcaagaatttggttgcaagtaactcccaacttcgagggttgatcatgacaagaaattctcttgcacagcataactttaggcgcagccttcctgaaatgatttcgaaccgaaaaatttgcgatcactgcagtttagtttctgaatgtttgttctttcaaaagatgagtgataaaggagtagctaatagtaacggcttgactgagtcatggaatgaatggatgcgcgaagtaaaagatgaggatcttgaattttataagaagtgggagaagttattaaatcaagaggaacgactcttactactaaaaagaggcgatgtgttgacttttgatacagaagagctagaagcttatggaaaaactctgtatcctttatacattactaaagaggatatcgtttgtttagaaattgatgacagggtttttcattacaaattcgcttttttaaatgacaatggttatcctcgaaatttcttgcactcaggcttcagcgttggtgaacgagtatttatttctgatgaacatggacactggtcactagctaaaggacacatagtccatattcaagattcatgtattgaagtacgaactcgtcatcgacttcatattccatggctaaagatgcctaactttgatttcaaaaaaaaccaggtattttttggtaactatgaagattccaaattgtcatttatcggaagtaaccatacgaggtacagaattgataaggacgaattttcgagcggaattgcatcaataagaggtaccttgatgtcttctgtattaccagatgctcccttaattataagggacatgattatccgtttgaagcctccaaaattttgtaatagtgcattaatcgatcctgaatttttgaaatgtttaaacgaagatcaaattacagctttaaagaaatgccacgctgcagaacattatagtttgatactcggaatgcctggaacggggaaaaccactacaatttctagcttaatcagatcattgcttgccaaaaagaagaaaatacttcttacttcttttacgcatttagcagttgataacattttaattaaactgaagggttgtgatagcacaatcgtccgcttaggatctcctcataaaatccatcccctagtaaaagaattttgtttgactgaaggaacgacgtttgacgacttagcgtcattaaaacatttttacgaagacccccaaatagttgcatgctcttctctaggggtatatcagtaagtaattgaaagcgacggcaatgaacaaactactaacaacattagttccattttcaataaaagaaaattcgattattgtataattgatgaggcatcccaaatacctctaccaatttgcttaggccctttgcagcttgctgaaaaatttgttttagttggtgatcattatcaacttcctcctttagtaaaaaattcaagaacatctaaggatggtttgtcgctcagtctatttaaattactatcagaaaagcatcctgaagccgttaccactttaagactacaatatcgtatgaatgaagacattaattcattatctagtgaacttatttatggcggcaatttggtgtgtgggtccaagacgatatcccaaaaaaaattaattttgccaaaagctcatctaagtgatggtttacccgattcgtcgtctagcctacattgggtcaacaagttaatcaatcctagtcattcagtcatattttttaataccgatgatattctgggagttgaatcaaaaactaataatattctagaaaatcatactgaagcttttttgatagaacaagcagtttcctccttcttggaacgaggcgttaagcaaagttctatcgggataatttcaatttacaaaagtcaggtggagttgctttctaagaatcttaaatcattcactgaaatagaaattaacactgtcgatcgttatcaaggaagagacaaggacatcattttaatatcttttgtgagatccaacagtaaaaacttagtgagtattgaaccaattatttacacaactgctaaccatttatttaggttggagaattgctacgcgattggcatcgtttgaacgttgctttaagcagggcgaaagtgaaatgtattatgtttggctcgttatctactctttcgtcttcaaatatagtttctcatttattgaaattattagaaaaaaacaaatggattttcacgttaaatgagaatgatatagcaacgaaatttgacgagaatagctctccaattaaggattgttctcaggttgcaacgacaaataatgctaaagttattattagaaagaaccaaaggttttttaatagtgacaatttatgtgaaaaagctattttacctcaactggaattttga

SEQ ID NO: 46242 - DNA, 2715 bp, Schizosaccharomyces pombe
atggctgattatccttttactgacaaagccgcaaagacattgtctgatgcgtactcaattgcacaatcttatggtcattcacaattaacccctattcacattgctgctgctcttttgtccgacagtgacagtaacggtactaccttactgcgcaccatcgtcgacaaagctggtggtgatggtcaaaagtttgagcgaagtgttactagtcggttagttcgcttgcctgctcaggatccacctccagaacaagtgactctgtcacctgaaagtgcgaaactgctgcgaaatgctcatgaacttcaaaaaacacaaaaagattcttacattgctcaagatcattttatcgctgtgttcactaaagacgacacgctaaagagtttattggcagaagccggtgtcaccccgaaagcgtttgaatttgctgtaaataacgtccgtggtaataaaagaatcgattcaaagaatgccgaggaaggatttgatgcactaaataaatttactgttgatcttacagagctcgctagaaatggtcaactggatccagttatcggacgtgaagatgaaattcgtcgtacaattcgcgtactttctagaagaacgaaaaataatccagttcttattggtgagcctggtgtaggtaagacctccattgctgaaggacttgctcgtcgtataattgacgatgatgtccccgctaatctttcgaattgtaagcttctcagcctggacgtcggaagcttagttgccggctccaaatttcgtggtgaatttgaagagcgtatcaaatctgttttaaaagaagttgaagaaagtgaaactcccattattttattcgtagatgaaatgcatcttttaatgggcgcaggttccggtggtgaaggtggcatggacgctgccaatttgctgaagccaatgcttgcacgtggtaagcttcactgtattggtgctactactttggctgaatacaagaaatacatcgaaaaagatgctgctttcgaacgtagattccaaatcatcttggtaaaagagccttctattgaagatacgatttctatccttcgtggtcttaaagaaaagtatgaggttcatcatggtgttactatctctgaccgtgccttggttactgctgcccatctcgcttcccggtacctaacttctcgtcgtcttccagattctgccatcgacttggtcgatgaagctgcggctgcagttcgtgttactcgtgaatctcagcccgaagttcttgataaccttgagagaaagcttcgacaactccgcgttgaaattcgtgctttagagcgtgagaaggacgaagcttccaaagaacgtctcaaggctgctcgtaaagaggctgaacaagtggaagaagaaacaagacctattcgtgagaagtatgaattagaaaagtctcgtggaagtgaacttcaagatgctaagcgtcgtcttgatgagttgaaggctaaggctgaggatgccgagcgtcgtaatgatttcactcttgctgctgatttgaaatactatggtattcctgatttgcaaaaacgtattgaatatttagagcaacaaaaaagaaaggctgatgcagaagcgattgcaaacgctcaaccaggctcagaacctttacttattgacgtagttgggcccgatcaaatcaacgaaatcgttgcaaggtggactggtattccggttactcgtttgaagacaactgaaaaggaacgactccttaacatggagaaggttctcagtaaacaagtaattggtcaaaatgaagcagttactgcagttgcaaacgccattcgcttatctcgtgctggtctttctgatcctaatcaaccaatcgcatctttcttgttttgcggtccttccggtactggtaagactttattgacaaaggcattggcatcatttatgtttgatgatgaaaatgcaatgattcgtattgacatgtctgaatacatggaaaaacactctgtttcacgtctcattggagcaccacccggttatgttggacatgaagctggtggacagcttactgaacaacttcgtcgacgaccttactccgtcatcttgtttgacgagattgaaaaggctgctccagaagtattgactgtacttttgcaggtactagatgatggacgtatcactagtggccaaggccaggttgttgatgccaagaatgctgttatcattatgacttctaacttgggcgctgaatacttgacaacagacaatgagtctgatgatggaaagatagatagtaccactcgggaaatggttatgaactcgattcgtggcttcttccgtcccgaatttttgaatcgtatctcttcaatcgttatctttaatcgtctgcgtcgtgtggatatccgcaatattgtcgaaaatcgtatattagaggttcagaaacggcttcaatccaatcatcgctcaattaaaatcgaggttagcgacgaagctaaagaccttcttggaagcgctggttattcccctgcttatggtgcaagacctttgaaccgtgtcattcaaaatcaagttttgaatcccatggctgtcttaattttgaatggccagcttcgcgataaggagactgctcatgtcgtagtccaaaatggcaagatatttgtcaaaccaaatcatgaagctaatgcaaacggctctgctgatattgacatggatggtattgacgacgatgttaatgatgaagaattggaa

SEQ ID NO: 46243 - DNA, 891 bp, Schizosaccharomyces pombe
atgcttgaagctagatttcagcaggctgctttgttgaaaaagcttctcgatgccatcaaggagttagttacagatgctaatgtatgtaaggggcagcatataaataaagatgctcaacgacaaagcctttcttttttttaaaaaaaatatatttattaacttcttttgaatgattctctaacctcataacagtttgattgcaatgacaacggtatctctctgcaggctatggatagttctcatgtagcccttgtttctatgcttattaaatcagatggatttgaaccatatcggtgtgatagaaatattgctttaggtataaatctgaacgccttatcaaaggtcttacggtgtgcccaaaacgaggatttggttactttaaaggctgaagatacacctgaggtattgaatttggttttcgagagcgagaaaaatgacaggatctctgattatgatgttaaattaatggacattgatcaagaacacttgggtataccagatatcgaatacgatgctactattactatgcctgctgccgaatttcaacgcattactcgagatttattaactttgagtgattcagtaacaatcaatgctagtaaagagggtgttcgttttagctgcaagggagatattggtaatggtagtaccacgctgaaacaacataccgatctttctgaccaagatcaaagtatcgaaatttctcttacccaagctgtaacacttacgttttctttgaaatatttagcccagttcactaaggctactcctttagctacccgagtcacactttcaatgagcaatgatgttccacttcttgtggagtataaaatggaatccggatttttacgattttatcttgccccaaaaattggtgaggaggatgaggag

SEQ ID NO: 46244 - DNA, 1867 bp, Schizosaccharomyces pombe
atgaacaattccattacggattcggtagaaaaaaaacctgaacaggttagttttgaagttcaacccaatgcccttcgtccggttgctttccacgtatttaccaggaagtacgatctcaatattaatcgtgactcactgcaggaattagcatctttcgtatctaaaaaatgcggctcacaatggcgttcccaatgtgagcccttactagacgaaattgcaaaaacttggaaacgagttcatgaaactcaacctatagttactcgacctcttttgatccctgtcttggcaaatttaaatgttccgcatgaagttcgcgtatcttccttagcaagagttcaaacgcttgagacaaccggttcatttttaaattcgagtaattcggaaatccgtgaaactataaaaaatgagaaatactttagagtccttgatgcttttaaaatgcctaaatttaagtacgattcatcaagaaaggttttcgttttatcaaaacagtctcctactttaatggcatctgcaagtgcctgcacagatatgcttaaccgcagattcaatgttgtatatagccgtattttacgcaatgaatcttttcaaacaccttctttcagtggctctttctctcaaacaggtacatatcaattaactcctattcgcaatttattaggtcgagctggaaacacatttttgttgttcggactcttgactatagctcccgatggtaccttatggctggaagatcttgacagtcaagttcaactagacgtatcacaggcagaacaagggttcggtctcttttgccctggctgcttggtacttgttaatggtcaatttctaagttctgggctatttttagtttttgagcttggtcatcctcccattgaacgccgtgatgcttccttgaaggcccttaataatttagatattttggggttgaatatggatgcaaagcaacttgctcttctccgtcacgcggaacaggcatatcagtcacaagcttttgtttgtatcagcgaggttcatcttgacaaccatcaaactttctatgcattagaaaaaatattccaaaaatatgaatcctctgaagctgtgccgttttgtataatattatgtggaagttttatgtcttccgctttccataattcaggaagctcaattcaatataaagaaggatttaataagcttgcagcttctcttgagaagtttccaaaaatttgcgaaaagacaaaattcatatttgtccccggtccaaacgacccttggacgacaaatgggatatccttaatgcctaagcattcaataccccttcatttcgtaaatcggatccaacgcgtttgtaagcataccattttcgcttcaaacccttgccgcatcattttcttttctcaggaagtactaatttatagagacgatatatcaggaagatttcaaaggaattcattaaagtttgggaagactccccaaggtacctccaatattaattctataccccttgcagaacaacaagtgcatcagcaaagaaaagtaagcaagtttcttataatttttttatgctaatttgtttagttggttaaaacagttttagatcagtctcacctttcaccgtttccatcgagaacacgaccaatattgtgggattttgattatgctttatcagttttcccgcttcctagctgtgtacgttataaatcttttttttctttgctaatatttttagatgggtctaatagattctgagtcgtcggcgtttgatgttcattatggaggttgcccaacttttaatcccggtgctcttttacttggcgttcactataattggcaagaagtatttccagtaaaaaaagaaataattacacacaaggagagaatttag

SEQ ID NO: 46245 - DNA, 2445 bp, Schizosaccharomyces pombe
atgtcttacagagataacgaatatagtggaaattacaatggaaaagaggatggctataacagcagagggtaagaattcacaattgggcgtgcccctgttcagtacaaaattattgatactgatttacctttttttttaaaataattaatattaacattttacagtcgttatggtggcggataccgcaataactatagtcgtggcggcggtcgtggaggtttcaatgatggcgcttcttatggctacgatcaacgaggacaaggaagaaatttttacgagtcagatggtcccggtgctaatttggtaaagaaggattggaaaaatgaaactttgattccgtttcaaaaagatttttataaagaacatgaaaatgttcgcaatcgttcagacgctgaagtcaccgaataccgtaaagaaaaagaaattgtcgtgcatggattaaatgttcctaaacctgttacgacatttgaagaggctggttttcctaactatgtactaaaggaagtcaaacaattggggttcgaagctcctactcctatccaacaacaagcatggccgatggctatgtctggtagagatatggtaggcatttcagctacgggttctggtaagacactttcttattgtcttcctgctatcgtacatattaatgcccaaccactactttctccaggcgatggtccaattgtactcgttcttgctccaacgcgtgaattagctgtccaaattcagcaagaatgtactaaatttggcaaatcatcccgaattcgcaacacatgtgtgtatggtggtgtccctcgtggtccacaaattcgtgacctaattcgcggtgtcgaaatttgcattgcaacacctggtcgtttattggatatgttagactctaacaaaaccaacttacgtcgtgtgacctatttagtgctggatgaagccgaccgaatgcttgatatgggttttgaacctcaaattagaaagattgttgatcaaattcgaccagaccgtcaaactgtcatgttttctgcaacatggccaaaagaagttcaacgtcttgctcgtgactatttgaatgactacattcaagtaactgtcggctctttggatttggcagcttctcataacattaagcaaatcgtagaagttgttgacaatgctgataaaagagctcgtcttggaaaggatatcgaagaggttttgaaggatagggataacaaagttcttatttttacaggcacaaaacgtgttgctgatgacattactcgcttccttaggcaagatggttggcctgcccttgccattcatggtgataaagctcaagacgagcgtgactgggtactcaatgagttccgtactggcaagtctccgattatggttgctactgatgttgcttctagaggaataggtaagtttttatttaacagttttttccttttcgcaggcttttttatttgacgttatactttcaccggcgttctcaatgtctcttttgataataaaagatggactggcgatcaacaccattttagcttgaattttgcaagtttgtgttgctttgatgaatatttttgtttacgcccagtcttaaggaaagtagaaaattcggatgattgtttagcctgtttcttacaggcacgaatggtgttacaaagagaaactgatgatttctatttcatgatcttggccttttcaatagtagtcgagatacgtgtggtctgctacctgttaaatttgttgtcaacgtttccgcgatctatgtaaccatttgatttgcggtcaatttaaaaggtttttaaacgcttattctattcagccttcaaaccaacttgactcattgtttacttttagaccacattaaatgatttaaaacatagtttttctgtactgtttcctccttttctttactttcttttgtcttttgtctttctttcattgtgaacttattgctgttcggtaccattgctaaaatgtttatgcagtgttgttgacctaacttgtcaaatttaaagaagcttaaagttgttgatatattggataaatccatgaaacatatatctcgaagcttaaagtcaaaaccctcttgggcattactaactttttatagatgttaagggtattacacatgtctttaactatgatttccctggaaatacggaagactacgttcatagaattggacgtactggtcgtgctggagctaaaggtaccgcatatacctatttcacttcggataatgctaagcaagctcgtgaacttgtttccattctctctgaagccaagcaggacattgatcctaagcttgaggaaatggcccgctattcaagcggtggtcgtggtggtaactaccgccgtggcggctatggtcgtggtggtttccgtcgtggaggaggttatggaaaccgtaataggggttttaccggaagtaattctgccccccttgcgcgttcacgttgg

SEQ ID NO: 46246 - DNA, 3057 bp, Schizosaccharomyces pombe
atggctgaatatgaaatagacgaaattacatttcataaacgcttgggcatacttcttacctcctggaagaatgaggaagacggaaagacgctgtttcaagactgcgacagtattttagtaacagtaggggctcatgatgatacgaatccatatcaaaagtccactgcactacatacatggctcttgggttatgaatttccatcgactttaatacttcttgaaaagcatcgaatcacaatccttacatcagttaacaaggccaatatgttaacgaaattggctgaaaccaagggggctgcagctgacgttaacatcttgaagagaacgaaagatgctgaggaaaataaaaagctttttgaaaaaataatagagtatattagagccaccaataaaaaggtcggagtatttcctaaggataaaacacaaggaaaattcattaatgaatgggactcaatttttgaaccagtgaaatcagaatttaatcttgtggatgcatcgcttggcttagcaaagtgtcttgctataaaggacgaacaagaacttgctaatataaaaggagcatcgcgggttagtgttgcggttatgagtaaatattttgttgatgaactttcgacttatattgaccaaggaaaaaaaataactcactctaagttttcggatcagatggaaagccttattgataacgaggctttttttcaaacaaaatctttgaaactaggagacatagacttggatcaactagagtggtgttatactcccattattcaatcggggggtagttatgatttgaagccttctgctataacagatgatagaaatcttcatggggacgtcgtcctatgctctttagggtttcgctacaaatcgtattgttctaatgttggtcgcacttatttatttgatcctgattccgaacaacagaaaaattactcttttttagtagcgcttcagaaaaagttgttcgaatactgcagagatggcgctgttattggggacatatatacgaaaattttgggtcttatacgtgctaaacgtcctgatctcgaacctaattttgtaagaaatctaggtgccggcattggcattgaatttcgcgaatcttcacttttagtaaatgccaaaaacccacgcgttcttcaagccgggatgactctaaatcttagcattggatttgggaatttgattaatcctcatcctaaaaattctcagtctaaagagtatgctcttttattgattgacacaattcaaataacaagaagtgatccaatcgtatttactgattctccaaaagctcaaggtgatatatcctacttctttggtgaagatgattcttctcttgaagacggcgtaaagccacgcaaaccacctactcggggaacggcaactatatcaagtcataaaggaaagactcgaagtgaaaccagagacttggatgattctgctgaaaagaggcgtgttgagcatcaaaagcaactagcatcgcgaaaacaggctgagggattgcaacgatttgctcaaggttctgttccgtctagcggcatcgaaaaacccactgtcaaacgatttgagtcgtacaagcgtgactcgcaacttccacaagcaattggtgagttacgtattctagtagattatcgagctcaaagtattattttacccattttcggtcggcctgtcccgttccatatatctactttaaaaaatgctagtaaaaacgatgagggaaattttgtgtatttacgactaaatttcgtaagtcctggccagattggcggtaaaaaggatgagttaccgtttgaggaccctaatgcccaattcatacgaagctttactttcagaagttcaaataattctagaatgtcgcaagtattcaaggacatccaagatatgaagaaagcagctaccaagcgtgaaactgaacgtaaggagtttgctgatgttattgagcaagataaattaattgaaataaagaacaagagacctgctcatataaatgatgtttacgttcgccctgctattgacgggaaacggttgcctggattcattgagatacaccaaaatggtattcggtatcaatcgccattacgttcagatagccacattgatcttttgttttctaatatgaagcatctctttttccagccatgtgaaggcgagcttatcgttcttattcatgttcatctgaaagctccgatcatggtgggaaaaaggaagacccaggacgtgcaattttatcgcgaagtttctgatattcagtttgacgaaactggaaacaagaagcggaaatacatgtatggtgatgaagatgaattggagcaagaacaagaagaaagacggcgtcgtgctcaattagatcgcgaatttaaatcatttgctgaaaaaatcgctgaagcaagtgagggacgaattgaattagacattccatttcgcgaacttgcattcaatggtgttcccttccgttccaatgttttattgcagccgactactgattgcctagttcaattgacagacacaccatttactgtaattacactaaacgaaattgaaattgcacacttggagcgtgtacaatttggtttaaaaaattttgatttggttttcatctttcaagacttccgccgccctccgattcatatcaatacaattccaatggagcaattagataatgtaaaggaatggctcgattcatgcgatatatgcttctatgaaggtcctcttaatttgaactggaccacgattatgaaaactgtcaacgaggaccccattgcattctttgaagaaggaggatggggatttttgggagctccgagtgatgatgaaggagatgatagtgtcgaagaggtttctgagtatgaagcttctgatgccgacccttctgatgaagaggaagaagaatctgaggagtacagcgaagatgctagtgaagaggatggttacagtgaaagcgaagtggaggatgaagaaagtggtgaagattgggatgaattggagcgtaaagcacgtcaagaagatgctaagcacgatgcttttgaagaaagaccatctaaaaagagacaccgg

SEQ ID NO: 46247 - DNA, 1577 bp, Schizosaccharomyces pombe
atgcgagatttgacctctgcaacggacagcgcgtctttggaaagtgattcgtcacgaaatcaatttattatcaattcactggtatgttttattaaaattgtgattatactaacgtttagctaccatggtactcatgctctgaacatgaatttcctcatcgaaaggctagaaaaaggcgttcgcctaagaatttagattggtcggtttcggtgcaaatgcctctggtcacatcaaagacgaaagagtctgaaaaatcgcctaaatcgtggtctgcaattgcgaaaaagcatgttcaaggagactctcctgttaaaaaatcacattctgttccggtaccgtctgacaggtctgagaaaaaaagtttcaattcatcccttggtgaattgatcgaaacatattctccatccctcgatgcaccccgtcctatacagcctcggggttttataaataccggaaatatatgttttatgaactctattttacaggcactaatgtattgtgttccattttataatttacttaagcaaattaaccggatggttccgtataattttgaacgtacaacacctcttattgaatcgttgacaatgctttctagggattttagagaatattctgagaaatttgatttacaaggagattctattttgccagaagtggtatattcagctactaaggggaatcctcgatttgaaatgttgcagaccggcgaacaggaggatgctgaggagtttttgaatttgtttcttgacgaattacatgaagaattcgtgcgtgaacgtagacattatttattaaaaaatgacgaaagaaatccaaaatctgatatcaaaatttcaaatggtatcaagtctggtttagatagttttgatgatcaatcttctgtagaagctagtggctggaccgaagttggtaaaaataaaaagccagtaattgctagatctgctactgttgaaaggtctcctataagccaaatttttggtggtcagctgcgctctaccttaagggttccgagtgcaagagattctgttttgttagaaccgtttcaacctctgcaactcgacattcaagcagaagatatacattcagttatcgatgcgttggagcatatgaccgcccctgaaattttaccggaatggcattcgtcgaaaggaaatgttactgctaccaagcaaatgtatatagagtcacttcctcctgtcttgattcttcaccttaaacgattcttttacgaagcatctggcggtacacagaaaaattataagcctattgcttatcctgctcgcttgagtattccacaaaacgttttcagcccttctgttcgtggttccatacatccggaatatgatttgaatgcagtggtttatcatcacggtacttctgcgtctggtggtcattatactgtcgatgttcagcaacttgataaaagcggctggtttcggattgatgatacacacattcaccgcgtacctattcatgatgttgaaaactccgaactttccgctgatccgagtcttagtaaacttggtcacggcgatcgtgtggcatacttactgttttacacacgacgctcctag

SEQ ID NO: 46248 - DNA, 1077 bp, Schizosaccharomyces pombe
atgttagtttcttccaatgaggaacaacttactgctcatactcccacttcatcttcaagtatagaacctaaaatattagctgcctgttcatattctctatcagtgggcccttgctctttagctgtttcaccaaaaggcgttaattccaaatctccctctcttaaaaatgagactgcatttgttgtcgactctgttagcacattgtcagcggaatctagcgccttactttataacactcaatcctctttactcactggtttatcaatgaacgggtatttaggtgagtaccaggaagacattatccatcatctgattactagagagaaaaattttttgctgaatgtccatctttctaatcagcaaccggaactcagatggtcaatgcgacctgcactcgttaattttattgtagaaatacataatggattcgacttgtctattgatactcttccgcttagtatttccctcatggattcatatgtctcgaggagagtggtatactgcaaacacattcagttagtagcatgtgtttgtctttggattgccagtaaatttcatgaaacagaagaccgtgttccattattgcaagaactgaagttagcttgtaaaaacatctatgctgaggatttatttattcgtatggaacgccacatacttgatactcttgattgggatatctcaatccctacaccagcttcgtatattcctgttttagacccgatttttttcttagtacttgatgcatcaatgtttgtacctaatttattcaaatttcccgcttccaaaatcgcatgttcagttatgaacatcgtaaacgaacatgtcggatcgtttcttttgacacacccttctatggaatcctatcgcaaagatgataactttttgtggcctgaagacttggataccgtaacatcatatatggaaaacatgtcaaagaggtatgctaatgaggaatgtactgatttactgttttcctcactaggccgtatttctagtattttagcaaagaaatatccggaacaatgcgcaatggctgcctggtgcaacatgactgaaaaggatactgagcgtactttg

SEQ ID NO: 46249 - DNA, 828 bp, Schizosaccharomyces pombe
atgttagtttcttccaatgaggaacaacttactgctcatactcccacttcatcttcaagtatagaacctaaaatattagctgcctgttcatattctctatcagtgggcccttgctctttagctgtttcaccaaaaggcgttaattccaaatctccctctcttaaaaatgagactgcatttgttgtcgactctgttagcacattgtcagcggaatctagcgccttactttataacactcaatcctctttactcactggtttatcaatgaacgggtatttaggtgagtaccaggaagacattatccatcatctgattactagagagaaaaattttttgctgaatgtccatctttctaatcagcaaccggaactcagatggtcaatgcgacctgcactcgttaattttattgtagaaatacataatggattcgacttgtctattgatactcttccgcttagtatttccctcatggattcatatgtctcgaggagagtggtatactgcaaacacattcagttagtagcatgtgtttgtctttggattgccagtaaatttcatgaaacagaagaccgtgttccattattgcaagaactgaagttagcttgtaaaaacatctatgctgaggatttatttattcgtatggaacgccacatacttgatactcttgattgggatatctcaatccctacaccagcttcgtatattcctgttttagacccgatttttttcttagtacttgatgcatcaatgtttgtacctaatttattcaaatttcccgcttccaaaatcgcatgttcagttatgaacatcgtaaacgaacatgtcgga

SEQ ID NO: 46250 - DNA, 1467 bp, Schizosaccharomyces pombe
aaattactaaataatttatttagggaatacctaagtactaagcgcgtagcattggtatgctctgctcgcagcacagataccaaagcagaaggcactactactagacttattagagcaacagaagcagcattgcgacctgctgtaggttctgtgcatgatttggttcgtattattgaaactgatcatgttcaagctgctcgtgatttcatccaggatgttggcattcaagacgaacttattgatgcttttcatgcagactgcgttgaattggaacagtacctaaatgctattagagttctttccgaggtttctcctcgtactcgtgatctcgtgattggcatgggggagcgtttaagttgccgatttatggcggcagttttgaaagatcaagggatcgattctgagtttattgatatgagtcatataattgacgagcaaagagagtggaggaatcttgatgcatccttttacgcatatcttgcttcccaacttgctagtaaagttaccgctgttggaaataaagtacctgtcgttactggcttttttggtatggtaccgggtggtcttttgtcgcaaattggccgtggttacaccgatttttgcgctgctttattagctgttggtcttaatgctgacgaacttcaaatatggaaggaagttgatggcattttcacagctgatccccgtaaggttccaactgctcgacttcttcctctcatcacacctgaagaagctgctgaacttacttattacggtagtgaagtcatccatcccttcactatgtcccaggttgttcacgctcgtattcctatccgaattaaaaacgttggcaacccacgtggaaagggaactgttatttttcctgatacaatttcacgtcatggtagtgctacacctcctcatcctcctaaaattatgcccgatgatatttctgctagcctcgctaacaaaggcgctaccgcggttactattaaagacaccattatggttattaatattcaatcgaatcgtaaaatatctgctcatggtttcttagcttccatatttgccattcttgataagtacaaattggctgttgacttgattactacttcagaagttcacgtctcaatggcgctttacgaagagtctgatgacggtaatatgcatgaggcattcgttgaattgcgtcgattgggaacgcttgatattctccatggtttagctattctatctcttgttggtaagcacatgagaaacactaccggttacgctggtcgtatgttttgcaaacttgctgaagcccaaatcaacattgagatgattagtcaaggtgctagtgaaatcaacatttcatgcgttattgacgagaaaatggctgtaaaggctcttaacgttattcataaagaattgcttgaacccttagctttacatgaagttccgtcacaggcctcgatgttggttgaaaagccttggctttacagtgct

SEQ ID NO: 46251 - DNA, 2280 bp, Schizosaccharomyces pombe
atggcacttcccaccatagatttaaaaatcccagagtatgaagaatgtcaacataaaattacggattttctatcccacttcaagcaggaacaggttcaagatggacaacaaaatcaggatatttcgatgtcggatgcaggtgatgagccttttttaaaatcaaagtatatggatatactacaaaaaatctccaatcgagagtcaaatgttattaatgttgatttgaatgatttgtacgagttcgatccaagtgatactcagcttttgcataatattgaatctaatgctaaacggtttgttgaacttttttcgcagtgcgcagatgcgttgatgcctcctcctactgtggaaattaattatcgcaacgaagtacttgatgtaattatgcagcaacgtgttcaaaggaatgaaaatatagaccctgagcataaaggatttcctcctgaattaacccgaggttatgacttatactttcgaccagtaactcgcaacaaaaaaccattcagcgttcgtgatttaagaggcgaaaacttgggatctcttttgactgtccgtggtatagttactcgtacaagtgatgttaagcctagcttaactgtaaatgcttatacatgtgatcgatgtgggtatgaagtgtttcaagaaatccgtcagaagacattccttccaatgtctgaatgtccttcggatgaatgtaaaaagaatgatgcaaaaggtcagcttttcatgagcacaagagccagtaaatttcttccttttcaggaagtaaaaatacaagaattaacgaaccaagtacctattggccatatccctagatcattaaccgtccacttatatggtgctatcactcgctctgtaaatcctggcgatatcgttgatatttctggtatatttttgccgactccgtatactggttttcgagcaatgcgcgccgggctcttaaccgatacttacttagaatgccattatgtttcacaaatcattaaaaattacacaaatattgaaaaaactcctcaatcggaggctgctatcgctgaattaaatcaaggaggcaatgtgtacgaaaaactggccaagtccattgctcccgagatatatggacatgaagatgttaaaaaagctttacttctgttgcttgtcggaggtgttactaaagagttaggggatggaatgagaattcgtggtgacataaatatttgtttaactggtgatcctggtgtcgcaaaatctcaattattaaagtatatttcgaaggttgccccgagaggagtatacaccacaggtcgtggatcttcaggtgttggtttaactgctgctgtaatgcgtgatccagtgacggatgaaatggttttagagggaggtgccttagtacttgctgacaacggtatttgctgcattgacgaatttgataagatggatgaaagtgaccgtacagcaattcatgaagtaatggaacagcaaactatttcaatttcaaaggcaggaatcactacgactttaaatgctcgaacaagtattttggccgctgcgaaccccttatatggacgatataatccgaaagtggcaccaatccacaatataaatcttccagctgcactgctttcccggtttgatattttatttttaattttagatactccttctcgtgaaacagacgagcatttggcacaacacgtaacatatgttcacatgcataacgaacaacctaaaatggactttgaaccattagatccaaacatgattaggcattatatttcttctgctagacaatatcgcccagtcgtaccaaaggatgtatgcgactatgttactggtgcttatgttcaacttcgacaaaaccaaaagcgtgatgaagccaatgagcgtcaattcgctcacactactccacgtacacttctcgctattttgcgaatgggacaagcattagctcgtttgcgtttcagtaatagagtggagattggcgatgttgatgaagctttgagattaatgtctgtttcaaagtcatcactatacgatgatttggatcctagttctcacgatactactattacctcgaaaatatataaaattattcgagacatgcttaatagcataccagatgttgaaggcaatgaacgctcacttacactacgtgctattcgtgaacgcgtacttgctaagggttttactgaagatcatttaataaatacaatacaggaatatacagaccttggtgttcttttaactacaaacaatggtcaaacaataatgttcctcgatccggatttacatatggagaat

SEQ ID NO: 46252 - DNA, 1173 bp, Schizosaccharomyces pombe
atgggccttgagcatctcgaagaattcagttatcctaaggaacatggtgaagaagtcgagtatgatagcgaacaaggtgttcgtaaaatttatgttaaatctattaaagaaacctttaactttgataatgtaagtgaagaagagaaacaggaaggaggcgactactacttgggcaaaaaggaagatgagcttgatgaagttgtgcttcgccctaatcctcaccgctttgttttgtttccaattaagtatcacgaaatttggcaattctacaagaaggctgaagcatctttttggactgctgaggaaattgatctttcgaaagacttggttgattgggataacaagttaaatgctgatgaacgttactttatttccactgtactcgcctatttcgctgcgtcagatggtattgttaatgagaatcttctcgagcgtttcagctctgaagttcagatccctgaagctcgttgtgtttatggtttccaaattatgattgaaaatattcactctgagacctactcacttttgcttgatacatacattcgtgaacctaaggaaaaacagcgtcatttcgatgctattttaacaatgggttctattaaggccaaagccaagtgggctcttcgttggattaatgatgaagattccacctatgcaattcgtttggttgcctttgctgctgtagaaggtatcttcttttctggatcgtttgcctctattttttggcttaagaaacgtggacttatgcctggtcttactttttccaatgaattgatttgtcgtgatgagggtcttcacaccgactttgcctgtttgatgtttagtcatttgaagcacagaccaggccgcaaggttgttgaagccattattgttgaagctgttgatattgagaaagaatacttcacggacgctcttcccgttagtctgcttggtatgaataaggatttgatgtgtcagtatattgaatttgttgctgatcgtttgttggttgctttgggcaatgacaagtactataacgtaaccaatcctttcgatttcatggagaatatctctttagcaggaaaaacaaatttctttgaaaagaaagtttctgactaccaaattgctggcgttatgtcgggtaccaagcgcgctgagaaggatgatcatacatttacaatcgatgaggacttt

SEQ ID NO: 46253 - DNA, 1386 bp, Schizosaccharomyces pombe
atgcaagcagaattcaagtctagtatcaacgacttcctggaacagttaccaaatcatgcaaggctttaccaaaagccagctgcttgtcttgctgtgtttcgtttattgccaattctagctagacagtatgtcatgtctatgcttttcaatcctatgccagtagcactctcagatttcgatttatggatcaaactttcgagtaaagtttatcaatctgaatccttcaacaaactggttaggatgcatatatttcaatttgatggacaatatatcactctaaatagtgaatttcgcaaacaatttataactgctctgactggagggtaagttttattgaattttgagtataaactaattaagctttttagaggaaatcacaattcgtttggcgtgccatgtaccgatgaagacaagcacttggtgacggttgattttcttgacgcatatgcgaaagaaacttgggaaacaatcttgcacttcatggtaggaactccggaagctaaatttcctggagaaggtgtcttaagtctattaaagcggggcggtttaatgtctggtccaaaaaaccagctacgtattacccgtgccggttttcagtttctgttacaggatataaatgctcaaatttggacgttacttttggattatttaaaactatctgaagacacgcatatggatcctgttcaggttttgcactttttatttatgcttggaagtttggatttggggagggcatactcagtggacttcttaacagatacacaacaaatcatgcttgaagacctaagagaatatggattagtttatcaaagaaaaattacttccaagcgtttctatccaaccagactggcaacaggtctgacaactgattatcgctcattgcatggaaagcaaagtgaaaatgatgatgataaaggttttattattgtagaaacaaattaccgattatatgcttacacaagctccccattacagattgccatcatcggattgtttgctaacttaagggcgcgtttttcaaatcttgttgtcggtgtgataactcgggatagtattcgtcgtgctttgatgaatggaattgcagcggagcaaattattacatacttgacaactcatgctcaccctcagatgagatcgaatgttcctcttttacctcctacattagtagatcaaatttatttatgggaattggaaaaaaatagacttcgggctactcctggaattttgtttcgcgattttcttactgattctggcttcgaccaagcagtagagtacgcaaaagaactcggggttttggtttgggacagttccttgaaaagaatgtttttcataactacgacaggcgcccagcccatgatcgcatacttgaaaagacgagctgtcaaa

SEQ ID NO: 46254 - DNA, 711 bp, Schizosaccharomyces pombe
gatcctgttcaggttttgcactttttatttatgcttggaagtttggatttggggagggcatactcagtggacttcttaacagatacacaacaaatcatgcttgaagacctaagagaatatggattagtttatcaaagaaaaattacttccaagcgtttctatccaaccagactggcaacaggtctgacaactgattatcgctcattgcatggaaagcaaagtgaaaatgatgatgataaaggttttattattgtagaaacaaattaccgattatatgcttacacaagctccccattacagattgccatcatcggattgtttgctaacttaagggcgcgtttttcaaatcttgttgtcggtgtgataactcgggatagtattcgtcgtgctttgatgaatggaattgcagcggagcaaattattacatacttgacaactcatgctcaccctcagatgagatcgaatgttcctcttttacctcctacattagtagatcaaatttatttatgggaattggaaaaaaatagacttcgggctactcctggaattttgtttcgcgattttcttactgattctggcttcgaccaagcagtagagtacgcaaaagaactcggggttttggtttgggacagttccttgaaaagaatgtttttcataactacgacaggcgcccagcccatgatcgcatacttgaaaagacgagctgtcaaa

SEQ ID NO: 46255 - DNA, 882 bp, Schizosaccharomyces pombe
atgtttatcattaactggttctacgatgctcttgccatgcttggtcttgtcaacaagcatgccaagatgctgtttttgggtttagataacgccggaaagaccaccttgctacacatgctgaaagtatgtttgacttctactctccttgattatccttatactaattatttagaatgaccgtttagctgtaatgcaaccaactttacatcctacttcagaagaactggctattggcaacgttcgatttactactttcgatttgggaggtcatcaacagggtatgtagtcacagagttgtttttctaaatcatggagattttgtaagagttggaatgtctttagaataattaattttttttcgcttaaaattcttttttgtataaagttgtttgaatttctatatcgtctcatatgtcgttggctagtttatcagtgggccgttttgttctcatgatctttgttttttctttgcaatttcttctatgattttggattctctatctgattttatgtatttttactaattttcttatagctcgccgcttgtggagagattatttccccgaggttaatggcattgtttacttggttgactgctgtgactttgaacgcctttctgaatcaaaggccgaactagatgccttattggccatggaagaacttgctcgcgtcccctttttgattcttggcaataaaatcgatgcccctggtgctatttctgaagatgaactcaaggcggcccttggactttatcagaccactggtaagggcgtgtctaaacccgttcctggaatccgacctatcgaagtattcatgtgctcggtggtccttcgccaaggttatggcgaaggcttcaagtggcttgctcaatacgtctaagtt

SEQ ID NO: 46256 - DNA, 3120 bp, Schizosaccharomyces pombe
atgagaaataatacagcttttgaacaatttacgttaaatccatgtgaacaaatacctttagatgacaaacataacattgggttcaataaaaataataccccggactattcttcttctgcatcgtctgaccaattgttaaaaaatgatataaacagacatgaaatggaaaggagaattgcttttcttaatcgaaaacaggcgctattcaatgcctttatgcatgattcatcgtcctctttaaatacgatggaatctaacatagaaaaagtgaatggcctttttcctaatgacaatagtgtgattgcattaaagcctaatgaagagaagctgaacagttctctttccgttgaaaataatgattctacttacacggatgccactttaattgctcctaaaattgggcttgatcgtccaaacatcaatgcaattactattgatgttgatggccactctttgcaaaacgaaattagttcttcaacagataagcttagtccgagtcaatctgatgcactttttgaacaaaaacaggactctttgttttggaacgacaatgctgtgattgtcgtatctgactctgaatccgatgataataatgttcggacgaaatcttcactgaacgaccatgataaagttaatatgaaggaaaaaaggaatttagagcttgcgtttatgaattcgaaaaggaaaaaactagagttaccttcgttaccagttttatctacggctggaccttcttataccaattctttagctcttcctccttttcatcatcataataattataagatgtttaacacaactcacactttagaagatgataagtttcttcaaggaaaaggaacttctaataatccgatctctttatcagacgaagaagataacgaaattaattttcagaataagcgttatggctcggattcagtcattcttccgggtggtttgttgcatgattccaagctacccgaacctggtaaacacttattccaccttcaatggtatcacgatagatttcacaatattgaaggattcaatttgtcagactcaaataaccagaaagttcaagatgatcagcaacaacagttggaggagttgttcaaagatcttgatgagcagcttgtcaacgatccaacaattcgcgaaggtacacctgctggactaatacctacattaatggaacaccaaaaggaaggactaatgtggttaaaaagattagaagaaagctctaagaaaggagggattttggcagatgatatgggtctaggaaaaactgtccaggctcttgcattgctagtaacaaggcctccagaatctaaatcagttaaaacaactctgattatcacccctgtgtcgctattacagcaatggcataatgaaatacttactaaaattgctccctcacatagacccactgtttatattcatcacggaagttcgaaaaagcacaaaattgctgaacaattgatgtcgtatgacattgttttgactacttataatgtcatcgcttacgagtttaaaaacaaaatggcttatgacaagagtatcgaagataacgctccaataaaaaaatttgaacaccttccattttttgaagcagagtggtatcgagttatattggatgaagctcaaactatcaaaaacaggaatacgttagctgctcgtggatgctgtctattagaatcaacttatcgttggtgtttgagtggtacccctatgcagaatggggttgaggagttctacagcttgataaaatttctgaggattaaaccttattcagactggtcaagtttttcaaaggactttaccattcctttaagtagcaatataaacacgtccgctcctatgaagcgctttcgtggcttattaaaagcagtgctacttcgtagaacgaaaaatacaaagattgatggcaagccaatattgacacttcctccaaaaaccgccgtcaaatctgaaacagacctctcttcttctgagatggaattttacaatacgcttcaaagcggagcacaaattcaaatgcgtaaatatcttcaagaagggactataactacgcattacggtagtctactagtattacttttgagacttcgacaggcttgttgtcatccctggctaattgttgctcgagaagcagcggttgatgataacgatagctttcaagctaagaatcgtgcaatctacaaccaaatatatcccgaggctgtcaatcgccttaagttaattgaaacgttgcaatgctccttatgtatggatgttgttgcagaacttttgataattgtgccttgcggtcattttctatgtagagagtgcttaacccatgttattacatccagtgaggatatggctaagcaaacaagcaacgaaaatatttctcctaagtgctcagtttgcgaggagtacatcgatactgaaaggcttttgagttacgcattatttagacgatattctggaatggcacctattgtcgatgccgataacaaattaagaacagaaaacatttccgaattgctacctaaacagtatagtaatatcttagagaatagacaaatgggtatgaagatctttacggatcctaaacattggaccacttctacaaaaattgaaaaagcattaaatgcagttaaagaaatcatcaagaaacagccaactgacaaaattttaatattttcacagtttgtttcttttcttgagctttttacggtaccctttcgacaagagggtataaaatatcttatgtatactggtggtctaagcacagcggaaagaaatcaagctcttattaattttgaagttgatccgaacgtgagagttttactgatctctttaaaagcaggaaatgtcgggttaaacttgacttgtgcaaatcatgtcatcatactcgatccattttggaatccttatatcgaagaacaggctgtcgatcgagcacatagaattggacaagataaaccggtaaatattttacgaattgttactaataacacgattgaagagcgagttttagccttacaagacagaaagagagaactaatagatagcgctttaggggaaaaagggcttagagaaatttcacgtctgaatacaaaggagttgtcatttttatttggaatgtcatcacga

SEQ ID NO: 46257 - DNA, 2981 bp, Schizosaccharomyces pombe
atgagtaattctgacattcgaagcttctttggaggagggaacgctcaaaaaaagccaaaagtctcaccgactgtatgtttgtttcttcaatcagtcaaatttgataagctagtcattcattttctaacgtctttgtctagcctacttccccaaaaccaaaaaggagtttgaagaaaaaaagaatcgttttatcagatgatgaagatggtacaatagagaattcaaaagttcctgcatccaaaagcaaagtgcaaaaacggttcgtttaattcgggttatcagtttatatttctaaccctccaactagtaatgagtcggaagatatttcccattctttgccatccattgttcatgaagacgataaactgtatgtttattttacttttacctcattatgcgttgttcgctaatttgaatttttgtttagtgtcggttcagatggagtttcaactacacctgatgagtactttgaacaacagtctactcggtcacgttctaaaccgcggattatctccaataaagaaactactacttccaaagatgtcgtacatcctgtaaaaacagaaaattttgccaatgacttggataccacttcagacagtaagccagttgtccatcaaactagagctacacgtaaacctgctcaacctaaagcagaaaaatcgacaacttcaaagtcaaaatctcataccacaactgcgacaactcacacaagtcgttctagcaagtcgaaaggcttacctaggttctcagacgaagtttcccaagccctcaaaaatgttcctttaattgacgtagactctatgggtgtgatggctccaggtactttctatgaacgggcggctacaacacaaactccaggctcaaaacccgtccctgaaggcaatagcgattgtctctcgggaattagctttgttattacaggaattctagagactttaactagacaagaggctacagacctgatcaaacaatatggtggaaaagtgacaggtgcaccttctgttagaacagactttattctcttaggtgagaatgctggtccaagaaaagtggaaacaattaaacaacacaagattcctgctattaacgaggatggactcttctatcttataactcatcttcctgcttcaggaggaacgggtgctgcggctcaggctgctcaacagaaaaaggaacaagaagaaaagaaaatccttgaaactgttgcgagaatggacgatagtaataaaaaggaatcacaaccttcacagatatggacttcaaaatatgcgccaacttctttaaaggatatttgtggtaataagggtgtcgttcaaaaacttcaaaagtggctacaggattaccacaaaaacaggaagtccaactttaataaacctggacctgatggtctgggtctatacaaagccgtattactctctggtcctccaggtattggcaagacgactgctgctcatttggtagcaaaattagaaggttacgatgttttggaactgaacgctagtgacactagaagcaagcgcttgctagatgagcagctgttcggtgtgacagatagtcaatcacttgccggctactttggcacaaaagctaaccccgttgacatggcaaagtcccgacttgtactcattatggacgaaatcgatggcatgtcatcgggtgatcgtggaggcgttggtcagttgaatatgattattaaaaaaagcatgataccaattatttgtatttgcaatgaccgtgctcatccaaagctgcggccccttgaccgtactacgtttgacctccgtttccgtcggccagatgctaattcaatgcgatcccgaataatgtctatagcgtatcgtgaaggtctcaaattgtcaccacaagcagtcgatcaactggttcaggggacgcagtccgatatgcgccaaattattaatttgctatccacttacaagttaagctgttcagaaatgacacctcaaaatagccaagctgttattaaaaattctgaaaagcatatcgttatgaaaccatgggatatctgtagtcgttacttacatggaggaatgtttcatccatcaagcaagtccaccattaatgataaattagagctgtattttaatgatcacgaattttcttatcttatggttcaagaaaactaccttaatactacaccagatagaattcgtcaagaaccaccgaaaatgtcacatttgaagcatttagaattaatatctagtgctgctaactccttttccgactctgatcttgttgattcaatgattcatggtcctcaacaacactggtcacttatgccaacccatgctcttatgtcttgcgtgcgacctgcttctttcgtggctggttccggttccaggcagattcgctttactaattggttgggtaataactcgaagacaaataaattatatcgtatgcttcgtgagatacaagtacacatgcgtttaaaagtatccgctaataaattggacttgcggcagcattatattccaatattgtatgagtctctgcctgtaaagctatcaacaggccattcagacgtcgttccagaaatcattgaattgatggatgaatattatctaaatcgtgaagattttgattcaataacggaattagttcttcctgcagatgcaggtgagaaactcatgaaaaccataccgactgctgcaaaatctgcattcacaagaaaatacaattcttcgagtcaccccatcgccttctttggaagtagtgatgttttacctatgaagggctctgctcagcgcgaagtgccggatgtcgaagatgcaattgaagccgaagatgagatgttagaagaagctagtgactcagaggctgctaatgaagaggacatagatttaagcaaagacaaatttatttcggtaccaaagaaacctaaaaaaaggactaaggcaaaggctgaagcgtcctcttctagctcaaccagtcgccgatccagaaaaaagacagcttaa

SEQ ID NO: 46258 - DNA, 991 bp, Schizosaccharomyces pombe
atgggccttgcaaagcaaaaggactcgcaagagtttgcccaacctgtttggcattacactttggctggtggcatttcatccgtaatttgtcggtatggctaagtggcagggaaatagtcaattaacgatttaaactagatttatgatagcaccatttgatgtgataaaaattcgtatgcaaattacccagtcttcgttgaggccggtctttaaagagactgttcagaaggaaggcgtacgagctttgtggagaggaaacgtggttgctgaactgctttacttagtatatggtgctgccgaatttgtggctttttcaaagttaaaacatttaacagagaatctcgctatgaatgaccatgcagtcaactttctgtgtggaacttcagcaggaatttttgctacactcacgtcctatccacttgatacaatgcgtacaaagtttgcttcttacgccaagacacctcatatgcttcctgctacgaaaaaaatttacgcagaagcaggcatcaaaggtttttttccaggactcaaattctccgtcatccaaatcggtccttacgcaggatgcttcttcatgttttatagagcatcagaggccgtcttgtcgcctctgggtcttgcgctcagctctaccttgagtggggtcatcgccggcgctggatcaaaagctatcatgtttccggtcgacaccgtagtaaaaactttacaaaccttcccctcaaactataaatcgtttaaagattgcttcctttccatctatcgtaactctggaatcaaaggactgtatagaggtttatcagtcagcatgcttaaagttgcgcctggaaggtacgaatgtttatggttatcgtgccatttttattattctattatctatttgttaaactctatgttttatttactgacattttattctcttagagcaattactatgcttatatacgaacaaactctacagggacttcgcacactgtcctctccggaagcttaa

SEQ ID NO: 46259 - DNA, 1650 bp, Schizosaccharomyces pombe
atgtcttttagcttagcttctactcttcctgcatggcaggccgttcaaacccattatgagtccgttggtaagcatctcgtcctcaaggaattgttcgccaaggattcatcccgttttgagaaattttcttttacttttaacggattaaaagaagaagatggacctatcttgttcgatttctccaagaacttgatcaccgaagagaccgttgagcttttggttaaattagccaaagaagccaatgttgagggtcttcgtgatgctttatttgctggtgagcacatcaactttaccgaagaccgtgccgtctttcaccccgctcttcgcaacgtttccgagaagcccatgaaagttaacggtcaagacgttatgcccggtgtcagaaaggttttgagacacatgaaggaattctccgatgccgttcgcagtggtgcctggaagggttacactggtaagcccatcaagtctatcgtcaacgtcggtatcggtggtagcgacttgggccccgttatggttaccgaggctttgaagccttatggtcaagaaaacttagagctccattttgtctccaatattgacggaacccatcttgctgaggctttgaagaagtgcgatcctgagactacccttttcttgatcgcctctaaaacttttactactgctgaaacttgcaccaacgccaagtctgctaaggattggtttttggcctctgccaaggatccttctcatgttgctaagcatttcgttgctttgtctaccaacgaaaaggaggttaccgcttttggcatcagtgctcaaaacatgtttgagtttagcgactgggtaggtggtcgttactccgtttggagcgccattggtttgagcgttgctctttatattggttatgaaaactttgaggctttcctcagcggtgcccacgccatggatgagtatttctgcagtactcctttagagaagaacattcctgctttggccgctttgatttccatttggtactctgacttctttggagctcagactcatttggttgctccctatgatcaatatttacaccgtttccctgcctacttacaacaattgagtatggagtctaacggtaaggccatcactcgttctggcgatatggttaactacacaactggcaaaatcctttggggtgagcctggtaccaactctcaacactcattcttccaattaatccatcaaggtaccaaattgattcccgccgatttcttgattcccattgaatctcacaaccctattgataacaacaagcatcatcgtatgttgttctcaaactttgccgctcaaaccgaggctttgatgcttggtaagactcctgctgaagttaaggctgagggtactcccgatgagattgttccccacaagacttttgttggtaaccgtcctagcaactctattattgctaagaagatcactcctgcttccttgggtgctctcattgctttctatgagtgggttaccttcaccgaaggtgctgtttggaacattaactcctttgaccaattcggtgttgagctcggcaagaagcttgctaagaatgtcttggctcagctcgagactaagggtgatgttgagaaccatgactctagtactaatggtttgatcaaccttttcaagaatggattt

SEQ ID NO: 46260 - DNA, 711 bp, Schizosaccharomyces pombe
cttcgttcttttccttctgttcagaggaccgcctggcagaggcttgttctgccttccactcgcaagttctctctgactccgactacattcgataagacgcctagtggaaggattcctcccgaccaaaaagcagcaaatataatcagctctgttccttctacctctttattaacaaaatctggtgtcttgactgttaccgctgctgctcttgctactgccatatctaaaggcatttatgtcgttaacgatgagtcaattgttgtggcttcttttcttggacttgtaggagtctttggtactttaggtcgtaaagcttataatgaatggtctgacaagacaatcgctaaaattggtggaattatgcaagctgctcgaaatgatcatactagtgctatccgcgaacgtatagatcaggttgctagccttcaggaagtagagtctgtaactcaggctctattccacacttcgaaagaaactgcccgtatggaggctgagatctttgagctcgaacagcgagttgctttagctaaagaagctaaatcagtgttggatagctgggttcatcacgaagccaacgttcgcgctgaacaacaggaacgtctcgttgaagatgtcttggctcgtgtcaacagcaaagtttctacccaaaagttccaacaggatgctctcaatgaaagtctcggtgaaatcgaaaaggtcttagctagtgcc

SEQ ID NO: 46261 - DNA, 1617 bp, Schizosaccharomyces pombe
atggaatcgagatatttatcagatagaagaagccgttttaaaagcaaaggtgttttcaaagctgatgaacttcgtcggcaacgtgaagaacagcaaattgaaatccgcaaacaaaaacgtgaggaaagtttgaataaacgaaggaatttaaacgctgttttacaaaatgacattgatgtggaagaggaggctgatcagtctcaggttcaaatggagcaacaaatgaaagatgaatttcctaaattgacagctgatgtgatgtcagacgacattgagctacaattaggtgccgtcacgaaattcaggaaatatctttctaaggagacgcatccccctattgatcaggtaattgcttgtggtgttgttgaccggttcgtacaatttttagaaagtgaacatcacttgcttcaatttgaagcggcttgggccttaacaaatatcgctagtggtaccacagatcaaacccgtattgttgttgattccggcgctgttcctcgttttattcaattactttcttcacctgaaaaagatgtccgtgagcaggttgtatgggccctcggtaacatagctggcgattcttctgcctgccgtgactatgtactcggtaacggagttttacagcctttacttaatattcttcagagtagcgcttctgatgtttctatgctccgtaacgctacatggacactttctaacttgtgtagaggcaaaaatccaccacctaactggtcaactatttctgtagccgttccaatccttgctaagctcctttattctgaagacgttgagattattgttgacgcgtgctgggccatctcctatctttctgatggacctaacgaaaaaattggcgccattttagacgttggatgtgcgcccaggcttgttgaacttttgagctctcccagcgttaatattcaaactcctgcccttcgctctgtggggaatatagtaacaggtactgacgcgcaaacacagatcataatcgattgcggtgctctcaatgcattccctagtcttctcagtcatcaaaaagagaacattcgtaaggaagcttgttggactattagcaatattactgctggcaatacccaacaaatccaagcaattattgaaagtaatcttatacctccattggtccatttactctcatatgccgactacaaaacaaaaaaagaagcctgttgggctatttctaatgctacttctggcggtctcggtcagcctgaccaaattcgttaccttgtgtcacaaggcgttattaagccactttgcgatatgttgaacggatccgataataaaattattcaagttgctctcgatgccattgaaaacatacttaaagttggtgagatggacagaactatggatcttgaaaacattaatcaatacgctgtctacgttgaggaagctggcggtatggatatgatccatgatttgcaatcctccggaaataacgatatttatttgaaagcgtatagcatcattgaaaagtatttcagtgacgaggacgcagttgaagatttggcacctgaaaccgaaaatggcgccttcacatttggcaatggccctcaagctcaaggagaatttaaatttgattctcaagatatggctatg

SEQ ID NO: 46262 - DNA, 1974 bp, Schizosaccharomyces pombe
atggaaagagggactttacaacctcgaaagaaggctccaaatggctatggaataacccctattgttgctcataaaactggtgaacctgtacgttatgaagtagaagatgatttgagaaaactgaagcccagcaggacagctccaaagcctccagctataaatactaatcttgctgaagacaccttttccggtttccctttatctcaatcccgtacaactgtatctagggtttcacttggttctcgtcagcatagtagcagttccattagaaaacttcagactaatgtttctgatgtgcgttcatatgatgaaaggaaccaaaagaagtctgcgtttgaaaactttgtctcgagcatgagttcgttcttaactgggggtggtagcagtcctacaagttcctatgggtcaggctctgccagccctcgcaaatcgactgtcatctcttctccatttgatccgaagcatgtcactcacgttggttttaattatgatactggggaatttactggaatgcctactgaatggcaggcactactaaaagtcagtggcattacaaagtcggaacaagtacaacatccacaggccgttttggacgctatggctttttattcccaatccaagaaatatcttgaggagggagcaaagccaccctttccccgtgaaagtactgagaagcctttactctccgtttcagcgttgtctagtagttctcatcttcaacccacctctgctacaagctcatcttctcgtttgtatccttctcgacctgctcccacgcctcctgcaagttcttcatcgtctcctttattatcatcacaaacagttaaaactactacctctaatgcttctcgacaaccttctccattagtttccagcaagtcaaccgataatataatccgaagtcattcccctgttttgttaacgcctcaaaccttaagtacatctgaaacgaaacatatccgtccgaataactcgacaccatatcaacggagagccgagactagcaccaaaccgaaagctgttgcgactcctcaaaaagtggaagcaccaagtgcccctcgacttcaaaagcgtgcacctcgacaacaatccaatgattctgctgtattggcaaagttacagtctatatgcaatcccaaaaatccaacacttttatatcgaaattttgttaaaattggtcaaggtgcttctggtgatgtgtattctgctcgccaagtcggcactaatctttctgttgccatcaagaaaatgaacattaatcaacagccaaaaaaggaatttattgtcaatgaaatactcgtgatgaagtcacatcatcacaaaaacattgtcaattttattgacactttcttctataaatcagagttgtggatggtaatggaatacatgcgcggtggcagtcttactgaagtggttaccaataacactctttcagaaggtcagatagctgcaatatgtaaggaaacgttggaaggcttacagcatctccatgaaaatggcattgttcaccgtgacataaaatcagacaatatccttctctcacttcaaggagatattaaacttaccgattttgggttttgtgctcagatcgacagtaacatgacgaaacgaacgacgatggttggtactccatattggatggctccagaagtcgttactagaaaggaatatggtttcaaagttgatgtctggagtcttggtattatggctatagagatggtagagggagagcccccgtatttaaacgaaaatcctttacgtgctctatatttaattgctactattggtactccaaagattagtcggccagaattgttaagttctgttttccatgattttctttctaaatctttaactgttaatcctaagcaacgccctagctccggtgagcttttaaggcatccgtttcttaagcaagccgttccagtttcatcccttatccctttgataaaatccatacatcattctggtaaa

SEQ ID NO: 46263 - DNA, 1884 bp, Schizosaccharomyces pombe
atgagttcatcttcctcaaaacccgtgaatactgggttggttacacctcgccgctattctacaatgactggcatacggactggtccatctcagagtggaacagggagtattccatattccccaacgtcaccattgtcccgaaatttttcgaactattccatacctatgctacgaagcaatagcactcaaacaaatgtaaatgggcctacagcatttgatttgggagttacagagaaattgatgtctcctggaactttagatagatacacgcgtcctgccttgtatccgtcgaaggacttggattatttaaaaaatgagtatgttaattatgaatctacaacaagtcaacaaaccaattctaaaggtttaaaagagagcaactttgttggttcaggaattatcacaagtatacgtattcgacctattggtaaaaaccaaggtgtatggtcacatggcaagttaagcaatgacccatatggtcgtgaatacattcgccagcaaacaagtacaagctcgtccacaattcagcaagaatatctttttaataatgtttttgggatggaatctaaaaattacgatatatacaaacgttctgttaagtcggttgtccgtaatgttttttccggatataatggaatagtgtttgcttatggaatgaccggcacaggaaaaacatattctatgcaaggtacggaaaacgaacctggtattattccacttgccatgaatgatttatttgaaatggttgaaaacaattctgatgacgatacctttcaaatccgtatatcctatttagaaatttataatgagagaatacgagacttaatcggaaactcggacgaagagccaagaatacgcgaaaatgcatctggagaagtcaatgttacaccattaactcgagttctcgtcactagccccgaagaggttagtcaggttattgaacagtgcaatgcaatccgaaaaacagcagcaaccgatttcaatacgtatagttctcgttcgcatgcaattcttcaggtttttcttattcgaaataatcctactgctcacacttcacaaatttcgagtctcagcttggtggatctcgctggaagtgaaagagcttcagctcaccatgaaagacgcaaagaaggagcatttatcaacaaatctcttttaacattaggaactgttatttctaggttgtcagcagctgcaaatccttcacttacctcaaattcaggacatataccgtatcgtgagtctaagttaactcgtctgttgcagcaatctttatccggccaatcacaaatatcacttttagcaacgataagcatagaatccaaccatacgatggagactactaacacgcttaaatttgcatctagagctcaaaatttgcctcaagatattcgccaagcggaagctgtgactaatgttcaagctgaattagcatctttacactctgcccttgaaaagaatgcccaagaagttgaatattatgcttctttggtgaagcaattgacttcggacttagaggaacgagatacatacattgccatgttagaggcagagcgttcgcaaggaactgctataagtagagctcgtttacgaatggaggaattgctttctgaccataatttcgaaattgcagatctaagagatgaattacaagataaagaacaaattatttatgctcttcgatatgctcagaagcaacgggatattgccgatttcaatcaatcgcttgctaaattccctcacaaaatcttaaagaaaaatgttactaggggaagcagaagctcctctgatcagttcagtaatgaaactaaaactgaaattttgccagacgatcaacagcaatcgaaaaaggattctgtgactcaggaaacgcaacttctttct

SEQ ID NO: 46264 - DNA, 2715 bp, Schizosaccharomyces pombe
atgaccaaccaaattccgtctgcatcttcagcggcagattttggaagctcaaaatctacttctgttgatgcagttccaaatatggataaatcttcgtccgttcgccgaaaaaatattgatagcaatggtttgcaacaaactaatcaaatcgagcaagcagaaagtagtttgaatgccgaagctgatcactctgaacctgaacgttatggttgtacaccgtcaggaaaagttttcttattaccaaaagaacaagaaaatcgacgaagtatattagaaactgtagatcctcggttttctaagacaccctgggattggattgtcatttcatctatccttgctcaagtacttctgttttttatgacaaccggtgcagttcgtcgttactctatgatgctttgtttctttttttggagaatcagttatgatgctggtataggttttttgctacatatgcaatcgaatcatagaaaagttgtcacttggatttctgactttggtttttttgataaagaaaatcacccgaagctttatgatttaacaaaaaagcaacttatatctaagatggactctagttataactatgatacttcccctcttgagtttaattcctggttggtattccgtcacttcgtcgatttaattctcatgtgcgatttctgctcatacattttgatgggattggcatggacttgttggccgaaggttaatatcattcttcaatttttgaggatttttggaggtatcgcgcttattgtattcaactattgggtaaaaatggatgctcatagagttgttcgcgactacgcttggtattggggtgattttttctttttgcttcgctcttctttggttttcaacggagtttttgagctcgctcctcatcccatgtattctgtaggttatgctggttattatggtatgagtcttttaactggtagttatgcagttctttttgctagcatcctcgcacatgctgctcaatttggtttcttactgtttgttgaaaacccccatattgagagaacatatggtacagacatcaatcatgctagattgtctccacggggtgaagacaatgaatttgaattacctccagaacatgatttagttgggtttgtcaactttgatttcactaggatttccgatgtcgctttgcttatcatagccttgtatagtattttcataattttgttatcgtcgaattctcattatagtcagttttgggctatatttcaagcttttgtttggcgtttcttgcattccataattcatgcttttattcttttttaccaatcaaaaagcaaagcatggaccaaacattttatcagaaatggtgaatctgctgcttatgcatggtcccaatggaaggggttatataatcttacattgaacatgtcttatatttcctttgttatggctgcttggaaattgtatcatttaccttcaaactggacgtatggacttgtgtctctaagacatgccttaggttttggactgattgctttacatatttatacatctgtctcaatatatgaagacctagggcaatatggttggttttacggtgacttctttttacctagccgatcacccaagcttgtttatcaaggaatttatcgatatgttaacaatcctgagcgattccttggttgttcggcttattggggtcttgcattgatcagcagttctgcttggatatttttaatcgcaattctagcacaactttctaatctagcaattatccgtttagtcgaacagccacatatgcagaaagtttatggaaacactcttcgtaaagaagccggtatttctaaattgattaaacaggctacttctgaaaaaggaaatattcttccaaaaacagtcgagacgcatatgaaagctttaacaacatccgttgataaggttctggatcaaactgcagaagctcttgaggagtttgtaaatactgcaccaccgaaagtacaggaattattgaaaggaactgaaagcaatcttcgtaaaaatgcacaactcgccattctcaaactgtttgctcctcaattaagtagctctactcattttgattataagttagaaattaaaggaattgacaacaaccaagtactattggggcatcccattacggtatgctggacagcttctccgaatcatgaaattaacgattggattggactttataaattatctgacaatgcgagcgatctttatactcaaacttcgagtgaaggtcggtggtctgcgattgatgccaatggctacacatctcattgttccagtataaagtcactttcgaatgacaaaaattctggagaagttgagttttccggagatctgttattttgggaaaccggaacgtttgaattccgttatcattatgggggaaagcatttagttatggcaaaaacagaacctttcgtgatcactgcaacttcaatgaatactaccgacgtggatgaagtttcagcatatttacttaaatccattaaattttgtgaccctaatataacaccgcatgatggtgatgcgtccttgtgcgatatttctgaaggttctgctagaaaactaacttctatcatcaagtatagcttcggcatagatttaagttatcgcgttgttcaagtagatggcagctgtagcgctttatctcgaagaatcgtcaattccttaaaaattttacaatcttttgatggtcccagcggtgcaaaagatgat

SEQ ID NO: 46265 - DNA, 1218 bp, Schizosaccharomyces pombe
atgactgatttagatttggattggcaacttgaggaactggagaacggaaggttaattccagaatcaaatggtatgtataatagtatttatagaataacttttatctccgtcgatataacaacgatcattcatattggttgttctttgccataattataagaatggggtctaacgttttgtggtagttgttgaactttgtcagcgtgtaagagatattttaattgaggaatctaacatacaatggatctcatctcctgtaaccatttgtggtgatatccatggccaattgcatgatttactggagctttttcgaattggtgggtcatgtccaggtacaaaatatttatttctaggggattttgttgatagagggttttactctgtagaaacatttctcctgttattgactttaaaatgtaaatatccgaaagagatgacccttatccggggaaatcatgaatcacgacaaataacacaagtttatggattttatgacgaatgtgtaaggaaatatggttctgccaatgtatggcgatattgttgtgaaatatttgattatctttcgcttggtgctttggtggatggaaaggttttttgtgtgcacggtggactttcaccaagcatcagcagtatcgatcaggtatgttattaattccgaaaatttgaactaaacttttaacgctttttatgaagattcgactgttggatcgaaaacaagaagttccgcatgaaggagcaatgtgtgatctactttggtcagatccagaagatattagtggatggggtttatctcccagaggtgctggatttttgtttggtgccgacgtttctgaagtttttaatcgcgctaatgacctttcattcattgctcgtgctcatcaattggttatggagggttacaaaatccatttttccgataaagataaacagtatcccaaatttacaaatgaagaggactctgagctggattcagattctgcctcacctgttgatgattctccggcacctggagacataataaccattccagaaaaggataaaggaagcgtggttactgtttggagtgcacccaattactgttacagatgtggaaatgttgcttctatattacaacttgatgaaaaccaaacgcaatcctttaagatttttggtactgcctctcaagaaagatctggcattccaacaaaacgacccattgccgactactttttatgatta

SEQ ID NO: 46266 - DNA, 1613 bp, Schizosaccharomyces pombe
caataggttcatattcaagctggtcaatgcggaaaccaagtcggtgcggccttttggtaagcaaaatctactttgttataacgtttctctcaactaacgcttggaaggtctaccattgctgatgagcatggtttggattcagctggaatgtaggtctattttgcttgtttttttactgacttttacgtagatatcatggaacttctgaggcacaacacgagcgattgaacgtttattttaacgaggtaggtttttttgctttcttacaagtgttcggttgcttaaaactttttgaaaaaatttttttttgtttatttagtactgacgactgtaggccgctggtggaaagtatgttccccgcgcagtccttgttgatttagagcccggtactatggatgccgtgaagtcaggaaagtttggaaatcttttccgcccggacaatattatttatggacaatctggtgccggaaatatttgggctaaaggccattacactgaaggtgctgaattggccgatgctgttttggacgttgttcgccgtgaagctgaagcatgtgatgctttacaaggtttccaattaactcactctttgggtggtggtactggatctggtatgggtactcttttactttcgaagattcgcgaggaatatccggaccgtatgatggctaccttctccgttgctcctgctcctaaaagctctgataccgttgtggaaccttacaatgctactctttctatgcatcaattggtagagaactctgacgaaacattttgcattgataatgaggctctttcttcaattttcgctaacacgttgaaaatcaagagtccttcatacgatgacttgaaccatcttgtctctgctgtaatggctggtgtaaccacatctttccgattccctggtgaattgaactctgacttgcgtaaattagctgttaatatggttcccttccctcgtttacactttttcatggtaggatttgctcctcttgccgccatcggttcaagctcatttcaagctgtttctgtgcccgagcttactcaacaaatgtttgatgctaataatatgatggtcgccgctgatcctcgccatggccgttacttaacagttgccgctcttttccgtggtaaagtctcaatgaaagaagtcgacgagcaaattcgctctgttcaaactaagaattcagcatatttcgttgagtggattcccgataatggtatgtttacttggtttaaaacgtcgtttgtatatttagtttattttttctacttgtttatgctcatctgctaacctcgaaatagtcctcaaagctgtttgttccgttcctcctaaggatctcaagatgtctgcaacttttattggtaacagtacttctatccaagaaattttccgtcgtttgggtgatcagttttctgcaatgtttagaagaaaagcctttttgcattggtatactggtgaaggcatggacgaaatggagtttactgaggctgaatctaatatgaatgacttggttagcgaatatcaacaataccaggaggctggtatcgatgagggtgatgaagattatgaaattgaagaagagaaggagcctctcgagtattaaaccctt

SEQ ID NO: 46267 - DNA, 3077 bp, Schizosaccharomyces pombe
atgagcactgtttcaggattgaagaggcctcaaagctccgagaagaatcacagagatagagtatttgttcgtgcaaccagggggaaggttcaaaaagttgttcgtgagcaatatttacgaaatgatataccctgtcaaagtcgggcttgccctctttgccgttctaaacttccaaaggactcgaggggaaatggtaagtattaaaggaatcccacatgagtaatttgcattggtctggaattagttggtataattttctgtgaagttaatttctgagagctattgaaactaattcatttactattcaatttcatttttttttaatgtgaagcaaaatttaattaactcttacgatagtgttagagcctattttatcagagaagcccatgttcttggagaaatttgggcatcattatttaatccctgattccaatatattttaccattgtattgatgccttagaacatccaaataattttttcgatgtcattattctgcaaacggttttttcagaaatttcttcaaaatctattcctctatacaatagaatgaaacgcctttgccaagagaaaactaaaagatttaccccttttagtaatgaattttttgttgatacgttcgttgaaagattggatgatgaatctgctaatgaccgtaatgatcgtgcaattcgcaacgcggctagttggtttgccagtcatttggccagcttaggtattaagattgttttattaaccgatgatcgcgaaaatgctcgcttggctgctgaacaaggtattcaagtctctacattgaaagactacgttcagtacctgcccgactctgaaattttactggatatggtgtcggccattgcggacgccattgcttctaaagagcaggtagagtctggaacaaaaaacgtatatgaactacattggtctatgtctaggctgttagcttgtataaaaaatggggaagtgcataaaggacttatcaatattagtacttataattatttagaaggttctgttgttgttcctggttacaacaagcccgtgctagtttcaggaagagaaaatttaaatcgtgctgtgcaaggtgatatcgtttgcattcaaatattacctcaagatcaatggaaaacggaagctgaagagatagctgatgatgatgaagacgttgttgtgagtactgcagcagaacccgattcggccagaataaatgacttggaactgattacgaaaagaaatgctcatccaaccgctaaggtggttggtattttaaaaaggaattggcgcccatacgttggccatgttgataatgctactattgcccagtcaaaaggcggttctcagcaaacagttttgctaacacctatggataggcgagtacctaagattcgatttcgaacaaggcaagcgcctagacttgtaggtcgtcgtattgtagtagctatagacttatgggatgcttctagtcgttatccagaaggtcattttgttcgagatcttggagaaatggaaaccaaggaagctgaaactgaagctcttcttcttgaatatgatgttcagcaccgtccctttcccaaggctgttcttgattgccttcccgaggaaggtcataattggaaggttcctgctgataaaacacatccactttggaaaaataggaaagattttagagataaattaatctgtagtattgatcctcctggttgtcaggatattgatgatgcattgcacgcgtgtgtccttcctaatggtaattacgaagttggagttcatatcgccgatgttactcactttgtaaagccaaatacctcaatggatagcgaggcagcgtcccgtggaacgacagtttatctggtagacaagcgtatagatatgttgcctatgttgcttggcacagatttgtgctctctacgaccatacgttgaacgttttgccttttcatgcatttgggaaatggatgagaacgccaatataattaaggttcattttaccaaatctgtaatagcttctaaagaagcatttagttacgcagatgcacaagctcgaattgatgatcaaaaaatgcaagatccgttaactcaaggaatgcgtgttttgttaaagctttcaaaaatactgaaacaaaaaagaatggatgaaggcgctttgaatctggccagccccgaagttcgtattcagactgataacgaaacttcagatcccatggatgttgaaattaagcagcttttggaaaccaattctttggttgaagaatttatgttgctggctaatatatctgtcgcacaaaaaatatacgatgcatttccgcaaactgcggtgcttcgtcgacatgctgctccaccattaacaaactttgattcgcttcaagatattttacgagtatgtaaaggcatgcacctaaaatgtgatacatcaaaatctttagctaaatctttggacgaatgcgtggatcccaaagagccatattttaatactttattacgaattctcaccacaagatgcatgctttcagcagaatatttttgctctggtacatttgcaccacccgactttcggcactatggcttagcttctccaatctatactcattttacatccccgattcgacgatacgctgatgtattggctcatcgccagctagcagccgcaattgattatgaaacgataaatcccagtttgtctgacaaatcacgcttaatcgaaatttgtaacggtattaactatcggcatcgcatggctcaaatggctggacgagccagtatagaatattatgttggacaagccttgaagggtggtgttgctgaagaagacgcttatgttattaaagtgtttaaaaacggatttgttgtatttatcgctcgttttggtttagaaggaattgtatatacaaaaagcttatcctcggttctcgaacccaatgttgagtatgtagaggacgaatacaagctaaatattgaaattcgtgatcaacctaaaccgcaaaccgtgcaaatacaaatgtttcagcaagtgcgtgttcgtgtaacgacggtacgtgatgagcactctggaaaacaaaaagtccagattactttggtgtattaa

SEQ ID NO: 46268 - DNA, 1404 bp, Schizosaccharomyces pombe
atgtctgcttctttaacagccgagcaaaaggaccaaaaaagttctgttaagcgacctttaaacagttttatgctttatcgtcgagatcgccaagctgaaattcctacttctaatcaccaaagtatctcacgtatcattggtcagctgtggagaaatgaaagtgcccaagtcaagaagtattattctgatttatccgccctcgaaaggcagaaacatatgctggaaaatcccgaatacaagtacacccctaaaaagcggtctactgttcgtagacgccataaaaaggtatcaccttcttccggatcttttgtggcctcggattacgttgtactgcagcaaattgcacaatcttctaagactctaaaacagaccgaacccgaaaagcctgttaatgaggaggaaactttagcagctttattagctcccgctctttcatatccaaagtcaggtaaatcgaatcttattgaaaccagtgaattgtcttgtctttcgtcttccccaatgattcgaagtcatacaattccttccttatccttcaccgatcaagtttctacaactatttctacattggataaatccgagcaagctcctagttctttgggcatctattatagatcacccagtagcggtagtccaatcgggcgaacaaaatctgtgtgtttagctaataaagcccgaatagtaccgaaaagatcaatgtcatctgatggctgtgttgacaaatcttatcaaatgtcaaaaacaccgagcttggaggcgaacttgcctcaaaattcaagcaattgctctgctcgaagagttccaaaatttgattctaaaggaaccgtgagtgagcaaagtaactctgatagtccagagctgtcagccgataaagtgttgtctcattgtagtcctattgatgctcgaccctcaactccctcttgccccaatgccagtatatcacctaaaaccccgaataccggtgatcattatggttttgatggagctgagtacctaggaactcctctcagtgtaggcagcactactgcgtatttatacggccaagagaccgaacttttatctacgccttattgccatacttcttacccagcaatgagtcgattgaacagcagttctggctatacatgcgtctcttcgtctagtgttaccaattctggacatactgaaaataatacctggagaagcgacgaacaaagtaaaggctttgttgacattaatagtttttctcaaagtttgttctcaaatggcaattatgagttcgccgctcattctcaagaattggatgatttattttcacaaattacggattttacatcaactgatcctattgcttcctcactcaaagatgctaactcattgggaccttctcttttagaaccttggttgcccaattctaatttattt

SEQ ID NO: 46269 - DNA, 421 bp, Schizosaccharomyces pombe
atgtcttcacaatcatatcgagaacggacacttgtttctgtaattggagacgatgataccgttactgggatgcttttagctggaactggtcaggtaaatgaaaacggtgacaaaaacttttttataattactcagagtaagattatctgttaaaaaatggaatcgtgttttcgctaacttgctgttttatgtagagactacagatgagcagattgctgaagcttttgatgattatactacgaaaaggaaggatattgcgattgtattgattaaccagtttgccgctgaaagaatacgtgatcgtattgaaaaccatgtgcaggcattccctgctgtattggaaattcctagcaaagacgatccttatgatcctgaaaaggacagtatcctccgtcgtgttagaaagatcattggagaatag

SEQ ID NO: 46270 - DNA, 1155 bp, Schizosaccharomyces pombe
atgtctggatatggtcaacaaggtgtttctgctgccaacatcgacagcatccgccccaagaaacgtttgtcaattggtgtagttggctccggtaactggggtactgccattgccaagatttgcggtgaaaatgcccgtgcccacggtcaccatttcagaagtaaggtccgcatgtgggtctttgaggaggagattgagtacaagggtgagaagagaaagctcaccgaagtattcaacgaagctcacgagaatgtcaaatacttacccggcatcgaatgccctcccaacgttattgccgtccccgatgttcgtgaggtcgctagacgtgccgacatccttgtctttgtcgttcctcatcaatttattgaacgcgtttgcgaccaaatggtcggtctcattcgccctggtgccgttggtatttcctgtatcaagggtgttgctgtcagcaaggaaggcgtccgcctttactctgaggttatcagcgagaaactcggtatttactgtggtgttctttctggtgctaacgttgcaaacgaagttgcccgtgagcaattctgtgagactactattggtttcaaccctcctaatgaagttgatatccctcgcgagcaaatcgccgccgtctttgatcgcccttacttctcagttgtctccgttgacgacgttgccggtgtcgccttgggtggtgctttgaagaacgtagttgccatggccgttggtttcgctgatggtttggaatggggcggtaataccaaggccgctattatgcgtcgtggtttgttggagatgcaaaagtttgctactaccttcttcgactctgatcctcgtaccatggttgagcaatcttgcggtatcgctgacttggtcacttcttgtttgggtggccgtaacaatcgttgtgctgaagcatttgtcaagactggtaaatctttagagacgcttgaaaaagagctcttaggtggtcaacttcttcaaggagctgccacttccaaggatgttcatgaattccttctcaccaaggatatggtcaaggatttccccttgttcactgccgtttataacatttcctatgaagacatggatcccaaggatttgatcatcgtccttcaaccccttaaggaggactctgagaacgagggcggtactgaaaccgag

SEQ ID NO: 46271 - DNA, 3279 bp, Schizosaccharomyces pombe
agtaataccccagatgccaatgcttatatccgctctggtcatattaaggccgccgagcatgagaaagttaagaaagtcgttgtagtcggctctggtggtttatccattggccaagccggtgaattcgattattcgggcgctcaagctattaaagctttgcgcgaaagctctgtccatactattcttatcaatcctaacattgctactatccaatcctctcatagcttagctgatgagatctacttcttgcctgtcactgctgaataccttacccacctcattgaacgtgaaaaccctgatggcattctccttacattcggtggtcaaactgcccttaatgtaggtatccaattggacgacatgggtgtctttgcccgtaatcatgtcaaggtgttgggtactccaatttccactcttaaaacttccgaagatcgtgatttatttgccaaggctttgaacgagatcaatattcctattgctgaatcagttgcagtttctaccgtcgatgaagctcttcaggctgccgaaaaggttagttaccctgttatcatccgttcagcgtattcccttggaggtcttggctctggttttgcaaacaataaggaggaattgcaatcgatggctgctaagtcattgtctttaaccccccaaattttggttgaaaaatcattgaaaggctggaaagaggttgaatacgaagttgttcgtgatgctgctaacaattgcattaccgtctgtaacatggaaaactttgatcctcttggtatccatactggtgattccatcgtcgttgccccctctcaaaccctttctgatgaagaatatcatatgctccgtactgctgccattaagattatccgtcacttaggtgttgtcggtgagtgtaacgtgcaatatgcgttgagtcccaacagtttggaatatcgtgttatcgaggtaaatgctcgtctttctcgttcttctgctttggcctctaaggccaccggttacccattggcatacaccgctgcaaaaattgctttaggtcacactcttcctgaacttcccaatgctgttactaaaactaccactgctaactttgaaccctctttggattatgttgttactaagattccccgttgggatttgagcaagttccaatacgtcaatcgcgaaattggatcttccatgaaaagtgtcggtgaagttatggccgttggtcgtacttttgaggaatctcttcaaaaggcattgcgtcaagtcgatccctcctttttgggttttatggccatgcccttcaaggatttagacaatgccctcagtgtacccaccgatcgtcgcttctttgctgttgttgaggcaatgcttaaccaaggctattctattgataaaattcatgatttgaccaagattgacaaatggttcttgagcaaactcgcgaatatggctaaggtttacaaagagttggaagaaattggttctttgtatggacttaataaagaaatcatgttgcgtgctaaaaagactggtttctctgatcttcaaatctccaagcttgtcggagcttctgaattagacgttcgcgctcgtagaaaacgtcttgatgttcatccctgggttaagaagatcgataccctcgcagcagaattcccggcacatacgaactacttgtacactagctacaacgcatcctctcatgacatagattttaatgaacatggaactatggttcttggatctggtgtctaccgtattggttcaagtgttgagtttgattggtgcggtgtctcttgtgctcgtactcttagaaaacttggtcatagcaccattatggttaattataatcctgaaactgtttctactgactttgacgagtgtgagcgtttgtatttcgaagaattgtcctatgaaagagttatggatatttacgagatggaaaccgcatctggcattgtagtaagtgttggtggtcaacttcctcaaaatatcgccttgaagttacaagagactggtgctaaggtattgggtactgatcctttgatgattgattcagctgaagaccgtcataaattttctcagattttagacaaaattggtgttgaccaacctgcttggaaagagcttacgtctgtagccgaggcaagcaaatttgcaaatgcagttggttatcctgttttagtacgtccttcctatgttttatctggtgctgccatgagtgttattcgcgatgaatctagtctaaaggataagttagaaaatgcttcagctgtttctcctgatcatccagttgtcattaccaagtttatcgagggtgctcgggaactcgatgttgatgctgttgcttccaagggtaaacttttagttcatgccgtttcggaacatgttgaaaacgcaggtgttcactctggtgatgctactatcgcccttcctccttactcacttagcgaagatattttaagccgatgtaaagaaatagccgagaaagtatgcaaagctttccaaattactggtccttacaacatgcaaattatcttggcccaaaaccctgataaacctgatactcctgacttgaaggttattgaatgtaaccttcgtgcttctcgttcattcccttttgtttccaagactcttggcgttaacttcattgacgttgctactcgttctattattgatcaagaagtaccagctgctcgtgatttgatggctgtgcatcgtgattatgtttgcgttaaagttccccagttctcctggacacgtttggccggtgctgacccttaccttggtgttgaaatgagctccactggtgaagttgcttgtttcggtaaggatgtaaaggaagcctattgggctgcacttcagtctactcaaaactttaagattcctcttccaggtcaaggtatacttttaggtggtgatcgacctgaacttgctggtattgctgctgacctttccaagcttggatataaactttacgttgctaataaagatgctgctaaattattacagcctacctctgctgaagtcgttgagttccctgttaaggacaagcgtgctttacgtgctatatttgaaaaatacaatattcgctcggttttcaacttggcttctgctcgcggcaagaacgttttggatcaagactatgtgatgcgcagaaatgctgttgacttcaacgtcactcttattaatgatgttaactgcgccaaattgtttgttgagtccttgaaggagaagctcccttccgttttatctgagaagaaggaaatgccatcagaagtcaagagatggagtgaatggatcgga

SEQ ID NO: 46272 - DNA, 1173 bp, Schizosaccharomyces pombe
gaggtttacattgtgtctgctgttcgcacacccatgggcagctttggcggcagtttcgcttctcttcctgccaccaaattaggctctattgccatcaagggcgctcttgaaagggtcaatattaagccttctgatgttgatgaggtgtttatgggtaatgtcgtctcagccaatcttggccaaaaccctgctcgtcaatgcgccttaggtgctggactccctcgttccatcgtttgtactactgttaacaaggtttgtgcctctggtatgaaggcaacaattctcggtgctcaaactatcatgactggaaatgctgagattgtcgttgctggtggtaccgagagcatgtcaaatgctccttactatgccccaaagaaccgttttggtgccaaatacggtaacgttgagttggttgacggtctcttacgtgatggtttatctgatgcatatgatggacttcccatgggtaatgctgccgagctttgcgctgaggaacacagcattgaccgtgccagtcaagacgcctttgccatttcttcttacaaacgtgctcaaaacgctcaagctacaaaggcatttgaacaagaaatcgtccccgtcgaggtccctgttggtcgtggtaagcccaacaagcttgttactgaggacgaggagcccaagaaccttaacgaagacaaactcaaatccgtacgtgctgtcttcaagagtaacggtaccgtcactgctgctaatgcttctaccttgaacgatggtgctagcgctcttgttctcatgtcggctgccaaagtgaaagaacttggtcttaagcctcttgctaaaattattggttggggtgaagccgctcaagatcctgagcgttttaccacttctccttcccttgctattcccaaagctctcaagcatgcaggtattgaagcttcccaagttgactattacgagatcaatgaagcctttagtgttgttgctgttgccaacaccaaaattcttggattagatcccgagcgtgttaacattaacggaggtggtgttgccatgggtcatcccttgggtagcagtggttctcgtatcatttgtactttggcatatattcttgctcagaaggatgccaagattggtgtagctgctgtttgcaatggtggtggtggtgcttcatccattgttatcgaaagagtt

SEQ ID NO: 46273 - DNA, 918 bp, Schizosaccharomyces pombe
atgagtaaaactgcagcttcttccgccgtagatgcttcacaagctgggactgtcaaggttggcgacatggttgtcaatagaatgggattcggagcaatgagagttaccggtgatggtatatgggatgaacccaaagacaaagaggcttgcatcgcaactttaaaacgtttgcctgaactcaatattaactttattgataccgccgattcttacggccctgaggtcagcgagaatcttttacgagaagctttatacccttacaaaggacttataattgctaccaagggtggccttgttcgtacaggtccaaatgaatggcatccttgtggagcacccaaatttttacgtcaagaagtacttatgagcatgcgtcgacttggagttaagcaaattgacctctggcaactacatcgcatcgatcccaaggttcctcgcaaagaccaattttctgaaattgcagctatgaagaaagaaggattgattcgccatgttggattgagtgaggttacagtagacgatatcaaagaagctgaacagtattttccggtagttagtgttcagaacttattcaaccttgtcaatcgtaagaatgagaaagtgttagaatattgtgaacagaagggaattgcgtttattccttggtatcccttagcttcaggagcattagccaaacccggaaccatcctggacgctgtttcaaaagaccttgatcgttccactagtcaaatagctttgagttgggttttacaacgcagtccggttatgctacctattcctggtactagcaaagtagatcatctcgaagaaaacgtcaaggccgctggaatccaattatcttctgaggtgtttgccaaattggatgaggagggtaaaagcgaagatgctaagcgtcaagaagaggagaagaaaaagtcttct

SEQ ID NO: 46274 - DNA, 1216 bp, Schizosaccharomyces pombe
atgttcactaacaacttctctcaaaaacagatccttggagtcagtaaagatgcatctgaatctgagattcgcaaagcatatagacaattgacgaaacaatggcaccctgacaaaaatccgtaagttaaacaagcatgcaaacaaatgaaagcctaaagctaataaatgttctagaggtaatgaagaagcacaggagaagtttattgaaattaacaaggcccatgaagtcctttctgatcctgagcaacgtaagatttatgatgcttatggagaagaaggattaaacggtcaacctggtggtcctggtggtggtccaggtgaaggattcccaggtggaggtttcggatttgatccatttggtgatatattcgataacatatttggcggacgtagacgtcaaaatgccgttcgcagaggacctagcatggagcaaatagttcaaattcatctttcatctttttacaccggaggcagttttaccttggaaattccggtgaagagaacttgcagtgtttgtagtggtcagggctttaatcctaaatactccgctgataaagctatcgaaagttgccctgtttgcggtggttcagggttcagagtcattgaacacatgatcgctccaggttttcgtcagcaaatgcgtatgccatgtaacgcttgtaatggaaatggacgtacgatcaagcataaatgccctcgctgcaaaggtgagcgtgttgctgaagttgttgaaagctttgacattaaagtaccagctggtgctcctgaaggttaccgtatcggttttcgtggtaaagctgatgaaattcctggtatggaagctggagatatcatcgttatccttgaggctgctggtggtgattatggatggactagaaaagataatgatctatatagaaaggaaactatttcggttagggaagctttactcggaaattggaaacgtaaaatacaaaaactggatggatcctttatggaggttaagcggtcagctggcgaagttgtgcatcctggggaaacggagagagtgaaaaatcaaggaatgccaatttacaaccttcataaaggaaaaaccacttctgcacatggaagtgcttatatagagtgggaggtcaaatttcctaaaaagttgaaaggaaagtttttgaaaggtatgttacatctcgcagactatataagttttgttaaactaaccaatgtattcagacctcaataa

SEQ ID NO: 46275 - DNA, 1424 bp, Schizosaccharomyces pombe
atgagtggacaaaacaatgtagtcggtgtccactacaaagttggaagaagaattggcgaaggctcgtttggtgttatttttgaagggacgaatttgttgaataatcaacaagtagccattaaatttgtaagtgagaatccatttgatgccatgctttgaagctggatatttttcttgtttccttcattactgattgattttgcttataggaaccaagacgcagtgatgctcctcaattacgtgatgaataccgtacttacaagttgctggcaggatgtacgggtattccgaatgtttattattttggccaagaagggttacataacattttggtgattgaccttcttgggccaagtttagaagatttgctcgatctctgcggccgtaaatttagtgtaaaaacagttgctatggccgcaaaacagatgttggcaagagtgcaatctatccatgagaagagtctcgtttatcgagacattaagcctgataattttttgatcggtcgaccaaacagtaaaaatgctaatatgatctacgtagtagactttggcatggtaaaattttatcgtgatccagttaccaaacagcacataccttaccgggagaaaaagaacctctcgggtactgctcgttacatgtctattaatactcatttgggtcgggagcaatcccgtcgagacgatttggaagccttgggtcatgtattcatgtattttcttagaggtagcctaccttggcaaggattgaaggctgccaccaataagcaaaaatatgaacgaattggtgagaaaaagcaaagtaccccgttacgcgagttgtgtgctggtttcccggaagaattctacaagtatatgcattatgctcgtaatttggcattcgatgctactccagattatgattatttgcaaggcctattttcgaaagtcctagagcgattaaatactactgaggatgaaaattttgactggaatctattgaataacggtaaaggttggcaaagcttgaagtcgcgaaacgcagagacagaaaatcaacgttcaagcaaaccaccagcacccaaattggaatcaaagtcaccagccctgcaaaatcatgcaagtactcagaacgtagtttccaaacgctctgattatgaaaagccttttgccgagccgcatctgaattctgcaagcgattctgctgaacccaatcaaaattctttacctaatccgccaacggagacgaaagctaccacaactgtgcctgatcgttccggtttagcaactaatcaaccagcacccgttgatgttcatgattcttctgaagaacgggttacccgagagcaagtacaaaatgctacgaaagaaacagaagcacctaaaaagaaaaaatcattttgggccagtattctttcttgttgttctggctccaatgaagacacatga

SEQ ID NO: 46276 - DNA, 1227 bp, Schizosaccharomyces pombe
tttgataatcagccgatatgtatcgacaatgtatgccagactctttttagccggctatttcctgttaaactgtctagttatattgacaaaactatctagggctctggatttattaaagctggattcgctggcgatgatattcccaaatgcctttttccgacttggtatgaagtttatttctcatactagatactaatatacagtgttggaagaattaagcatgagcgtgtcatgccaagtagtatccaaaaagatatgtttgttggttctgaggctcaaaatcttcgcgggttgcttaaaattcaacgtccaattgaacggggaatcatccaaaattggtccgatatggaagagatttggagctatatttattcagatcaacagctcaatactttaccggaagaacatcccttgcttttaaccgaacctcctttggctaacatccgaaacaaagaaaaaattgcagagtatttttatgaaacgttaaacgttccagcattgagcttttccttgcagcctgtattggcactgtatgcctccgcacgtacaactggcattgttcttgaatgtggagatggcttgactcatagtgttcctatttatgatgggttttccattccatcagctatacaacaagaggaaattggaggtcgtgacgttacagattatttgcaattgcaacttcgaaaatctggccacgaactcgtcagctcggcggagaaagaaattgtccgggaaattaaagaaaaatgttgctacgtagcatctgactttagatcagaaatagaatcatggactgaacacaaaccgcagattcatacatatcaactcccagacaaccaaactataactttgggtacagaatgcttttctgcgcctgaggttttattcaacccggaaatgatgggttctgaggcgtctggtcttcacatacaattgttcaagtctattttattgtccgacatcgatttaaggtcaaccttatattcaaacattgtactttctggaggttcaacgttattgagaggatttggggagagattcatctctgagttacgtgcaatttctgggaaaaaaaatcaagttaaaatttatgcttcccctgaacgtatgcataatgcttggcttggcggctcaatattagccagtctaagtacatttcgtcggcttttaattacttcagaggagtataaaaatgatcaaaacgtaatttttaggcgaagattt

SEQ ID NO: 46277 - DNA, 2427 bp, Schizosaccharomyces pombe
atgtctgtggctattaagttcactgttaaaataaacgatggctctttaagaaggcagcaaactcgacacgtattcttaagtcctgctgctttgaatcgtcttaagctttctccgtcacaagtaatttatttgaaacataaaggcggtgaagctgttggaataacccaatcagttaagggaaatggaataggtccatttgaaatattaattagtcctttattggcgaaatgggcaaacttgaaggccttccagcgagttaacatttcacaatatgtacaccctttaaaagaagctgaaggaatcaaaattgttgcttcattgagtagcaataatgaacctataccagagtccttaataaggaaagaattgctagaaataaggtatcttcatccaggcatgattgttatgggtgaatcaccgatgaatatggcaaagagtggtagcaaaaatctcagctcagagaatatggctacggaaatttttgaaataaattcaggtttatctgcgcaatcgggtactgaagtagggtcctctcaatcttctccctccgtgaatgaatctgaaccaaaagcaacagaagatctcgatgagctttctcccggctcttataaagttaaagaaattcacattcgttctccttcaaaccttatagaagcaatttctgatatgtctttagatgagcctcgtatttacaaatttacggcagcttccagtatggaaattgaaacacctgatttattaaaattacctcatgaagacagaactcagtctgcatacaaccaaggaagtgaagagactcaaaacttcgacggtcctccttctgcagtaacattttcgtcgattggtggtttacaagcccaaatcgcccaaattcgtgacattgtagaacttccgtttcaaaatcccgaactttttaagttttttaatattatgcctcctcggggtgttctgttatatggtcctccaggtactggcaaaacgatggttatgcgggctgttgctgcagaagcaaatgcacaagtgtttacgatcgatggtccttctgtggtcggaaagtaccttggagaaactgagtctaggcttcgaaaaatatttgaagacgcacgggcgcatcaaccttcaatcatttttatagacgaaattgacgcactggctcccaaacgaacggaggacgtaagtgaagcggagagtagagctgttgctactttgttgactctattagatggaatggctaatgccggaaaagttgttgttattgctgctacaaaccgacctaactctattgatgaagcacttcgacgacccggacgtttagagaaagaaatcgaaatcggtattcctgataaaagcgcccgattagatatcattaaactgttgttatcaggtgttcctaatgaaattaatgatgctcaattggaagatctagcctcacgaacgcacgcttatgttggtgcagacctagcagctgttgttcgtgaggctgctttaagagctataaaaaggacaatttcactacaaaaggacacttcgggattagacattttcggtgcggtgcagatggacgatttggagtttgctttatcgtctgtccgacaaagtgctatgagagagtttatgatggaatcgcccaatgtacattggtcagatattggaggacaagaagaggtgaaacagaaactaaaagaatcagtagaatggcctttaactcatggcgaaaccttctcacgattgggtgttcgacctccgaaaggcgtacttctttacgggcctcctggttgttcaaaaacaatcacggccaaagccatcgcaacagagactggattgaattttattgctgtcaaaggaccagaactatttgataagttcgttggtgaaagtgaacgagccgttaggcaagtttttcaaaaagcaagacaagccagtccatcagttatattttttgatgaaatagatgctttgactgcgaatcgaggagaagacaatagtagcgaccgggtagttgcagctttactgaatgaattagatgggattgaagcgcttaggaatgtacttgtgcttgctgctacaaaccgccctgatatgattgatccggcacttatgcgaccaggtcgcttggatcgcttgctttacgttggaccaccaaattttgaagcaagaaagcaaattgtgaagatacaagctgaaaaaatgaagtttgcagaggatgtagacttggatttgattgcggaaaaaacggaaggatgctcaggagcggaagtcgtggctctttgtcaggaagctggtctgatagctatgcacgaggatttggaagcgaaagaaatatgtcaagctcactttaaaacagcattattggcattgcggaaagccataacccgagatatgcttgagtattatgcatcgttttcagaaagtgttactagcatttcc

SEQ ID NO: 46278 - DNA, 1245 bp, Schizosaccharomyces pombe
atgttgcgatttttgaaaccattccctttgagatttggtaaaagattttattctaaggttcctcctgtcaccaatcacgagcgtattttaccaaagcaaccttcttttcctacagctcctgcgcaaaacgagattgccaccctcacgattcgcaatggtcctatctttcacggcacttcctttggtgccaacagaaatgtatctggtgaagctgttttcaccacttctcctgtcggctacgttgagtcattgactgacccttcttacaagcagcaaattctaattttcactcaaccattgatcggaaattatggtgtccccgattgtaaaaagcgcgatgaaaatggtcttttgcgacactttgaatcacctcatatccagtgtgctggtgtcgttgtcaacgattatgccaccaaatactcccactggactgcagttgagtcgctcggtgaatggtgtgctcgtgaaggagttgctgcaatcaccggtgtcgacactcgtgccatcgttactttcttgcgtgaacaaggaagtagtttggcaaagatcagtattggtgaagagtacgacgccaacgacgacgaagcgtttatcaatcctgaagaagtgaatttagttagccaggtttccacccgtgagcctttcttcgtcagtggcggagatggcatgttgaacattgccgttattgactgtggtgtcaaggaaaacattcttcgttctttggtttctcgtggtgctagtgttaccgttttcccctttgattatcctattcaaaatgttgctagcaattacgatggcatatttttgactaacggcccaggtgatccaacccatcttaccaaaaccgttaacaatcttcgtgagttgatgaatacttacaatggtccaattatgggcatttgtatgggtcatcagcttctcgctctttccacaggtgctaagactattaaacttaaatatggtaaccgtggccataatattcccgcattagacattgcttctggtaactgccatattacttctcaaaaccacggttacgctgtggatgcatctactctcccagctgagtggaaggctacttggactaatttgaatgatcaatctaacgaaggtattgcccatgtttctcgtcctatttcttctgtccaattccaccctgaagctcgtggtggccctatggataccttctatctttttgacaactatatcaaggaggccatcaaatatcaaaagtctcgtacggct

SEQ ID NO: 46279 - DNA, 1578 bp, Schizosaccharomyces pombe
atggctcgagaaactgaatttaatgacaaaagtccctcttccaccgatgatggtatgagccagtcgcacttttcagataaactgaaaaatttgtttcactttcgtaggaatcgagcggcaaccgtttctactagtgtccgaaatgatcagagggataatgattctgatgactcaacctttgatattaatgttaatcaattgaatgaattagatctgaatgatagtagcgatcaattggatagtcgtcccagccttagacgcgtatcttccgcacctgattctcacaaaggagtagaagcgcctcctcctcgtcctttaattaatatgagcaatattcgaaaggcacaggtcaagattttaaaaaaccccggcaactacatttttggaagaactgagtacggcaaacgaacttattctgggaatagtacaaaaattagccgagtagaagtcacacctcatagttttgaaaaaatacgtcttcttggtcagggtgatgtgggtaaagtgtatcttgttcgccaaaaaagcaaccatcggctctttgctatgaaaattttaaacaaaagagagatgattaaaagacacaaggtaaacagagtccttgcagagcaagaaattttgaccaagagcaaacacccgttcattgttacgttgtatcattccttccaatctagggactatctttacctttgcatggagtattgtgcaggtggagagttttttcgtgcattgcattcccttccaaagcatattttacctgaaaaggatgcttgtttttatgcagcagaagtaacggctgcgctggaatatcttcatttaatgggatttatatacagagatttgaagccggaaaatatattattgcatcaatctggccatattatgttatccgactttgatctttcaaagccaatttccattgtcacacatccaacagtcgtacttccaaaacattctaccttctcacaggagaaacccgcgttagacactaattcctacttttctaattttcgcactaattcattcgttggaacagaggagtatattgcaccagaagtaatccgtagttgtggtcatactgttgcagtcgactggtggacccttggtatttttatatatgaaattctgtatggaactacaccattcaaaggtaaaaacagacatgctacattctctaacattttatactctgacgttagcttcccagagtatcatggcgcccccaacgtgtcgagtacgtgtaagagcttgatccgcaggcttcttgtaaaagatgagtctaaaagatgcggttctgtcgctggtgcctctgacattaaacagcatccttttttccgacacattcaatgggcgctgttaagaagtatgaagcctcccattattcccaaaatcgaagatggtatggaggcagttgaaccttctgataatgataatgaagaagaggattttttaaactctcagtaccttatctctgcgaatttacctgcagttgatatgcattcctctacgcctgttaatgaacagagcaatccttttgacagttttagctctgtcactcttcatcatgctggtgatgaa

SEQ ID NO: 46280 - DNA, 1242 bp, Schizosaccharomyces pombe
atgtctttgtctactaagctcgctatcaccgacgtcgacttgaagggcaagaacgtcttgatccgtgtcgacttcaacgtccctttggacggtgaccgtatcaccaacaatgcccgtatcgttggtgctctccccaccatcaagtacgctcttgagcaacaacccaaggctgtcatcttgatgtctcacttgggccgtcccaacggtgctcgtgttgccaagtactccttgaagcctgttgctgctgagctcagcaagcttttgggcaagcccgtcaagttccttgacgactgtgttggccctgaggtcgaaaaggcctgcaaggaagccaagggtggtgaggtcatccttttggagaacttgcgtttccacatcgaggaggagggttccgccaaggttgacggtaagaaggttaaggctgacgcttctgccgtcgaggctttccgtaagtctttgacttctctcggtgacatctttgtcaacgatgctttcggtaccgctcaccgtgctcactcctctatggtcggtgtcgatctcccccgtgtctccggtttccttatgaagaaggagctcgactacttctccaaggctttggagaaccccgctcgtcccttccttgccatcttgggtggtgccaaggttgctgacaagatccaacttattgacaaccttcttgacaaggtcaaccgccttatcatctgcggtggtatggctttcaccttcttgaaggtccttaacggtatgaagattggtgactctcttttcgatgaggctggttccaagaacgtcgaatccatgatggccaaggccaagaagaacaacgtcgaggtcttcctccccgttgacttcgtcactgccgacaagttcgacaaggacgccaaggttggctctgccaccgccgaggagggtatccccgacggatggatgggtttggactgtggacccaagtcctctgctaagtttgccgaggttatcaccacctccaagaccattgtctggaatggtcccgctggtgtctttgagtttgacaactttgccaagggtaccaagtctatgcttgatgcttgtgtcaagacctgtgaagctggtaacgttgttattgttggtggtggtgacactgctactgttgccaagaagtacggtaaggaggatgctctttcccacgtctctaccggtggtggtgcttctcttgaactcttggagggtaaggctcttcccggtgtcgttgctctttcttccaag

SEQ ID NO: 46281 - DNA, 1146 bp, Schizosaccharomyces pombe
atggctcaaacttttttgtttacttctgaatctgtcggtgaaggtcatcctgacaaaatttgcgaccaaatatctgacgctattttggatgcttgtttgaaggatgaccccttttccaaggtagcatgtgagaccgcttccaaaaccggtatggtaatggtttttggtgaaattactactcgctcacaaattgactaccaaaaggttattcgtaataccattaagagcatcggttatgatgactctgagaagggtttcgattacaagacttgcaacgtcctcgtcgccatcgagcaacaatctcctgatatcgctcaaggtcttcactatgagaaggctttggaagagctcggtgctggtgaccagggtattatgtttggctatgcaactgatgagacccccgagaagttacctttgaccattctccttgctcacaaactcaatgctgccatgtctgtcgctcgtcgtgatggatctcttccatggttgcgtcctgataccaagactcaagtcactattgaatatgaagaggaaaacggtgctgtcatcccccgtcgtgtagataccatcgtcgtctctgctcaacacgctgatagcatctctactgaagacttgcgttctgaaattttggagaagatcattaagcctactgtccctgctcatttgttagatgagaagactgtttaccacatccaaccttctggtcgtttcgttgttggtggtcctcaaggtgatgctggtctcactggtcgtaagattattgttgatacctatggtggctggggtgctcacggtggtggtgccttctctggtaaagactactccaaggtcgatcgttctgccgcctatgctgctcgttggattgccaaatctttggttgctgctggtttggctcgccgctgccttgtccaactctcctatgctattggtgttgctgagcccctttctatttttgtcaatacttacggcacttcttccaagacatctgctgagcttgttgaaattatccgcaagaactttgaccttcgtcctggtgttttggtcaaaagccttaagcttcaaactcctttctatctttccaccgcttcttacggtcacttcactgatcaatccaagccttgggaacaacctaaggagcttaagttt

SEQ ID NO: 46282 - DNA, 1419 bp, Schizosaccharomyces pombe
atggctaaagaagcattggaattaaaaaatgaagccaacaagtttctaaaagagggacatatcgttcaagctatagatttgtatacaaaagccattgagcttgattctacaaacgcaattctttactccaatagatctcttgcacatttaaagtcagaggattatggtctggcaatcaatgatgcttccaaagctattgaatgcgaccccgaatatgcaaaggcatattttcgtcgagctactgctcatattgctatttttcaacccaaagaggctgtcggtgacttccgaaaggcattggcactagcacccagtgatccagctgctcgtaaaaagcttcgtgaatgtgagcaattggtcaaaaggattcgttttcaggaggctattcataatactgaacctccttcaccacttgcgaatatcaacattgaagacatggacattccttctgactatgatggtgtaatattagaaaagcaaataacgaaagagtttgttgaagacatgaaggaacgcttttgccaaggtaaaaaactccccctaaaatttgcatatagcatattgcgagacttaaaagaattacttgaaaaaactccttctttaattgacattcctgttaaaggggatgagacattggttatctgcggtgacacccatggccagtattttgacttgttaaacattttcaaacttcatggtcctccaagccctactaacaaatatttattcaatggtgactttgtcgatcgtggttcgtggtccactgaagtcgcttttactctttatgcatataagttattatatccggacgctgttttcatcaatcgcggtaatcacgaaactgacgatatgaacaaagtctacggattcgaaggtgaatgtcgtagtaagtataatgagaggacatttaatattttctcggaaactttttctctgctacctcttggttccctaatttccgattcttatcttgttgtacatggtggcctattttctgatgataacgtaacattagaccaactacgaaacattgatagatttagtaaaaagcaacctggacaatctgggttaatgatggaaatgctttggaccgatccacaacctgctccaggacgaggaccatcgaaacgtggggtgggtttacaattcggccctgatgtttcaaaacgtttttgcgaggctaatggtcttaaagcagtgatccgttctcatgaagtcagagatcaaggctacgaagttgagcacgatggttattgtattactgtgtttagtgctcctaattattgtgatagtaccggaaatcttggtgccgtaattaaagttaaggaagacatggagttggatttccaccaatttgaagccgttccccatcctaacattcgcccaatggcatatgccaatggactgctaagtggtatg

SEQ ID NO: 46283 - DNA, 1020 bp, Schizosaccharomyces pombe
atgccgatgaattccgtgttagttattggaagtggatttttaggaggtcatatcatacggcagctgtgcgaacgtgaaaatcttcgaattgctgcatttgatctctttgaaaatgaaaagttgctacacgagcttcatggtcaattcaccatgtatacgggtgatttaacgaaacaaggtgatattgagcgtgtttttgaggaatttcatccacgcgtagttattcacactgcttcacctgtgcataaccttgctcgtgatatttactttgaagtgaacgtagatggcacagcgaatatcatcaaagcatgccagaaatttaatgttgatgcccttgtttatactagttccgcaggtgtagttttcaatggtgctgaccttatcaatgtggatgagtcccagcccatcccagaagttcatatggatgcctataacgagtccaaagctttggcagaaaaacaagtcttggaggcaagttctgaatctttaaaaactgctgcccttagagttgctggtttatttggtccaggtgatcgccaactcgtccctggtatgctttctgttttaaagaatggacaaaccaaatttcaattgggtgataatttgaatctttttgattttacctacatcgaaaacgctgcctatgctcatcttctggctatggacaatttactttctagtaatcctactgccaatggccaagtctttttcattaccaatggacaggttatttacttttgggactttgcacgtgctatttgggcacatgcaggacacgttcccccttatatcatcaaattccctagaccggtgggtatgctcttagccactgctgctgaatgggtttgttatttcttgaaaaaggaacctggctttacacgtttccgtgtccaatttagttgtgctaaccgttactttaacattcaaaaggcagaagatgttttgaagtaccatcccattgtggatttggaggaaggaattcgtcgtactttggcttggatggatactgagaaaaaacat

SEQ ID NO: 46284 - DNA, 2433 bp, Schizosaccharomyces pombe
atggaccaggattatgaggagttacgtgccaagtttacaaaaataggattaaatgaaacaacggtaaaagatacgttaaaaaataaaaagctttcttcttcattaaataaggtcattgaggaaactaacgttggttcttcgggatgtgatagaacaattggaaatttgctatttacattggccaacgcttctttaaaacaaaaagacccgaaatccaatgctcatgaggcattcatagcttccaaaattgtatctggagacttaaaaacaaacctccaagtcaatgcggctattacctattgcaaggacaaagacacgatcgacgaatctgagttcgataaagaaactggtgttggtgtagtcttaacacctgaacaaattgaacaactcgtcggtgattatgtcgctgagaataagtcaaaaattttggagcaaagataccagctgttaaatccttctgcctctgctttacgtcagcatgctttattgaaatgggctcctcaactggaggtcaagcagacccttgataggaaattccttgaactcttgggaccaaaaaccgaacaagatgctgccgctggtaaaaaaaaaggcgcaaaagccaagaattcgaagcagaagactgttgattctgggaaagctaaggaacaaaaaattgtttctgaacagtctaagaaatataatatgtttgaggaagggtttttagcaaagctacataaaccaggtggtaatacgcagctgattcctgaaaggatgaaggagcacctgcaggctactggaggcggcgttgtaaccaggtttcctccggaaccaaatgggtacctccatattggccattccaaagcaatcgctgttaattttgggtttgctcgctatcataacggcgtttgttatttacgctttgatgatactaatccggaagctgaagaagagcgttactttgaaagcatcaaggatttggtagcctggttgggattccaaccttataagatcacctattccagtgattactttgataagttatatgagttagccgaagagctcattaagcgggacaaggcatatgtttgtcattgtaccgatgctgaaattaaaaaagctagaggtggtgaggagcgcggtcctcgttatgcttgtgttcatcgggaccgcccgatagaagaatcgcttcttgaatttcgtaatatgcgtgatggaaagtatcaaccgaaggaggctattttacgtatgaaacaagatctcagtgatggaaatcctcaaatgtgggaccttattgcctaccgtgttcttaattctcctcatcctcgtactggagacaagtggaaaatttacccaacttatgattttacccattgtttagttgattcgttcgagaacatttctcactctttgtgtacgactgagtttatattatctagagtaagttatgagtggttatgtaatgccttggaagtttattgtcctgctcagcgtgagtacggtcgtttgaacgttgtcggaaccctcatgagcaaacgaaaaataatgaaattggtaaaggaaggatacgttcatggttggaatgatcctaggctatatacccttgtagctcttcgccgccgaggtgttcctccaggtgctatccttgagtttgttagtgaagtcggtgtcactactgccgtcagcaatatagaagttgctcgatttgagaactgtgttcgaaaatttctcgaaaacagtgtaccacgtcttatgtttcttcctgatcctatcaaggttacattagaaaatctagacgactcttacagagagcaaattgagataccctttaatcctaaagatccttctatgggatctcgttctgcttttcttacaaagcatatatacattgaccgttctgattttcgtgaggaagcatcttctgactttttccgtttgacattaggtcaaccggttggcttgttccgtgcctctcatcctgtagttgccaaaagggttgtaaaaaatgatgaaggggaaccaatagaaatcatcgctgagtacgacgctagctcttcaaagaagcctaagacctttattcaatgggtgtctagggacaaagaaagtaatagtccagtacttattgctgaaacccgcctctttaataatcttttcaaatgtgataaccctgccgccctaaaagaacaagagctcgctgcacaattgaatccagagagcgaagtcgtactaaaaaattccattattgaacctggcatttatgatttaattaaatcggcaccttggcctaagactgattcatcggctggtgtcgacaaagccgaaaatcctgaaagtgtccgttttcaagctatgcgggttggatatttctgtttagatgaggatactaagaaaccaaatcatcttgtattgaatagaattgtatccctcagagaagattcggctaagaataaaaat

SEQ ID NO: 46285 - DNA, 954 bp, Schizosaccharomyces pombe
atgattaatatagtcgttttagggagtatgaataccgatctcgtaatgcgtacaaagatatgtccctcaggtggtgagacgattcatggagaaccagatggcttcagtacaggaaatggtgggaaaggagctaatcaagctgtagctgttgctaggctatcaaatccggctgatacgaaagtatctatgttgggatgcgtaggtgatgatgcctttggggtggaaatgttgtccggattgaagaaagacggcgtaaatgtagataatgtcaaaaagattgaaaacaagtccacaggtgttgccatgattattgtcgaagaaacgggagaaaacagaattttgctttctgagggtgcgaacggtaatgttgatactgcgtttgtgaaggccatggagcaaagaatatcaacatgtaatcttctaattatgcaattagaaattcctttagaagcagtggaaattgcattgcagatcgctcacaaacatggtgtcgatgttttgatgaatccagcaccagcgattccgcttagtcatgacatgatatcttattgtgcctatcttgtacctaacgaacatgaagctgccattctcttaaatcaagcagactcacctgctacgttggaaaatgtggatgcatatgcttctaagttactaagcttcggtgtccgtaaagccgtaattataacccttggtagccaaggtgcttactataagtctgcgaacggagaatctgctttggtctcagcatgcaaagtgaaagccgttgacacgactgccgctggcgataccttcattggtgccttttctaattcaattgcacacggacagccacttaaggactcactggaatttgctgctaaatgtagtgctattactgtacagagaaagggagctgcaagttctattccttccttacttgaagtcgatggttcctttaacctaaaaaagaataca

SEQ ID NO: 46286 - DNA, 1650 bp, Schizosaccharomyces pombe
atgatttcgaagttactgaaaatagtccttttaactgcaggtgttattggcaacacacttgctgattctagaattcatgaacaatatcttgtaaaagcatttcctaatgagcctgttgattatgagggaagaatgcatgctggacacttaaatcaaacggatcagctggatggtgatttgtttttctggatgtttgaatccgtaaaacccgaatacgaacatcgttctgtaagtatttcaagtgaatgtttttaaattaaattatatattatacaaattactaatttgataaaagattctttggttaaatggaggtcctggctgctcttcagaagacggctcgctgatggaagttggaccattccgtcttgatgacaataatacattccaattgaaccctggacgctgggacgaattgggtaatttgcttttcgtagaccaacccctaggcacagggtattcatactctctggctaaggattttcaatctaacaatgagaaaatggccaatgatttttctattttctttgagaaattcttggaggagttcccagaaagagcaaatgatgaatggtttatcgccggagaatcatttgctggtcaatacattccccatatcgctgcaaagttgaaagaaaaaaatcttgttaacttgggaggccttgcaatcggaaatggatggattaacccactttctcattatgaaacatacctaaattatttggtagaaaaaggcatggttgattttgaatcagagctgggtcaatatttacatcattcttgggcggaatgtttacttgcttttgacaagataggttccggatctggtgatttatctaagtgcgaaagttttcttggcgatattttatacatggtgtcaaaggaacctgggaaagcatgtatgaacatgtatgacattagcttagaatcgacatatcctacttgtggaatggactggccttacgatctttcctatcttactgaatttttaagtgtatgtttataattatatgataatatatcttttactaacattgtcagactcgtgaagcgatgacttccttaaacgttaacctcgaaaaggttcatgattgggaagaatgtaatgacgacgttgccctacaatatgctcgtgaagggattgagtcctcatctaagttaatccaggaccttgtatctacggttcctattttgttgttttacggcgaaaatgactttctttgtaattatttatctggcgaaaaattaacccgatcactggagtggaatggtgctgttggttttcaaaatcaatctgctcaaccattttatcttccgggctattctgatcaaccatcgggctcctatgttagttcccggaacctgacctttgctcgcatagttgaagctagtcacatggttccatacgatcatcctaatgaaatgaagaccttgattactgctttctttaataatgactttgccagcttaccatcggtacctaaaccctctccggatttaggtaatggaaactacaaatggctttatttgggtttgattcctgttgctttaactatcattattttattctcaatttatttgtgcaggagatttggattatttggtcttagcaaacaacgctaccaacctatatctccaactccttagact

SEQ ID NO: 46287 - DNA, 2096 bp, Schizosaccharomyces pombe
atgcgcgtcctatgtgttgctgaaaaaaactcgattgccaaatcggtagcaagcattctagggggtggacacgtgagaagggtttgttaaaaaatttaatcttttctgaaatttactaatctcttaagagagatacacgaagtaagtatgtaaaaaattacgacttctcatttaattttggaggcaatgttggatcttctgatgttacaatgacttctgtatccggtcacttaacagaagcttcttttccttctgaatattctagttggagctctgtccctcaagacgttttattcgatgctcaaatcatcacctcagtatcaaagaatgcagaagtactagcagacaatattaaaaaagaagctagaaatgcccagtacctttatatttggaccgattgtgatcgtgagggtgaacacattggggtggaaatctccaatgtagctagagccagcaatccatctattcaggttatccgagcagacttcaataatttggaacggtcgtaagttataaacatcttagcgttttaaaaagcagatatttatttattacagaaaaaacccttcaagataaatgctaactaattttcagacatattatcagtgccgcgaaacgtccaagagatgtttcaaaaaatgctgcagatgctgtggatgctagaattgaacttgattttcgtttaggtgcaatattcactcggctacaaactattcaattacaaaaatcattcgatattcttcagaataaaataataagttatggtccctgccaattccctacattaggctttgtagttgatcggtggcagcgagtagaagactttgtgcctgaaacctactggcaccttcgatttgttgataaaagacagggtaagactattcagttcaattgggaaagggccaaagtttttgacagattaactacaatgatcatcttggaaaactgtttagaatgcaaaactgctaaggtcgttaacataactcaaaaaccaaaaaccaagtataaacctctgccattatcaactgtagaacttacaaaactggggccaaaacatctaagaatttctgctaagaaaactttagaggtacgatttgattataagtgaatttgcaactttaacatcattttcatcagctcgccgaaaacttatatactaatgggtttgtttcttacccacgtactgaaaccgaccaatttgactcttcaatgaatttgcatgcgattatccaaaaactaacaggtgcacaagaatgggactcttatgcagaagggtaaatataatttttcttatagtggcttccgtaataactaatgttaggcttttggctggagattatcgaccgccccgaaaaggtaaacacaatgatcgcgctcatccacctattcatcccgttcaaatggttcaccggtcagcgcttccttcccaagatcattggaaagtatatgagctaattacaagaagatttttagcttgttgttctgacaatgccaaaggagccgaaacgttggtgcaggttaaaatggaagaagagcttttttctaaaaagggattgctagtgacagagaaaaattatttagaggtttatccatatgagaaatgggaaagttcggatcaattaccagagtatagacttcacgaggaattccaaccccacattctcgacatgatggacagttcaacgtcctccccttcctatatcactgaaccggagttaattgccttgatggatgccaatggaatcgggacagatgctactatggcagagcacatcgaaaaagttcaggagagagaatatgtcataaaacgaaaaaaaaggggccaaggtgtaactgaatttgtaccaagctctttaggagttgctttggcaaaaggctatgatgaaattggtttagagtggagtttgaccaagcctttcttgcgaaaagaaatggaagttcaacttaaaaacatagaaaatggccaacttaatcggaatgttctagttcatatgatccttacccaattccgtgatgtttttcatctcacaaagcaaagattcgattgtttaaaaaatgtaagtcaaattatcattgtttcctacttttccaatttt

SEQ ID NO: 46288 - DNA, 1272 bp, Schizosaccharomyces pombe
atggctaaaggtgcggtaaaaaaggagaaattcgaatatgaattttttgggcccattggcgctttaggtgttactgttttaacgaccgtcgtatcttttggttcattttatatctgtaatgaggaaggatgcccggctaaattctctaaaatctctcatatatttaaaaaaactcctctatttgaccaaaagtctttaattttgtacttgctttggtttagtactctcactttgttatggaaatgcacgaatggaaaatgggcaaagggtacacctatagacgacaaagggacaagattactttataaaataaatggttttaactcagcttgcctaatacttggtgtcgtttgtacctcaatatacctgttgggagctagctgcatggaatttatttgggataactttttacagttgatgtttgctgcatacgttttttcagtagttttatgcacgttttgctacgttcagtctttttttggaaagcagcaacttgctaaaggggggacttctggaaacattttatttgactggtttattggccgcagcctcaatcctagaataggcaattttgatatcaagtgtttttgtgaacttcgtcccggtctaattttatgggtcgtttttgacattgcttttgcatgccatcagtacctggtgttaggaggtagaattacagacagcatggttctggttattattttccatacatggtatgttctggattctctaatcaacgagagtgctgttttgactaccatggacattaccacagatgggtttggctacatgctgagctttggggatctcgtgtgggttccatttctctattctttgcaagctcgctatttagcctttcatcccgtggatttaggacttgtcaaaacattggcgattttatgcttacagttccttggatactatattttccgtggcgccaatggtcagaagaataggttccgaagcaatcctaacgatcccaagctcaaacacttaaaatttatccagactaaacgtggaactaaacttttaactagtggttggtggggaatggcacgccacatcaactattttggtgattggattatggcttgggcttggtgtttacctgctggatttggttcaccgatcccgtacttttatgttgcctattttggtgtgcttcttgttcatagaaatgcacgggatgatcacaaatgccgtgtaaagtatggtgaagattgggagaagtactgcaaggcagtcaaatatcgtattattccctatgtgtat

SEQ ID NO: 46289 - DNA, 1092 bp, Schizosaccharomyces pombe
atgacttcgtttacggaatcaaaaaaactggatgaaatagagtcgccagttccggaaattattgttccaagtaccaccaatggaaacggaacaattgaatcttacaaagaaaaatcggttggaacctctttcttggatttttttcgctcctacaagttgcgcccagacaatgagtttgctgaagtgcacaacagtgaggactttttgaaaccgaggcatttgcaaatgatcgccattggtagctgtattggtacgggtctttttgtttccactggcaaatctttaaaaaacgctggaccgggaagtctaatgattaatttcattatcctcagcgcaatgattctcgctttaattctttctctaggagaaatgtgttgtttcctaccaaatcaaagtagtatcacaatgtacactggacgattgttaaataataacattggttttgcgcagtcatggttatatttttggatatggctgaccgtcttgcctagtgaaatctctgccgcttgcgaagtagttgacttttggacaacacagcacttaaacccagctatttgggtaactatcttcttggcttatgttgtcttagttaatgcatttggagcccgtagctatggtgaatgtgaattcgttagttcatttttaaaagtcgtcattgttatcatcttcttcttcgttgcaattatcatcaactgtggagctgctccaaaaggtggctacattggtgcgcactattggcatcatccaggatcgtttcgtaacggtttcaaaggtttttgctccgtatttatttcctcagcctattcgttgtcgggtactgagaacataggtacggctgctggaaataccagcaatcctcaacgtgcaattccaagtgctgtgaaaaaggtgttctaccgtatgggcttcttctacatcatcaccatcttcttgatcactttagtagtcccgtatgataacccagacctgggtaatgtcagtccattcattattgcgatcaagaatggaggaattcatgtactaccacatatcaccaatgctgttattctcgtttccgttctctctgtaggtaatgcagctgtattcgcagcg

SEQ ID NO: 46290 - DNA, 1041 bp, Schizosaccharomyces pombe
atgagtagcgaaaccaaaagtgagtttggaaccaagtccgcttggctttacaaccgtactggcaagccgaaggatgttttgtacctggaaaagggcttgcatatacccaatcctgcggagctgggaccgtatgatgttctcgttgaagtggtcgctaccagtatcaatccgcttgattacaagctgatgaacacttaccaaatgattgccaaggcactcttcaagcttccaaacattccgggttatgattttgctggtcgtgtactagctgtgggatcagaggtcaaggaattctccgccactcagcgtgtttggggttgtcagtcctttcctcgtgcaggtcgccaaggtggttcatgtgctacacacatcgttacgggcgataaggatgtttggcaccttcccgatggtgtttcgttcaatgagggtgccgggttcggtattgctggattaaccgcctgggaggtattggtccgacaaatgaaggtaaagccaggtaccaaattggttatcgagggagctagtggaggtgttggtacgtttgcagttgcgttagctaaagctttggaatgtgaagtcactacgatttcctcaaccgagaacttggatctctgtaaatctttgggtgccactcatacactcgactataaaaaggacaacctcgttgagcgcttggctgatctaggaccctatgatttcgtatttgattgtgttaacgataatgttttataccgagcttcaagtaaatttgtcaagcctgacggcgcattttttggaattggaggtgatattactttgtcatacgttggcagtcgcttatcacgtactcttcgtcctcgtgtactaggtggatcatcccatagctactataatatccttttgcacgtagatcaggaaatgctacgtgattttgtcgattttgtgatgaagcataatatcaaaacagtcatcgatagtgtatatgactttgaagatactgttgaggccttcaaccgtttgatgactcatcgttgtaaagggaaagttattattaagacggat

SEQ ID NO: 46291 - DNA, 906 bp, Schizosaccharomyces pombe
gatagtaaagtccgtatttacgaagtgcaagctacagggcaatcaattggaaaagcactttatgaacaccaaggtccggtattaagtgtcaattggtctcgagatggtaccaaagtagcatcaggaagtgtggataagtctgctaaagtctttgatattcaaacggggcaaaatcagcaggttgcggctcatgacgatgctgttcgttgcgttcgtttcgttgaagctatgggtacttcacctattctggcaactgggtcatgggacaaaaccttgaaatattgggatcttcgacaatcaacacccattgctacagtcagtcttccagaacgtgtttatgcgatggattgtgttcatccattacttaccgttgcaaccgctgaaaggaacatatgtgttatcaacttgtcggaaccaacgaaaatatttaaactggctatgagtccattgaagttccagacaagatctttggcttgttttattaaaggtgatggttatgctataggaagcgttgaaggaagatgtgcgatccaaaatatagatgaaaaaaatgcatctcaaaacttcagttttcgctgtcataggaatcaagcaggtaacagtgctgatgtttacagtgtaaattctatagcatttcatccccaatatggaactttctcaaccgccggatctgatggtacttttagtttttgggataaagatagtcatcagcgtttaaagagttatccaaatgttggtgggactatttcttgcagcacgtttaatcgtactggagatatttttgcttatgccattagttacgactggagtaaaggttatacattcaacaatgcgcaattgcccaataaaatcatgctccaccctgttccgcaagacgaaataaaacctcgacctaagaaaggaagg

SEQ ID NO: 46292 - DNA, 1455 bp, Schizosaccharomyces pombe
atgagagaagtaatttctgttcatgttggacaagcaggtgttcaaatcggtaacggtatgttcaatatccatctttttgtattgctgtatactctaaatagttggcaatcgattttttcataaaaaatttagctaacatttctagcatgctgggagttgtactgtttggagcatggcataggacccgacggttttcctacagaaaactccgaagttcacaaaaacaatagctatttaaatgatggattcggtacatttttttctgaaaccgggcaaggaaaattcgtacctagaagtatctatgttgatcttgagcctaacgttattgatcaagttcgtactggaccgtataaagatctgtttcatcctgaacagatggtaactggtaaggaagatgcttctaacaattacgcccgtggacattatactgtaggaaaggaaatgattgatagtgtattagaaaggatacgtcgtatggctgacaattgttctggtctccaaggtttccttgtatttcattcttttggtggtggtaccggctcgggtttgggtgctttacttctggagcgcttgaacatggaatacggaaagaaatctaacctccaattttctgtttatcccgcccctcaagtgagcacatccgttgttgaaccttacaactctgtgctcactacccatgctactctcgataactctgactgtacctttatggttgataatgaggcttgttacgatatctgtcgccgaaatcttgacattgagcgtccaacctatgaaaacctcaaccgccttattgctcaagttgtctcttctatcaccgcttctcttcgatttgctggtagcttaaatgttgacttaaatgagtttcaaactaatcttgtgccataccctcgtattcactttcctttagtcacttattctcctattgtcagtgcagctaaagcattccatgaatccaacagcgtacaagagattacgaatcagtgctttgagccttataatcaaatggtaaaatgtgatccacgaactggccgctatatggctacttgtcttttgtatcgtggtgatgttatcccacgtgatgtccaggctgccgttactagcattaaatctcgtcgcaccatccaatttgttgattggtgccctactggtttcaaaatcggtatttgctatgagccaccccaacacgttcctggtagtggaatcgctaaggtaaatcgtgctgtttgtatgctttcaaataccacctcgattgctgaagcttggtctcgtctggaccacaagtttgaccttatgtacagcaagcgtgcttttgttcattggtatgtcggtgaaggtatggaagaaggtgaattttcagaagccagagaagatttggctgccttagaaagggattacgaagaggttggtcaagattctatggataacgaaatgtacgaagctgacgaagagtat

SEQ ID NO: 46293 - DNA, 1568 bp, Schizosaccharomyces pombe
atgccacctaaagaagattgggagaaataccaaaagccagttgatacggaagaagaaaatgataaaaatccaccacctttagacgaaggagacatcgagctcttaaaaagctacgtaagttacattaatgattgaatttgtcaccagcagcatactaaatgtcaatgtaggctacaggcccatatgctagagaattagcagctattaaagaagatacagaggctgtgttaaaaagaattaatgatactgttggtatgttttatgtcgagaaagcagttgcacgatgttgtctgatgaatggcgttcctgtagttcatatagctgatatgaactacaagatatgacattcatgaacaggatgtatttttacaattttttatcatgtaaaatgctctcattttatatgaaatttgcttaacccgttgttctattgctaactagccctaggaattaaggagtctgacactggtctagcaccaatttcattttgggacgttgctgcggaccgccaaaggatgagtgaagaacaacctttacaggttgccagatgtaccaaaattattgagaatgaacaatctgcggagaaaaatgcatatgtcattaatttgaaacagattgcaaaatttgttgtcagtttaggtgaacgagttagtcccaccgatattgaagaagggatgcgtgtcggttgtgatcgtaacaaatatgctattcagcttcctcttcctcccaaaattgatccttcagttactatgatgcaagttgaagaaaagccagatgttacttacggagatgtgggtggttgtaaagaacaaatagaaagacttcgcgaagtcgtcgagcttcctttactatctcccgaaagatttgttaagcttggtattgaccctcccaagggtattatgctttatggaccaccagggactggtaagacactatgtgctcgtgctgttgccaatcggactgatgcaacttttattcgtgtaatcggttccgagttggttcaaaaatatgtcggtgaaggtgctcgtatggttagagaattatttgaaatggcacgaactaaaaaagcatgtattatcttttttgacgaaattgacgctattggcggggctcgctttgatgatggagcaggtggtgataatgaagttcaaagaacaatgcttgaattaattacccagttggatggattcgaccctcgtggtaacattaaagttctgtttgcgaccaacagaccaaataccttggatgaagctttgatgcgtcccggtcgtatagatcgtaaagttgagtttggtttacctgatttagaaggtcgtgctcatattttacgcatccacgctaaaagtatggcgattgacaaggatattcgttgggaattaattgcacggttatgcccttcacaaactggtgcagagcttcgttctgtatgcactgaggctggaatgtttgcgattcgtgctagaagaagagttgctaccgaaaaggatttccttgacgccgttcaaaaggttgtaaaaggtaaccaaaagtttagcagtactgctgattatatgaacatgagctcttag

SEQ ID NO: 46294 - DNA, 1380 bp, Schizosaccharomyces pombe
atggcttcttcacaaaaactttggggcggtagatttactggcgccactgatcccttgatgacagcttataatgagtctattcattatgacaagcgcatgttcaatgccgacattgatggctcgaaagcttatgctaaggcattagaacaacgcggaatcattagtgctgatgaattggataaaatgttagatggtttagaggctgtccgagatgaatggaagacaaataaattcactcttcaaccttctgacgaagatatccatactgctaacgagcgcagattgggagaaataattggtacaggcattgctggtaagcttcatacaggaagaagtcgcaacgatcaagttacgaccgatatgcgcctttggctacgtgatgagttggacatcatccaaaaatctttagttgggttactccaagtttttgttgctcgtgcagagtctgaccttgatatcattatgcccggttacactcatttgcaaagagcccagcctattcgctggtcccatttcttattgtctcatgccttttctatattaaatgacttggatcgcttgaaacaaatttattctagagtcaaccgactccctttaggcgctggtgcacttgctggtaatcctttcgccgtagatcgtaagttcttacaaaaggaacttggttttgaaggggttattatgaattcaatgaatgctgtagctgaccgcgattatgttattgaatttatgttctgggctagtatggtaatgacccatatttcccgtttggcagaggatcttattatatattctacttctgagttcaacttcgttaccctttccgatgcttattcaactggaagtagtattatgcctcaaaaaaaaaatcccgattctttagaacttcttcgtggaaagtctggccgagtttttggcaacatgatgggctttatggtttcggttaaagggattccttcaacatataacaaagacctccaagaagataaagaaccgcttttcgattcttccaaaactgttttggattccattcaaattctaaccggagttctttctactttaactgtaaatccagaaaatattgctaagagcttgactgcggacatgctagcgactgatttggcagaataccttgtgcgtaaaggtgttccctttcgtgaaactcatcatatttccgggtccgctgtccgaatggccgaggaaagaaacactaccattgataagctaagtgttgaagattttaaatcgctacacccattatatgaagaagatgttgcagatgttttcaactatgaatccagtgtggagaagcgttgtgcgattggtggtaccgctaagagttgtgtattagaacaaatccaaaccattaaaaaggccttggag

SEQ ID NO: 46295 - DNA, 318 bp, Schizosaccharomyces pombe
atgtcttctactttcgagcaagctgccgctgacgttaaagaattaaaggaaactcctaacagtgatgaattattaaaggtatttttttcttaaccccctttttttgtagcttagcttactaatttgttgtactagctttacgcattatttaagcaagccactgttggtgataacaacactgaaaagccaggtctcttagatcttaaggggaaattcaaatggaatgcttgggaagaacttaagggaaaatcgaaagaagacgctgcttctgagtatatctctttcgttgatgagcttaagaccaagtatggaatgaag

SEQ ID NO: 46296 - DNA, 1056 bp, Schizosaccharomyces pombe
attcaggttgcccctccaaaagctcatgaggttcgtgtgaaagtcgattggagtgctgtttgtcacacagatgcttacacgctgtctggtgtagatccagaaggcgcattccctattgttcttggtcatgagggtgctggtattgtggaaagcattggcgaaggggttatcaacgtgcgtcctggagaccatgttattttgctatatactccggaatgtaaagagtgtaaattctgtcgtagtggtaaaactaatttgtgctccaaaattcgtgaaacacaaggtcgaggtttaatgcctgacggtactagtcgcttttcctgtcgcgataaaacgttgcttcattacatgggatgttctagctttagtcaatacacagttgtagctgatatctcgcttgtggctatttcacactccgcacctcttcgcagtatttgcttgttgggctgcggtgtcacaactggatttggtgctgtgacacactctgctaaggttgagtctggttcaacggtagctgttgttggatgtggatgcgtaggtctcgctgcaatgcagggtgcggttgcagctggtgcttcgagaatcattgctattgatatcaatgcagataaggaagtatatgccaagaaatttggtgctactgactttatcgattcttctaaagttaaagacctcgtacagtatgttattgatgtgactgatggtggtgttgactatgcatttgattgcactggaaatgtcactgtcatgcagcaggaacttcaattctgccacaaaggttggggtaaactgtgtgttataggcgtcgccgcagctggtaaaacccttgattttcgtccattccttgtagtaactggtcgtcaagtgttgggttcagcttttggaggagttaaagggcgttctgaattgccgaactttgttgatgagtacatgcaaggccacttcaaagtggatgaatatatcactaatgaagaaccacttaagaacataaacaaagctttcgaccatatgcacgaaggaaagtgcataagatgcgtcgtggatatgaataagcca

SEQ ID NO: 46297 - DNA, 960 bp, Schizosaccharomyces pombe
atgggcaattcactatttaaggggttttcaaagccatttagtcggttgttttctaacaaggaaatgcgtatcttaatgctaggtctggatgcagctggaaaaacgagtatgttttttattcggatggatttttacagtcttcattccgtataatcgtgcttaacttggtgttttaataatggtaactcttttattaacattttagctatcttatacaaattaaaactcaatcaaaggtaaagagcactaaacagcattcttcgattgtgtcaaggtatcgtatgcgctgcttctgtattagcatagtagatatagatttcattacgaagactgttggttaattaatcagtgaagtctactgtcgcgcattatcttgagttgcaattatgcttccgtaaatgaaattgatttttcttgtgttcattaactaacagccagtgttgtcaccattcccactgtgggttttaacgtcgaaacagtcacttacaaaaacatcaagtttaacgtttgggtatatttataatcaatcttgggtcgagcatgttctaacgttgatttgtttgtaggatgttggaggtcaagataaaatacgacctttatggcggcattattttactggaaccaaaggattaatttttgttgttgactctgccgacagcaatcgtatatcagaagctcgtcaagaattgcatcgcattatttcagatcgtgaaatgcgggactgtcttcttttggtgttggctaataaacaggatttgcctggaggtaaggttgcgaatccgaataacttatgctaacactatggtagctctttcacctgctcaaattaccgatgttttgcagctagacaaattgaaggatcgtttatggaacgttcagccaacatgtgctcttacaggagacgggctgttggagggtctggcttggctaagtcaaaacgcaaagttaaaataatttgct

SEQ ID NO: 46298 - DNA, 973 bp, Schizosaccharomyces pombe
atggctcaaccacaaaacgttcctacctttaagcttgtacttgtcggcgatggtggtaccggtaagaccacgttcgtcaagcgtcatttgactggtgaatttgaaaagaagtatattgcaactttggtacgttttatgattttactttattagaacagtttttgtataccggaaacgatgcctagtatcgtaaataaatgccatctttttatgagacatacagttatctgtactcgtgcatcatcggttttcagttactctttttatgcttagatctttcgtttagaaacaacagtctaacatatttttagggtgttgaggtccatcctttgcattttcatactaattttggtgaaatttgctttaatgtttgggataccgctggtcaagaaaagttaggtggccttcgtgatggttactatattcaaggtcaatgtggtattatcatgtttgatgttacttcccgtattacctataagaatgttccccattggtggcgtaagtgatatttaagcaaaaaaaagctttaaatgttttttttgatactcatagaccgctagatttaatggttataagtatattgacattagctttttttgactactttaatgaacattactaatcgaatgcaggtgatcttgtccgtgtttgtgaaaacattcccattgttctttgcggtaacaaagttgatgttaaagagcgtaaagtcaaggctaaggctatcactttccatcgcaagaaaaaccttcaatactacgacatctccgccaagtccaattataacttcgaaaaacctttcttatggcttgcccgtaagctggttggcaaccccaacctggagtttgttgcttcgcctgcccttgctcctcctgaggttcaagtcgatcagcaattgttagctcaataccaacaggaaatgaacgaggctgctgctatgcctttacctgatgaggatgacgctgatttgtaaacc

SEQ ID NO: 46299 - DNA, 2808 bp, Schizosaccharomyces pombe
atggcaagtcagcggttcgtgattgctttgcattcctttccggggaagagtagtgatgaacttccgttggttgaaggtcggaagtatctgttgataaagatggatgaagaatttggtgatggttggtgggaagtaagtatataacttcgaagtcaaaatcctattatttttattcctggtatattttataatttgaaggattcttgatgcctgctttgtacagttttccaatccacataaagatgcaaacactatatgtcaaagttgcatgcccttaggattgtgaaaccttgatatatttttatcatactaactaagttttaatagggagaagatgaacagggaaataggggtatttttcctgcttcgcacgtagaattgatatctgatgagaggtctgactcaagtgattcaagaagaggcaaagaagatttctccatttctaccgcggaagtcacaagatcctctttatcaagcagccggtcaacttcttcacgatcggacaaggacagtgaaaagttgtattcgaataattccttgtcttcaagtcactcatcaatcttaaacggcccccttgatagtctttcgaaaccttcggtccctagtaattttaactcaatgtttccatcttctaaacaagaaggcccttcccctttgttggataaccaaccttcctcagatctatcaaacttcaacactattgatgccgattataataatgcttctgcttctacttctgctcctgctacttcagcaagcttgaaaaaggttttgtcagctgaggattccgttagagaaactattacagatattgaaacagctttacagaatatgtcaacttcagcatctcgtactccaaatgacagttcacctttgccctatattgaaaatcgacctgcatcctctcttgctgtttccgaaaaaattcaaaatgttcctaactggtctacggaagaggtagttgaatggcttatgaatgccggccttggatcagtagctcctaattttgcggagaatgaaataaccggtgaaattttattaggcttagattccaatgttttgaaagaacttaacattacttcttttggaaaacgttttgaagttttacgaaagatccaacaattaaaagattcatacgaacaatctttatatgaagaatatccgcagtttgctgagcctatttctgttagccaaagttctgattcctcctcttctattccaaaaaaatctaatgatgaagccggcggttcaccatcaaaatccagtccaactcgtccgggatttaacgattatgttaatcgtccgactagtgtgatgccttctttgtcaaatatgattgtttcacctgatttggactcatctccatctaccgattggaaccaatacgtgattcctcctttagccacaccaagttcgcgcaattctaagtctacgcaatctgcggtccctgaaaatgtatctcgttttgattctaacgaaccttcggccacatcaccgatattaaaacgttcatcccctacggactcaatttctcaaaatagcggtttaccttctcgtcttactgagcccatctcttctccttctaccagtagcattgatgttgataaggaaggaacttcatttcctggtttaccttatcattcatctaagggcaacttgtatgctcctcaaccatcttctaacgttcctactaaatttacgggcggtgcatcggaatcttcttccgtacctcctagacctattccaagtgctatgaaaggaaaagcaccagcttcagctatatctatcgaagctttggaagaattggatcctccaaagattactactattgatggtgaaagtccttcatcgataagttctcgactccctagtagcaatctcgaacaagggagttcaagttctgttactaagtcacctgaatcaatgccagacccatcagcaaaagcatcatcgcctgtcacaagcaaaggggtgtccataaacgaaaaatccgctgttaataattatgccactcctctttcaaaacctcaacccaaagatacgaagggctcaaaattaggaaatacttttgttgctccatctccggctgcttccttacccgcttcacctccagtcggcactgagttaaagactcgtccaacccttcgttctgttgcttcatcaccattaaataaagagccaataggtaaacgaaagtcgaaacgtgatatttttgggagacaaaaggttttacctactggaattagtgaaggattaagtaatatacctgccaaagaagcaattaaaacggcggactgtcatggttggatgcggaaacgtagtgatcgttacggtgtttggaagtctagatactttgtattaaaaggaacaaggctttcttattaccattcattaaatgatgcttcagaaaaaggcctaattgatatgacttctcatcgtgttacgaaaaccgatgacattgttctaagtggaggcaaaactgctatcaagttaattccacctgctccaggtgccgctaaagcagcagttatgttcactccaccaaaggttcattattttacttgtgaaaataatgaagaattacatcgttggtcttcggcttttctcaaggctactgtggaacgcgatatgtcggtacctgttttgacaacgtcgagaatgcctaccatttcacttagcaaagctaaagaacttcgtactaggcctccttctctattaattgatgatgaaaatgaagcaaatctcacttcttcgattggattaaagaagaatgcaaaacaaaagaataagaaatcaagcaagcaaaaa

SEQ ID NO: 46300 - DNA, 1266 bp, Schizosaccharomyces pombe
atggataaacgaaaggaatcggagagtgcgactaatggacatttagtatgttcgattgctaaaaaaacatgcactaatataaataggttaaaagaattagaatccaagattctagcttaataacggagggttctgtattgcaacgaacatctgatctcaatgttccaaacctacagatgtttgggcatacggtatggttgtattgaaataaatcatactaacgctttaggctgaagttttagtcgccaggttcgatccttctggatcatactttgcttctggcggtatggatagacagatacgtaagtgcagctgtaattaaaatgttgatttataataactgtggtttagttctttggaatgtgtttggtgacgttaaaaactacggagtattaaatggctgcaagggagccataactgatttacagtggagcagggattcacgcgtagtttactgttcttcctccgatacacacctcatgtcttgggacgctgtctctggtcaaaaaatccggaagcataaaggccacgctggcgtggtgaatgctttagacgttttaaaagttggttccgaacttctgacttctgtaagtgatgattgtactatgaaggtatggatattgttattaaaatatggaatagttactaaatttaaggtatgggactcgcggtcaaaagactgcataaaaacaatagaagaaaaatatcccttaacggctgtcgcaatagcgcagcaaggaacccaagtttttatcggtggtattgacggagctattaaaatctgggatttacgaaacaatcactgctcgcatgttctgaaagggcataaagatatcattactagtttggctatatctaaagatggatctagcttactttctaattctatggacaacacgggtatgctaattttttttgggtgtttgatcaacctttgtactaatgctattttaatttatagttcgaatatttgatgtaaaaccttttgcttctgctcaacgacagttgcaaatttttgaaggagctattcacggacaggagcataatttgttaggtgttgcctggagtcgtaattcacgattcgttggtgctggtagctctgataaaaacgtatatgtttggtcagccacaggcgatttacgttatgtattacccggacatgagggttcagtaaatcacgttgactttcatccacatcaggacatcattctttcatgttcctcagatcgaacaatatttcttggggaattgaattaatttttattt

SEQ ID NO: 46301 - DNA, 1125 bp, Schizosaccharomyces pombe
atgcgttggtattcttatgttataccagcagtgatcctcagcataattgctatttctggagtatggtggaatgctacccttggtactaggctcgaccagaaagtacaacttttcttaaatgaacattcttcaattttgaatgcagtttacgaaacaactactatcgtttacacagagccattacacaccagtgtcagcgaaacgattacatctacgtcttttgttacagaaactacgacagtaaccccaacggttactgccacagctcaagagttaagcacacttaatcctcatcctgaaaattctaagatagtccttttgatgggttccaatgcccaaaatgacccttcctcacccttaaatccttatattagaacgattattaaaaatcgccgcgactatgcagaacgtcatggttttaagtttgaatttttagatttagatgagtacaaaccttcaattggcgacaagcctgccccttgggctaaaattcccatgattaaaaatgtgattagaaaatatccagatgctgaatgggtatggtggttggatcacgatgctttaattatgaatcgtgatttgaatctggttgatcacattttgaagcatgaaaagctaaattctcttttattgcgcgacaccgaatattttagtggatttggcattgactctgaaggattccgaacacctaaaaatcaagaccctgatgatatacattttatcattgctcaagattttaatggcattaatgctggcagttttttaataaggaattctgaagtaggaacatggatgctggatttttggaatgaaccactttataaagaacataatggtgtatttgtcgaacaacaagccctttctcatatgatatatagtcatcccattgtgcataaacatgttgggctagttactcttcgttcaataaacgcatatgattcttctgatcctgcttggggatatgaagacggtgatttatgtgttcattttgctgggtgctttgtctttcagacatgtgcacaaaattttgaaaagtatggcaagattatcacagaaaagcaaggccatgattggttcgatccatccgaaaaggaatatattgaacaacgccttttccctcaacct

SEQ ID NO: 46302 - DNA, 3999 bp, Schizosaccharomyces pombe; identical to SEQ ID NO: 25982

SEQ ID NO: 46303 - DNA, 3849 bp, Schizosaccharomyces pombe
atgctagtgtttacagatcttatttttctcgctatctttgctcatattgggaaggctactgcaaaagtatggaacagaaatgtacaaggatttcttgatttaaacttgccaaatgaatgttcacaatacacaacaatttacagtgacggccctagtgaatatacttcaacgttgccatacacgcactcctttagcaacgcaagtgtatatactaccttaattactataacaaacagtcaatgcaccggaaactactcaacattgacaatatcatcacaacctttaatacatactaatacttccatttccaagccttcgcaaacagctacaccacaaaacactaataccacacaagtctccttaaccaatggaacgacaaccaacagttattctaacacaaactccctgccaattacagatactatcaatggaactactgaattaattattccaacaactagctacaacaaccaaagccatactcttatttacagtacctacacctccacctacctccccaattctacaattgacttatctattctaccacactcaacaataagcactctaagtacagtctccataaatgatactagcgcgtcattgtcaaaaacaacttcacccactgctggaactattactgagacgattgtttctggttctgttggatatacttccacgtttcctgctagtggaactacctctggcactgtagaggtggttgaacccactgctggaactatcactgagactattgtttctggttctgttggatatacttcgacattcccagctaatggaactacctctggtaccgtggaagtagttgaacccactgctggaactatcactgagactattgtttctggttctgttggatatacttcgacattcccagctaatggaactacctctggtaccgtggaagtagttgaacccactgctggaactatcactgagactattgtttctggttctgttggatatacttcgacattcccagctaatggaactacctctggcactgtagaggtggttgaacccactgctggaactgttactgagaccattgtttctggttctgttggatatacttccacgttccctgctagtggaactacctctggcactgtagaggtggttgaacccactgctggaactatcactgagaccatagtgtcaggttctaaagcatttacttccacattcccagctaatggaactacctctggtaccgtggaagtagtcgaacccactgctggaactattacaaagaccattgtttctggttctaaaacttttacttccacattcccagctaatggaactacctctggtaccgtggaagtagttgaacccactgctggaactattacagagaccattgtttctggttctgttggatatacttcgacattcccagctaatggaactacctctggtaccgtggaagtagttgaacccactgctggaactattacagagaccattgtttctggttctaaaacttttacttccacgttccctgctagtggaactacctctggcactgtagaggtggttgaacccactgctggaactatcactgagaccatagtgtcaggttctaaagcatttacttccacattcccagctaatggaactacctctggtaccgtggaagtagttgaacccactgctggaactattacagagaccattgtttctggttctgttggatatacttccacgttccctgctagtggaactacctctggcactgtagaggtggttgaacccactgctggaactgttactgagaccattgtttctggttctgttggatatacttccacgttccctgctagtggaactacctctggcactgtagaggtggttgaacccactgctggaactgttactgagaccattgtttctggttctgttggatatacttccacgttccctgctagtggaactacctctggcactgtagaggtggttgaacccactgctggaactatcactgagaccatagtgtcaggttctaaagcatttacttccacattcccagctaatggaactacctctggtaccgtggaagtagtcgaacccactgctggaactattacagagaccattgtttctggttctaaaacttttacttccacattcccagctaatggaactacctctggtaccgtggaagtagttgaacccactgctggaactattacagagaccattgtttctggttctgttggatatacttccacgttccctgctagtgggactacctctggcaccgtggaagtagttgaacccactgcgggaaccgttactgagactgttatttcggggtcagtttcttttatgtcaacgattactgctcatgacacttcgtctggtgctgtcatagttgttgaacccactgctggtaccgtcacagagactattgtttccggatctattccgtttacctcgactatccctgctcaaggtacgacatcaggaactgttgaggtggttgaacctaccgctggtaccgttactgagaccataatatcaggttctgttgggtatacttccacattccctgctcaaggtacaacatcaggaactgttgaggtggttgaacctaccgctggtaccgttactgagaccataatatcaggttctgttgggtatacttccacattccctgctcaaggtacaacatcaggaactgttgagattgttgcacctaccgctggtaccgtcacagagactattgtttccggatctattccgtttacctcgactatccctgctcaaggtacgacatcaggaactgttgaggtggttgaacctaccgctggtaccgttactgagactataatatcaggttctgttgggtatacttccacattccctgctcaaggtacaacatcaggaactgttgagattgttgcacctaccgctggtaccgtcacagagactattgtttccggatctattccgtttacctcgactatccctgctcaaggtacgacatcaggaactgttgaggtggttgaacctaccgctggtaccgttactgagaccataatatcaggttctgttgggtatacttccacattccctgctcaaggtacaacatcaggaactgttgaggtggttgaacctaccgctggtaccgtcacagagactattgtttccggatctattccgtttacctcgactatccctgctcaaggtacgacctcaggaactgttgagatcgtagtacctactgctggtacggtaacttcgactacgggttctggtacttcttggtttactactactgttcccgctactggtacgagatctggaagcgtaattgttgtttctccaactgctcctgcttgttcttctactccgtttgctgagtgtccaaatctaaattttaattttcattctaaaaatgtgaactttcctcccgctgacattagggtaattagtgtcacaccgaagggtaacaatatgtacgatgctacagttcagttcactacttcttcgactatgtcgaaaaaatcattgagtgaattaaagatattgggattatctcaaacctatctcttgtactcatacaactctaaagtggacaacatttctaatcctggcagctggacttcaacggtaactgttcaaggtacaagcacaggtagctatatttgcatgcctcatttccaaattcagtatgattggtgtagtgctggtgttactgacatgtctgaatgtaatacatggagctatcaaaaatcctatgattatattaccgggtgcaataattacgataatcaaggcaattcccaaacggatgcttctgactattgttggaatgtttgt

SEQ ID NO: 46304 - DNA, 1596 bp, Schizosaccharomyces pombe
aataagctactctttaacagatttgcatcttctcagtctaaggattcaaacatcagcgaaatgaactcgaaagactcaaataccgtccctgtttacaccaccaacaccggttgtcccatttttaaccctatggctgcggctcgtgtgggtaagggaggtcctgtcttacttcaagattcccatttaatcgacgtctttcaacactttgatcgcgagcgtattcctgaacgtgtcgtccatgcaaagggttccggtgcttttggtgaattcgaatgcaccgacgacattaccaagtataccaaacataccatgttttctaaggttggtaagaaaacccctatggttgctcgtttctccaccgtcggtggtgaaaggggtactcctgatactgctcgtgatcctcgtgggttcgcattaaagttctacaccgatgaaggtattttcgatatggttggaaacaatacccctgtcttcttccttcgtgatcccgctaaattccctctcttcatccatactcagaagcgtaaccctcaaaatgatatgaaggatgctactatgttttgggattacctttctcaaaacgcagagtccatccatcaagttatgattcttttctctgacttgggtggtaccccttatagctaccgtttcatggatggcttttccagtcatacctacaaatttgttaatgataagggtgaattctactattgcaaatggcatttcattactaatcaaggaaccaagggtttaacaaatgaagaagccgctgcattggatggatccaatcccgaccatgctcgtcaagatcttttcgaagctattgaacgtggtgattaccccagttggacgctttacgttcaagttatgacccctcaggaggctgaaaaatatcgctacaacattttcgatcttactaaggtctggcctcataaggacgtaccaatgcaaagggttggacgctttaccttgaatcagaatcctaccaatttctttgcagatatcgagcaggctgggttctctccttctcatatggttcctggtattgaagtctcagcggatcctgttttgcaagtacgtacattttcctatcctgatacccaccgccatcgtttgggtgctaatttcgagcaaattcccgtcaattctcctaagtgtcctgtctttaactattctcgtgacggccctatgaatgtcaatggaaaccaaggaaattggccaaactatccatcctcaatccgaccacttgctaaagttcaatatgagcctgacgaaggtcacgaaaagtgggtaggtcaagttacttaccatatggacgaaattaccgacgttgattttgagcaacctagagcgttttggcaaaatgttttgggcaagaaacctggacagcaagataactttgttaagaacgttgccggtcacttgtctggtgctatatctcctgtacgtgaacgccaatacggtgtatttactcgtgttgattcagagcttggtcgccgtattcgtgaggctactgaagctgaagtgaagaagatggaagaaaaagcccccaagccaattaacaagggcgaaccccatatgttccaaggaagctca

SEQ ID NO: 46305 - DNA, 1153 bp, Schizosaccharomyces pombe
atgtgtcctttatttaaaacctatttgctgtacatattaaaaatctgttcgataccttgtttagcatacgttgtaaatttcttggtgtgcttcgtactttttaccaacattaaattggacgtccgaaagatggcaaaaaggcacgcagaagagaatgaagatactgttatgtctgaaagcctgaaagtagtagacacggactttattaatgtaggtaagtattgatgaaactaatggagtattgacatatattaactttttatattagattttgaattctttgaccctcaacccattgactttcatgcctttaagaacttgttaaagcaattattaggttatgaccatacaaatgttaatcttagtgctttggctgatttgatacttagtcagcctttgcttggttcaactgtaaaagttgatggtaacaattctgatccttatgcaatgctttctgttatcaatttgaatacaagaagggtatgaaataatagtttttattttttttgaatttgcaagcccatacaaggtggtgatgcatctgcaatgttttacactcgagtgcaaatttttggaatctttagctaacggtacttattaggatgagccagtgattaagcaattaacctcatacatcatttctcgactagccaaatcgaattcgagactcgagaacgagttacagaaactactggaaccaaattctggctcccaagttggtctcatagtgaatgaacgtctgataaacatgcctgtccaagtaatcccccctatgtataacatgcttttagaggaaatgcaatgggccatcaatgaaaacgaaccctacaactttactcactatttgctgctttcacggacttatactgaaattgaatcaaagttaatggatgatgagcgtccttccaaaaaaggtaaaaagagtaaaaagacatctggtgaggaagttatgtttttccatcccgaggatgaacagtttcgcgaagttgctattgatattgccgattatccctttgcaaaccaggattttaatccggatgccaatcgagtatttcaagatgcaggaatcaagccccagggagagctgttgcttatgacaaatgaggatttcaaaaatttggttcccaagctgatggaaatttacagcgcttga

SEQ ID NO: 46306 - DNA, 1278 bp, Schizosaccharomyces pombe
atgaagtcgtttacaagaaatttaagaagatttcagaccccgagacgaaatttgcatggaatctcttatacaccaaaaaaagtggaaggagtttcgtttgccgggcgcgagacacctactgcgacaggttctttatccgttgtgattaacgccggaagccgttatcaaccagatgctggtgtttcgcaccttttggagaagtttgcatttaaaactacggaagagcgttctgctttacggattactcgagaatctgaacttttaggaggacagttatcaactcaaatcactcgtgagcacatcatattaacagctcgttttttgaatgaatatctcgaatattatgccagattgttggctgaagtcgttgatgccaccaaattccttcctttccagttaacagaagaagttttaccgaccgctcgcattgagtctgaactgtttagggaagacatccttagggtcgccatggccaagcttcacgaaaaggctttccaccgtggcattggaaacgaagtttaccttcctgcttctgccagcccttctatctctgaaataaaagattttgcttcaaaggcttatgttaagtctaacttttccgttatttcctctggtcccgacgttcagaaggcttctgacctgtgtgctaagtattttgccgtaattcccgatggcagtcctttgaagtcagcacccacaaagatttcttctggggaatcacgtgtttattccaaaggaaccaattatttctgtttaggatttccagctcccgctgcttctcctgagctttttgtgttgtcttctatacttggaggagatgctgccgtgaaatggtctcatggaaacactctccttgctaaggctgctggaactgcttctgaatacaaagccacagctgttgctgatctcactccttattcggatgccagtttgctatcggtcgttatttctggcagttgtccaaaagctattaaagctactgcctctgaatctttcaaggcccttaaatcattatcttctaatatccccaatgatgttgttaaaagtggcattgcaatggctaagactaagtacttgtctgcttttgaacctgttactttgaacgccatatctgcttcatctttagtttctgcttcaaaaggatctgatgcctttattagtggtttcgacaaggttacccccgcatccatctctaaggtggtttcatctttattagccaaacctgctagtacagttgctgtgggtaaccttgacgtgctcccttactacgatgagctt

SEQ ID NO: 46307 - DNA, 2889 bp, Schizosaccharomyces pombe
atgcatatatctactctaaaagtggaccaattacaaaatgaagctgtagatattaattcaaacgatacaattgattccataaattggaaaaatactcgcaataaccatactactcaggcgtctcttcaagcagacaataatgatgagcaaagtaatgggcaggctccattttctactacttattcagagataaataacattcatgatgtaccaggcaatcaagatgaatggtcatcttctcccattgcgggcattattgtagaaagtgaagatgaggaagtggttgaaaacaatttacattcacaaatggggacgtcatgtaataaaataaactcgaatagtaataagggaaaagaaaatatgcattttgttctagatgataatggtgattcaaaggggaatgcttcaaatcaacaagtcgagcgtgacgacaagttagatatggagacaacgcgctggaacggaaaagagtttgaagaacctctgtcaacaaacaaaaaattgattatccagtcaaacaacacctcatctcaacattcgacacccccattatccatttctgataccagtacacacaccggtagcagcacagacaatgtagaagcaaatcccaatacaggtttttctagtgccagaaaacgttcattaaggtcctcgaatttgaaaaaaaagtttgtgccattgtcatctccagaagaatctaatgaatccgaatttattgatgatgatgaaagtgatgaagttgctagcataattgatatcaaagaggatgaaacttttgatagtaaagtagaaattccagaagctgctccaagttcttctacggaaagtgatgaagagtcaatccctttaagttaccagtccaaacgaaggagggtatccgctagggcttcttcttccgcgtcctcttcctctagaacacaagcaaaatcaattccatcacatgaaagaacccattatcgtctgattcgacaacatcctgaactagaacatgtttgggagaaattggaagaagaagcacctcgtgaagtgaaacagatcgagcaacccaaagagttggtcctaaaccttctcccttttcaacgagaaggtgtatattggttaaaacgacaagaagattcctcttttggtggaggaatcttggccgatgaaatgggtatgggtaagactattcaaacaattgcgttgttgctttcagaacctcgaggtaagccaaccttggttgttgctccggttgtagcaattatgcaatggaaagaagagattgatacacataccaataaagcactgagtacatatctttattatggccaggctcgtgatatttcaggagaagagctttcgagctatgatgttgtactaacgagttacaatgtaattgaatcagtttacaggaaggaacgcagcggattcagaaggaaaaacggtgttgtaaaagaaaagtcattacttcatcaaatggagttttaccgaattatacttgatgaggcccatggtatcaaatcaaggacttgtaacactgccagagctgtttgtggcttaagaacgacaagaaagatatgtctttcaggaacacctttgcaaaaccgtattggagaattattttcacttcttcggttcctacgggcagatccttttgcttactactattgcttgcaatgtgaatgtaaatctctgcactggagattttccgatagaagtaattgcgacgaatgcggccataaaccaatgagtcatacttgctattttaacgctgaaatgctaaaaccaatacaaaagtttggatacgaaggtccaggaaagctagcttttaaaaaggtgcattctttattaaaacacattatgttacgtcgaacaaaattagagagggctgatgaccttggattacctcctcgagtcgttgaagtgaggaaagatttattcaacgaagaagaggaagatgtataccaatctttatatatggattcaaaaagaaaatttaatacatatcttgctgaaggtgtcgttttgaataattatgcaaacattttccagctaattacacgaatgcgccaaatggcagatcatcctgacctggtgttagctagcaaacgaaaaacagttgatattgaaaatcaggaaaatatcgtctgtaagatttgtgacgaagtcgctcaagatgctatagaatcacgttgccatcacacattttgtcgactctgcgttacggaatatatcaatgcagctggtgatggagaaaatgtcaactgtccaagttgtttcattcccttaagcatagatcttagtgcccctgctttagaagatttttctgaagagaagtttaagaatgcatcgattttgaatagaattgatatgaatagttggcgttcatctacaaaaattgaagcattagttgaggagctttacttacttcgtaagaaggaccgaacactgaagtcgattgttttctctcaatttacttctatgttagatctcattcattggcgacttcgaaaagccgggtttaattgtgtaaagctagatggtggtatgacccccaaagcgagagcagctactattgaggctttcagtaacgatattaatattaccatttttctagtttcgttgaaagcaggtggtgttgctttgaaccttacagaggcatctcaagtgtttatgatggatccttggtggaatggagctgtacagtggcaggcaatggatcgaattcatcgtattggacaaaaaaggccgataaaagtaattaccctgtgtattgaaaattccattgaaagcaaaattattgaactacaagaaaagaaagctcagatgatacatgcaaccatagatcaagacgaaaaggctttgaaccagctttctgtcgaggatatgcaattcttgttctcaaat

SEQ ID NO: 46308 - DNA, 1737 bp, Schizosaccharomyces pombe
atgtcaagtggaagtcgggtgagagggccaaattctgctttaacagaatttttaagagtatgtgatgactctttcttagctcggagttactaatgcattattcagtctcaaggtatcaatgcttcagcattaggacgtgctcgtcctcctcgtcaaagcgaggagtcagcagggcaatcgactgggacagaatcagaagttattcaaacaccgacttctgttgaagaaaacaacgaagatgaaaactcgatgtcgacaacgacaattgagataccagtagtgaaacgacgaaatctacgaaatcaaaaaaagaagaagaaaacggatgaagaagctgaagacaacgaggacactttttcaatgaattcaagagctgggttttcttataaagcaagggagcatacgggcaaactagatttttgcgcacactgtaattgtcgctttacaataaccccatacagcaaatacagcaattcagagaaagggtggctatgttatccttgtagtcgtggtgctgaagatcgatcggtacctgaattaaggacgagaaaaagaaaagcattgacccgtaaaaaggtggctgccgctaccatggacgaagaaatcagtgttcctaagcttcaggatttgtgtatacgagttattgctgaatacataaatgatatcgaagcttttggggatattggccaagtgaatatggacaaaattagccaaataatttcaaaaaaccgctctcttaacgatactactgtgaaattattcttaagtgggggtcaaactgaattaaaactatatgattgctcaaagattacagcagattcacttttccaaattgctcaatactgcccaaatcttcaaactttgcatcttacttattgtggtcaaatgcaggatcaagttttacacttttatgcggatcatttgactgaattaacagatgtatcttttcaaggtgcctttttggtttcttcctcagaatggataaatttttttaaaaaacggggttcaaagcttataagtttagagcttacggatactgcccgaattcatgtttcggttatcaacgctatagttgactgttgcccaaatttgattagccttaatctctctagaattttctatcttgatgatgaatgcgtccgtctattagctggttgtagaaatcttgtcagtttgaagattgaatcaccaggcggcatcattaatgatggaagtatattagatgtactaaaccaaattggaagcggtttgcatactcttagtttatctggttgtacaaaattaactgatgaagttttgaaacaaggtataggtccttgttgtggtcgtcttaagcatctaaatttaagtggtttggaactgttaacagatgatgaggcctctatagtttttggtgaatggaagattcagtcaggcttagaaacattgtccttaagaaggtgtctgtcacttggagataaaactgttcgtgcagtattggttaattcagggcatacgcttcgcactctggatttaaatggaatgtcgtttgtgactgatgaagcattacagtatattgtcaattttccattacctatgctaaaagcacttgatgtcagctggattcgtggaatgaatgacaaattggtatgcgattttgaaagcaaaaagccaacgcttgagaagcttttggtatggggagataatcatgtcctgatgccctcaaatcggttacttctgatagggcgtgaagttcaa

SEQ ID NO: 46309 - DNA, 1737 bp, Schizosaccharomyces pombe; identical to SEQ ID NO: 46308

SEQ ID NO: 46310 - DNA, 540 bp, Schizosaccharomyces pombe
atgttcgcaactcgctcattctgcctaagctcttctttattccgtccggctgctcaactgttgcgccctgctggccgctctactttacgaaatgtttggagacgctctattgcaaccgaacatttgacccagacggaggctaattctcgtcttgcttcccagcgtgttcaccgtccaaattctcctcatttgactatctatgaacctcaattgacttggtatctatccagtttacatcgtatcactggttgtgttgtcgccggtactctttatgctttcgctatgggctacttggtggctcctctcgctggatactctttggatacagctaccatttctggtcttattcagcaagttcccacctggatcaaagttcctgctaagtttgttatttcttatcctttgactttccacatttttaacggtattcgtcacttgatctgggataccaccaaggagttaagtctaaagggtgtctatcgtaccggttatgctgttcttgccctttccgttttgacctctggctattttgcgatgatt

SEQ ID NO: 46311 - DNA, 1152 bp, Schizosaccharomyces pombe
atggtgttacctcaaaatgtaaacaacaacgctcctacttctggacgaacttgtcaaaagccaacatcagcgtttttttacgaaataatgtcagattcaaagttggcagattctttgaattgcctttctgtgtcaactccatcaaccacagctaatcctgggagacaacagcttttacgacttgcagtatcaaaccaacgacaagtaaataatgttagtctagcaaatgggaaggaaaacaaacggacttcaaatagcaagttcaattcttcccttcgtaagatagaagagccaattgctggagtaccttcatcagctggtcctcaatggcgagaatttcatattggaatgtttgaaattggaaaacccttagggaaaggaaagtttggaagggtatatctagctaaagagaagaagaccgggtttattgtggctctcaaaacattgcataagtctgaacttgtccagtcaaagatagaaaagcaagttcgacgagaaattgagattcaatcaaatcttcgccataaaaacattttacggctatatgggcactttcatgatgaaaaaaggatttatttgattttagagtttgctggcaggggtgagttgtatcaacacttgcgtcgtgcaaaacgattctcagaagaagttgcgtctaaatatatcttccaaatggctaacgccttatcctacttgcataagaagcatgtaatacaccgtgatatcaaacctgagaacattttattaggaattgatggagaaatcaagctttctgactttggttggagtgtccatgcaccttctaaccgtcgtaccactttatgtggtacattagattacttaccacctgaaatggtggagggaaaagagcataccgaaaaagttgatctctggtcgttgggtgtcttaacttatgagtttttggtgggagcaccgccttttgaggacatgtctggtcattcagctacgtataagcgtatcgccaaagttgacttaaaaattccaagctttgttcctcctgatgcacgggatcttatttctcgtctattacagcataatcctgaaaaaagaatgagtttggaacaagttatgaggcacccttggattgtaaaatataaagattcatggactcgcaaaagttctgaatcttcc

SEQ ID NO: 46312 - DNA, 1152 bp, Schizosaccharomyces pombe; identical to SEQ ID NO: 46311

SEQ ID NO: 46313 - DNA, 1323 bp, Schizosaccharomyces pombe
atgtcggtctcgtcttatagttctgatgcttcttccaccgttatggatgaaagtccaccgaatggcgttactaagagcgtttctggtaaaggacctacagtatgttattattgatttttaattattatattactaacagaggtgtgcaggctgttgtcatgatgaacatgggtgggccttccaatttagatgaggtaagactttaattgaagaagcgtttgtatggagtacagcctgaaaaacgcttcaacttttgttgtttttatattcatttataattactatcaacacgagaactaatgttttcaggtgggcccctttttggagcgtctattcactgatggtgatattattcctctcggttattttcaaaattcattaggaaaattcattgcgaaacgtaggacacctaaagttcaaaatcactattccgacattggtggaggaagtccaattttacattggactcgtatacaggggtcggaaatgtgcaaaatccttgataaaaaatgtccagagtccgccccacatcttccatttgtagcctttcgttatgctcctcctttgactgaagatatgttagatgaattaaagaaagcaaatgtttcgcgcgctgtcgcattcagtcaatatcctcaatggtcttgtgccacgagtggtgcttctctcaatgaattacgaagaaaacttattgaaaagggaatggaaaaagatttcgaatggtcaattgtagaccgttggcctttgcaacaaggtctcattaatgcatttgctgaaaacattgaggaaacattgaagacatatcctgaagatgttcgtgatgatgttgttatagtttttagtgctcattcattaccaatgagtcaagtagcgaaaggtgatccttatgtttatgagattgctgctactagccaagccgttatgaaacgtttaaattacaagaataaatttgtgaacgcttggcaatcaaaggttggacctttgccttggatgtctcctgcaacagactttgtaattgagcagttgggtaaccgaggacagaagaatatgattctcgttcctattgcttttacttctgatcacattgagactctgaaggagttagaagattacattgaagatgcaaagcaaaagggaattaccggagttaaacgtgtttcaagcattaatggaagtatgacagctattcaaggaatggctgacctggttgcagagcatttaaaggctaaagtaccctattctcgtcaatttacccaacgatgcccaggatgtacaagcgaatcttgtgctgaacgtattaatttctttcaagatttttaatgt

SEQ ID NO: 46314 - DNA, 2515 bp, Schizosaccharomyces pombe
atgaaagaagttagagtagtaatttgcggtgaccaaggcgtaggaaaatcttctttaatttcggctttgattcaagaagacaatgtgacgagcattcctaaggtagcttgctctcatagtataatttattgttctaatgcgctaggtatttccgattatatccataccctctaatccggattcaaatgacgatgtttctcttgttctcgtagacacgcaatgtgagaattcttagtttaactttttgtggatattttttcaaagctaatatgacgacgtgtagcggatagcaatgaaagagaatatttagcagcagaaataaaaaaggcaaatgtgatttgcttagtctattctgataactattcttatgaacgagttagtatcttttggttgccatactttcgatctcttggagtcaatgtaagttaatcacattcgatttagcttgttttactaatataattgaggttccaattgttctttgcgaaaataaatcagaggatctggacaactatcagggacttcatacaattgaacatgaaatgatccctttaataaatgagttcaaggagatcgaagcatgcattctatgtagtgccctcgagaaaataaacgtgaacgaggtacgtgatttgttataaataattcaatttacttgtgttgtaactaacaataaaaagttgttttacatgtgccgtgcatgtgtaatttacccaatcactcctttatgggatgcaaaagaacgtgtatgtagctacatatgaaaaattaaacctaataatcttactagacaatgagaaaagctacaattcatgctctgagtaggatcttctgtacgtatacaattcgtgtgcttcattatgtaaatttttactaactagccagttttaattgataaaaataacgatgatttactctctgttgatgaacttaattcactttccgaaaaatgcttttcgaaaaacctaagtatcgaagatgcatcagaaattttatcgaaagtcaaggaaatatgccctgagggcgtttatgaaggacagttgactttgcctgggtttttagcttataatcgtgtacaagttgaaaatggtaaacaagaaagtacatggggaatccttcgagcttttcattacacagatagccttagtctggacgattcatatttgagccctaaattcgaggtcgcaccaggacagatcgttgagctgagtccgaagggtaagcaataatttttttttattttattaatgtaaaatgcaattaggttatagatttttggtagatctcttttatcaattcgatagagataatgatggtgccttgaacaatgaggaactttcagccttgtttcgccataccccaggtcttccggaaatttgggtgagctctcagttcccaaattctactgttctcaacgaacacggatatgttacttataacggatggcttgctcagtggagtatgatcactctttttgattataaaacaacattggcttatttggcgtaccttgggtttgacactgatggacgtggtcataatacggacgctttaaaagttatgcgtaagcgagtttctcaaaatcgaaaagtttcgaaatatgatagaaatgtctttctctgcttcgttgtaggttcgaaaagttgtggaaaggtgagttatctatacatttctgtaaattcactatatctaacttaacattcatctagactgctttgctctcaagttttataaacaataacacaaatcggttaaccccaaacactgtcgttaatagtgttgaattccaaagcacacaaagatatttggtggtatgggatatatttatttaatactttttaaccttttttgtcccagctctccgaaattggtgaaactgatctagatattctggcagaaccaaagtcacttgaagcctgcgatattttgtgtcttctatacgattcatcaaaccctaatagtttttcttttatagcaaacttattggtaagacatcaatttttgtttctgtctaatctgttctctcttagaatttatacccggatcttcaaaagattccctgcgttttcgctgctaccaaggccgacctggacagacagcaacaagtaagttatataaaatttaaaaagtgtttagttaacaagttatgtcgtagagatacccagtccaaccagatgagtttactaaacagttggggttaccctcacctacccatataagtactgcagccatttggaacacctcaaaagaattttttattcaggtgagcatacataaatcatacacattttatttaacaaatcatttttagctggctgaatctgcccagtatccagcttcctctattatccgcattcctgaagaagattctaataagacaaattaccagctcgttgccgcgcttaccgctttcggtgctctactattatctgttggcggaagtctgacatggaagataataaaacaccaatattactcgaaaaaataatgcatttatgaatttagtctaataact

SEQ ID NO: 46315 - DNA, 3852 bp, Schizosaccharomyces pombe
atgcttccttacaattcaaattacttatcggacaacgggaaacgaaagttttccgacgaaaatcctcaatcggaagtttatggttcttcgcaaacaggtttgccttcttcatacggaaatcctcaaagctatggtacgccccctgtccaacagtcttccgctatgtacggggtgaataattccatgggtggtggaatgtataatacttctgagaacactcaatttatgaatactgattattcgcaaacttcttcgtatgcgtcgactccaatgtccaatgcttattccagagatgctcccgctgcaatcaacaacaattttggttattcatacgtgggacaatcatcgcagccagtcccttcttataaccccctgccctcttacaatactgcgtctttgcccaatgctggaattcccgcagcaatgcctggtatgccatctggttatccaggcactgttccaatacctcagggtggttataatgcacattatagttccccttataataacggctatcctatcggtgctgtcaatcctacatcggcaatacccgcgcagcctccagcacaacccgtcaataatgttttacccagctacgttcgttcaaactcgcgctcatctgcacgctccacagcgcgttctgctccacgctctactcagcgatctcgttcctcctccgcaaatcccgtgactaccccaccagtcaacaataccttgcttacacctcccgctccacctgtcgagcttcctcctgtaaccactacttctcctaatgctattattcgttctgttcaatggatacgctcatttgttccccaggctccgattcaccaggtgatcaacacacttgctcaaactaagtgggatgagactgcagcactttctattttatctcaaaaatatttgagttgtgaccttggtattccaatacaagagcataaaaggtttaagcaaagtcccgttgctagcaatatgcctacttatggaagctctaaccgtacggttcaatcccaaaagcgctcgattcgggacaaatatatacaaatgccaaatgattctacgcaagcttcccttatgccttcttataccagaaaaactagcaatgcatcaaagaaacttactactgaagaagatgaattttatgactcagaagaagagcctgaagccatagttcacagggatacatcggcgttagagagaactgtactcaattttataaacagcagtactgctaaggaactctctgatactgctagttgccctttgtcccactcgaaactccttttagagcatcgtcctttccagacacttgccgaagcttgtatcatcaaacatcctgatgacgttcctagcaaacctggtagacgtggaaggcgtcgtgaaaaaaatcctatgggccaaaaaatcgtcaatgcttgtatggaaaccatggaaggatattatgcaattgataatctaattgccaaatgcgagtttcttggtaatcgtatatctaaaggtatggcctcgtggggaattaaattagaaatgtctaatggtgaactgaacatcgttgacatggagtcggttcctaccgaggcagcggataacagtgatttccctaaatttgttacagagcaacccaaaactcttgcaagtgacgtccagcttaaaagttatcaactcgttggcgttaattggttacatttgctttatcaacagaaactgtcagggattttggctgatgagatgggtcttggaaaaacttgccaagtagtcgccttttttgcacttcttctggaacaaggacaccacggacctcatttagttgtagtcccttcttcaacgcttgaaaattggcttagggaacttgcccggttttgccctagcctccgcgtggaaccttactacggaagtcaacaagagcgagcaaatattcgcgaagcaatagaagaaaacgaaataaagtatgacattttggttactacttatcagttagctacgaacaacaaagaggaccgatcttttcttaaacatcaaaactttgatgtctgcgtttacgacgaaggtcattatttgaaaaatagaatgtcggagcgttacaaacatctcatgaaccttaacgctaactttagactgctgctgactggtactcctttacaaaacaatctcaaagaattagtttccttgctcgctttcattcttcctaatatgtttgacagtgacatggacgatttggatgtaatttttaaagctaaaccaaccgcagatgcggatatagaacaagccttactttctaagcaacgtattagccgtgccaagactatgatgactccgtttgtccttcgccgtcggaaaaaccaagttcttaatgatttgccaaaaaagactcagattattgaacattgtaagttatcagaaaaccagttggaaatttacaatcgatatgctgctttgcaaaaaaatcaacaacttcggagagacgataaacgaaacaagcgtagtaagaacgatgaagaaagcgatggcaagtcattatcggccggtcatgttctcatgcagcttcgcaaagctgcaaatcatgccttactttttcgcaaattttatgacgatgagaagttaaagcaaatggctaaggatataatgcaagaggaacaatataaaaatgccaatgaacaatatatatatgaagatatggaagttatgtctgactttgaattgcatcgactttgccgcagtttccctacgctgcagtcatatacgttgaaggatgatccctggatggattcaggtaaaattcgagtgttgaaagaattacttcctaaaatgaaagaagaaggaagcaggatccttttgtttagtcagtttactcagatgctcgatattttggaacaggtgctggatactttgaaaatatcatatgttcgattggatggttcaacacaagttgaagtacgtcaggatattatagatcaatttcacaaagaggaagatgttactgtattccttctttcaacaaaagctggcggttttggaattaatttagcgtgtgcaaatgtggtgatattgtatgactgctcttataatccattcgatgatttgcaggctgaagaccgtgctcatcgtgttggacaagtccgtgaggtaacggtaattcggttaatcaccgataatacgattgaagaatatattcaaaaattagcgaacaccaaacttgcgcttgacatgagcttaagctctgatggtaaggatagagaagaaattggcgaacgtcttgtgcaagacatgcttgacgaagaaaataatggcaacaatacaaaacctgaaattacgggaaacgagagtgatggagagttcaaggtcagcagcagtaataattccaaacaaacggatgcggaggagactaatacaggagttcccttagagggttctcaaccgaactctgtggagaaaactgacttggctgacggggacgaaaaggctaacataaaaactgagatgaagagtgagactgtagagggtgataataaggaacttcgagaaaccatgaagggcgaaaatgttcaaacggattctaatgctgctgtaccgtcgtcaaaatcttcaaccgaagaaccaaacgaatctgtacttagcggccatttagatttagacaccgaggcgtcacctgtcgtaagcacaatagaaaaaactaccaagggcgatgtttccgttacggaagagcaacagtccgctaatatcgacggtcaattggagaaacccgaaattgaggaaagtaaaaagcctgatgtcttgaatcaagtttccttgtctattgaagaagaaaaaccaaaaaataaagaatcggaggttgacaataatgctgctaaagac

SEQ ID NO: 46316 - DNA, 2322 bp, Schizosaccharomyces pombe
gattttcatcgattatctactcatattgagcgatttgaacgcgagcaagcgtctcttaatatgcatgtgaaaacggagctcgaaaagcacgtggaagccgttgaggttagcacaaatattaaattaatgcgataattgtaattgatctaacttacgtctttagttggggaaattggcactgcatgatgctcaaacgaaaagagtgaagcttcttcaggaattgcataacgtgagtaaagtcgaagcttaagctttcttgacattttctaaaagacttttttactaatgttgatttttttttagatgttgactttatgtgagagtgcacgcgagatggtcgatgaatttccgttaatcagtcgcatgtctcggatatacaaaaattgttatgcaacaaaacaaatgatatcgcagttaaataatttagtcaaggagacagatgtaatagaagacatgttgcgtgaagatttagaacttgactctgatatgccaaatttgttacgcgcccattataaactttctaagcttcgagaattccgtgaagaagccctataccaggcatcccttgaaggccaaagtgatcttccaattaccctagagaattctttttctaatttaaacactctatctgataatttcgatcggttggttttgaatttttgccgtaacattttccaactcgtcaaaagtggccatataaaaaccattgttcaaattttcaaaattgtcgaggctgaagaatcttctgatgaagtgttgaaaagtatacgcgatgctaaatccagcctaccggactcccaagatggtccttttctaagtctgcaagggatgacccgtcagctacgaaactttcgtctacgtgttcttgaagagtttcaaggtgctgccgctgaaaactttcaacgtgcatgggtttcttaccttgaggacggtagcggtgaattgaacttagatttcatctttgaagatttaaaagttgcattttacgttttacctgatcttaccccgccctcgtataatatcgctaaaacatttgcttccatttatcaagagtgtcttgttggccttgtaactaaagcagtctcactagatactccggctgccgtttatttatatttaatcaactttcatagagagtaccggaaatttttcgaagaaaatgctcctttttcggtcgatgaggtggaacctggtcttgaagatggaaaagacggaattttagtaagagaatatacccgactttttactcaaaaaatacgagaatggtctgataaactgttccagagcagcgttgacacatttatgaaacgtgaaagtgaacctgaactagatagtgatggaaactatggtcttcaaggtactatcatctttttccaaatgattactcaacaaatcaatattatttctcatactaataattctgacgtcgtcggcatcgtgttaagttcaattatgtatattatgcaatctatgcaggatcaatggaaatcagttatgcgctccgaactttcacagcaattatctggcaacccggaatcagttcccccaggattaatggagtacttacttgcagtagctaatgataatttaaagtgtgctggctttatggataacactttgctcaacacctttgaactgattaccagtgaacgagaggaagatttaagagaagcatttggcaaaaccgttgatgggtatatattaattagcgatattggcgtcagccagattgtcgccattataagtaacgacgttaagcccgctctcacttcactttttcaaccaaactggtatcaatctagcaatatgaagcttattgttgacacctttagggattatatcgttgattgtatcgaacatatggttcccggtttattcgatgtctttttattggaagcttcaaatgcgcttaccatcagttatttacgaagtatatttaacaagaatgcatgtttcgatggagataatgctatacaacaaattcgttctgatattgctttagctataagggtgtttggagaatacatggctgcggaacatttgcgatctacgtttgagcccattgaaaaattactattgggaatgttagacgccgatgtggaaactgtctccgaatactttcatttgctgaaagaagcatactgggatgcacctttgtccttggttgaagcagtccttcaaaaccgcaccgacctggaaaaatcaataataaagaagatgattgatattgtacgccatgaaaatgattcactccaaatagacacttcgcaacaaccgacagtattttcccaagtcacgtctctttctggaagttcaatttta

SEQ ID NO: 46317 - DNA, 1605 bp, Schizosaccharomyces pombe
atggcgaaaatcttaaccattgtcatgttggtcttcgtgtccatggccggatggatgttcggtgctgacacgggttccattggtggtatcactaatatgcgggactttcaatctcgatacgcagacaggtatgatcctgtcacagatacgtattcgtattcttctgctcgccaaggtcttttggttggtatggttaacactggaactactgttggatgtttactttcttcacctcttggagatcgattcggtaaacgtaagtgtatcatgggatggacattggtttacattaccggtgttatcgttcaactcaccacaattccatcttgggttcaaatgatggtagctaaaatttggactggtcttggcattggtgctttgtcagtcattgctcctggttaccaatccgaatcttctcccccccatattcgtggtgccattgtaactacttatcaattgttcattactcttggtatttttattgccgcctgtatcaacatgggtactcacaaatacaccactcatcctgaagctcaatggcgtgttcccatcggtattaacttactttggggtattctcatgttctttggaatgcttttcctccctgaatccccacgttaccttgcagttaaaggaagaaatgaagaatgtatgaaaattcttactcgtaatgctggcctcccagccgatcatcccatcatgcaaaaagaatacaatgccattcaagctgacgttgaggcagaattggctggtggtccttgctcctggcctcagatctttagcaacgaaattcgttacagaacacttttgggaatgggtgtcatggcattccaacaattgaccggtaacaattacttcttctactatggtactcaggtattccgcggtactggcttgaactcccccttcctcgcagctttgattcttgatgctgtcaactttggatgtacgtttggtgctatctttgttcttgaatactttggtcgtcgtggtcccctcatcgttggtggtgtttggcaatctatttgtttctttatttatgcttctgtaggtgatcgtgcacttacccgccccaatggtacttcgaatcatcgtgctggtgccgttatgattgtgttctcatgtcttttcattttcagttttgctcaaacttgggctcctgccgcatacgttatcgttggtgaatcgtatcccattcgttatcgttccaagtgtgctgccgtcgctactgctagcaactggttctggaactttatgatttccttcttcactccctttattagcaactcaattggtttcaagtatggttatgtgtttgcagcttgcaacttgtgtgccgctattattattttcctattcgccaaggaaaccaaaggtcttaccttggaagagattaaccaactttatttgtcgaatattaagccctggaacactggtgcttaccagcgtgatcgggaagatattaagcaaagcgactcagaaaaggagcgtggacctacttctaagttacatgaatacgttgagcatgctcccaactcgtatgcttcaacacactctacagagagtgagaattatcctcaacaagtcaccaatccggttggctta

SEQ ID NO: 46318 - DNA, 1638 bp, Schizosaccharomyces pombe
atgggaaaaaatttgaccattgtcatgttggtcttcgtgtccatggccggatggatgtttggcgccgataccggttccattggtggtatcaccaacatgagagatttccaatctcgtttcgcagatcggtataatccggtaacagattcgtattcgtattcttcggcgcggcaaggtctaattactggtatggttaacgttggttctttctttggttgtttcctttcttcccctcttatggatcgcattggtaagcgtacctctattatgttttggactattgtttatttgattggtattattcttcaagttaccgctgtcccatcttgggtccaaatcatggttgctaagatttggactggtctttccattggcgccttgtctgtgcttgcccccggtttccaatctgaggttgctcccgccgatcttcgtggtaccattgtcaccacctatcaattggctgtcactggtggtattttcattgccgcttgtatcaacatgggtactcacaagttgcacaagactgctcaatggcgtgtatccatgggtattaacttgctttggggtatcatcaccttcatcggtatttctttccttcctgaatcccctcgttatttgatctctgttggtagagatgaagaggctcttcaaattatggccaagaacaacgatcttcctatcgaacacgaagttatccaaacggaataccatgttattaagtctgattgtgaagctgaattggctggtggtcccgctacttggcccgaaatttttggtcccgacattcgttatcgtaccttccttggtcttggtgtcatgtctcttcaacaacttaccggtgataactactacttctactatggtttcgaggtgtttgagggtactggtatgaactctccttatctttctgctttgattcttgatgccgttaactttggatgtacgtttggtggtcttttcgtcctagagttctttggtcgtcgtatgccattgattattggtgctctttggcaatccattactttcttcatttacgcagctgttggtaatcgtgctcttactcgtaagaatggtacctcaaaccatcgtgccggtgccgttatgattgtgttctcatgtcttttcattttcagttttgctcaaacttggggtcctgccgcatacgttatcgttggtgaatcgtatcccattcgttatcgttccaagtgtgctgccgtcgctaccactggtaactggttgtggggtttccttatttcctttttcactcccttcattaccaactccattggattcaagtatggttacattttcgctgcttgtaacttgtgtgctgcttgtattattttcttgtttgctcatgaaaccaaaggtcttaccttggaagagattaacgaactatatatctctggtgctaagccctggatgcctagacctaagaaccttggtaacttcaccaagcaacaagaagaggttcgtgaaaaatcccgtggtgttcaaggcgaaagtgccgctcatcttgaaaacgttgacggtgaggaaggtattgaggactctagcaatgacattagttccacaacatcttcggatggccgtgccaagcccgaatctagctaccacgatcaggaagaacaattcgca

SEQ ID NO: 46319 - DNA, 1425 bp, Schizosaccharomyces pombe
atgctatccatcattgttttcggtgcatccggcgatctcgctaccaaaatgactttcccggccttgtttgccctttacgtccgcaaaattattcccgaggactttcaaatcatcggctatgcccgttccaaattgtcccaagaggccgctaacaaaatcgtcaccgcccatattcccattgacgatactgtcggtgcttctcaaaaggccttaaacacctttgtcgagcattacaagtatgtccccggtacttatgataagcccgagtcttttgagatgctaaacagcattattgctgaaaaggagactgctcccgcctccgaatgcacacgtatcttttacttggttctgcctcctcatctctttgctcccgtttccgagctaatcaagagtaaggctcatcccaatggtatggtcactcgtcttattgttgagaagcccatcggcttcgactacaagtctgccgatgccattctcagcgatctcagcaagcactggtctgccaaggatactttcaaagtcgaccatttccttggcgaggatatgattgatggattcactgcaattcgctttgcaaactccatgttcgagcccatctggaatcgtgaacacattgaaagtgttcgtgtcgactttcgtgaagactttggttgtgagggacgtggaggttattttgagggcgctggtatccttcgcgatgtcgttcaaaatcatcttttgcaactacttaccttactttgcatcgaagagccaaagtctcaagatgccgaagatatcatcaaatgcaaggttgacttcttgaaatcccttcatcccgtttccaaggaggacatcgtctatggacagtacactaaaagtgcaaatggaaaggtccccggttatcgtgaactggatggtgttgctgatgacagtgaagtttctacattctgtgctcttcaacttcgctctgaagcacctcgttggaagggtattcccatcatcatttctgccggtaaaggtttggaccgcgattactttgaagctcgtatcacttttaagcgtagggaaggaggtatgttccctaccgttgatagcagcaatgttctagtccttcgtgtttatcccaaggaattcattgccctcaagggacacattaaacaacctggtttctctcgtcaaattgttcctgtgactttggacgttaagtatcccgaagctttccctgatacatggatccataaggcctatgaagtggttattgccgatgccattaatggaaagcatacacactttattagtgatgatgaggttcgtacctcttggaaaatctttgatgatgtccttgacactacaggcgatttgtcacctcttccttatgcttttggttcccaccatggtccagatgccacactcgaatttttcaagaagcgtaatttagagtgggat

SEQ ID NO: 46320 - DNA, 1589 bp, Schizosaccharomyces pombe
atgctatcagcaaatatgcttcgtcgtatgcaccatggtgttgctgtaactagaatgctgcttgtttcgaatgggtaagtaagatagatcagtatattgatgcttctggttcatcgattaatcgtaatgaattttaaacgaaaatctaatcagtgtgcagaaaagttcaggttaaaaagtctgctctttatcctgttatggctaagctagctcgcacatacgctaccaaaagtaagtgattgcttttttggctgagaaatggctttctaacagttaccatagactatcctgctcataccgtgattaacatgcccgctttgtctccgactatgactactggcaatattggagcattccaaaagaaaattggagacaaaattgaacctggcgatgttttgtgtgagattgaaacggataaggcccagattgactttgaacaacaggacgagggctaccttgcaaaaattttgattgaaactggcactaaggatgttcctgttggcaagcccttagctgttacagtcgaaaatgaaggagacgttgccgctatggctgatttcaccattgaggattcgtctgccaaggaaccctcagctaagagcggtgaagaaaagtcggctccttctagcgagaaacaatcaaaagagacctctagcccatctaatgtttctggcgaagaacgcggtgatcgcgtttttgcttcacctctggctcgcaagttggccgaagagaaggatcttgacttatcccaaattcgcggctcaggtcccaatggacgtattattaaggtcgatattgaaaactttaaacctgtggtcgcacctaaaccttcaaatgaggctgctgctaaagctacaactcctgctgcctccgctgccgacgcagcagcacctggtgactatgaagatcttcctttaagcaacatgcgtaagatcattgcttctcgtcttgcagaaagtaaaaacatgaaccctcattactacgttacggtctcggttaacatggaaaaaatcattcgcctccgtgctgccctcaacgccatggctgatggacgctataagctttcggttaacgaccttgttatcaaagctactactgctgctttgaggcaagttcccgaagttaatgcggcttggatgggtgactttattcgtcaatataagaacgtcgatatttctatggctgttgctacaccttctggtttaatcactcctgtaattcgcaatactcatgcactcggtcttgcagaaatttccactttagctaaggattatggccaacgtgcccgtaacaacaaattgaagcctgaggaatatcaaggaggcacattcaccatctctaatttgggtatgttccctgttgatcaattcactgctatcatcaatcctcctcaagcctgtatccttgctgtgggaaccactgttgatacagttgttcctgattcaacctctgaaaagggctttaaggttgcccccataatgaaatgcactcttagttccgatcatcgtgttgttgatggtgctatggctgctcgatttaccaccgccctaaaaaagatcttggaaaatccattggagattatgctttaa

SEQ ID NO: 46321 - DNA, 1380 bp, Schizosaccharomyces pombe
atgggcaaggaaaagggacatattaacgtcgttgttatcggtcacgtcgattctggtaagtctaccaccactggtcacctgatttacaagtgcggtggtattgacaagcgtaccattgaaaaattcgagaaggaagccaccgagttgggtaagggttccttcaagtacgcctgggttttggacaagctcaaggccgagcgtgaacgtggtatcactatcgacattgccctttggaagttcgagactcccaagtacaatgttactgtcattgatgcccccggtcaccgtgatttcatcaagaacatgattaccggtacttctcaagctgactgtgctgtccttattattggtggtggtactggtgagttcgaggctggtatctccaaggatggtcaaacccgtgagcacgctttgcttgcttacaccttgggtgtcaagcaacttattgttgccgtcaacaagatggacaccactggctggtcccaagctcgtttcgaggaaatcgttaaggagacctccaacttcatcaagaaggtcggtttcaaccccaagaccgttcctttcgtccctgtctccggtttccaaggtgataacatgattgagcccaccaccaacatgccctggtaccaaggctggcaaaaggagaccaaggctggtgtcgtcaagggtaagactcttttggaggctattgactccattgagccccctgcacgtcccactgacaagcctcttcgtctcccccttcaagatgtttacaagatcggtggtattggtacagttcccgtcggtcgtgttgagactggtgttatcaagcccggtatgattgtcaccttcgctcccgctggtgtcactaccgaagtcaagtctgttgagatgcaccacgagtctctcgacgctggtcttcccggtgacaacgttggtttcaacgttaagaacgtttccgtcaaggatattcgccgtggtaacgtctgtggtgactccaagaacgatcctcccatgggttgtgctagcttcaccgctcaagtcatcattcttaaccaccccggtcaaatctctgctggttactctcctgttttggattgccacactgctcacattgcttgcaagttcgctgagctcattgagaagattgaccgtcgttccggtaagaagattgaggagtcccccaagtttgtcaagtctggtgatgcttgcattgctaagatggttccttccaagcctatgtgtgttgaagctttcactgactacgctcctcttggtcgtttcgctgtccgtgacatgcgtcaaaccgtcgctgtcggtgtcatcaaggccgttgagaaggttgcccctggtgccgctaaggtcactaaggccgctgttaaggctggcgccaagaag

SEQ ID NO: 46322 - DNA, 1497 bp, Schizosaccharomyces pombe
atgttgcatcgtcgaattcattttaaatcacagtccactttggactttgacagtgttgcagttagcatatctgccagtacgatgaaaaacgaattagataaacttgtactgaattccagagtttcggataaaaaaacgtttggcatacaaatggacaacttctttgctttgtatagaagatatttattacacacagttaaaggttatgaatgtgattgggattctatccggcctctgggacccgaagacatgatagattacggtgatttaccgttatgcaaaaatgctggaaagtacttaaatcggcttgcagttgttaaattaaatggaggtatgggaaatgcgttgggtgtgaattatcctaaagccatgattgaggttcgtgacaatcaaagtttcctcgaccttagcattcgccaaatcgaatatcttaacagacggtacgatgtgtccgtgcctttcattttaatgaactcttacgatacaaatgatgaaacctgtaaagttcttcgaaaatatgcaggctgcaagattgatatttctactttcgaacaatctcgatatccccgtgtatttgttgactctcaacttcctgttccaaaagctgctccctctcctattgaggagtggtacccaccaggtcatggtgatatttttgatgcgttagtccactccggtacaattgagcgattgctcgctcagggtaaagattacttatttgtcagcaacatcgacaatctcggggcttcggtggatcttaatattctgtctcatgtcatagacaatcaaatcgagtactcgatggaaattactgataaaacaaaagctgatattaaagttggcatccttgtcaaccaggacggcttactaagacttttagaaaccaaccaagttcccgaacaacatcgagaagaatttatgtctgataaagttttcaaatacattaatacgaataatgtgtggctttaccttccggcagtcaaacgcgtagttgaaaaccgagaactcaacttagatattatgccaaacatcgaaaccgtctactataacaatgagcctgcacgaattatagaatttacgacagcaattggttccgctatcagccaatttaaaaaaaccgagggaattcgagtttcaagaccacgctttatttctgtcaagaattcctccgatttattcttggtacgatgtgatttatacaacgttgatcatggttccttaaaaattgaagaatcaaggctcggttttccccctccagtcgttcgcatgtctaatgaatttaaagatatcgcagaacttttttgccgtattccttacatgcctagcatgaaagacctagtttctctatccatttctggaaatgtatatttcggaagaaacgtgatattaaaaggaaacatcgtgattgttgcttcggaaaataccatcctttgcatcccttccaatgcagttttagaaaattgtgttgtgacaggaaattgtaaaataatggagtgt

SEQ ID NO: 46323 - DNA, 1695 bp, Schizosaccharomyces pombe
atgcctgcaggaaccaaagaacaaatcgagtgtcctttaaaaggagtaactttgttaaactctcctcgctacaataaggacactgcttttacacctgaggagcgtcaaaaatttgagatttcatcacgtcttccccccattgttgaaactttgcaacaacaagtggatcgctgttatgaccagtacaaagcaatcggtgatgagcccttacagaagaatttgtatctttctcaattaagcgtcaccaaccaaactctgttttacgcactcatcagccaacatttgatcgaaatgattcctatcatctatacacctaccgaaggcgatgccatcaagcagttttccgatatatatcgttatcctgagggttgttatttggatattgatcataacgatttgtcttatatcaagcaacagctttccgagtttggaaaatccgatagtgtcgaatacattatcattaccgattctgaaggtattttgggtatcggcgatcaaggtgttggtggtgtcttaatttcagttgccaagggacatttaatgactttatgcgcgggtttagaccctaatcgattcttgcccattgttctcgatgttggcaccaacaatgaaacccatcgtaaaaatcatcaatacatgggtttgagaaaggatcgtgttcgtggtgaacagtatgacagctttttggacaatgttataaaggccattcgtgaagtctttcctgaggcctttattcattttgaggattttggtcttgccaacgccaagcgcattttagaccactatcgtcctgacattgcctgctttaacgatgatatccagggaaccggtgccgtagcattggccgccattattggcgcccttcacgttacgaaatctcccttaaccgagcagcgcatcatgatctttggtgcaggtactgctggtgttggtatcgccaaccaaattgttgccggtatggtgacagatggcctttcattagataaggctagaggtaatcttttcatgattgatcgttgcggtttgcttttggagagacatgctaagattgctactgatggacaaaagccatttttgaagaaggactctgactttaaggaagtcccttctggagacattaatttagagagtgctattgcactcgtcaagcccaccattcttttgggatgttccggtcaaccgggtaaatttacagagaaagccattcgtgaaatgagcaagcacgtcgagcgccccatcattttcccaatctctaatcccactactcttatggaagcgaagcccgatcaaattgacaaatggtcagatggaaaggctttgatagccactggttccccacttcctcctctcaatcgcaatggtaaaaaatacgtgatttcccaatgcaacaatgccctcctttaccctgctcttggtgttgcatgtgtgttatcccgttgcaagttattgagtgatggtatgctgaaagcagcttccgatgctttggccactgttcccagatctttatttgctgctgatgaagccctcttgccagatttgaacaatgctcgcgaaatttctcgtcacattgtttttgcagtcttgaagcaagctgtttctgagggaatgagcactgtggatttacccaaagatgatgctaaattgaaggaatggattattgaacgtgaatggaatcccgaatacaagccttttgta

SEQ ID NO: 46324 - DNA, 1847 bp, Schizosaccharomyces pombe
atggaatttcctatcgatgatgaggaattgctagatgagcgaaataaacttctccaaatttgcaatatggacgagcaaacaatgttctacaagtgggagtcctggtgtttgcaacgaggaaatacaccaaaactcgaccttgacacattcaaggcctttgctaaagacatgaaatttcaaatggagaggcaggtaaaagccacacttaaacagaatcctgaaagaaaatcgataaagcaaatcccgggaatgaatattgatagcatgtgcgtacattagcaaatggttttaactaacaaatatctagactaggtctaccagtgaagaccaccgcatcaggcgactcgttgatgcaagagtctaaaccatctaccgaaactttcgaattgaattccagtgacgctggaagggttttggaagttttaaataaagaattaaaaattgtaacttcaaaaccttcagctccatccaagctggttatcgtagcgaattttgatctcaaggcatttaattacaggatcatgtatcaaaagctttatgattcttctgaagttctggatgatcgcattgagctttttagtgcattaacttgcagaaaatacaacataagtgatgaagatttggcaaatcctagcgaacttactcaagaacccgttgtagttgtaggacgaattgttgtcgaaagtaccaatttaggtggaagactcaaccaaaatagcattttacttgaaagttcaagacgtctaggcgctggtgttcgagttcgtttgaaggtggatgatctaccaagttactcaatatttcctggtcaaattgtttcagttaaaggatccaatcctagcggtaacatgtttatcgccaaggaaatccttcctatacctcctttgccgttcccaagttcatctaaacaggagcacgctacctttgttgctaatacaaataatcagccaatttctatatatattgcatctggaccttggtctctccgtgatgatctctctttttcccctttaaaatcaatgatttcatatgtaaataaaaatcctgttgacttggttattctatgtggtccattcttggatattaatcatatactaatacgtaccggaaacattacaggaacgtctgcgacttctttggaagagttgtttaaagagcgtgtcacacccatattaagccagctaacttgtccttgtattttaattcctcacatcaatgatgctgcttcagatcatcctgcatggccacaggatgcatttaatcgggtggccttaggtcttccatctgtatgttaagttgtataataatttttattgaccaatccatagaacttcaaatgcttcccgaatccttgcatgttttccattaatgatgtcgtctttggtgtgtcaaccaacgatatactccttcacacatctagagaagagttatttcgtctaccttctcatggtaacttatttgcacgtttggtttctcacgtacttcaccaaaggcatttttatcccttattccctggaggttctcttgaaaagtgcaacccttcaaacttagatatcgcacatcttaaacttggtgaattcctaaatactatgccggacatactaattttaccaagtgatttacgttatttcgtaaaggtatgttaattttctactttgttttaactaatgttatagaacgttgaaaacgttgtatcattgaatcctggtaaagcgaccaaagggattaatttgggcacttttgcaaaattaactatcgcgccattagagctcggggataatggttcttctaatcattattcacatcgtgtatggcttcgaaccaaggcagaaattttaaaactatga

SEQ ID NO: 46325 - DNA, 2856 bp, Schizosaccharomyces pombe
atgcggtgtattgtttcgtataaaagtctaagatcatgtctggttaatgttccggaattgctgttggaatctatctctgaacctgtccaaaactacgccgttcaggctgtagtttgtaaaaacgatataaagaaaacattttattttgggatttctggaattccgtcacaattttcatttgagatcgattctacctacgcccatactctgaaattagcagaaaatcaagaggtaaaaatatttgtcagcaatgaaatgtttttactaatctcttagataaatttatcaataatcgattgtactcatgaaattgagcagctagaaattgaacctgtcacctctaatgattgggaaatcgctgaacgcaatgcagcttggctggaagaaaatcttttagtacaatatcgtgtagctaccaccgagagatttattatttatcttccttccggtacatttatccaattccagcctcttaaattgattcccagttctttatgcgggcgcctgttacgaactactgaagtgttgattactcccaaacccaatacatctgccattgaagttaaagaaaatagaaaagttaatcttagatgtgttgtagaaaaccgcttgttgcctgacagcgttactgctgattcaccagctctttgcgtatttctacctctaaattttccggataggccagatgtagtatatatggatggtggaaatttaaaatccacaattgtatgtcaatgtgtatcgtgcccttttcaaatacctggtcatttttttatctcaaagagcttagctttgtcatacagcataaaaacaggtttcaaattccaaatatggaaggctcataaccctccctcttcctcaaaatttattctagagcaaaagggtcttccaccagaaagcaacttgagttctgagctggtggctgccaagctaaaaaacagctatttaatggacggcatgactttaaaacttgttgacatagcagtttcttattctgttagcggactcagtggtgttgttaaaaatccaattcaagatataaaaattacaagtgatacaaacgtcccagtaaatgcaggtataagaaataatagtcctcgtttgtctatgcagccgtttccgcatgaatttgcgcaagtacgaaatgctgtattcttgcaccaaaatatctatatcaatggacccaaaggttgtggaaaatcaaatttagttcactcattgtttgattattattctcttaactcaatctatttccagatgattgtatcttgttcagaaatcgatcgatcatcttttgccaaattccaaagcttttggaacaatgtatttatacaagcagagaggtacgaaccctcaataatttatctagatgatgttcattgtcttatatcttcctcaaatgaaaatggggagcttggatttgtggaagagcgagaaatagcatttttgcaacatcaaataattaatttaaaaagaaaaagaaaaataattttcattggatttggggaggaatttttaactttctcagaaaatttagttttgcctttgctttttcaaataaaaatagctctaccatcgcttgctgtgactaggaggaaagaaattttaacaactatctttcaagaaaatttctctgatataactatggatagtattgaatttatttcagttaaaacggaaggctacctgatgacagatttagttttattcgtgaaacgattactgtctgaagcttttgttgaaaagatacaaaatgggccaaaacatttaatgaataagggattgattgagaagaccttaaaagattttgtcccattgcagcttcggaaagctaaatttgtcaagtccagtattcggtggattgatattgcgggcatgcaagaagcgaaagaagctgtgagagatataatagagtctcctgttaaatactctctcatatataaacaatgtaggcttcgccttcccacgggaattctactttttggttatcccgggtgcggcaaaacgtatttggcttccgcaatttcaagtacttttccagttcagtttataagcataaaagggcccgaacttttggataagtatattgggaaatcggagcagggtgttcgagatttgttcagtagagctcaaatggccaagccgtgtgttttgttttttgacgaatttgattcagtagcacccagaagaggacaagatagtactggagttacggacagagttgttaatcaaatacttacacaaatggatggagctgagagcttagatggtgtttacattgtggcagctactactaggcctgatatgattgatcctgcattattacgtcctggtcgtctcgataagctgatattctgtgatttgcctaacgaagaagaaagacttgaagttttacagaaattggcaaaccgattccatattgaaaatgcggccatgttaaagaaattgtcaactttaacagatggttatacttatgctgacttatcgtcacttctgtacgatgcgcatttgattgctgttcataaactattgaaacgtgtaagtataaacgcagtggaccccagtcaaaccacaagttccttcactaacttgacgactgagtcaaaaaggaatgcgtcaatgcttgctcttccacctgaaagtcgctataatcaaaatatgcaaagtatgagtgattcaaaaagtgtcgtaatagaagattatatgctcatggaagctttgaagaaaaatagtccaagcttaaactcggaagagtttgagcacctttcaaacctatatagagattttcgttcaaagctttttgagccagaacttaatgcaaggaatacggacgtgggaagtaagactagacaaatc

SEQ ID NO: 46326 - DNA, 1287 bp, Schizosaccharomyces pombe
atgttccctcatcgagtctctcatttatcgaaactattttcgagaaggtttcccaattggaaaagaaaagtccaaacagattcttggtccaatgtcccagagcatattcactcaaaaattggtcgaaacctttttcaaaaagaaggtcatcccatatgcagtctacgacaacttctcgaacagcaatttcaaaaattcgaaatgaataatgttcaaaaagaatcacctattgtttctgtagagacgaattttgattctttaggatttcccaagacacatgtaagtagaagcaaatccgatacttactatatgaacaataaaacttgtcttcgaacccatacctcggctcatcaacctgaagagttctctcgcttggccaaagaaggatttaagaaaaatggtttcttaataaccgcagatgtataccgtcgcgatgaagtggattctagtcattatccaatttttcatcaaatggaaggtgcattggtgtggaacagaaatgatactgcaaaaatgaaaaatgatctaaaaaaagtagctctttctccatctcttaagtcaatggtggatgatgaaactactgcattagaaactcataatgacatgcaagatatttattcacttgaagagacaaaatttgtttcccaacatttaaaggatactctgaccaccgtgattcatgacctggtatcacttgctccttctatttcttccggagctgaacaggttcggtatcgttggacgtacgacagtttcccctttaccaagccctcgtttcagttagaaattgactggaaaggaaaatggcttgaaatattaggatgtggggtcgtccaggataggctgcttaaaggtgcaggattaaataactacattggttgggcttttggaattggtcttgaacgtctcgcaatgattttgtacggtattcctgatattcggcttttttggtcactggatgaacgattctcgaagcaattcttgcctaacaagattagcacttttaagccttttagtaaatacccagcatgtttcaaagacattgcattttggatcaataatgattttaatccaaatgatttttatgagatcatacgggatgtctgtcaagatatggtagaatctgttaacttgattgatcagtatactgccaaatctggaaaaacgagcttgtgctaccgagtcaattacagaagtatggaaagatcccttagaaacgaagaaattgacaagctacaggaaaagcttaggaaccgagtagctaattctttgagagtcgagctcaga

SEQ ID NO: 46327 - DNA, 1125 bp, Schizosaccharomyces pombe
atgcggttcgctccttatttaattagtgctgttgtaattacaaccataatcctgggtggagcttggtggacttcagctatggataccaagcttcaaacgaagatgaaggagatcatcgaccaacacacgagtacttggaccccagtcgtttcctccgtaaccagtacccaaactgatactttacgtgttaccattagtgaagttgttagtgttactgccactttaaccgaaactttcactgctactccaactgtcacttctgtagttcatgctttagctaccactgatcctcatccggataactctaaaatcgtcattttgatgggctctaactttcaaaatgatgctaactctcctctccatcctttcgctcagtccattatcaaaaatcgtcgtgaatatgctgaacgccatggttacaaattcgaattcttagatgccgatgcctatgcttctcgtgttacaggtcatttaatgccctgggttaaggtccctatgcttcaagatacgatgaagaaatatcctgacgctgaatggatttggtggcttgatcatgacgcgttggtcatgaacaaagatcttaacgtcgtcgaccatgtgcttaagcacgaccgattgaataccattttaactagggaggctgaatataagagtggtgcaggtatccccgccgatggatttagaactccaaaggatcaggatgctaaggatgttcatttcatcatctctcaagattttaatggtattaacgctggcagtctttttattcgtaatagcgaagttggccgctggattgttgatttgtggtttgaacccttatatttggatcatattcagggatatgctgagcaacaagcgttttctcacatggtattttaccatccccaggtgtataaacatgtaggtgttgtcccacttaaggctataaacgcatatgattttgatgataatatttggggctatgacgacggggacttgtgtatccattttgctggatgtaactattttaagaattgtcccgagaagttccttaagtatgctcaaattttatcttctaaacaaggatccgattggatgtctgctcaagaaaaggatcatattcaaaatcttttgaaaccatcatcc

SEQ ID NO: 46328 - DNA, 2637 bp, Schizosaccharomyces pombe
atgactgagctgttagcagatgaggtttttaaagaccgtgttagaatttttcaagaatatcttgaacatgacactgatgatgctaacgttaccttgtaccaagaggcaatccttagaatgcttaacatgggtcagcgtcgtttaattgtcaatattgatgaactgcgcgattacaaccgagaattagctgatggtgttcttttgaagcctcttgaatatgtggaaccttttgatgaggcattgagaaatgtagttagcactctcatagatcctgttgttcataaggacctaaaggataagctgttttacgtgggtttcaggggatcgtttggtgaccaccatgtgaatccacgtactttgagagccatgcatttaaataagatgatttctctggaaggaattgttacgcgctgctcttttgttcgtcctaaagtaattaaatctgttcattactgcgaagctacaaaaagacatcatttcaaacaatatgccgatgctactatgaatggcggccttagctttcaatccactgtatatccaacacaagacgaaaacggtaatcccctatcaatagaatttggcttcagcacctttcgcgatcatcagtcaatttctcttcaggaaatgcctgaacgtgcaccaccaggacaacttcctagatcaattgacattttgttggatgatgacttagttgatactgttaaacctggtgatcgtgttaatatagtaggacaatatcgttctatggggtctaaaacatctggtaatacaagcgcgacgtttcgaactgtgctgctagcgaacaatgttgttttgttagggaataaacctggtttgggaaatgttggtggtggtgcattagacatcactgatgctgatattcgtaacataaataaattggccagaaaaaaaaatgtgtttgaacttctctctacgagtcttgctcccagtatttatggctatgaatacgtcaagcaagcaattttacttcttcttctgggaggaactgaaaaaaatttgacgaatggaactcatattcgtggtgatataaatattttgatggttggtgatccgtccactgcaaaatctcaacttcttagatttgtacttaataccgctccacttgctatagctacgactggtcgtggttcttctggcgtaggtttaactgctgcagtgaccacagataaagaaactggcgagcgtcgtttagaggctggtgccatggtattagcagaccgtggcgtggtttgcattgatgagtttgacaagatgagtgacatagatagagttgctattcatgaagttatggaacaacagacagttacgattgctaaagccggtattcatacttcgcttaatgctcggtgtagtgtgattgccgctgcaaatcctatatatggacaatacgatattcgtaaagatcctcaccaaaatatagcacttccagattctatgctttcgcgttttgaccttcttttcattgttacagatgatatcgatgataaaaaggaccgtgctctcagtgagcatgtattgagaatgcatcgttacttgcctcctggtgttgagccaggtacgccggttcgtgattccttaaacagtgtattaaacgttggagctacaaacgctgctggtgtctctacggaaaacgttgaacaggaagttgagactccagtctgggaaacattttcaagtcttttgcatgcgaatgctcgaacgaagaagaaagaattgcttaacatcaactttgtgcggaaatatattcagtatgcaaaatctcgtatccaccctattctgaatcaagcaaccgctgagtacattaccaatatttattgtgggttacgaaatgacgatttacaaggaaaccagcggcgcacaagtcccttgacggcacgtactttagaaaccttgattcgattaagtactgctcacgccaaagcacgtttgagctcagttgtggaagtcaaagatgcaaaggctgcggaaaaaattttgcgttatgctttgtttcgtgaagttgttaaaccgaaaaggaagaagcacaaaaaacaacgcctagaggctggtgaagagtttgactcagaagacgataattccgatgacatggatattgaggaatctgaagaagaaatggatacaaacatggtcattgattcgggatcgagaagagttacccgatctcagaatgcaacttcgcaaagtcaagaatctggttcggagattggttcaagtatcgctggaacagctggttcctataatgtaggaacatcaaatacccagttatcatggccttccactcactcgaccttaccagctacatcgagagagctagccagcagtgaccgtaacatcaatacaggcactagcgtggcttctgaagtgtcggcatctgtgagcgagcagagcacagtttcattacctcgtgagaagatgtctgtgttcatggcccggttggcttcccttacaaaatccgagctgttctcagaagagtgtgcctctttggaagatgttttggaatcaattaataatatcgaggatgatgtaggattttcgagagaagaagctattgtggcacttaaagaaatggacgctcagaacaagatcatgttttcagataatgtggtttatcgtatt

SEQ ID NO: 46329 - DNA, 697 bp, Schizosaccharomyces pombe
atgtttgctaacgcacgggctaaaaggcgttcaagggcatcttcaccgactcctgcaaggttgggaggatatgcgcctttgcgagtagagattacagaggaacagcgacaagatattaatgaagcttttaagctgtttgactctgataaagataatgctattgattatcatgagctcagggctgcgatgcgtgctttagggtttaatgcggaaaaatcagaggttttaaaaattctacgtgattttgataaaactggcaagggctacttacaaatggaggattttgttcgcgtcagtaagtgtgcacgtcttggcattgatatattttattagatggaaatttaaaatagggaagacacatacaactggcttgaaaatgagtttttttttaaatttctttttccactcttatatggcttgtcattcttcttctgttgaacgtgtttactaattagatatagtgacggaaaaaattgttgaacgagatccattagaagagattaaaagggcttttgagttatttgatgatgacgagacaggaaaaatcagtttaaggaatcttcgaagagttgcaaaagagcttaatgaaaacatcgacgatcaggaattggaagccatgattgaagaattcgaccttgatcaggatggagaaattaatgagcaagaatttatagcaattatgatggatgaagcataa

SEQ ID NO: 46330 - DNA, 1396 bp, Schizosaccharomyces pombe
atgaatgagaaccaaaaaagttttgactctgacaagtcggaaagcgaggatgaacaaaaaaatggaagagttaaagtaagaagcaggaaaactgacgataatgagggttatacttgggaaggtgaatatcagcgttcttgggatatcgtacaggaggacgcagagggtagtttagtaggcgttatcgctgggcttattcaaagcgggaaacgtaaaaggtatggcgtatcaaaattggttttcttatgttcttcatttgtttgttagttgcctatgttgggcatttggaaacatattagtcttttatagcatcgatgaacggtatactaacttgtcaatctgatttagacttcttagagatacaactccgttacaacgaggtattattagacacatggtcttggtgttagatttgagcaactctatggaggagcgtgattttcatcataagcggttcgaccttcagataaagtatgcttctgaatttgttcttgagttttttgaacaaaatcctatttcccaattatcgattataggcgtaatggatggaatcgctcatcggataactgatttgcatgggaatcctcaatcgcatattcagaagcttaaatctcttcgagattgtagtggaaacttctctcttcaaaatgctctcgaaatggctagagcttctttatcacacattgcttcccatggcactagagaagtccttatcatttttggttccatcttatcatcagaccctggcgacattttcaagacgattgatgctctggttcatgattctattcgtgtccgtatcgttggtttggctgctgaagtcgccatttgtaaagaaatttgtaataaaactaactcatctacgaaaaatgcctacggcgtagtcatcagtgaacaacattttcgcgaacttctactcgaaagcacaatacctcctgctactgattcggctaaaaccactgatgcttctttggtaatgatgggatttccttctaaggtcgttgagcaattgccaagtctttgtgcttgccattcaattccgtctcgtggtgggtttcattgtcctcgttgtaaagcaaaagtttgtactttaccgatcgaatgccctagttgttctctcgttctaatcctttcaacacatcttgctcgatcttatcatcatttgtttccattgaaaaactggagcgaaattccttggtccgcaaatccaaagtccactcattgctttgcgtgtcagttaccttttccgaagccgccggtttcaccgtttgacgaatctacttcatcgatgcggtatgcatgtccctcgtgtaaaaatcatttttgtttggattgcgatgtttttgcgcatgaacaacttcatgagtgttatggatgccaatgctccggaaattaa

SEQ ID NO: 46331 - DNA, 1019 bp, Schizosaccharomyces pombe
atgcctcctgcagtgagctctgaaacctctacaatcgtcccacagcaagttgtaagtagaaaatttgagaaacttttttattaaccattggttagattgtgcatccattagtacttctgtcagcagtagattcttataatcgatctgccaagggaaccaaaagacgggtcgttggtattctattgggtcaaaataatggcgacgttgtaaacgtggccaatagttatgctataccatttgaggaagatgaaaagaatgcatcggtttggtttttggaccataattttatggaatcaatgaatgaaatgtttaaaaaaatcaatgcaaatgaaaaattagttggctggtatcatactggaccacaactccgaccctctgatttggaaatcaacaacttacttaaaaaatacatacccaatcccgttcttgtcattatcgatgtaaagcccaaatcagtgggtcttccgactaatgcctactttgccattgatgaaattgaagacgacggctctaagtccagcagaacttttgttcatctaccctccagtatagaggcagaggaagcagaggaaattggtgttgaacacttgttacgtgatactcgtgatgcatccgttggtactttagcgacaagagttacccagcaggcacaatctttacaaggccttgggcagcgtctcactgaaatcgcagattacttaaggaaagtcgtggatgggcaactacctataaatcatgctatccttgccgagcttcagagtgtgtttaatcttttgcctaacatttttagcggtcctgtggtttcagaacaggccttggaatcagaggcacaacgtgctttcaatgtgaattccaatgatcagttgatgtccatttatatttccagcatcgtgagggccgtgattgctcttcatgatcttttggattctttggctgctagtaaagctatggaacagcaggacataaagccaactgttcaaaatggagaagtttcggctaatgccgaacaaaaggcttaa

SEQ ID NO: 46332 - DNA, 1371 bp, Schizosaccharomyces pombe
atgtcgcttgctactttacaaggacagtcactagattttgcagtcaagcattcactagatgatttgcttaaaaatcccgttcgctttcgtcccgcggttgtttcctcaccatcggttcctgaaggtacttacactgtcttaaacaatccaaagcaatctactgttagccgtaagtcattttcagcgcctacttccccaactagaaacaaacgttctggttcttcttcccaggaatacaaaaaatcttcaggaacaaggggtgatggagctaatgattttgtggatgaggatcctgcttttatacctccggctcgcattctatttcccgaagaaaaattgtcgatggaatgggataatatcatgcccaatgctccggggctcgtaaatctcggtaatacttgtttcatgaattcagtacttcagttgatgactcaaactccaccgttggttcaatatcttttatccggtcaacattctttatcctgccgtatgaatgcatgtgtactctgtagaatggagcaacatgtcgcccgtgcctatcccaacaaaggcaccaaacgagcttcggccttcaaaccttcaggtatacaaagtatgctcaaagtaatttccagtcatttccgcccatatcgccaagaagatgctcatgaatttatgcgatatttggttgatgcttggcaaaagtcttgtcttcaaaaccataaaaatcttgatcatccaagcagggagacttcggtagtacacagaatttttggtggttacctacgccagcagattctatgctcagtttgtaaaaaaccttccaacacctaccaagctttacttgacttatctgtggatgcgaagggctcctccttggcagattccttaaagcattttgtgcatgcagaaaaacttaccaaacaaaacaaatatcgatgtgaaaattgtaagcaactggtggatgcgtccaagcaaatgactatttatcgggcaccaaatattttaaccattcacttcaagcggttcacattcaacggtttccaatctagcaaaatcagtaagcaaatttcataccctgaatcattcaatctcggtccgtatatgtcagatcccaattgttcttgttggtacgaattaattggggttcttgtacatgcaggcggaagtacccgaagcggccattattattcgttttgcaaaagtagtaatggtgtttggcttaaatttgacgatgatttcgtttccaattccagtattgatcgagttttgaatcaacaggcctatattttgcaatacaagaggaaatcaacttcatcgtctaaacacaagctaaacaccgaaaacacggttaccaaaacttctaataaaaaacggagaaaaatttcattt

SEQ ID NO: 46333 - DNA, 1221 bp, Schizosaccharomyces pombe
atgtcggaaagagacactgctttagagaaatataaatcctatttattacaacatcgagaatgggattcaaaactgaaggatttgcgttttggaaatcgagatctagtcaagaaatatgataaaacagaggatgatataaaaagcttgcagtcggttggtcagattattggagaagtattgaaacaacttgattctgaaagattcattgtaaaagctaggtaagtaattactcaaacttttgggagattgtttgctttacgtggaggatatatacaagtgaaatgtgaaaatggatgtgaagaccttattattagtaatgcatatgttgggcgttgaattccttcataaagaattttttgtggcgtatgaatgggaaccatgtttaaatgcatataatcatttgcccgttcctttttttttttaaagataagttcagtgggcaaaatctgtgttcaaaaactgtttggttctaacctctccatccagcaaaaattctttttgaaatgcgcacacggtataaaaatctataaccggaagcatgaaacactctgtttactggtttcatagcaaatcgttgggaaagtagatacctcacgtatagtcatccttctctttttacaaatctatcgttgcattagtacactattttttatttcctttcattattttctgtttccctaacctattctagctctggtccacgttacgttgtaggttgcagaaacaatgtcgaccaatctcatttggttcaaggcgttcgtgtatctttagatatgaccacgttaaccattatgcgtattcttcctcgtgaggttgatcctctcgtttacaatatgtcaattgaagaccctggtgacatttctttcgccggtgtcggtggcttgaatgaacaaattcgtgaattgcgtgaagttattgaactacctttaaagaatccggaattattccttcgtgtgggaattaagccaccaaaaggtgttttgctctatggtcctcctggtactggtaaaactcttttagctcgtgccgtggcggcatctttaggtgttaactttttaaaagtagtttccagtgctatcgttgataaatatattggagaatctgctagaataattcgtgaaatgtttggctatgcaaaagagcatgagccatgtgttatttttatggacgaaattgatgctattggtggtagaagattctctgaaggaacatctgctgatc

SEQ ID NO: 46334 - DNA, 2226 bp, Schizosaccharomyces pombe
atgaaaagagctagtttaggcgggcatgcgcccgttagcttaccctccttaaatgacgatgcattagaaaaaaaaagagctaaagagaacagccgtaagcagcgcgagttgcgaagaagttcagctctgcactcaataacgccaagaagagaatctctaaacaattcttcaccatttaatagctctcatcaggttcctgttctttctaattttgaggaatggattaaattagctactgacaacaaaattaattccacaaatacctggaattttgcgcttattgactattttcacgacatgtcgcttctacgtgatggtgaagatataaatttccaaaaggcaagctgtacattagacggatgcgtgaaaatttatacttcgcgtattgattctgttgctactgagaccggcaagctactcagtggattggcaaacgattccaaagtattgcagcaaacggaagaaggcgaagatgctgaaaatgatgatgaggatctacagaaaaagaaagagagaaagcgtgcacaacgttcggtaaagactctcgttaaagatttcgagtcaatacgcgctaaaaaatttgagttagaatgttcttttgatcctttattcaagaaaatgtgtgcagattttgatgaggatggtgctaaaggcttattaatgaatcatctttgtgttgatcaacatggacgaattgtattcgattctagcgatactgtcatcaaggatttggaaaataaagatgttgaagctgaatcgcaggaagcggtagtcgcagcgcctatcgaaagccatgacacagaaatgactaatgtgcatgacaatatttctagggagaccttgaatggtatttacaaatgctattttaccgatattgatcagttgacaatatgtccctccttacagggctttgaatttgatagtaaagggaatcttgatgtctctctcttaaaatcattaagtgatgaagttaacatgataacgacaacctccttagtggataatacgatggagaaaactgatgctgatgcagcttccctttcttccgattccgatggtgaagaaggacatattgtgcatgctttggaggaaatggcttacgatgaggagaacccatatgttgatgtagtaccaaaagcaatggacgaatccgaaaatccagattttggtgtggatactgaagtcaatatggctgatggaagtactatgaatgaaaattattctattatttctactgccgctgcgaatggagtatacgaatattttgacaagtcaatgaaaaagaactgggctggacccgaacattggcgcattcaggcattgagaaaaaatatcaataacgcatcaactgtattcaactcttccaatacggctgaaagttcagataatgtatcgcgttctctttcttccacggaacggaaaaagcgtcgagaacttgataacgccattgatttcttgcaggaagtagacgtcgaagcactgttcactcctgcaaccagcagtctcaagcttcccaagtctcattggaaaagacataatcgatgtttactacctgatgactaccaatatgattctaagaggcttttacagcttttcttgaaaccaaagatgtcagttctacccaacgctgatggagaaggacagctacaactgaataaagccttagatgatgagaatgatttggacggtattcaaccccatggattcgattctgatggcagtgataatgttgatgaaggaatacccccgtatggatttggagattccgatagccctaagcaaacacctctgcttacacctccatcatcatcaggatttggtgataaccttttgttaactgctcgtttggcaaaaccagatatgctgaattatgcgaagcgtgctaaaaaggttgatgtgcgagtactgaaagaaaagctatggaaatgtctagatcttgaaaacacaattaaagaaaattccatcaactctcatattgagggttcggagatggagtcagaagaaaccaacatgccagtcaaatcttttttttccactgtcaatcaattagaggagacatacgagaaaaaagaactcaaagatatatccaccagttttgcctttatttgtgttttacatttggcgaatgaacataatttagagcttacaagcaacgaagatttttcagatgtttttattaggccaggtcctaacttgacgacgctagaagcattagaaaatgatgtt

SEQ ID NO: 46335 - DNA, 1023 bp, Schizosaccharomyces pombe
atgtttgccaaagtagctttcaaaaactttactccccttaagagtatcgctccccgttctttttctacgacctccagtcgcgcattcaaagtagccgttttgggtgctggaggaggtattggccagcctttgtcaatgcttttaaaactgaacgataaggttagtgaattggccttgttcgatattaggggagctcctggcgttgctgccgatattggacatatcaataccacttccaatgttgttggctatgctcctgatgacaagggacttgaaaaagccttgaacggtgctgatgtggtcattattcctgctggtgttccccgtaagcccggaatgactcgtgatgatctctttgctactaacgcatcgattgtgcgggaccttgcttttgcagcaggtgaaacttgtcccgaagccaaatatctcgttgtcactaaccccgtaaactctactgtgcccatctttaaaaaggctttagaacgtgttggcgttcatcaacccaaacatttgtttggtgtcaccacacttgactctgttcgtgccagccgtttcacctctcaagtcactaatggcaaggcagaacttcttcatattcctgttgttggcggtcattccggtgcgaccatcgtacctttgttgtcccaaggcggtgttgaattgactggtgaaaagcgtgacgcacttattcaccgtatccaatttggtggtgatgaggttgtaaaggcgaaggctggtgctggaagtgcgaccttgtctatggcctatgccggtgctcgtatggcctcctccgtactccgtgctttggctggtgagtctggcgttgaggaatgcacctttgtggagtcccctctgtacaaggatcaaggaattgatttctttgcctctcgtgtaactttgggtaaggatggggttgacaccattcaccctgttggtaaaatcaatgattatgaggagagccttcttaaggtagctttgggtgagctgaaaaagagcattacgaagggtgagcaatttgtagca

SEQ ID NO: 46336 - DNA, 1730 bp, Schizosaccharomyces pombe
atgtcggatatgatcaatatacgtgaaacaggctacaattttaccacgattctcaaacggtatgtaattgcattaaactgctaaaagagtaatagtctttaattgattatgcatctaacatttactcatatagactggaagcggcaacttctcgtttggaggatcttgtggaaagtggtcataagcctcttcccaacatgcatcgtccttctagagattcaaacagtcaaacccacaacatatccttcaacattggtactccaacggccccaaccgtgtcgactggtagtcctgctgtcgcatcattacatgatcaagttgcggctgctatcagtcctcggaacagaagtcttacatccacctctgccgttgaagcggttcctgcttccatttccgcctacgatgaattttgttccaagtatttatctaaatacatggaattgagtaaaaaaattggtggtttgattgccgaacaaagtgaacacgtcgagaaggcttttaaccttttacgtcaggttttgagcgtcgctttgaaagcccagaaacccgacatggattccccggaactcttggaattcctcaagcctatccaatctgaactgctcactattaccaatattcgagatgaacaccgcaccgcccccgagttcaatcaactttctaccgtcatgagtggaattagtattttgggctgggtcacagttgagcccactccattatcctttatgtctgaaatgaaagattcgtcccaattctacgccaaccgtgtaatgaaagagtttaaaggtaaagatgacttgcaaatcgaatgggttcgttcttaccttactctgttgactgaattgattacatacgtcaagacccacttcaaaaccggtctcacctggtctactaaacaggatgcagtacccttgaaaacggctttggcaaacttgtctgcttcgaaaactcaggcaccatcttctggcgattctgcaaacggcggcttgcctccaccaccaccaccacctcctccatctaatgatttttggaaggatagcaacgagcccgcacctgctgataataaaggtgatatgggagcggtgtttgccgaaattaataaaggcgagggaattacatccggacttcgtaaggtggataagagtgaaatgacccacaaaaatccgaatttacgtaaaacgggacccactcctggtcctaagcctaaaatcaaaagctctgctccttctaagccagcggaaactgctcccgttaaaccacctcgcattgagttggaaaatactaagtggtttgttgaaaaccaagtcgacaatcacagtatagtcttggattctgtggagctcaaccactcagtgcaaattttcggttgctccaattgcacaattataattaaaggaaagttaaacaccgtttccatgagcaactgtaaacgtactagcgttgtagtagatactttagtggccgcttttgatattgctaagtgttccaattttggctgccaagttatgaatcacgttccaatgattgttatcgaccaatgcgatggaggttccatctatttgagcaaatcttcgttgtcgtccgaagttgtcactagtaaatcaacaagcttgaacatcaacgtccccaacgaagagggagattatgctgaacgtgctgttcccgagcagatcaagcacaaggtgaatgaaaagggagagcttgtctctgagattgtacgtcacgaataa

SEQ ID NO: 46337 - DNA, 661 bp, Schizosaccharomyces pombe
atgttggaatccctgttacccataattcgtatggaggatagtgaaatgtcgacgttgcagttaggatgtgatttggctgccttgggtttcgacttggctcctgtagagtatgtttttctaaggcgttgttgaaacttgaatttctaatttgattgtggttactaaccttttttagggaggaccggcttatttcgacaaatctcttttcaccatgggctgaactcaatacaaaaaaaccagtctcccagcccatgttcaaattacctgcatgttacaaaaacgttaatccacctccagccatttctaaaatttttcaattttctgatgaaactttattttatatattttacacaatgcctcgagacgttatgcaagaagctgctgctcaagaattgtatgtgttttccaactttactttttaattgttttttatattccatctaacgtaaacagaacaaacagaaattggcgatttcacaaggaacttcgtgtttggttaacaccggtccctggaatgaaaccgttgcaacgcactcctcagtttgagcgtggttattacatgttctttgatccgattcattggaaaaggattaaaaaggactttttattaatgtatgctgcgctcgaagatcgtgctcagagtgctgtgcacagttagtca

SEQ ID NO: 46338 - DNA, 1584 bp, Schizosaccharomyces pombe
atgttcagcaagtatttacaatcccgagtttgtggattgcattcttttacaaattcttctgctcagcagctcttttcaaagtcaattgcccattcttccaggcggaatttcgtcataagctcttcttgcaccaaatttcgaaatgtagcaattcaacgaaatgcaaaacgagagttttctcgatgtgctgccttgaaaaacttttcatatcatgcacgatgcttccatgccactagagcagtttgggaaatgactgatccctataaaacgttgggagtatcaaaaagcgcttctgcttctgagataaaatcagcatactataaactggcaaagcaataccatcctgatgcgaaccctgacaaagctgctcaagataaatttgttgaaatcaaacaggcttatgaggtgttgcaggatccgaagaagaaaaaagctttcgatacatatggtgcaggcgcatttaagaatggagagtttactggcggtgattttgaaggattccagaacggatttgctggcgcttcttctttttcttctggttttccaggttttaatttcgaagacttatttggattttcctctcgaggcccccaagctcgtcgtaatacctcttttgatgtatttgttggtgaagacattgaggcaagtattactatcgatttcatggaagcagtgaggggtgcaaaaaaagacttatcctattcagtctcttctacttgctcatcatgtcatggatctggcttgcaacccggttctcataagagcacttgctttgcttgtaaaggtactggtcaacgtcttcatttcattcccccatcttttcacatgcaaactacctgtgactcttgtggtggaactggaacaaccattcctcccaactctgcttgtcgctcttgtatgggatctggtacagttcgagagcgaaaaactgtctcaattgacattcctccaggaattgacgacaatacagttcttcgtgtaatgggtgcaggaaatgatgcgtctactgctaagggaggcccaaatgcgaaatcaaggcccggcgatttgtttgcaactattcatgttcgcaagcatccgttctttgttagagagggtaccaatgttacttataatgcaaaaattcccatgactactgctgcgctaggtggcactcttcgggttcctacacttacaggaaacgtggatcttcgggtttctccaggcacttcgactggagaccgaatcactatggccggaaaaggtattcgcaaggttaacacatctcgctacggaaacttttatgttaattttgaagtcactattccgaaaattctatctccgcatgaaagaagtctccttgaacaactagcagacgcattaaatgatagcacagctcgacggacacaaagtagcccttcaggaacaaactcttctacgtcgacatcttctacttcttccaaacactctacaggaatatctaccgagccaactacaggagaagaaaacaaacaagacggttcggtcggcgggttttttaagcgtgcctttcgtcgtctgcatcctgatgaagatcagaatccaaaaaaggatgaatcctcttca

SEQ ID NO: 46339 - DNA, 2463 bp, Schizosaccharomyces pombe
atgggacagacaaattctcgacattcattaattgaaaccgatgaacccaccacatcatctagagtttccatgttagtggacagagtgaagttgctgtggaaaaggtacacaacacctctgtcaactgaagacggtagtcgagaagcacattttgctgttcctagtgaaaattatgccgacactccatctcgcaataccccaaattcttcgaatgggttcccttccgaaaccctggttacctcatccgctcattgttccacccaacctcataaagatgaagcatattcacatcatggctattcaagtacaatggcgttagatgacagtagtctagcacaaacttatcatgagtatgaagaaggcacctctggaaactccccattgaggagagcgattggctcttatgattttcttcatcctcgtccgtccggtaactcctctcgtttggataggaattcgtcacgcccttttacctcctccttccattctgctccatttttaagttcttacggctcatcaaatgacccttctcaagaacgtgtaaacgaatattcacttccctcaaattcaaattcaacttacacgacacctcttcaatcaattaacaacgaacatccccttcccactgttctggaaaataatgctcttttaaataactccggtaactccccttctttaataaaccatttgcgtcaatatcttaatcaagattttagtcgtctacatcaatccccttcacccatccctaattctaatgataatgactctcaaacccgccggtcgtcttggtcatctatcgcttctgcatttaatgactttcctgaagaatttccgaatgccagcaatcctgaagcgcattcgaattttacacctcttaacggtaatgatgaaagcaccgtcaatatgcttagccggttactttctgctgctgccattgaaacagttgcttcaattatgaatagcgaagctaggaatatggactcccagaatatggcaaacggtgaaccatctcgctttcgttctgttgatggttcatttgaacagttcttaaccgaccttcgtagtggaaatttgactaatgttcttcaaaactcttctcaaaatggaaatgatcaaatttcttctgaccctgagtctaattcctcagaccttcaatacttaaggatgttccgttttccgtcgtttcatcagtctcacaatcaacctgcctctaataacgaagcttcagatacaaatggaccggctttggtgcctgtccttatcgtttgtatgcgtagcatttccgagacttccgaggatcatgcgccaactatgactcaagaaaatcaaagccttcataacgagagtagagaaaacatatccattaacgatataaccgaaagaatggctcagtccactgaattttccactgatcttcctcctacattcgagagaagcaattcaactttttcacatcctgaacctacaagaagtgactttagccaggcttttacgccggtatccgatttccctgcaaatctttttcctggttccagaaatttgtttccaacgtccaactcgggtaatcaatctacttcttcgttttcgcgctacaatcaacctactgtttccgtggatttaaggaattcaagtatactaagaagagctcaagaacctgtaaatggttcaactggagaaaatcacattggagatgattacatttcttcattattggatagttcaaattccaattcacaacgaccgttttcaacagtgccttctgaatcaaatgttttttcgaggaacgcctccggcaatttctcgatgtcacaaactcatcagccgactaccgataatacctcctcattttccacacagcctggaaggttatctacaggactccatcattttccgtctgatcgagatttactgtctaatcaaactagacgttctagcttagcacggagctatagatttgaggaacaactttctgttgatgataatactagcgactttagtacgttggcttccaatggggctgccgacatggttactcaaacgcattcagagggaactttctctaatagcacccatggtgattggcttatctatgtgtttggtggtctgtttccagaacatcatccagttttgtctacagttagcttgtttagcgataatcccatgtatgaagacttgttggctcttactacatacctgggtccagcgaagaaaccagtcgcttctcatgaagatgtgaaacgatcgggcggactttttgcatatttcgatgatgcttcactttctagtgctgattcttgtctaatatgtttagaaacttatactaacggtgacatatgtcgcaagttgcaggcttgtaaacattttttccatcaggcctgcatcgatcagtggcttaccactggtaataattcctgcccgttatgtcgggctcatggggttacgacacaagctgaagaggaaaat

SEQ ID NO: 46340 - DNA, 1308 bp, Schizosaccharomyces pombe
atgcctgtctttatgtttgatgagcacgacaatttgaatgagaattacaattcccatttgtctagtgacgatgagattgcagaggagggatatgattttgaagaattggaggcatctgcgtcgacaatcacttcgtcaagtgatttgaaggatggaaagaatgccaaagatgaaaaggggacggtagagtttaaggttgctgcccatggtgattttatttcttccaagggtgacaactatgtaccaagcggaaagatgcgtccagcagactttcaacccttaacggtattgggtcgtggctcttacggaaaggtgctcctagtgaagcaaaaaaatactggacgactgtttgctcagaaacagctaaagaaagctagcattgttcttcgtgccaagggcctcgaacaaaccaaaaatgagcgacagatattagaagaggttcgacatccgttcatttgtcgcctttattatgcttttcaagaccacgatcgtctttatctgatattgcaatatgcacctggaggagagttattttctcatttggccgagcaaaggatgcttcctgaggatgtggttgctttttatactgctgaattgactctagcattgatacatttacataaacttggtattgtgtatcgggacttaaagccagagaattgtcttttggatgctgaaggccatatccttcttacagactttggattgtcaaaggtggctgaaaatggagctgattgtcgttcttttgtaggcactgaggaatattgtgctccagaaattttgttggagcagccatatgatcatgccgtcgattggtggtctatgggtatcctcatattcgatcttcttacaggatctccccccttcaccgccaacaatcataagagaattatggaaaaaatcactcgtgcaaagcctaacatacctttttatgtgacttctgatgctagagacattatcaacaaatttctcaagaaaaatccaaagcaacgcctcggcgcagatggtcccgagaaaggttacgatgcaataaaaaagcacagaatttatcgccgaattgattggaataagttagagaagcgcatgctgcctcccccaattgttccttgcatcaccaatcctgaggctgcggagaatttttcagtcgagtttaccaaattgcctctttctacaacacccattcttcatgaagaatttgggaatttaacaattggtagccattcctctgcttttcaaggctttacctatgttgcgtctcccaattttctcaactgtgaatttttatctaacaacgcagtttcgaaccat

SEQ ID NO: 46341 - DNA, 2107 bp, Schizosaccharomyces pombe
atgtatcagaatggtaaaccagatgcccccacaatcttaggccagaaaagagaacttgaagatgtagaaatacaagatgatgatattcaggtatgttaacgtgttgagcctttaggcattcgaatgttaagacatgtcgctaactctgttaaaggaagtctctaaagaagacttattaaaggatgtaagagtgaggagcattcaatttgatgagttagaaagtaaaatagagggacttcaaaatttagcagaagagaaattaaaagttttagctactttggtctcttggtggcctgaaatacttcagcagtttagcgttgtgtttcaaggcaatgagctgaaggacttcgagagtgaaggtgttttttcgattttggagaaattcccggagctttcatacttcaatgacgctgtgaaaaataataaaactaaagccttgagcatcattcaaaaactcttgtctactgttgactcaagcacaaattcggtctccagagatcctttttcagttttatcaattgatgactctgcccttactgagaaattaaacaccattaatttggatattgacaagattttagatgaattggataccactcggtctcagcttcattcaattataaaactaccagatcgctcgtctagttttactttgcaatgcattaatgaatcagtgagaccccagtctactaaagtgaaagaggaagcaaccacctcctctaaggggaaagatgaagaaaagaaagttagcacggttgaacaacgtactcaactgcaacaattatccaggcttcaagaccaacaaaatggtttaatggagtctcgctcacaaagccttaaaattttggattcgaacgttaatgaaatggataaattaattatggaacgagaaaacgcattaaacaacgtcgaaactacaaacttgaaaaaatactcttcctttttagcacttaaagaagctgtttctatgacatctgagcagttacgcgtattagagcacttattgtccgaatgttctcacgaaataaatgtattgtcgcaacagtcaaagaattttaacggtgtttttgaatcttcctatcagccgttaataaacgatcttgatcatcaaatatctgttatgcaaaacgatgaaaaaagaattaataacgcaaagactgaattaagcttatcccttgaaaagaagttggaagctaaaaagcaaaaagagaaggtctacaaagacaagttagatgaacttgcgaatttagagacaatggtattggaaaagaaaaaagcggtggctacccgtgaagctgcaaacaaaatccggctcgtagaccttaacgatttggagttacaaaaagatctgtcaacttacctttctaaagagttggcttctactgaaaaagcatttaggttggtaaaacagcaaactgtgaaaagtagccactcccattatcaagaattgataaccaaatttagtgtcgaaaaggaaaaggcggagcaaaaatattttctgaccatgaagtctacagatagtcttcatgctgaagtaaagttactgcgccagaagtaccagaagaccaacgaaattatctcaaaaatgttaaatagccaagacactgctgtccatagaataatagagtttgaagatcagctagcccgtctatcatcggttcgaaataactctataaaacaatcaacaacgtttcaagtcaaaaagtcatctcaaaaatcaactattcaaaacctggaagaaaaggtgtcttatttacagcaatttatggataaaaataatgctacattaacagaccttgaatttcaatgctcagatttatcatcttctatagatatactttccaagcaagatgaagagcatgaaaaagagaagcgaaagttaaaggatactggggtatcaacgtcagctgaagagttaaaaacttttagggccatgtgtaagtgttcagtttgtaacttcgagcgctggaaagatcgaattatttctctctgtggtcatggcttttgttaccaatgcatacaaaaacggattgaaacacggcaacgcagatgcccgatttgcggtcgtggatttggtgcttctgatgttattccgatacatctttga

SEQ ID NO: 46342 - DNA, 903 bp, Schizosaccharomyces pombe
atggccaaacaaactcttcttagtaccccgttgcatggagtctatattccagtgtttttgatcatctttggtacttacattgtgaaacgcgaatgggtgggttacgctattgttgtggcattctctcttggttttcataagttctggcgtggacgcgttcgtaaagtattgagtgataaaattcaacaatttgaacttagtgataaagctgtattgaaccacaacactgccatttatcgtttccgtctgcctcgcgctaacgatgttcttggtctccccataggacaacatttaaaggtctttgttgatgttgatggtaaggagtattccagatcttacactcctctgtcttccgatgctgacaaaggttattttgatttgctcgtaaagtcttaccccaatggcaaagtgagtaagaagttttctgaacttaagattggtgataccatcggtgttcgtggccctaagggaaattggaagcatcgcactggcctcgcgcgccattttggcatgatcgcaggcggaacaggtattactcctatgcttcaaatcattcgtgctgttctttctaattttgaagatccaacggaaatcactcttttatatgctaatgtatcagagggtgatattgttcttcgtgatgagattgacgcacttgctaagaaggatcctcgttttaccgttcattatgttttgaacaatcctcctgaaaactggaagggaagtgttggatttgttactcaagaacttatcaaggcgcatttccctgctccttctcctgaaaccaaagttcttatttgtggccctactcccatggttaattcactcagagaagctacagttgcattgggatatgaaaagtcccgagccatttcgaagcttgaggatcaagtatttgtcttt

SEQ ID NO: 46343 - DNA, 3010 bp, Schizosaccharomyces pombe
atggaaacaaaggttcatttgcctcttgcttaccagcagcaggtttttaacgaacttattgaagaggatggtctgtgtgtaattgcaccaggtttgtcattgctacaaattgcagcaaatgtactctcatattttgcagttccaggatcccttcttttgcttgttggagcaaacgttgatgacattgaattgattcaacatgaaatggaaagccacttggaaaaaaaattgattactgtaaatacagaaactatgtcggttgacaaacggtaagctttggtaacatatatttgcacaggacctgatttattaataattttagagaaaagtcttatctagagggtggtattttcgccattacaagccgcatattagtgatggatttgttgacaaaaattattccaacagaaaaaatcactggaattgtattattacatgcagataggtaagcgatttctaaggaaataatttcttacatatggttcttacagagttgtctctactggaacggtagcgttcataatgcgattgtatcgtgaaaccaataaaactgggttcattaaagcttttagtgatgatccagagcaatttttgatgggaataaatgctctcagtcattgcctaagatgcctgtttcttcgacatgtatttatatatcccagatttcatgtagttgtggcagagtcccttgaaaaaagccctgcaaatgtggtagagttgaacgttaacctaagtgattcccaaaaaacaattcagtcatgcctattaacctgtatagaaagtacaatgagagaattacgaagactaaattctgcttatctggatatggaggattggaatatcgagtctgccttacatcgtagttttgacgttatagtgcgaagacaactagattctgtatggcacagagttagcccaaaaaccaaacagttggttggagatctctcgactcttaagtttcttctcaggttcgtcttttctttcctttttcgatataaataatctctaactaaacaagtgctcttgtttgttatgactgtgttagcttccttaaactcttagataccctcgttttatctgtaaatgtttccagctacccatctaatgcacaaccttctccttggcttatgttggatgccgccaataaaatgatccgtgtcgctagagaccgagtatacaaagaatcagaaggaccgaatatggatgcgattcccattttggaggaacagccgaaatggtctgtcttgcaagacgtattaaacgaagtgtgtcatgaaacaatgttagcagatacagatgcaggtataaaaaaaactctctttaaaggaagaaatattaacaaatctttcagaaacatccaataattcgataatgattatgtgcgcagatgagcgtacttgtttacagttacgtgattatttgagtacggtgacttacgacaataaagactctttgaaaaatatgaatagcaaattagtggactattttcaatggagagaacaatatagaaagatgagtaaatcaatcaagaaaccagagccttccaaggagcgagaggcttctaatacaacgtctagaaaaggtgttccaccttcaaagagaagaagggtaagaggtggaaacaatgccacttcacgcacaacttctgataatacagatgcgaatgattcttttagtagggatttacgcctagagaaaatgtacgctaattattaggttttacacgctaataagtctagtctgctctcacacttatccaaacgttatgaacctgaagtgggcaatgatgcatttgaagttattgatgatttcaattccatctatatctattcctacaatggtgaaagagatgagttagtattaaataatttaagacctcggtacgttattatgttcgattctgatcccaattttattcgaagagtcgaggtttacaaagctacatatcccaaaagatctctaagggtttattttatgtactatggaggatcgattgaggagcaaaaatatcttttttctgtaaggagagagaaagattcattctctcgtcttattaaagaacgatctgtaagttattctaaacttttcaaaacttgctaatctaaaaagaatatggctatcgtactgacggctgattccgaaaggttcgaaagccaagagtcaaagtttttaagaaatgtcaatactcgtatagctggaggaggacagttatcgatcacaaatgagaaacctagggtacgttcattatatcttatgtttatatgtattaaaacgttaaaggttatcgttgacttgagggaattccgtagttcgttaccttccatattacatggaaataatttttctgttatcccttgccaactcttagtgggagattatatattatcaccaaagatctgtgttgaaaggaagtcaattagagatttgatccaatcattaagcaatggccgtctttattcccaatgtgaagctatgactgaatattatgaaattccagttttgttaattgaattcgaacaacaccaatcttttacatctccagtaagtctgactaaaacaatctatgtctgacagcttttagcctttctccgacctttcaagcgaaattggaaaaaatgatgttcaatctaaactggtactgttaacattatcgtttcccaacttaaggattgtttggtcttctagtgcctacgttacatcaattatttttcaagatttgaaagccatggaacaagaaccagatcctgcttcagctgcctctataggtttggaagctgggcaagactcaacgaatacttataatcaagctccactcgacctgctaatgggactcccatacataactatgaaaaactacagaaatgtgttttatggaggcgtgaaagatattcaagaagcttccgaaacctcagaaagaaaatggtcagaactaattggccccgaagcaggaaggcgtctttattccttcttccgaaaacagttaaaggactatgagtaatttattttttta

SEQ ID NO: 46344 - DNA, 1626 bp, Schizosaccharomyces pombe
atgagtgcatcttctcgctttattcctgaacacagaagacagaattacaaaggtaaaggtacatttcaggctgatgagttacgccgcagacgtgaaacccagcaaatcgaaatccgtaaacaaaaacgtgaggaaaatttgaacaagcgtcgtaatctggttgatgttcaagagcctgccgaagaaactattccattagaacaagataaggaaaatgatttagagttggagcttcaattacctgatttattgaaggcgttgtattcggatgacatagaggcacaaattcaagctactgccaagtttcgaaaggctttgtctaaggagacaaacccaccaattcaaaaagttattgatgcaggcgttgtcccccgcttcgtcgaatttttatctcatgagaacaatttattaaaatttgaggcttcttgggctctcactaatgtggctagcggatcttccaatcaaacacacgtggttgtagaagcaaatgctgttcctgtttttgtaagccttttatcttcttctgaacaagatgtacgcgagcaagcagtttgggcattaggtaacattgctggtgattcacccatgtgtcgtgatcatgttttgcaatgtggagttttggagcctttgcttaacataatcgaatctaacaggcgtcttagtatgctccgcaatagtacttggaccctgtctaatatgtgccgaggcaaaaatccacaacccgattggaacagcatttcgcaagttatccctgttctgtcgaaattaatttataccttagacgaagatgttttagttgatgccctttgggccatttcctatttatctgatggcgctaatgagaagatccaagccatcattgatgcagggattcctcgtaggcttgttgaacttttaatgcatcctagcgctcaagtacagactcctgctctccgatccgtaggaaatattgttacaggagatgacgttcagacccaggtcatcattaattgtggtgctttaagtgctttactttctttgttaagcagtccacgcgatggcgttcgtaaggaagcctgttggacaattagtaatataacggccggtaattcttctcaaattcaatatgttattgaagctaacattattcctcctttaattcatctccttacgaccgctgactttaaaatccaaaaggaagcctgctgggccatttccaatgccacatccggtggcgctcgtcgtcccgaccaaattcgctaccttgtagagcaaggcgcaatcaaacctttatgtaatttgctggcttgtcaagataacaagattatccaggttgctttagatggtattgaaaatattttgcgagtgggtgaacttgatcgcgcgaataaccctgataaaatcaatttatacgccgtctacgttgaggatgctggtggtatggatttgatccacgaatgtcagaactcatctaattcggaaatttaccaaaaagcttacaatattatcgaaaagtttttcggtgaagaagacgaaatcgaagagcttgaaccagaaaccgtcggtgatacgtttacatttggaactacacaagagcctgccggcgattttcaattttcggcgactaatgccgaagatatggctatg

SEQ ID NO: 46345 - DNA, 1626 bp, Schizosaccharomyces pombe; identical to SEQ ID NO: 46344

SEQ ID NO: 46346 - DNA, 1062 bp, Schizosaccharomyces pombe
agattttgtttgcatgcccagggcaaactagaagatgtaattcaggaagccatacaacaaggttttcaatcgttttcatttacagaacatacccctagagatcgagttgaagacttatatcccgaagaagtaagtgtgcttgcaggatgatgtgtgaaacattattattattttataggtcatttcaagttttggaaatgaattgtcgggactaagtttcatgttacatttgagctttgttatatgatattactcttgtattaaaatgcttttacgatggactgctaactatgattcatttagctacatctacaaccagaagatctctttaaaacgtttgatgaatatgtgaatgaagctcgacgattgaagcaaaactatggagaccaaataaatattctaattggtgctgaaaccgaatacatacgaccagagtcagttgaacttttgaaaagcctcaatacaaaatacaacttggattactttgttggcagcgtacatcatgttaactccattccgatcgatttttctcctgaactatggcaaaaagccttacaacatgttggaaataatccagaacagctctttattgattattttgagcatcaatatgacttgatgcaacggttgcatccattagtgattggtcattttgacttgatatgtctttttgcacctgaagacgctaaggaagttttcaagaactcgaaaagtgtttgggaacttatacaacgaaacattaaatacgctgtttcttatggtggtatctttgaaattaacacctctgcatttcgcaaaggatggaagactgcgtatcctcagcaacgacttcttgagctgatggttgaacaaggagcgcaactcactttatctgacgatagtcatggaccacatcaagttggcttgaattatcatttggccaagtcgtatctggacaaatgcggtattacaagcctctgtatgatagaaaagggccccgatggtaatggcacggtggttaaaaatgttacggtcgacaatgtttggtctaaattcgttggcacaaacggaataactaacaca

SEQ ID NO: 46347 - DNA, 1453 bp, Schizosaccharomyces pombe
atgtcagaggaagtagtccaggatgcacctctcgagaataatgaactcaatgccgagatagacttacaaaaaacaatacaagaaggtatgattaaagggaattcttcattaatatatattattatgccgtaattactgacgattatactcgtttcagaatacaaactttggaaacaaaatgttccctttctgtatgacttggtaataacccacgctttggaatggccttctttgacaattcaatggcttcctgacaaaaaaacgtacgttgcttgccaaagtagttaggctatgattatactggcctttacttcaaaccatctcatcagttttctaactcgattcttgaagaataccaggtactgattactctattcaacgtcttattcttggcactcacacatctggtaatgatcaaaattatttacagattgcttctgtgcaattaccaaactttgatgaggataccaccgagtttactccttctacgattcgaagagcacaggccacgggctcgtatacgattgaaatttcacaaaaaatccctcacgatggcgatgtcaatcgtgctcgttacatgcctcaaaagcctgaaatcatcgctaccatgggagaaggaggaaatgcttatatttttgatacaacttgtcatgatgccttaactacaggtgaagcacttcctcaagcagttttgaagggccatactgctgaaggttttggtctttgctggaacccgaatttacctggaaatctagcaacaggagcagaggatcaagttatctgtttatgggatgttcagacacaatcttttacttcctctgagacaaaagtcatttcccccatagccaaatatcatcgtcatactgatattgttaacgatgttcaatttcatcctcaacatgaggcattattagcatcggtgtcggatgattgcactttgcaaattcacgatactcggttaaatccagaagaagaagctcccaaagttattcaggctcattctaaagccataaatgccgttgccattaatccctttaatgactatcttttagcaacagccagtgctgataaaacagtagctctttgggacctccgtaatccatatcaacggttgcataccctggaaggacacgaagatgaggtatatgggttagaatggtcacctcatgatgaacctatattggcatccagttcaactgatcgccgtgtttgtatttgggatttagaaaagattggagaggaacagactccggaggatgccgaggatggttctccagaattactatttatgcatggaggccacacaaatcgcatctcagaatttagttggtgtccaaacgagcgttgggtggttggaagtcttgccgatgataatatccttcaaatatggagcccttctcgtgtcatttggggtcgtgatcatgttcaggtttctcctagggatctggagtaa

SEQ ID NO: 46348 - DNA, 2590 bp, Schizosaccharomyces pombe
atggatatagatgtcttggagtttgtagataaggtaagagaatactgctgagttgtaattgataaattggtagattgcttcaatcgaatctgccggtgacaccttagatcggttgccccaattaattagcttggcgtgtgaaaaaggacaagagactcaagtttatgaacggctaaatgaattggccagcaaaagcgcgatacgcgttgaacagctctctgctgaaaacaaccaggtatgctagtctcctgtttccctaaggtataatcttacaattattaggattttagcaaatcggtaaaccagttatctgtagttcggtccgaacttcgtagtttgcaatctttaatggccgacctgaacactgacattcaagctagcggtcgtgatttacaaaatatggtgagcaattatattaagcgtggctctttcaacttgaagaaattgagcttgattaaattcttgaattttgattacgcagaaaactaacaattgtatcagaaacaacaattaaattctctaagcacatccgagagatttcttacaaaatatcataatttagtgaggagctgtatgcaagtgttgcatcaggttcagtactctcaagagttattgagtaaaaagcagtatcttcctacactcagaatttgctcagaaataagcgaagtgcatttaaaacgtttagatggattggggatgtattctaccatccaacaatacattgtcactaccaaggaagctatatgtagcgctgttatggaagacctgcatgaatggcttttcagcattagacaaaaactacctttagttggtaaatcatgctcacagcaaattgatgaagccagaagacgatgggctagggaatacaaagaggatttggttaacctaagctccaaaacctcaatttccctagaactatatttgcttgaaatgatggattgtatgtttacgttttgtttctgttttgttaacattttcagtttctcccttagataacgagatcgtcaagattagctttgaacctttatatatatgcttgcaagttcattcttatttgggcttgctcagctctttccgttcctcatttgagcgagataggagacgccaacaagagtttttagcgcctaaaagtctgaccacgctagacatggctgttgtcagcgaatggttaaattctattgctgggtttatgatagttgagtactacatattacagtgtatacccaattttcgctcttacgaagaagttcaaaacatttggactattatttgtgaaaagttggtcgaaacaattttaagtgttgcgtttacagagcaaagtaccactacaataataaaactgaaaaatcaaattgttttgcttatgcataccatggagagatttgggttttccgttgaaagtttgcggaacttatgtgtcgagcttattgatgcttttggtggagcccttatattgaagcattctgtgttctttgaagaggcgtttgaaaaggatgtgtatgctcccatgatcgttgagacacaggaggaatatgaccattatatagcgccctattggaacttcccctctgaacccttcccaagaacaatgagcttttcaaagatgtgcccactatgttgcacaactctttctaaatttgtccgtcatttcttcatgttcttaaatgattctgtcatattggctaccgaagttaatgaaaaggcaccacgattctatagaaggtttattcttcgaagccttgttgatagattgaagagtttatatccaaaacttgcactttctcaaatgtctcaacttgttaaaaacttttacgcatttgaagatcctttgttacaaatagagaaaagcctcgttttaaataagcctatacaccagattggtgcggaagcctcttctagtaataatgttaaatcaactgaattacttgaaggtttagcgaatgcacgaaagtctgcacttcacgaaatttttgttaaaataaatttaaaaatcgacgactttctcggcttggcagagtacgattggacgactactcaggtccgaaaggatgttagtggatatttgcaagaaatggttacatatctccaaaccatgtatcttgaatcgcttgcaggtcttccaaagcatgacaagtcgtacgtgtatttggagactcttgatcatctttgcactgctatggttgatttgttgtcagatccatctattcgaaaagttacgactgctgccgccgagggtttcaaattggacgttgagtatttagaaagttttgcagctcaagtacctgatcaaagcattgttaatgccgacagttttatagagttacgacaatgcgcaaatctgctgctaggagataatatggaggagtatttggatacggataagtttatgagagacttcaatagattgcaaccagcggttgctatcaagtttttagagaggtataatattcccgcatgtttacaagataattttactaaccttttgtgcaggcatattaataattattctgctaatccccttagcaatgatcgaccaaagcgaagggccattgaaattttaatagctactttgaagaaaagatagcagatc

SEQ ID NO: 46349 - DNA, 2590 bp, Schizosaccharomyces pombe; identical to SEQ ID NO: 46348

SEQ ID NO: 46350 - DNA, 1093 bp, Schizosaccharomyces pombe
atgactgttctgaatactacagataagcgtaaagctgatgataccgttaataaacttgacgggaaattaaagcagccacgtttggataatttttttaagacaaacacctcatcgcctgctttaaaggatactcaggtacttgataataaagagaacaactctgtctcaaagttcaataaagaaaaatgggcagaaaatcttactcctgctcaaagaaagctgttacagtaagtattgcttacaatgtaggctagaaaattggaaaaggttgttaacctatttagactagaaattgatactttggagagttcttggtttgatgcgttaaaagatgaatttttaaagccatattttttgaatctgaaagagtttttgatgaaggaatggcaaagccaacgtgtattcccgccgaaagaagatatctactcatggtcacatcatactccacttcataaaaccaaggtcattctcttaggacaagatccttaccataacattggtcaagcccatggtctttgcttttccgtacgtccaggaattccatgtccaccaagtttggtcaacatatataaagccatcaagatcgattatcctgattttgttattccgaaaacagggtacgttaaaattatttagtctttatattttttctttctaagatttggctttttgctaatgaagcaggtatttagttccttgggctgaccaaggcattttaatgctcaacgctagtttaactgtaagagcccatcaagctgcttctcattctggcaagggttgggaaactttcacttctgctgtcctgcaagttgcgttgaatcggaatcgcaagggtcttgtaattttagcatggggaactccagcagctaagcgacttcaaggtcttcctttgaaagcacactatgtacttagaagtgtccatcctagccctctctctgcacatcgtggcttttttgaatgccaccatttcaagaaaaccaatgagtggctcgaagagcagtatggacctgaaaaatgcatcaattggagcgctgtttctgaacaaaaagcaaaaataaagtctagcgagttggaatcctcttcaactgagtag

SEQ ID NO: 46351 - DNA, 918 bp, Schizosaccharomyces pombe
atgaatgcgaaattatcttcctccggaatggtactgaaagagcttccggaagtcgctttgcaaaagataagctcaaactactattgggctgtttttgcagtgttcctgctgtgcgcaattgtctttcctttagtatcgatattcagtttgcctcaaaagcagacttaccaccgtttcttttccatcctcagtttggtttcttgcttggcctactttaccatggcctgcaattatggattgaaaaatgtgttttcttctgcttctttttttcgagaagttagtgtacgaatggtttactatgttcgctatattcaatggttaatcaatttcccattaatcatcgtaatgctacattggacggtaggcgtatctatactagaaattgcatatgtcgtttgctatgtgctttttgcgattgtttgcttactggcggcagcattaacttcatctccctataaatgggcctattacggattttcgtttgtaggctattttattgcattggcacactcagtcgttttgcataaaaagtatgctagccgtttagagacgtctgcgcgcctagggtttttatggtcaattgtttacttacatgtcatttggttcctctattatgcatgttggattttatctgagggcctcaatgttatctcgccaattggagaagccatattttacagtatattagatcttttcgaattcggcttttttggcgctgctttttcttggatgctagacttggttggtattgaaaactttaaatcgcctcaatcgatacccttaggggcatgcagtcctgctgatgacaagttttcaatgtgtccggacatggaggcacaaaaccaagctgatgatttggccgttgaaactcgcattcaaatttccaatttaccttcttcacctacgaaaaataattgc

SEQ ID NO: 46352 - DNA, 2306 bp, Schizosaccharomyces pombe
atgtctgccactaatgggccgcaaccgcaggatctgaacagaattgttctggattaccttgcgaagaagggatactcaaggaccgaggcgatgcttcgtttggaagcatcgggttctggcgtgtcagtagaggagaagttaaaaagcattgaggaaactccagatgcatacacacacacgtatacgatcttacgagactgggtggatagttcgttagaattgtacaaagctgaacttcacaggatattatttcctatatttgttcactcatatcttaatctcttgtctcaagatcattatgaagctggtaagttggtcatattggaggaggttacgaatttgttacatgtttgtttcgatgatctacgaacaagaggggtatttgaactattctaaatacttattagtttctttatctattgagtttacaacttgtctttatttctgaaactcattccacttgaccacccatatttaattctttataaggataaatgataattttactaacgtgctatagcaaagcaattttacgaactcttcaaagacgatcatactgatcttcatgactttgatgtaaaaaacttaaaatcgctgagtcttccaagccatgtcgcagaagaccgcactgctcaacaataccggcaaaataaatatcaactccatttttctaggataacatttgatttattgcttcatttcttatttgaaaacgtttcaaacggtgggtcaattatcattaaattaatcaatcagcatatagatatccatatcgttcccggacgtcccaccgtcttggaaaatgctaaagttatcaatgaacaagaaggtattaccggccaatcctttgaacgaggagatgctcaacttcaacctgtaaagctgcaacaaatgccaatggacaaagaaatggaaaaaattgtagagatggacttagaagaagaggatatgatgcaccaaaacgatccaaataaccaatctccaaaactattaaaagaatttagaaagctgcatgaacctaatgctgaagatgctccgtctagagattatatccctcttcctcctcataaaggtgttgatattctttcagaagttgaggctgtgaaagattggagtaaaagattacatcttggacctagagcctcccttcctagtgtttgtatgtacacattccatcacaccaataacaacatgaactgtgctgaattttctcctgactccacaatgatcgcctgtggttttcaagaaagttatatacggctatggtcaataaaggctgacaaaaaatcattacctaagtcaacttctgtagaggattcagatggctcagtacgtttactgagtcattctggtcctgtttacggcaccacattttctcccgataataaatatttactatcttgttccgaagatgctagcgcccggctgtggtctgttgacacaaaaactgctttggtagcttacaagggacatactggcccggtttgggatgttgcctttggtccgtttggtcattacttcgctactgcttctcatgaccagactgcacaactttggagctgtgatcatatatacccacttagagtttttgctgggcatttaagtgatgtagacgtatgattattatcttttttaagaaatgtgtttccttatgactgacttgtatttagtgcgttacctttcatccaaactccgcttatgtgctaactggatcaagcgataaaacatgcaggctttgggatgtacatagaggacattctgttcgtgtttttaatggacatacccaaccggtaactgctgttgcgattgccccagatggtcatactatggcaagtgctggtatgttatacatttgttattactaatgattttactaatttgattaaagacagtgaaggtctaattcacctttgggacataggaacaggaaggcgtataaagacaatgcgaggtcacagaggcaacatatactctttgtcattttctcgcgaatccacggtcctcgttagcggagggtcagattgtactgtgagagcttgggacgttttcaaaactaattacaacaatcctgtttcttcttctctaacgggaagtgttgttacacctttctctgctaaaacatccacatttaatgaagtcaattggtctacaaggtatgagaaaatgtaatggaatcgatatatttactaaccttctcaaacagtccggatcaaatggtagctctttatacgaagcaaacccctatatttaatgtctcctttacgcgtcgtaacctttgcttagcaataagcgttagttagataaat

SEQ ID NO: 46353 - DNA, 1134 bp, Schizosaccharomyces pombe
atggctgatttatatacaaaagattggactgatgttaaagacaagcccgttgcacgtgttgtttttatccatggatttggcgaacatgtcaatgcttatccagagttttttgaagcattgaacgagcgtaatattgaagtttatacctttgatcagagaggttttggtcattcaagaaagggaggtccaaagaagcagggttgtactggtggttggtctctagtatttcctgacctggattatcaaattcttcgtgctagcgatacggagcttcccctatttttatggggacattctatgggtggaggattggctttacgttatggtatcagtgggacacatcgtcacaagctggctggtgtaatcgcacaagctcctatgcttcgttgtcatcctgacactgaaccaaactttttgttacgaaaagcacttactttggtttccaaggtacatcctaattttcttttcgatagcgatgtccaaagtcaacacataaccagggatgaagccgtcaatcaacgtttgcaggatgatcctcttgtttcatcggtaggttcgttgcaagtctttagtgacatgctaaacagaggtacgaaaactattgaattagctcctcagtttttccttcctctccttataacccatggtactgatgataatgtgacttgttccgattcttcaaaagaattttatgaaaatgcgggcactaaagataagacatatcaatcgtatccaggattttaccattctttgcatattgagaagaaaccagaggtttatgagtaccttgacaaagttgctgcttggatttacgaacactcaaagcctagtgaaactgtaaagtcggaacaggaaaccgctgttgaacatcctaagcctaccgctactacatctgctccttctgcttctcctactggagttcctgttgaagaggagtcacataaagccacgtcggatgctgttcctcctgctgaagcaaagcctgagcctgtaccagcatcagctgcagaaagggcgcctacttctgaaagtaccactgttcctgagaccatagtggcatcaacaaccaaggtaatttcagaaccagctcctagagttactactgcggccaccgccgatattgtaaccaataaa

SEQ ID NO: 46354 - DNA, 3529 bp, Schizosaccharomyces pombe
atgactacagagcttactaatgtatctttggaagaagctatcacggaaaaaacaagcgaaaatagaagaaagagagattcagacgttcttcaaactgaagaagtggatttggtatgtttaaactcttgccgtttttataacgaaacgcgttctcaattgcgagagaaaaggttctttgttggttgaaatttgtatattaatattttatttttaatagtcaaatgtgaaaagaattcgggcttctcgaaatcaagataatagacccgaaaggcaatctcgacttcagcgatcatcttcattgattgagcaagttagaggtaatgaagacggagaaaatgatgtcctcaatcagaccagagagacaaattcaaattttgataaccgcgtgggagtcattgagtgtatccatttggtgaattttatgtgtcatgactccttgaagattaattttggacctcgtatcaactttgtcattggtcataatggtagcggaaaaagtgctatacttacaggattgactatttgccttggagctaaagcctcaaatactaatcgcgctccaaacatgaaaagtcttgtaaagcagggaaagaattatgcccgaatctctgttacgattagtaaccgtgggtttgaagcataccaacccgaaatatatggaaaatctattacaattgagcgtactattcgaagagaaggatccagcgaatatagattgcgttctttcaatggaacggttatttcaaccaaacgcgatgaactagacaatatctgcgaccatatgggtttacaaattgacaatcctatgaacatccttacgcaggatacagcacgtcagttcctgggaaattcaagtccaaaagagaaatatcagctctttatgaaaggaattcagctgaaacagctcgaagaaaattactctttaattgaacaaagcttaattaatactaagaatgttttaggaaataagaaaactggggtctcttatttagcaaagaaggaagaagaatataaacttctgtgggaacaatctcgtgaaactgaaaaccttcataacttattagagcaaaaaaagggggaaatggtgtgggctcaagtggttgaagttgaaaaagagcttctgcttgcggagaaggagtttcaacatgctgaagttaaactttcagaggccaaggaaaatttagagtcaatagttaccaatcagtctgatattgatggaaagatatcttcaaaagaagaagtgattgggagagctaaaggtgaaactgacactacaaagtctaaatttgaagatattgtgaaaacatttgatgggtatcgttcagaaatgaatgatgttgatatacagaagcgtgatatacaaaacagtatcaatgctgccaagagttgcttggatgtgtatcgtgaacaactgaacactgaaagagctcgagaaaacaatttgggaggttctcaaattgaaaaaagagcaaacgaatcaaataatttgcaacgtgagatagcagatttaagtgaacaaattgttgagcttgaatctaaaaggaatgacttgcattctgctcttttagaaatgggcggcaatttaaccagcttgttgacaaaaaaagactcaattgccaacaaaatctcagatcaaagtgaacatttaaaagtattagaagatgtccaaagagataaagtttctgcatttggaaagaatatgccgcaacttcttaaactcatcactcgggaaacaagatttcagcaccctcccaagggacccatgggaaagtatatgacagtgaaagagcaaaaatggcatttaattattgaaaggatattgggaaatgttatcaatggttttatagttcgtagtcatcatgaccaattgatccttaaagagctgatgaggcaaagcaattgtcatgctacagttgtagttggaaaatacgatccttttgactattcttctggtgaacctgattctcaatatcctacggtgctcaagattattaagtttgatgatgatgaagttctacatacgctgattaatcatttgggaattgaaaagatgttattgattgaagaccgacgtgaagcagaagcttatatgaaaaggggcattgctaatgttacccaatgttatgctctcgatcctagaaaccgtggatatgggtttcgaattgtcagtacacaacgatcttcaggtatatcaaaggtaacgccttggaatagacctcctcgcattggattttctagctcgacgagtatagaggcagaaaaaaaaattttggatgatttaaagaagcaatacaattttgctagtaatcagctaaacgaggccaaaatcgagcaagctaaatttaaaagagatgaacaactgttagtcgagaaaatagaagggataaaaaagaggatccttttgaaacgtagggaggtaaactcacttgaatcccaggaactttctgtgctagataccgagaagattcaaacccttgaaaggcgcatttctgagactgaaaaagagctcgaaagttatgcaggacagttgcaggacgcaaaaaatgaagaacatcgaataagggacaatcaacgcccggtaattgaggaaatcagaatttatagggagaagatacaaacagagacgcaaaggctctcatccttgcaaaccgaactcagtcggctacgtgatgagaaaaggaattctgaagtggatattgaaaggcatcgacagacggttgaatcctgtaccaatattttgcgtgaaaaggaagctaagaaagttcagtgtgctcaggttgtggctgattacacagcaaaggctaatactcgctgtgaaagggttcctgtacagcttagtccggctgagctcgataacgaaattgaaagactgcaaatgcaaatagctgaatggagaaatcgcacaggtgtttcggtggaacaagcggctgaagactatttaaatgcaaaggaaaaacatgaccaagccaaagttttagttgctagactcacgcaactattgcaagctttagaagagacgttacgaaggcgtaatgaaatgtggaccaaatttcgcaagctaattactctgcgaacgaaagaactttttgaattatacctcagccagagaaattttactggaaaactggtaattaaacaccaagaggagtttttggaacctagagtttacccggcgaatcgtaatttagcaaccgctcacaatcgccatgagaagtctaaagtcagcgttcaaggattatcagggggtgaaaaatcttttgcaacgatttgtatgctgttgtcaatttgggaggcaatgagttgtccgctccgctgtcttgatgaatttgatgtgtttatggacgctgttaatagactagtcagtattaaaatgatggtagattctgcaaaggattcttcagataagcaatttatttttattacacctcaggacatgggtcaaattggtttggacaaagacgttgttgtttttcgtcttagcgatcctgtcgtttcctcttcagcacttcctccctctacggcgccatga

SEQ ID NO: 46355 - DNA, 3198 bp, Schizosaccharomyces pombe
atggatgaggagtttgaaaatgactttccttacaaggtgatgcttaatcagcaacaggatccttctgatgcgcaatcgagtcctacatttgttccttctgcaaacccttccctcaccactccttggttacaaaccactccctctgctaatcgccccacatggctaccgttacagcagcacatgcatcagcttcgacacactggtcttttacccgccgttgaatcgtcctttgttcatggccatcgtcgaagtgctagtgctggcgttggtatgggcaatttttccaaccaagccactattccttctaattctccagccgtttctaatatgcaaccaccgactcaaggcggtcaacccttataccctactaatttcttcaccacttcggtctctgcctcttcagattccttccctaacagtccgaccgttccttcaaagtttagcttaaatccatcagttgctacatctacgaacattagtccaaggcggcatgcaaaaagccatagtgttgcttctgtttcctctcccaattcccataacgccgtaccgtttactccccatgcgttcgttcctccagtcaacaacgcatctcctttaccagccttgaacactttaccacaattattgcgccctcgtaatttggatgctcaatggcgtccttcatcactttctcaaacgaatagtcctactcatgccgcgaatccatcttttcctgggactattgtaactcataatacctcaaactttcgtcctgaaggcggtggtcatcgtcatcgtcgatcgactggcagcttaagtgttggctcctctggctctggtttttcttcgggaggttcaggtaatccccgtaaaaatcttttttctccttatttaccacagtcatcgattcctgctctactcgctgagcgtcgtttggtaacgggtattttaattgtaagtaagaaaaatagatcagacgcttttgttagtgtcgatggtttggatgcggaagtattcatatgtggttcgaaagatcgcaatcgtgcccttgagggtgatgtcgttgccatagagctgttagacgttgacgaggtatgggctggtaaacttgaaaaggaagagaatcgaaggcgtaaagacccaatttctactagaggctcttttgacaaccttcgaattgacgccgtaccgtttgaggttcctcagaggtctgctataaaagcaagagatgatgaacaagtggaagggcagaccctgttccttcttgaccaaaagcagcttggtgcggacgaaaagccaaagtatgctggtcatgtcgtagcagtcttgcagagggcgccaggccaggtattttctggtacgcttggcatacttcggccaagtagtgccgctaataaggagaggcagacctcgtcgggtaatcaaggctcttccaataactcgggaaatgacaagcccaaaatcgtatggtttaagccatctgataaacgtgtgcctttgattgcaattcctactgaacaagcacccacagactttttgggtaacgatcaagcatatgctcaacgattgtttttagcttctataaagcgttggcctgtaacttctctacatccttttggtatgttggttggtgaattaggatctatggactctatgtctgctcaagtatccgctttattacacgatacgggtgttcatagtgaaccatgggaaggatccgccgctacatccgccgtaactgcactcaatgctttatcggataattttttaaacgttgctggttgtgcagattatcgatctgaagatgtctttttatttgttaaaaatgacgttagcaaagcagccgtttcagaagtcaagcaacatgaatcaaacatcaattctagttctgctactgatttcgtttcttctgcctttcatattcgaccaacttcaactggttatcatgtaggaatccatgttactgacgtttctcgtgttattgagccaggatccccattagatcgcgaattacagcgaagaagtattgcggtgaatctttgccaaaagtcggttcctttgtttcccactacgttaggtgaggctttatctttacgagaagataaggattgttatacaatgtctctcttactggatgtttcctcaactggtaaaattcgtggcacttggattggatgggctgtcattcgtcctcgcaaggcatataccatgaaggaagctgatgagttgcttcaaactgatgctagacttcgtttattccataccgtaagcagtcgcttacgaactcatcatcttggtacagacgtgccactcagccggtattgtaggttagtacgtcgatgggatgaagaaagctgcagctttgatcccaatgaaacgaatctttttatttcctcggcggttgaagttttacgtgaaactcttttggatgccgctaatagagccgttgcaagccacttgcgtcaggaattccgtgaaaatgcattccttaggactcagcgattgccctctcgagaaaactgtcgcatattacaaagtatggccattcagatgggatgtgttttagatttgtcttcgacaaaatcacttttacgctctttaagtttgatcgaagacgatactgttcgtaacattttgcagctttattattataaggttaccccaagagcagtttatgaaatgcagaagtataaaggcaatctcgcttcccagatgatgagtcttggtattgaggacgaaagtgacgatttgacacattttacagcacctttggaacgttatggtgatattgtagttcattatcaactgcagttgcttttgagaggagaactggcttctgaaaagcgccttcgtgtatggtcgcaagcggcaaacgatgcaagccgtcgtctggttataagcaaatttgcgcaagaaactagcattcatataaaaatatttagtgactgggcggagagtcaggtttggcaagacggtctcgtatgttttgttgctccatcatattttgacgtatttttcccatctctaggcatggagaaacgtgttcatttagatttgctcaatctaacccacgtaaggtttgaagaggaccagggcattttatctttatacgacgagagcggagccgttacagttgttaaattgttgacctctgtcaaagttaagctctttgtgcagctttcgactccacctcttatcaacgtttcaaatgtcgagttt

SEQ ID NO: 46356 - DNA, 915 bp, Schizosaccharomyces pombe
atgaactaccaaaggcttgaaaagttaggtaagtatgagtttgaggtcccaaaatttgcaatttcattaacttaagtaggagagggaacatatgcgcatgtttataaggggcaaaatcgagtgactggtgaaattgtcgctctcaaagttattcgtattgatgcagatgaaggaacacctagtactgctatccgtgagattagtcttatgaaggagcttaggcatcccaatattatgtctctctcagacgttttgcaaaccgaaaataagcttatgctcgtttttgaatatatggaaaaagatttgaaaaagtacatggacacttatgggaaccaaggagctcttccaccttctcaagtaaaaaattttactcaacaattactcaaagggatatctttttgtcacgaaaaccgagttctacatcgtgatctgaaacctcaaaatttgcttatcaacagtcgtggtgaattgaaattggcggattttgggttagcccgttcaattggaattccagtgaatactttttcaaacgaagtggtcaccttatggtatcgtgctcctgacgttcttttgggttctcgagtatattcaacttccattgatatttggtcagttggttgtatcatggcagaaatggctacaggacgtcctctatttgctgggtcaaataatgaggatcagctactaaaaatcttccgattattgggaactcctactgaacaatcatggcccggaatttctttacttcctgaatataagcctactttccctatttataaagcacaagatctcgcctacctatttccaacatttgatcctcttggtttggatttgttacgacggatgcttcgtctacaacctgaattaaggacgaccggccaggatgcgcttcaacatgcttggtttttaaccgca

SEQ ID NO: 46357 - DNA, 927 bp, Schizosaccharomyces pombe
aagattaaaacttacaaacctatatctcctggtcttcgtcatttaaaaagaccagttagtgattacctttggaaagggaaaccttttcgacctttgaccgttgcaaaaagaaaaaaaggtggaagaaatgaaacaggaagaattactgtaaggcatcagggtggtggacacaaacaacgtattcgtcttgttgactttgaaagaaaagtaccgggtgttcatcgagtgattagaattgagtatgaccctggtagaagtggtcacattgcccttgttgaaaaattgaattccgaaacagccaacaaaagttatattttggcttgtgacgggcttcgcgaaggcgatacagttgagagctttcgatcgcttttgaagactggttctaatggcgagccagtagaaatggaccccgtcctagctgctgaaattgaagatggaacttttgcagcaaaaaatttgaagccaggaaattgttttcctctcagattaattcctataggaactgtcattcatgccattggtgtaaatccaaatcaaaaggcaaagctatgtcgttctgctggcagtagcgctcgtatcatagcttttgatggtaaatatgctatcgttcgtctacaaagtggtgaagagagaaagattttggatacatcatttgctaccattggtgttgtaagcaatatttattggcaacatcgccagcttggtaaagccggtcgttcacgttggcttggcattcgtcctacggttcgaggtacagctatgaatccatgtgaccatccacatggtggtggtggtggtaaaagcattggtaataaaccttctcaatctccttggggtgttttggctaaaggtggatacaaaacaagaagaggtaaaaatgttaataaattactcgtccgcgatcgtcctcgtggaaaggaaaagcgg

SEQ ID NO: 46358 - DNA, 1517 bp, Schizosaccharomyces pombe
atgtccttgacagtatggaatattgaatccatcaaagatgttgctgaaatgcttgggattggcaatcttgccgatgaaccagcagcagctattgcaatggatctcgaatatagaattcatcaggtggttcaggtaggtttcgtgaaagtagactatgagattttactttctttggaagaggctaaaataactaaaaaattgttgctagttttttacgatgcctttcaatttgctagatagtctgctttattctgacattaaacataattctctaacagtatttgatttaggaagccactaagtttatggttcattctaaaagaactgttttaactagcgcagatatctcttcagcgttacggacgttgaatgttgagccgttatacggcttcaataattctcgtccattagaatttcatgaagccgctgtaggtgcaggccaaaattccctttactaccttgatgatgaggaagtggattttgaaaaaatcataaacgctcctctccctaaagtccctagaaacatttcttacagtgcacactggctggccatcgaaggtgtgcagccagccattcctcaaaatccaactccctcagatcacacagttggagaatgggcatccaagggtacttcaggggttatgccaggtgcttcaactgctgctaaagaagctcgaaacggtgtcacttcgatggacaacgttgagataaaaccgttggtgcgacatgtgctatccaaagagttacagctttattttgagcgtattaccagtgcattgcttgatgaaactaatgttgagctccgtgatgctgccctatcgagtttacgtgacgaccccggattacaccaacttttaccatacttcataatgtttttatcggattctgtaactcgaaacttaggaaatcttgtggttcttactactttaatgcacatggcctgggcccttcttgataaccccaacctttttgtagagccttacgtccaacaactcatgccatccatccttacttgtttggtcgcgaagcgccttggcagtgatcctaataatcacgagcattatgcactaagagacttagctgcttttttactcgggattgtttgtgatcgatttggtaatgtgtattatacattaaagcctcgcgttactcgcacggcactcaaagcatttttggataacaccaagccatattccactcattatggtgccatcaaaggcttaaaaactatggggaaagaagctattagagtcctcgtcgttcccaatatcaaagtttacgaagtcctagttcggaaaaccttggaaaaaggaaatgaagaggagatttacgaggccaataaatgtatggatgctttgtacgacgctttgctattactgcgggatgatcaattaccaaatcaacgaactcttccgccaaatgctagtggtcttcttgagaagaacgttggcagtttaatggctgaaaagataatgaaggaaaacgatacctcattgcttcttggtctgctagaatag

SEQ ID NO: 46359 - DNA, 1869 bp, Schizosaccharomyces pombe
atgaatcaaaattcggatactactcacggtcaggccttaggcagtactttaaatcataccaccgaggttacgcgtatttctaattcctctgatcatttcgaggattcttcttcgaatgttgacgagtctttagattcttctaatccttcatccaatgagaaggcatcacacactaatgaggaataccgttcaaaaggtaatcaaagttacgtcccatcttcatcaaacgaaccctccccagaatcctcatcgaattcggattcttcctcatctgatgattcatcggtcgaccgtttggccggtgatccctttgaactaggggaaaacttcaacttgaagcattatttaagagcatacaaagattctttacaacgagacgatatcatcactcgtagtagtggtgtctgcatgcgcgaccatagtgtttatggcgttggttctggatatgaatttttgaaaacatttcctgatatttttttacaaccttatcgagctatcactgaaaaacaagtggtggaaaaagccattttaagtcattgtcatgctcttgccaatgctggtgaactggtgatggttttgggacaaccaggttctggatgttccactttcttgcgttcagttactagcgatactgttcactacaagcgtgtcgagggaaccactcattatgacggtattgacaaggccgacatgaaaaagtttttccccggtgatcttttatacagtggtgaaaacgatgtccatttcccatctttgactaccgctgaaacccttgattttgcggctaaatgccgtaccccaaacaaccgtccttgcaacctcacccgtcaagaatatgtgagtcgtgagaggcatttaattgctaccgcatttggcttgacacacactttcaataccaaggtaggtaatgatttcgtacgtggtgtctctggtggtgaacgtaagcgtgtaactattagtgaaggttttgctactcgtccaactatcgcttgctgggataatagtactcgtggtttggactctagtacggctttcgagttcgtcaatgtccttcgcacttgtgccaatgaacttaaaatgacatccttcgttactgcataccaagcttcggaaaagatttacaaacttttcgatcgaatttgtgtactttatgccggtaggcaaatttattatggaccagctgacaaagccaagcaatacttcttagatatggggtttgactgtcatcctcgtgaaacaactcctgacttcctcactgctatttctgacccgaaggctaggtttcctagaaagggtttcgaaaatcgcgttcccagaacccctgatgagtttgaacaaatgtggcgcaatagttctgtatatgctgaccttatggccgaaatggaaagctatgacaaacggtggaccgagactactcctgcttcttctgaagcccccgaaaaagacaactttggaagcgatatctctgccactaccaagcatgagctctatcgtcaaagtgcggtagcggaaaagagtaaacgtgttaaggatacctctccgtatactgtgacttttagtcaacagttgtggtattgtttagctaggtcatgggagagatatatcaatgatcctgcatatattggttcaatggcttttgctttccttttccaatctcttattatcggttctattttctacgatatgaaattaaacaccgttgatgtattctcacgtggtggtgttcttttcttctctattctgttttgcgcacttcagagtctttctgaaatcgctaatatgttttcccaacgacccatcattgctaagcatagagcttctgctttgtaccatcctgctgcagatgttattagtagcttgattgtcgat

SEQ ID NO: 46360 - DNA, 1750 bp, Schizosaccharomyces pombe
atgtcaaaacgcggtgctgatcatcagttaactaaggatcaagatgattctgatgatgaccgtcatggtccagttgaagttcctaaggaggcctccgcagacgtgatggccacaagaaagtatgtaacgatgaaacatagttcttcaattttttaggtactaatgtattagaattgcaaagccaaaatctagaaaaagaccaacgagcggtgtttcttctccgggaatttttgcaaatttggcagcaaaaccggtgtctttacctgcatcgactacgcaatttacatttggaaaacccgcggttacagctaataatgattcagatattcacttgaaaaaacgcggtcttaataaatcatttattgacgctgttatcaaaagtgttgacaataatccctttggtaatttgagccctctgtttgatgaatacaggcagcatttttcaagtatagaaaaaaagccagcagaaggtaatgcgtttatagttagtacttcatttctttctaacgttttcttagaacaaccaacttcaaatgctgttgtgtctgaggtaaatcctcagcaacaaaaaagccaagattcttcttcttttgttacagaaaaaccagcttcttcagaaaaagaggataaggagaagccccttgttccccccggtgctcctaggttcggattttctgctccagcgcttggtagctctttccagtttaattcatcggcttttactcctaaagggtcatttggtgagaagtccgcaacagaagcggaagcgaaggagaaagaaacatcttctaatcaaactgccactggtactgccgctaccacaaccaaccagttttcattcaatactgccgctaatcctttcgctttcgctaagaaggaaaatgaggaatcaaaaccattaactcccgtgttttctttctcaacgactatggcttctgcggatgcttcaaaagagaccaaacaaacccatgaaactaaagattcaaagagcgaagaatctaaaccctcgaacaatgaaaaatccgagaacgccgttgaacctgccaagggaaatactatgagtttttcttggactcctgataagcctatcaaatttgacacacctgagaaaaaatttacatttaccaatccattatcgagcaaaaagttaccggcctcttcggatgtgaagcctcctagcgctgcggctgtcggcttttcatttggaactactactaatccgttctcttttgctgctccgaaatcttcttttcctacttcttctactccagcttctgttggcgctgaaaaaagtgaagaaacttctaatggaaacaaatcagagcaagaagaaaaggaaaacggaaatgatgaaactcgatcgaatgattctctagtttctggtaaaggaaaaggcgaagaaaatgaagacagcgtatttgagacaagggccaagatataccgtttcgatgctactagtaaatcttattctgatatcgggattggtccattaaaaattaacgtagatcgtgacactggctctgctcgcatccttgcgcgtgtcgagggaagtggaaaacttttgttaaacgttcgtttgtgccaggattttgaatacagcctggctggtaaaaaggacgtaaaagtacctgctgcttctactgatggaaaatcaattgaaatgtatttgattcgtgtgaaagagcctagtactgcggaaaagttattagccgaattgaatgagaaaaaggtctcaaagtcagagaactag

SEQ ID NO: 46361 - DNA, 1841 bp, Schizosaccharomyces pombe
atggaagaaccagaagaagctacgcaggctactcaagaggcaccactacatgttagtcagaacatagccaaacaggtggttaacaacgaaaatgtatttatgaaattggttatgactcgcatgcttgatggtaagacagaagtgattcctcttactacagatgtgcacaatgggttttggagatttggacgtcataaatcttgtgaagtggttttaaacggacctagagttagcaactttcattttgaaatctatcaggtatataaaataatagtggccagctgaactcgtttagttttaattgaacttcaatctctttaagacataattatctaacgaaatgacccaggggcatagaaatgattccgatgaatctgagaatgtcgtttttttacacggtaagtctaaaggattaaaaaatcttttaaagtcttctgcctcttccaccttttctaacaatttcagaccactcttctaatggaacatttctgaattttgtaagcgagagcttaattcgtttacaatttactgacgtcatttaggaacggcttgccaagaatagtagaactatcttgtcaaacggagatgaaattcgaattggcctaggtgtgccgaaagatgaaatttgtacgtcctttacactgaaggagattgttgacgtagaattcacttcaagtttgcttacagtcttatagcttttttgtgccaggtaccagttaaacattcacgagattcccagaaaaacatgattaaatccgagaacagtcattacgaaattattcgtacacttggaagtggtacatttgcagttgtcaagctagcggtagaagtgaatagtggcaagtggtatgctattaaaattatcaacaaacgaaaaatccttttgacaagttcggaaaagcgagctactgaaatgtttcaacgagaaattgatatattaaaatctttgcaccatgtgagtatcattttatgttcacctttttttatacgaaaaactcctagctaacacttatcttttagccaggagttgtacaatgccatgaaatttttgaaaatgatgacgagttatttattgttatggaatatgttgagggtggggatcttatggattttttaattgctaatggctccatcgacgaacaagactgtaaacctcttctcaaacaacttttagaaacgcttttacatttgcacaagcagggtgtgacacatagagacataaaacccgaggtatatcttgtttattgataagaaagtctaacttgtagaacattcttataacaaatgatttccatcttaaaatatctgattttggcttggctaaagttattcatgggacgggaacctttttagaaacattttgcgggacaatgggttatctagcaccggaagttttgaagtcaaaaaacgtcaacttggacggaggttatgatgataaagttgatatatggagtttgggatgtgttttatatgtgatgtaagtttgtcggctttaatcaattagcaatgaaccttcatgccttaattttttccaattactaattcacaggcttactgcgtctattccttttgcatcttcgtcacaagcaaaatgtattgagttgatatcaaaaggtgcatatccgatagagcctttattagaaaacgaaatttcagaagagggaatcgatttaatcaacaggatgcttgaaattaatccagagaaaagaatatctgaaagtgaagctctccagcatccttggttttacactgtgagcacacacgaacatcgtactccaccatcatcgtctgaacatgaggccaccgaacagctcaattcttcgagttagattattaatatt

SEQ ID NO: 46362 - DNA, 647 bp, Schizosaccharomyces pombe
atgtctgactatgaagaggatgaggcctttggaatggacggtgctgttatggaggaggaagtcgatgaactggagatgatcgatgaaaatgggcaatcacagcaaggcgtctctcatcctggtgaaccttcgactaccgttattactgaagatgttgctagctcaaaaacagctcaatctggtaaagcggtagcaaaggaagaccgaaccactactccttatatgacaaagtatgaacgcgctcgtattttgggaactcgagcacttcaaattaggtgagtagatgcgtggatttacaataaagcgtcgtacaaaggcactagcgtaattgcttaagtcctgaatcgttatgctgttttgcagtcatggagtttaaaaaaaaacgatatagttaaaaattttttttttattttctagttaggattgtctgattatgatgaattttgtttcttttcaattgagctttcttttaatttctaactctttattttagtatgaacgcacctgttttagttgatttggaaggtgaaactgatcctttgcaaattgccatgaaggagcttgcacaaaaaaagattcctctactagtccggcgatatttacccgatggcagttatgaagactggagtgtagcggagctcatttaa

SEQ ID NO: 46363 - DNA, 3999 bp, Schizosaccharomyces pombe
atgtcctacgcaaattatcgttatatgaaagcaagagcaaaacgatggagaccagagaatttggatggaattcaaacatcagacgaacatttaataaacctttttgcaaaaatattatcgaagcatgtaccagagatagggaaattcgatccaaataaggatgttgaaagttacatttcaaaacttgatcaacactttactgaatacccttcattattcccaaatgagcatactaaaagacagtatacattgaatcacctagaagaattagagcaacaattcgctgaacgcatgttttctgagaatggaagtcttacatggcaagaattactcagacaaacagggaaagtacaaggatccaacaaaggtgatcgtttaactaaaacatttgaaggttttagaaatcaattggacaaagttcaatttataaggaaactcatgtcaaaagcaaatgttgatgatttccatactcgcttgtttatattatggatgctgccatattccttaaggaaattaaaggaaagaaattactggaaatcagaaatcagtgaaatttatgactttttagaggacaaaagaacagcctcgtatggtaaaactcacaagcgttttcaaccgcaaaataaaaatctaggaaaagagtccctttcaaagaaaaataacaccactaatagcagaaacctgaggaagacaaatgtttcgagaatagaatactcatctaacaaattcctaaatcatactaggaaacgttacgaaatggtattacaagctgaacttccagacttcaagtgctcaataccctgtctaatcgatacgggcgctcaagcaaatattataacagaagaaactgttcgagcacataaactgcctaccagaccctggtcaaaaagtgtgatatatggtggagtttatccaaataagattaatcgcaaaacaataaaacttaacataagtctaaatggaatatcaatcaaaacagaattcttggttgtaaagaaattttcgcatccagctgctatctccttcacaacattatatgacaataacattgaaatatctagcagtaaacacacgctctctcaaatgaacaaagtttcaaatattgtcaaggaacctgagttaccagatatctataaagaattcaaagacattactgcagaaaccaatacggaaaagctaccaaagccaataaaagggttagaatttgaagttgaactaactcaagaaaactacagattacctatcagaaattacccgctaccaccgggaaaaatgcaagctatgaatgatgaaattaatcaaggattaaaaagtggaattatacgagaatctaaagccattaacgcctgtccagtaatgttcgttccgaaaaaggaaggcaccttgagaatggtggttgactacaaacctttaaataagtatgtcaaacccaatatatatccgttaccacttattgaacaattacttgctaaaatacaaggttctacaatttttactaaacttgacctcaaaagtgcctatcacttgatacgagtaagaaaaggagatgaacataaacttgcttttcgctgtcctcgtggagtttttgaatatctagtaatgccttatggcatatctacagctccagcacattttcaatactttatcaatacaatacttggtgaagccaaagaatcacatgtagtatgttatatggatgatattttaattcattcaaaatcggaatctgaacatgtaaaacatgttaaagacgttctacagaaattgaaaaatgcgaacttaattatcaatcaagcaaaatgtgaatttcaccaatcacaagtaaaatttatagggtatcacatttcggaaaaaggatttacgccttgtcaagaaaatatagacaaagtcttacaatggaagcaacctaagaatcgtaaagaattacgacaatttctaggttctgtcaattatcttaggaaattcattccaaagacatcacaattaacacatccactcaataatcttttgaaaaaggatgtacgctggaaatggacaccaacacaaacccaagcgatagaaaacattaaacaatgtttagtttctcctccggtgctacgacactttgatttcagtaaaaagattctactggaaactgatgcttcagatgtcgctgtaggagccgtattgtctcaaaaacatgatgatgataaatactatcctgttggatactattcagcaaagatgtctaaagcacaattaaattatagcgtatcggacaaagaaatgcttgcaatcattaagtctctcaaacattggagacactatttagaatccactatcgaacctttcaaaattttaacagaccatcgaaacttaattggtcgcattactaacgaatccgagcctgaaaacaaacgtttagctcgttggcaattatttttacaagacttcaactttgaaattaactacagacctggatcagcaaatcacatagctgatgccttatccagaattgttgacgaaacagaaccaattccaaaagattcagaagacaatagtatcaactttgttaatcaaatctcgataaccgatgattttaaaaaccaagtggttacagaatatacgaatgatacaaaattgttgaatttactaaacaatgaagacaaacgagtggaagagaatatccaactcaaagatggcttactaattaacagtaaagaccaaatcttattacctaatgatactcagctgactaggacaattattaaaaagtatcatgaagaaggtaaattgattcatccaggcattgaacttcttacaaacattatattacgtagatttacgtggaaaggaataagaaaacaaatacaagaatatgtacagaactgccatacatgtcaaataaacaaatctaggaatcataaaccttatggacctttacaaccaattcccccatcagaaagaccttgggaatctttatcaatggattttattacagctttaccagaatcatctggttataatgcacttttcgtggtagttgaccgattttcaaaaatggcaatcttagtaccttgtacgaaatccattacagcagagcaaacagctcgaatgtttgatcaacgagttattgcttatttcggcaatccaaaagaaatcattgcagataatgatcatatttttacttcccaaacgtggaaagatttcgcacataaatataatttcgttatgaaattttcgttaccatacagaccacaaactgatggacaaactgagcgtacaaaccaaactgtggagaaattactaagatgtgtatgtagcacacatccaaatacatgggtagatcatatatccctagtgcaacaatcttacaacaatgcgatacattcagcaactcaaatgacaccttttgagatagtacatcgctattcaccagctttatcacctttagagttacctagctttagtgacaaaactgacgaaaactctcaggaaacgatccaagtatttcaaacagttaaagaacacttgaatacaaacaacataaagatgaaaaagtatttcgatatgaaaatacaagaaattgaagaatttcaacctggagacctagttatggtcaaaagaacgaaaacaggttttcttcataaatccaataaattagcacctagttttgcaggaccgttctatgtgttacagaagtcgggtccaaacaactatgaattggatcttccagattcaatcaagcacatgttttcatctacttttcatgtttctcacctagaaaagtatcgacataattcagaactcaattacgctaccattgatgagtctgatattggaacaattcttcatatcctagaacataaaaacagagaacaagtactctacttaaatgtcaagtacatttcgaatctaaatccgagtactattatgtcaggatggactacattagctacagcgctacaagcggacaaagcaattgtcaatgattatattaaaaacaataatctaaatatc

SEQ ID NO: 46364 - DNA, 966 bp, Schizosaccharomyces pombe
atgtcttcattggaacaattaaaggccactggcactgttgtcgtctccgatactggagattttgaatcgatcgccaaatacaaaccccaagatgccaccacaaacccttctctcatcttggccgcttctaagaagccccaatatgctgctctcgtcgacgctgctgttgactatgccaaggcaaagggtggttccatcaactctcaaattgagattgcttttgatcgtcttttgatcgaattcggtaccaagatcctcgctatcgtccctggccgtgtctccaccgaagttgatgctcgttactcttttgacacccaaactactatcgagaaggctcgtcacctcatcaagttgtacgaagccgagggcattggtcgtgagcgtgttctcatcaagattgcctccacctatgagggtatccaagctgctaagcaactcgaggaagagggcatccactgcaacttgactctcttgttctcttttgtccaagctgttgcttgcgccgaggctaacgttaccttgatttctcctttcgtcggtcgtattctcgatttctacaaggctaagaataaccgtgactataccgctcaagaagaccccggtgtcgtcagtgtctctaacatcttcaactactacaaaaaattcggttacaagaccattgtcatgggtgcttctttccgtaacgtcggtgagatcaaggaactcgctggtgttgactttttgaccatctcccccgcccttcttgagcagctcaacaacagcaccgacgctgtccccaagaagcttgatgcctccaaggcttccagcctcaatttggagaaggtttcctaccttactgatgagcccaagttccgtttcgactttaacaacgacgaaatggctgtagtcaagttgtccactggtatcgctgcctttgccaaggatgctgatactcttcgtaccatcttgaaggctaagcttgaggcc

SEQ ID NO: 46365 - DNA, 1749 bp, Schizosaccharomyces pombe
atgggcttcaagttgaatccattttcaaaaaagcccaaagatgaggagcctttacccttagagcaatatgaagcttctgagcaaaaaattttaggccttgtcactaaaaaggaggccaaacttcttgcaattgctggtactggttttcttttggacagttacgatcttttcattattaacttggtttcgccaattcttgcttatttgtattggggtggattgacaggacatcaagattatccttctggtattcgcggtgttgtaaatgctgctaccaacattggaaatattatgggtcaacttttatttgggtttttgggtgatttcttcggtcgtaaatttgtctatggcaaagaaatgatggttgtcattatcgctactattttaatcatttgtctccctgatcgtattcctacaccgactgctaaaatgatgtggctttttgctttccgtgttatgttgggtattggtattggtggtgattatcctatgtctgcatccatcacttcagagcagtcattgattaaccgccgtggtgctttgctcgcttggattttctccaaccaaggatggggtactctggctggctgtgttgctactttgattattttggcttgtttcgaaaaacctttgaatgatcgcggtgagtatacgaagctgaatggcgtttggcgcattcagtttggcattgctctctttccagctgtgatcgttttgattccacgcttgcgtatgcaggaatcagaacaatttaagaattcaaaaaacatgaaatctcccggggagggtgatcttgattctgcctctcaaatcgaattacatgatttcaagaaaaaagagtccttaactgcggagtttacaacttcttccccttctacagcttccttgtccgataaaaagaacccaggttccgttcatatccgtcccaataacgaagttgctcccagcagtgctcctagtcgtgctccttctactacctctgtcgaatctaatacggaaggtaaggagtctgatattcaaaccggttcttcgtttgtttcatactttaaagagtggagacatgctaaacttttaattgggtctgcgctttcatggtttttgcttgatattgctttttacgggataaatttgaatcagtctgttattcttcaagaaatggggtttaacaaaggtgtcaacgaatatcatattcttcaaaagaatgcaatcggtaatctgattattgcagttgctggctacattcctggatattgggtgagtgtcgtattgattgaggtaatgggccgaaaatggattcaaattcaaggtttccttatttgctgtcttttatttggcgttttagctggaacatgggaaactatttcaactggtggtcgctttgcgtgcgtcgctcttgcccaatttttcttcaactttggtccaaacaccacctgctttgtcattcctgcggaagtgtttccctccagagttcgtgctttttcacatggcatatgcgctgcatgtggtaaggccggtgccattttatctgctcttctattcaataaacttaccgaggtaattggttttggcaatgttttgtggatattcttcggatgcatggttgctggagctgttgttactttaattttgcctgaaactgctaatcgtgatgcggatttgattgatcgtcttgaaattgctgccatgcaacaaggtagaacttctattatcgatagaagcgagaagtgggcctggtggaaacatggcatt

SEQ ID NO: 46366 - DNA, 1692 bp, Schizosaccharomyces pombe
atgtttggtgtttattttgttctcctatttctttcaagcgccctcattcatgttgctaatgctggtagtaatgctgagtggcgcaaacgtattatttatcaaattttgacggatcgtttcgcggttgatgatggaagcacggataatccatgtgatccggatgcaaaccagtattgtggtggtacctggaagggtatcgagaacaaactggattacatcgaggatatgggtttcaatgcgatttggatatctcccattgataaaaatattgaaggagatatcgacggtgctggttatgcttatcacggctattggaacactgattatgagtccctcaatgaacactttggtacagaagatgatttagttagccttattactgctgctcataaagcgggtatctgggtaatgttggatagtatcgtcaattctatggcacttgctcctccgctagcagatgctgactattcatctcttaatccttttaacaaggagagctacttccatccgtactgtcttattgattgggatatcacagataatgagacgaacgtaatggattgttggcaagattctggtgtattgttggccgatttggatgtcgaaagttcagacgtttcttcctatttgagtgatcatttcaaaagtcttatttctaaatacgattttgatggactgcgtattgatgctgtgaaaatgatgaactacacattctttcctgatttcgttgatgctacgggtgtttacagcgttggtgaagttttctcttatgatcctgatactatgtgtagttacatgagtgtccttcctggagttaccaattactttttgcagttgtacataaacttctcttttactgctactggtgctggattcactcttattcccacttaccaggaggtaatggcttcaaactgttcaaaatatgatagtactttaatgttgacttttatcgaaaatcacgatttgtacagatttccttattacacaagtgaccagtcacagattatgggggctttgtcatttgtgttgatttgggacggcataccctcaattttctacggacaagaacagggattcaatggtggtgaggatcctgctaatcgtcctgcactttggcttactgattacgatcaatcaaacccgtactataccgttattaaaacgatggttgcatttagaaagtttgtcattactcaggatccggattgggtcacttccacatatcaatcgatcgaatctgctgttgatcactatgttggacaaaaaaatgatgttctcgtcatgttcaataatatgggagttaccaacaaccttacaatttatgaagttgagacgaattacactgccaatgaagtagtctctgatgtcttcggtcacagaactttaaccgttggtgccgataaaaccttgactgccagtatgaccaacggatatcccttgattatgtatccacattcgaagatgtctggttttacattaccaactgtcaatcgtacagtcatgccatctacatcggcaactgccacaaccactgtctatacctcttattactctccttcttattctgccagatcatttactggtactggtagtatatttacgatctcttcatcatctagacttatcctttctttcaagactttagtttttggcttgggtgttaccgcaatgctctttgttttattcttc

SEQ ID NO: 46367 - DNA, 1986 bp, Schizosaccharomyces pombe
atgacagcgcaagactctataccttcgctggagcagcttgttcagcaaaaaagagttaaggaagagaaggcggcgagaccaaagtttttatccaaagctgaaagagctcgattggcccttgaaagacgacaaaaagaggttgaagaagcgaaagcaaaacagaatgacaaattattagatttaagaaaaaggacttttaccaatcatttagaaaataatgaattagcagatgatgaaaaaaaatcccaggtatcctctgtatctagcaataacagtggcacagagagctccgcaacggacgaagcattcagcatgaccattcgtcaaaggtacatgggtataaagcctcctgtggtaaaaaaaagaagaagaaatgctgataaaaaatttgtatttgattgggacgccacagacgataccatgaaggatgcggaaacctcggcatcacctgaggctacaattgctgtatttggaagggggaaattaggcggatttgatgaccagtcgattcgaaaagcgaaaagtaattctggtttgattcagcgtttgcttcaaggaacggagcaggataaggctcgcgcacacgagttgattcagcttcaagaaaaacgagccaaaaaaatagattgggacgatgtgccatggagggaaaagccattggaagccatgaaacccagagactggagaatcctcaaggaagattataatatatccattaaaggggatgatttaccaaatcctttaagaaattgggaagaagcaggcttaccaagtgagatgcttaaagttttgaagaaagttaactataaagaaccaagttctattcaaagggcagccatacctgttttactacagcgtaaagatttaattggaattgccgaaactggtagtggtaagactgccgcctttataatccctctcataattgccatatcaaaattgcccccattaaccgaatcaaacatgcatcttggcccatatgctgtagttttagcaccaacacgtgaattggcccagcaaattcaagtggaaggcaacaagtttgcggaacctttgggtttccggtgtgtttctgtcgttggtggtcatgcttttgaagagcaatcatttcaaatgagtcaaggtgctcatatagttgtagctactcctggtcgtcttcttgattgtcttgaaagacggctatttgttctcagccaatgcacttatgttgtaatggacgaggcggataggatgcttgacatgggatttgaagatgatgttaataaaattttgtcatcactcccttcctcaaatgcttctgaaaaggatgggtcaattcttgctactgcaaattcctcttcgtcaagacgtcaaaccattatgttcagtgcgaccttacccccacgtgttgctaatttggcaaagagctatttaattgaaccagtgatgttaactattggaaacattggccaggcagttgaccgcgttgaacagcgtgttgagatgatatctgacgatagcaaaaaatggagaagagttgaggagattttggaatctaatcgattttcacctcctattatcatatttgtaaatctcaagcgtaatatcgaggctattgcgaagcaattaaatgccattggttggcatgctgttactcttcatggcagtaaaagtcaagaacagagagagcgagctatcgaacagttaaggaataagacggctgatattcttgttgcaactgacattgcaggtcgtggtattgatatacctaatgtctctttggtattgaattacaacatggctaaaagcattgaagactatacccatagaattggtcgtacaggtcgtgcaggaaaatctggtacagcaataacgtttttgggaccagaggatactgatgtatattatgatttacgcgtgttattaagccgaagcgcgaaagcacatattcctgatgaattacggaatcatgaagcagcatttgttagacatgcagcaatcacccag

SEQ ID NO: 46368 - DNA, 612 bp, Schizosaccharomyces pombe
atgagtattatggaatataatggtggttcatgcgtagccatggcaggtaaaaactgcgtggctattgcatcggacttgcggttgggtgttcagtcaatttctttgaccaacaactttcctaaggtgtttgcgatgggtgacaaaacgtatttgggactgacgggtcttgctacggatgttcagacgctttatgagttatttcggtacaaagtgaacctttacaaattccgcgaagagcgtcaaattcaacccaagacatttgctaatttggtttcttccaccctttacgaaaaaagatttggtccctatttctcattcccagtagttgctggtgtatctaatgacaataccccgtttatctgtggattcgattccattggatgcatcgattttgcagaggatttcatcgtttctggaaccgctacagaacaactttatggtatgtgtgagtctgtatacgagcccaatttagagcctgacgatctctttgagactatctcccaagctttacttaacgcccaagatcgtgattgtattagtggatggggctgtgtcgtttatgttatcaccgcagacaaatgtatcaaacgacttgttaagggtcgccaagat

SEQ ID NO: 46369 - DNA, 2772 bp, Schizosaccharomyces pombe
atggcatcaactgctactcaaaacgcaagcactcgatattcccaaatttggatcgaccaacctgcttcattgccgttccaagattcgataaatttaattaaagaggataaagaaaaatggaaaaaagaaaaaactgcctttttaattgactatgactggttcgaaggatacgttgactttatatatggagaaggcgacaaccctggtcctataactcaatggaggctgctggatgaaaaaaacgagcttaaacattctttggaggaatctattgattatagcattgtctctgcttcgctatggcatatgcttgttgagtggtatgaattttctttaaaggtctctacagtacttgtaaaaggcattattaattaaattcaaaactcatattcatatatgttttgaaagcattgtgtcttagttttgaatatttcattaatttatgtagtttgcattacttcccacggtgcctaaatatataggttcccttggattttgaggcctcttttcaattcccattatgttattagctaactcaaatataggtttggattagaaggtctagctatagagcgaaaagttcttttggtaggattggctgctgagcaaaagccattcgtagatatctatcctataaactttactttgcacgttttattcgacccaataaacggtgaaaacacgagctattcaccattataccaaattgatgaaccatatcatagtgatgaaccctatgcgtttagcttttcccgaagtgatacccttcggtctttgtacaaacaagtgatggaagctttccaaatatctgatggtacttctttccgtttatggtatctaaacaaaagtaatctatcttctaggtttgtaagtttgtcggagttcaatgatcaacctgcgattgctttgctttccgagtatgctgtttgcatgactattttcgaaatagatattgccgatggaagcttattgctcgagtttcaacatcctaacggagagtggttatctgactctataaccaaagagcaaaatttaacaataaataaagaaatcggactctgcggtctttacaatttgggtaattcatgctatatgaattctgcccttcaatgtatgatacatacacacgaacttacaaaatattttcttagtgattcttatgaaaaggatattaattacaacaatccgttgggaatgatggggaaagttgccttgtcttatgctagtctactgaagatgatccatcatactgctgatatgcactcggtgtcacctagttctttcaaatttataattggcgagtttaatacctatttttctggatatcgtcagcaagattctcaggaattcatcgcctttttcttagacgggttacacgaagatttgaatcgaattcagataaaaccatactttgaaaggccagatttatttgacgaacacccattacatgttcagagagttgcaaatcaatgttgggatattcatacaaaacgaaatgattccataattgttcagttgtttcaaggaatgtataaaagcaccttagagtgctccatatgctatcaaaaatcaactgcgtttgatccgttcatgtatcttactcttccacttcctactagtgcaaaatggcgacacaaggtagtgtacgtcccgccatttggcacacagagtcctgtggaattgtatttggagcttctcatggaaagtacggtaatccaaatgaagtttcaagctacggaaaagcttcaaaagatgggactcgaatgcggggaacttactgcttgtgacatttatcggggaaaggtgtacaaggtattgaaaaataaagacaaaatatctaaaaaaattcataaatgggatcatgttgtactttatggaagtactgcaaacggattaacaatacctatcgtccatggatgtaaacgaccggcaatgcccggatcataccagtctaacgatgtgtttggatttcctttacaactcaacgtccgttctcgaaatgtactcacaaatgatttagtgaaagagattgtcgaactgtatcgagtttatgcaggcatagacgtagcaatcggaactcttcagcttggactgaagcggatggaaagtaaggccgggaaatgggaatgcataaaggaaattgaggttaaaaggtttgaaatagtggaggaagaggaaatcgttattgacgacaaaactgtaattatgtgtctatggaacgatcaacaatatgaaaagttattttataactgcgaatggatatttgaaaaaattcagttccatatggagtccatcacccttgaagattgtttactggagttttccaagccagagcagcttgatttacaggattcctggtattgtcctgggtgtaaggcatttcgaccggcaacaaaacggctggagatctggcgattgccaaaaatactagtcattcatttaaatcgattcagcggccacggtggagatttgcggagaagacgtaaacgaagggatttagtagtttatccagtatttgatctcaatttgaagcaatttttgagtccatttataaaagatcatgagtggctatcgtcacagaaatcgatgctttacgatttgtatgcagtggacaatcatcacgggtttatgagtaatggtcattatactgcctatgcaagagatgcatcgagccaaacattctttaagtttgatgatacagctatttgtgaaatagatccggaggatattgtcacatcgtctgcttatgtattgttttacagagcaaagaat

SEQ ID NO: 46370 - DNA, 1638 bp, Schizosaccharomyces pombe
atgtcctctagtcagcaaagtggcagagccaatgagttgaggactcctggaagagctaacagctcttcaagagaagcagtggattcttctccgttattttttcctgcttcgtctcctggttctacacgccttacaacaccgaggactacagcgcgtacacctctcgcttcctctcctttactgtttgaatctagttcaccaggtccaaacattcctcagagttcacgttctcatcttttatctcagcgtaatgacttgttccttgacagtagttcgcagagaacaccgcgctcgacaagacgtggagacatccattctagcgtgcaaatgtctaccccatctcgtcgaagagaagttgaccctcaacgtcccggggtaagcactcctagtagcttgttgttttctgggtcagatgcactcacgtttagtcaggcgcacccaagcagtgaagtagctgatgacactgtccgtgtcatttggggaacaaatgtatctattcaagaaagtatcgcttcctttcgtggatttctacgtgggtttaagaaaaagtatcgacctgaatacagaaatgaacttatgccacctcctgatgccgaacaactagtgtatattgaagcgctacgaaacatgcgtattatgggtttggaaatattaaatcttgatgttcaggatttaaagcattatcccccaaccaagaagctatatcaccagctttactcataccctcaagaaatcattcctatcatggatcaaaccattaaagacgttatgctagacttgttaggaactaatcctcccgaagatgttcttaatgacattgagcttaaaatttacaaaattcgtccttttaatcttgaaaaatgcattaatatgcgtgatcttaatcctggtgacattgacaaattgatctctattaaaggtctggtacttaggtgtacacctgtaatacccgacatgaagcaagcattttttcgatgttcagtttgtggtcattgtgttaccgtggaaatcgatagagggcgaattgctgagcccataaaatgccctagagaagtctgtggtgctacaaatgcaatgcagctaattcataatcgttctgaattcgccgataagcaagttattaaactccaagagacacctgacgtggtaccggatggccaaaccccacactctgtaagtctgtgcgtatatgatgaactggttgactctgctagagcaggagatcgtatagaagtcactgggatttttcgctgtgtaccagttcgtttgaaccctcgcatgcgtactgtaaaatcattatttaaaacttatgtcgacgttgttcacataaaaaagcaggacaaacgtcgtttgggtacggatccttctacgttggaaagcgatattgctgaagatgctgctttacaaattgatgaagtacggaaaatatcagacgaagaagtggaaaaaattcaacaagtttcaaagcgggacgatatatacgatattctttcccggtctctggcacctagcatttacgaaatggatgatgttaaaaaggggcttttgctacagctatttggtggaacgaacaagtcttttcataaaggcgcaagtccgagatatcgtggagacataaatatcttgatgtgtggtgat

SEQ ID NO: 46371 - DNA, 421 bp, Schizosaccharomyces pombe
  unsure (1)..(421): unsure at all n locations
gatctggttgcttcctttgatgacattgtaaaggtgattgaaagtccagatgccgcaggcgttcacatcgttgatgctcgcgctcatgaaaggtttcttggcaacgttcccgaatctcgtcctggtttagctagtgggcatattcctacgtccatcaacattccatttaccgaaaccactgctgctggtattacagctccgaagcctgaggaagatttggaaaaggtgttttctagccatggtttaacagacaagtctgttcccataatcacttcatgtggctctggtgtaactgcttctgtattgtttgctgctcttaaggagtgcggttttaaggatgtacgcgtttatngatgagtcttggtctggatatggaaaacgtgccaatgaagattcttctttactagcaactggcccttaa

SEQ ID NO: 46372 - DNA, 1282 bp, Schizosaccharomyces pombe
  unsure (1)..(1282): unsure at all n locations
atgaaaaatgacttgattcttagggctgcaaagggtattatactttcgctttagcaatttgtaagcgcttactcacattatgaaataataggagaagaagtagaacgtcctcctgtttggattatggtatgtaaaaaaaaagatgattataaatttgctaacgttcttttagaggcaagctggaagatatcttcctggtacgtgcacgacttaaacttgatcgtttgcactaacgagaccatagaatatcataagcttcgtgctaaacaaagcttttttgagatgtgtcaaacacctgaaacggcgtgtgagctaacacttcagccagtcacccgctttaaaggtctgcttgacgcagcaattatttttagtgacattttagtgatccctcaagcattagngggatgcaagtggttatgcttgagcaaaaagggccgcattttcctaaacctctggttgtgcctgaagatattgaccttttagaaaaaactcccaacatctcggctaaattgggatatgtaatggatgcaatttctttgactcgcgaaaaattagatggacaggtccctttgatgggattttctggtgctccttggactattatggcctacatgattgaaggaggtggctccaaaacttttgcaaaagctaaatcttggctttttcggtaccccgaggcttcccacaagcttcttaaaatcattaccgatgccacggtttcatatctgatacagcaagtatacgctggagcacaggtatgagttaactctgattattttctatactaattcaaataatatatagctacttcaaatttttgattcctgggctggtgaattatcccccgaagactttacggagtatgcatacccttatctggtgcgaatatgtcaagaagttaagcaacacttgaagaaaaagagacgagacgaggttcctatgattgtttttgcaaaaggtgcttggtatgcaattgaccaattgtgtgattcaggttacgatgttattggtttagactggacggtcagtcccaaagaggctgtccgtattcgaggtaatcgtcgtgttacattccaaggtaacttggatcctaacattttatnatggcacacgcgaaattattgaagcccgtaccaaggaaatgatccaagattttggaggcggaaaacaaggctatattattaatttgggtcatggtatntacacnctggtgtcaatccagatgatgttcgcttcttcttnagagaaatgtcatcaatatggctnctgncgtaattattga

SEQ ID NO: 46373 - DNA, 345 bp, Schizosaccharomyces pombe
  unsure (1)..(345): unsure at all n locations
atgaagttagccatcggtaggcttttaagcnccattatttttgaaaaatcctcagaaacccttgatcattactaaacgattttattcgacacccggagaacgaaggataaaggacatactcactgagnaagctttcacctagttctttgagagttatcgacgtttctggaggatgtggcagcatgtatcaagttgcaattaaaagcaaagccttccaangggaagaacactttggcgcagcaccgtctagtcaattctatcctcaaagaagaaatcagaaatatgcacggactgaatttgtctaccgaagtcgaagacgatatatctgccggcggatncgactac

SEQ ID NO: 46374 - DNA, 1986 bp, Schizosaccharomyces pombe; identical to SEQ ID NO: 46367

SEQ ID NO: 46375 - DNA, 612 bp, Schizosaccharomyces pombe; identical to SEQ ID NO: 46368

SEQ ID NO: 46376 - DNA, 874 bp, Schizosaccharomyces pombe
agttcaattggtactggatacgatttaggattattcttctccccggatggtcgtttattccaagcggagtacgcgtataaagccgtcgaaaatgcaaggtaaggtggattgaatttccttatcgattgattttaacattgtatttagtacttgcattggaataaaatgtgaagatggagttattctagctctagaaaaggtagttactagcaaactacttaagccgcgagtaaataacagaattgggtcggtcgatcgacacattggtattgctactactggctttattcctgatggccaacacatcgtaaaacgtgcaagggacgaagccacctcatggagagataactacggatctcccatccctggaacagttattgctgatcgcttggggaactacgttcaacttttcacttgctattctagcgtccgtccattcggtgttatgtcttttgttgctacttatgactcagaaggtccacatttgtatatggttgaacctaatggtgtttattggggttacaacggtgctgcagctggtaaaggtcggcaagtagctcgaaacgaattagaaaaactgaatttttcctcattaaaaatgaaagatgcggttaaagaagctgctagaatgtacgttttgctttgttgagtacaattttttttcattctatttgctaataattcactcttttttagattatacgcaactcatgacgaagaaaacaacaaagagcatgaaattgagatgacttgggttggtgttgaaacaaacggtattcatacacccgttcctgatgagcttttgcaagaggctgaagcatatgctcgtcggattgctgatggcgaagaagaggatattgctatgcaagagtaa

SEQ ID NO: 46377 - DNA, 1563 bp, Schizosaccharomyces pombe
atgaggatttggattttaatatttttctccttcattaaacttgtctcttcgttacaatatacgggaaatggtgttttagctttggacttcgttgcgaaaacttttcccaaccaggaaaatcaattagagaagcgtgactatacttattctccatctggtatcacttcatttcctttagatttgcagagttacacttactacactactaccctttcgatcggtcgtccgagtatttcgtacactgtagctatagatttggacatgccgtacacatggttgacttactacaatgtaatggcgtttaatccagcgtatcttggcatagtgaatagtggtactcagtggagtacggatgaactgcgatactttctttgtaaaaaagaaagtgattcttgttattttgggaatgcatcttctagcttccattttgttacgagtccaagcactttttttatccgctatgacgataacattacagttgctggaattaatgttcaggactccctttcttacagtcattatcaagctttaccggacttccaattcggcatcacattaaaggagtatgttcccagttcaatgctgccgtacaaaggcgtgctaggtttagctgccagtaccgaaattaattcaatagattattcggattccatttcaagtttttcaccaccaacctttttggaacaactagttaaagaggatatattggcataccctgcttttagtatgtatctggataatcagggtaatggaagtttacttttgggagccgtggatacgtcaaagtaccagggacagtttgtcgctttgaagcagactaagcttacgcattacgccgtttccatttactctgtgcagttcttaaactctacgttcttttctaattattctatcatcactgatgcatactttcaaactcgtgaaacttatatttatttgcctgccgaattggcttacagtgtgatggataatgctggtgcctacttatccgaaggctatttcgcattaaactgtgatgaaattgatttggaagccgctctgatatttcaatttggatgtaattcaactatcaaggtaccgatatcgttgctagtgattgggcaagtttcaaacatatgtcttttaggtattcgaccttcgacggatagtgagattgtattaggtttgttattttttcgaaacgcctacacattttatcatcaaagtcaaaaaatgattgccattgggcaagccttttataacgcaacatccaacttgtccgccatcgtggatcaacacattcctggtgctctaacttgttcgcaatatcctacgagtgtggcatctactcaattggttcagactagtcacttcacatccacatcgttgtctgctgtgaatatttcggaaagcgtcgtttattcctatacaagtagtagtagtatgccctcttcagctattccgtccttcaacatctctttgatttctcagaatgcggttgcaaatgctggaaattcgttttctccgttaagtgctatggtcattatgatgatgtctgctgtatttttaggactcggtattata

SEQ ID NO: 46378 - DNA, 1908 bp, Schizosaccharomyces pombe
atgagcgacaatgtacagcaacaagtagattcagttggttctgtgactgaaaaattgcaaaaaacaaacatcagcagacctaggaagtatattcctccttttgctagggataagccaagcgctggcgcagctccagctgttggcgacgatgagtctgtctcatctcgtggctcttctaggtctcaaactcctagtgagttttcctctaactatggaggtcgccgtgaatacaatcgtggcggtcattatggtggtggcgagggccgccaaaataattaccgtggcggtcgtgaaggtggttacagcaacggcggtggttatcgtaacaaccgtggatttggccaatggagagatggtcaacacgttatcggagcccgtaacactcttttggagcgtcaattatttggtgccgttgctgatggtaccaaagtttcaactggtattaacttcgaaaagtatgatgacatccctgttgaagtttccggtggagatatcgagcctgttaatgagttcacttctcctcctttgaactctcatcttcttcaaaacattaaactctctggctacactcagcccaccccagttcaaaagaactccattcctattgtcacatccggacgtgatttgatggcctgtgcccaaaccggttccggtaagactgctggtttcttattccctattctttctcttgctttcgataaaggacctgccgctgttcctgttgatcaggatgccggtatgggttatcgtcctcgcaaagcctatcctaccacccttattttggctcccactcgtgaattagtttgtcaaattcatgaggaatctcgtaaattctgttaccgttcttgggtgcgtccctgtgctgtttacggtggtgccgatattcgtgctcaaatccgccaaattgaccaaggttgcgacttgctttctgctactcctggtcgtttggttgatttaatcgatcgtggtcgtatttctttggccaacattaagtttttggtgttggatgaagctgatcgtatgctggatatgggtttcgagcctcaaattcgtcacattgtggaaggtgctgacatgacaagcgttgaagaacgtcaaactctcatgttttctgccactttcccccgtgatatccaacttttagctcgtgactttttaaaggattatgtcttcttgagtgttggtcgtgtcggttccacttcggagaatattactcaaaaggtcgtacacgttgaagattctgaaaagcgtagttacttgcttgatattcttcacaccttacctcctgagggtcttaccttgatctttgtagagactaaacgcatggctgacacacttaccgactatttgttgaatagcaacttccccgcaacaagcattcacggtgaccgtacccaacgtgagcgtgagcgcgctttggaattgttccgctctggccgtacttccattatggtcgctactgccgtcgccagtcgtggtttagatattcccaatgtcacgcatgttattaactacgatttacctactgacattgatgactatgtgcatagaattggtcgtaccggtcgtgctggtaacactggtcaagctgttgcgtttttcaaccgtaacaacaagggtatcgctaaggaattgattgagttgttgcaagaggccaatcaagagtgccccagctttttgatcgccatggctcgtgaaagcagctttggtggtaatggacgtggtggccgttacagtggtcgtggtggtcgtggaggcaatgcttatggtgctcgcgacttccgtcgccctactaatagtagtagtggttatagctctggccctagctactctggatacggtggctttgaaagccgtactcctcatcatggtaacacttacaacagtggtagtgctcaatcctggtgg

SEQ ID NO: 46379 - DNA, 930 bp, Schizosaccharomyces pombe
atggaaccattagatgctggcaagaactgggtgcatatggatgtcattgagcagtccaaggaaaacatagagcctagaaaagctggtcattcagcttctgcacttgcaaaatcttcgtcgcgaaaccacaccgaaaaagaagttgctggtctgcaaaaagaaaggatgggccatgaacgaaaaatagagacgagcgagtctcttgatgatccactacaagtttggatcgattatattaaatggaccttggataatttccctcaaggtgaaacaaaaactagtggactggtaacattgttagaaaggtgtactcgagaattcgtacgaaatccgctttataaagatgatgttcggtatttacgaatatggatgcaatatgtaaactatatagacgaaccggttgaattattttctttcttggcacatcatcatattggacaggagtcctcgattttttatgaggaatacgcaaattatttcgagtctaggggattgtttcaaaaagctgacgaagtttatcagaaaggaaaaagaatgaaggctaagccatttttgagatttcagcaaaagtatcagcaatttactcaccgttggttggaatttgccccacaatcattctcttcaaatacaaattcggttaatcctttacaaacgacatttgagtcaacaaatatccaggaaatatcccagtctaggactaaaatttctaaacctaaatttaaattttctgtttattcagatgcggatggttctggaaaggatggccaacctgggacctggcaaactcttggtacagttgatcaaaggcgtaaagaaaacaacatatcggctacttcttgggtaggcgaaaagttgcctttgaaatctccaagaaaattggaccctcttgggaaatttcaagttcattgtgatgaggaagtatcgaaagaa

SEQ ID NO: 46380 - DNA, 4383 bp, Schizosaccharomyces pombe
atggcatctaaaatgcctgaagggtctccccctactagtcgttctattcaatctcgaaattccagttactctacctcttccaacgaacgtattggaacaccctctacgatttccctatctgaaaattcagatctttctaaattacaaagtactaatgattttgagtcgcgagaagatctctctcttacttccgatgacaataatgaccccgaatatgttatgtgctacaacactgtttatcaccaaaagacaaaaataaatgataaacttttatccgaaactgagcagttacgtaaaatttatcctttagaatcccgtgtatttccaaaacctaccattgttaaagagattaccaacgagcgaaccaagcgctacactttttatgacgatgatgctcctcttactaaccaacatactgttttagatgaagcaacttataatcgaattttaaaaaggatagactttttcattgaaaaagtcgttgaagtcccacctacttaccattttttatcgctattaaacgttcaattacgtattcaaccaatttggtggatggatgaatttgctgaaagaaatggtattgaaagtttactgtctgctttaagaaacctgggtcactatcctgaacgtgcatctaaaacacctcttgaatcccaaataatacagtcattatttcactgtttgaacagcgaaaactgccgtcgtcgttatcagtcttcagctaaatgctctgttccaggatttaatgctctaggtactattgctgagactgtgctttcaaaaagtttaaattcagctcgcatggctacttttctccttaaattcctttgtaataaaaaggggttgagttacttcaaagctgtaatcagggctttcgaatggctcgtcgagcaaaagttatcaaaaactcggtttagcgcatggatgcattcctttaatgatgtgattactggtgtccgagtttgtgctgattcatctcctcaagcgattgttcacatggacgaatttgaagatacggactgcttgattgattaccttgttgcaactttagctctcattcgagatttatgtgctgctccaccggatttgcaacttaggtgtgctctaaggcatgaattgttatctgctggtcttcaaaaggccatcgactctttgttaaaatggagaaacagacacgtccgtgatgctctgcaattactaatcaaagagcataatgcagatgctcggcgtttccgaagtggtagtgatgtgaataatgtagataggaaatgcgtaaagaaacagatgaactatagagaagaatcacatacacctcatggaaatactactcgaaagacctctactcctgtatctaataatcgacccacaactccggaacaacaggctgtttgggatgtttttcaaagaatttatactcgctttacgggaagtgaggggtctaaagaaagtttcattaaactactcgagtattttgtgactgaacccgacaacggaaaaattcaaaaaagtatgcagttattgactcacacgcttgaggcactggaaggtttcaaaactgccaaagcagatactaatgtcggtctaacgatcctatctcaaagacttttagacaaacttggtaccgcagaggagattgcagagtacaagacaaagtataatggagccatgcttgaaaacaagcatctgaaagaacaagttgaatctatgctttcccaattgaacgttgggccccgcgaccctatgcagtttctgaagaaacaattggatgaattgaaagctgaattaaatcttagagacaatctcctcgcatccatgcagcgcgaatttgaaacgcgttatagagctcaaattcaagcatacaataagttgcaatcccaaatggaacacgtgcagaattcaaatgagcagcacttacaaccgggcttacttaataaggtttcaaaaagttttgacagtgttcatagaagaaacctttctcaagattctctagatgcgatgaccgaacagttttcttatcatgttgagccaaatattttaagtggaagtggaattcctgttcgtgtacatacaccatccaaaactgaagatttggacgaatctttctccggaagtgaaatatcttcctcgccttcgccattgctaccagatgtttccgacaccgtagaagagcagcaaaagttattacttaaatctcctcccccaccacctcctgctgtaatagttccaacaccagctccagctcctattccagttcctcctccagctcctattatgggtggacctccaccacctcctcctccacctggtgtagcaggagccggacctccacctccaccacctccaccccctgctgtttctgctggtggaagccgatattatgctccagcaccgcaggcggagccagagcctaagattgacgaaaccagcttaacagaagaacaaaagattcaacttgaagaggccagaaaacagcgtaaagctgctgatgatgcagcgagagcagccatagaaaagtatacaagtatccctagtcttcgtgatcttcacaagccaactcgtcctttgaagcgcgtccattggcaacgggttgatccactgcctggaccaaatgttttcacaaagttctgcttaaattttgacattaccgctaaagtttttatagataatgggcttctcgattttttggatgagaaatttgataacactcctagggaagattttgttgcagtggaaatttctgaccaacgatcttctcttttacctgatacagttgaacaaaatatggctattattttgcggtctgtatctaatatgccagtggaggacttagttcaaaagtttttagtcgaacccgactttttaccggcctcaattttatactttgaccgcgctagccttgcatctaccaatgcctataccgatccattcattccttatagtacggattacacaaagaaaaatccaaaagaaccaacggcggatgtgaacagtttatcttattttgagaaattttttgtattgttcgtcgttaaccttcggcactatttccaagaaaggatgaaagctctaaaatttcgctcgacgttgtttggtgatttggaaatacttgaagttcgtatgaaagaagtcattgacacttcggacagtattatggaggataaaaattttgctgaattctttcaagtcttactgattattggcaactattttaatgaaccttatgatcgagcatctgcattttccttgtatatgatatatcgccttgaaactttacgagatagttcctcagctctaactttgatgcactactttgatgagattatacgaactcgtttccctgaattattgcaggcggaatccacgtttaaaaaaattcagagtgtttccggatacaatatagatgctatggttgcgggtgtagatggtgcttatgatgaattctgcgactttcaaacgtctctcaaagacggtgctctatcgaaatgcgaccagcatcatccagatgataaggcgtacgatattctttccgaatggttgcctgaggctaaagaaaggattaggaatattaaaaagcttaaaactgatatgctcactaaacttgaaaacactgtgaagtatctttgtgaatatgactccattgataaggttagaaactctttcttcaaaaacctgaattctttttatgaaatgtattccatcgccaaagcagagaatgaggaacgttttgagaaggagaaaagacgaatcatgtcggaggatcgtgacaaactgattcgtggtcgccaaaagacatccattgtagcaaaatacagaaataaaagagagttaccagaagactctgatgataaacaagatacggcctccaaggataaaaattccttagaaacaattgatgaaaaaatggaagatgccagtaaaatagaaggtgatgctaagaccggagatgataacgaaatggaagatcttgataaaatggaagaccttgaaaaaccagattatgctgaagaaaaagatccatatataactgtaatgtcagaattacgatctcgtatacaaaatgtccctaaaaggactgttactgtttattccgatgaaggcgttgctacacttgagcccggagctcaaggggatgatgttgtagataaggccaaaatgattcttgaaaaaatggaaggacattcccaactattaacttcttcggcaaatcctgatgaggaggttttacgtgccaaactgaaagctgctgagcgtttgcaaaaacctgcaattcctagaacacgccgtaaaggccacactgaaccaaagagtgctaagtcactacttgcagaactaactaacgggtctaatgcttcaaatctagttgaaaatgaccgccaaaaacaa

SEQ ID NO: 46381 - DNA, 4207 bp, Schizosaccharomyces pombe
atgggttcaaaaggaaaaaagggaaaatcatcggaggttaatttagaaacttcaaaaaacaaggaaaaaaatatcaaagggaaaaagaaaaactcacttgatccaattgaaaaaaataaacaggaaacagcaggcctgcaaacgacttcacgtcctactgccaaacagttagtaggaggaagctcttggactggaaaaattcctgtcgttttactaaatgaacattgccaaagaagtaaatgggagaaaagtgatgttaaggtggtaagtcagctcttaaaagatgcgaattaaccaatctatcgaacacatacttactaaaatcttctaaacagaggcaaaccaaatctaaaaattacatttttacttctgtcgtacttgctaagaaggacccaaaaaacccttcgatattagaccatgtatctctgattcctcccaagtcctattatgagaatggctactttcctgaaaaagaaacgttagtggaagcacgaaatgttggcgccgtttatgctttgcatcgagtaaggatctatacttatttattttcaagcaatcattaaccaactttaatttctaacagataatgtctcataaatcattacaacatgcccttccacctgaacatcggaatatatggtttgatatggagaaacaaaagaaggaagagctaaaaaataagcacagctggctttacaatgaagatcccttcaaagcagccaaagaactacaggcagcacgcgcttcttcagctgccaaaccaccgccaaaagcatctcagaaaaatgaaaaggtctctttgacatctatcaaaaacacaagcctttcacacttctcaaagttcaatttcaaatatgctcttcctattcacatgagtcttgaaaatcgtcgctctctagagaacctttttcgcaatatgaacacgtgggatatactagaggatacaaaaaatttagagcccgatacttctattgttaatgatttaatttctttaggttttcgagacattcatgctaaagaagcttgtcagtactgtgtttcccttgaagatgctttagagtggctaatcattcatgttccagaagacgatcttcctacaagatttcttccttctgattatacaacaggaatatctgttcagaatctaaattcagcgaatctggccattcactacaacgctaaacgtatgtgcgtatgacatttgttcaacactaactattaacagggatttcggagacgggctatagctttgacttatgtttttctactcttcaaacttttgaaaataacattcaaattagttcagagtacttacagcagcatctaattggtgaaagctttgatgggaatatatctttggaaccaaatagtaccgaatgggatgatgatgttagtgctttgcaatctattttggataataaggtctcaaaaatagagaatggatgtagagtgcgtattgactacccgactagtgaatttggtgagcttttcgtcgattttagaaggcctgcccgttcgtatcctgcacacattcctttaatgtctctatcctctacaaaaagaatggcatcctatattaagttgagtattcttaaaaagatggttgtttacgcaatggatcttagaggtgaatgcatgttatcctggttgtataatcatcttcaggaaaatattgaagactttttacaaaatattggaagcttactaaatatttcagctgcaacaattggtgtctctttatcctctcaaaacaagtctgcgccgactgccaaaaagaataacagtttcaagccaaaattatttcgccgttcgcgcgaattatctgaaaaattatgtaataactggagtgagagggttaaaagtccttcatatcaattaaaagttcgtgaacgtgagaaactccctgcatgggaatcaaggagaaaaattatggacgccatacagcattctcaagttgttgttataagtggtgaaactggtagtggaaaatcaacacaagtagttcaatttatcttggaccattatctttcttctggagaaaaagatttgcaaacagttgtttgtacacagccaaggagaatatctgcgataagtttggcggaaagagttgccttcgaacgtgatacaactgttggaaaagaagttggttacagtgtacatggtgaaaaatccatatctaaagaaacccttcttgagttttgcactacaggtttgcttcttagaagaattcagcaacatggtctaggctttttgagtactttatcttgtgttgttgtagatgaagtacatgaaagatccatcgaaaatgatatactcttaacacttttgaaactagtaatttctcgtatcccaaatttgaaagtcattttgatgagtgccacggtgaactccgatacattcaaatattattttggaaatgctggtcatttacatattcacggccgtacttttccgatcaaggattactacattgaggattttgcgcctaagctaaatgaagatgatgacgaggaagacgttcccagaagaaagaaaaaagaatatgaaattgattatcatcttatttctagacttgttagttctattgatgctgaacttggttcctctagtggttctatattggttttccttcccggtgtctcaaacatagctcgttgtattcgtgaaataaaatcaaaagacggctcaaaatttgaggtcctcccattacatgcctctttgaatacttcggagcaaaggagatgtttcaaaacatacacaaagcggaagatcatatgtgcaacaaatattgcggagacttcaattactattgatgatgttgttgccgttattgacagcggcagagttaagcaaattgattatgatgttgaacgagatctggtgacttttaaagagacttgggcctcaagagctgcttgtcaacaacgccggggtcgggcgggtcgtgttaagaaaggaatatgttataagttatatacaagaggatttgaagaaaaaggaatgctaggccaaacacctcccgaagttttacggacggctttaagtcaggtttgtcttaacgtagttcctttggtcaagagattttcttctgctggtaattctgtgaaccagggttcaatcaaaaaatttatgaacagccttattgatccaccgaatgatgcaacggtagaccttgctttgaaaaaactaattcaagtcggtgctctcaccgtgtcagaagatttaactggtttaggagaatacttagtaagtaatgatgtgtttttatgtgaaactaatataattttaggtgtcattacccatagatctaaagcttggaaagcttttggtgtttggttcgatctttggatatttggaacctgcgcttactattacagctattctctctacaaagtctcctttcttaggagacgatgaagctagggaaataaggagtaaacaaagtcaaggatggggagatgttttggctgatgctcgagtatatcacaactggctcgaaatactagaaaccaggggtgtaaagaaaacagttcagtggtgtgaagagatgcatcttcattacacaacgttacaacaaattcgacagaatcgaaacgaattgagcgaagctgcacagctacttgaactaactactaaaaagctgactggtaactttgattggtattcaactgaaaacctgactgttctatcgactctaattgctgctgctttaagtcccaatgttgtgaaatgtgtttatcctgataaaaaatttgttgcttcattttctggatcgcttgaaatggagcaggaagctcgcctgacgaagttttatgatcaaaacaaccaaaggttattcatacatccttcaagtactatgtttgttaattctccaaatgcttcaagatgtacgttcgtggcatatgagcaaaaggtagaaaccacgaaacctttccttagaaattgtacacctatcaatacatatggaatgattttgctgggagcaaatgatatactcattgatcctcttggtaagggattaatacttgatcaagcatattgcattaaagcgtggcctaaagtcgttattttattaaaaatgctaaaaagatgtcttgatgcctcattacatgagcgattggaatcttcgtcggggttaaactacgaaagtgaaatacatcaatgtattcgtactctgattgcaggcaacggtgtttagctccccttc

SEQ ID NO: 46382 - DNA, 854 bp, Schizosaccharomyces pombe
atggattctgatatgcaaaaccagaaccctcatactaattctaaaaactcttcttctgctggcatggctgttgacggtcatagcgttacaaaacggtaaaaaataaacagtttttaggaaaaaagtctctaatgcatttgtagattgagaagcgaattaatgagtttaatggtttgtaataagcttttttactttgttattaactagggttttatgactagatgtccaatactcctggaattagtgcgtttccagattctgattctaacctgctacattgggctggcacaattaccggcccaagcgatacggtatgacttttattttgaaagcttaatatttaaagtatatgaataatgcttggtgtgcttacttgtagctgcactttaatggaaaattaatacacatctttgtcattacattttcataactgtctactcttctttcttctttttcatacgactaacgtaacgaaaatagtactatgaaggattgaaatttaaaatttcaatgtcatttccagctaattacccatattcccctccaactatcatttttacttcaccaatgtggcaccccaatgtcgatatgagtggaaacatatgtttagacattttaaaagataaatggtcagcagtctataacgtacagacaattttgttatctctacaaagtctgctgggtgagccaaacaatgcttctcccttgaatgctcagtatgttgaaaatatctcatttaccttttttgattattaacaattcttagagctgcagaattgtggagtaaagaccctatcgagtacaaacgtcttttaatgcagagatataaagaaatcgatgaaatttagttaggc

SEQ ID NO: 46383 - DNA, 1762 bp, Schizosaccharomyces pombe
atggctcaaaaattagataactttccttaccatattggtagagaaataggtactggggcttttgcttcgtatgaattttgatttgaaaaatactatatactaacttaagcaagcgtccgtttatgttacgatgataatgctaaaatatatgctgtcaaatttgtcaataaaaaacatgctactagttgtatgaatgcaggggtatgggctagaaggatggctagtgaaatacaacttcacaaactatgcaatggacataaaaatatcattcatttttataatacagcagaaaatccccaatggagatgggtagtacttgaatttgctcaaggtggtgacttatttgacaaaataggtgggtgcatgaacctttcgtttttactaacggacttacaatttagagcctgatgtaggtattgatgaggacgtcgctcagttttattttgctcaacttatggaaggtatttccttcatgcactctaaaggtgtcgcgcatcgagacttgaaacctgagaacatccttttagattacaatggtaacttaaagatttcagacttcggctttgcatctttattttcctataaaggtaaaagtaggcttttgaatagtccagtgggtagtccaccatacgctgctccagaaattacacagcagtatgatggttcaaaagttgatgtctggtcctgcggtataattctttttgctttgttattaggcaacacaccttgggatgaagcaattagcaacactggtgactacttgctttataaaaaacaatgtgaacgcccgtcttaccacccatggaacttgttgtctccaggagcctattgtaagtcctgactgaaattcctttaaactaatgatcagcgattatcaccggaatgcttcgaagtgatccatttaagcgctactctgtcaaacatgttgtacagcacccatggcttacctcaagtacaccatttcgaactaaaaatgggaattgtgccgatcctgtagcattggcatcaaggctcatgttgaaacttcgtattgatttagataaaccacgtcttgcctcatctagagcatctcaaaagtaagatcttgcacagttgtttcatatttctaactctttcaattagcgatagcggtttttcaatgacacagccagcttttaaaaaaaatgaccaaaaggagttggatcgtgtagaagtttatggcgccttatcccagccagtacaacttaataaaaatattgacgttactgaaatccttgaaaaagacccctcattgagtcagttttgtgagaatgaaggttttattaaaagattggtattatttatttaaacctaaattttttctaactatatgaaaaaggccaaaaaggctaagaatttctacgaaatttgtcctcctgaaagactcactaggttttattctagggcgtcgagagaaaccattatagatcatctttatgacagtctacgactacttgcaatctcagtgactatgaaatatgttcgaaatcagaccatcctttatgttaatttacatgataaacggaaatgtctcttgcaaggtgttattgaactaactaatttaggccataacttagagcttataaactttataaagcgtaatggggatcctcttgaatggagaaaattttttaaagtatgtctttatcatagggatttcatatactaatccatgtgaaagaacgttgtcagttcaatagggaagccgattgttcttacagatgtttcacaaaattaattgcac

SEQ ID NO: 46384 - DNA, 417 bp, Schizosaccharomyces pombe
  unsure (1)..(417): unsure at all n locations
gatctggttgcttcctttgatgacattgtaaaggtgattgaaagtccagatgccgcaggcgttcacatcgttgatgctcgcgctcatgaaaggtatcttggcaacgttcccgaatctcgtcctggtttagctagtgngcatattcctacgtccatcaacattccatttaccgaaaccactgctgctggtattacagctccgaagcctgaggaagatttggaaaaggtgttttctagccatggtttaacagacaagtctgttcccataatcacttcatgtggctctggtgtaactgcttctgtattgtttgctgctcttaaggagtgcggttttaaggatgtacgcgtttatgatgagtcttggtctggatatggaaaacgtgccaatgaagattcttctttactagcaactggccct

SEQ ID NO: 46385 - DNA, 3639 bp, Schizosaccharomyces pombe
atgtcttctaaacttgtagatgcaatcaacgaagtagcagtttctaacaaggataaaattgaattagatggaataaaagatgattcctttgacggacacctgagtatcactgaagcaacttacgatgttgatacatttttgaagccttctccagccttatcgaaggactggattcgaaagttgcaaaaaaaatgggatagggaaattacatataaaggactatatgagtatcccgagactttagctcgtacgcaaattcgctttcaaagacatggcctggagggtaaaattatgggctacaaagaggttcctgaattaatagaagaccttaattctaaaaattcgtcaagtttcttacgaaaaccatcttcgaaaaatgaattcgttcgtggaagcacaagcaacattccttttctggcagatgactctgatgtcgatgctatagcaggcgaaccatccgtgaaaatggctctatacggtgaagatggtttgttgcaagtaccgccagggttctcccgagggctttccatgacagcgacatccacgactgacaatttgaacgatgaatttgaccccgaaaaatgggatactaagaaagtgaaaagctcgaatcgtaactttgtcaccattcatgagttgaatgaacacctaaaaaatgtcaattctaaacattctgaaattgatgatctactacctgacaaaagaagcatcgtttctctaccgccttctactttgaacttgcataagcaaccagactatgctcatgttgtagatagtagtgcaccaatagaaaattttcaacaactcgttccggaaatggctcttgactttccttttgaactcgataattttcaaaaggaggctatttatcatcttgaaatgggtgactctgtctttgttgctgctcacaccagtgctggaaaaacggtagtagctgaatatgcaattgctttggcacaaaaacatatgacgaaggctatatatacttcacccattaaagcactatctaatcaaaagtttagagatttcaaacataaatttgaagacgttggaattttaactggtgatgtccaagtaaatccagaaggctcatgccttcttatgacaacagaaattttacgaagcatgttgtatagaggtgctgacttaattcgtgatgttgagtttgttatctttgacgaagttcattatgtgaatgatttagaaagaggtgtagtttgggaggaagttattattatgcttcctcctcatgtaactttgattcttttatctgctaccgtccctaacaccaaagagtttgcttcttgggttggacgaacaaagaaaaagaacatttatgttatctcaactttgaagcgaccagtgcccttagagcattatctctgggtgaaacagaacatgtttaaaatcgttgatcagcacggtcggtttttgatggatggctacaaatccgcaaacgatgcactgaaaaagcctgataaacctgttatagctaaggataataagaactcagctaggggtcggggtgccgctagaggcagaggcgttcaaacgaatatgatgcgtggcagaggaagcgcaaagtctgttgaaagaagagatgctaacacttgggttcacttaattggtcatttacataagcaaaatcttttgcctgtaatagtatttgtattttcgaagaaacgctgtgaggaatacgtagatacacttactaaccgtgatttaaataatcatcaggaaaaaagtgaagtgcacgttgttattgaaaaggccgttgctcgattaaaaaaagaagatcgattgcttcctcaaatcggtcgtatgcgagaaatgctttctcgtggtttagccgttcatcatggcggactgttacccatcatcaaggaaatagtagaaatcctttttcaaagagggttggtgaaggttctgtttgctactgagacctttgcaatgggtgtaaatatgcctgcaaaatcggtggttttttccggtacacaaaagcatgatggacggaacttccgtgatcttcttcccggagagtatacacaatgctctggacgcgctggacgccgtggtcttgatgtcactggtacagttattatattatcgcgttcagaacttcctgacacagcttcgttgagacacatgattatggggccttcgtctaagcttataagtcaatttcgcttaacatataatatgatacttaacctcctacgtgtagagacgcttagaattgaagacatgattaaacgcagctttagtgaaaacgttaaccaaacattggtgcctcagcacgaggaaaaaataaaaagctttgaagaaaagttgtcggctttaaagaaggaaatgtctgatgttgatttgaaagaaattaaaagttgtttattgagcagtgaatcttttaaagagtataccaaaaaaatgcacttccgagcaataactactgcaaatggcaaaagaatatttaaagatggaagagtcattgtttttcaacaacttgattttactcgcactgttggagttctactcggaacatccattagaaccaatgcttcagactgtacactggaagttgcatatttaaatccacagaacaacctcaaacgaccatcggatttacttgcttttgctgacgcgttcaatgatgtttatgataacgctatctttgatgaatcaaaccaattcaagtatggccttatcaatctttccggtattgaaagagtctgcaatacgatccttcgaattgattctggtggaattagagaccgtcgagggggggcttttcgaaaacttagtgaacaatttgcatcaattaaaaagttttccgacctgctttttgaagaagttaattggagtaaagtcagagactttgaattttgtgaagctttcgaaaaacgaaattttcttcagaacaagttatccggaaatccaattatctcgactccaaactttcttactcatttcgccttagcttaccaagagtatgaattggaaagcaatatcgataacttatcttcctatatttccgatcaaaacctagagttactgcctgattacgaacaacggataaaagtattgcaagaactaggatatattgacgcagagcgaactgttttactaaagggaagagtcgcatgtgaaattaattccaccagtgaattggtattaacagagttgattttggaaaacagtttggcggacttttcttgtgaagagacaatagcattgttgtctgcatttgttttcgatgagaaaacggaggttgaacccacaatttctcctcatttacaaaaaggaaaggaaatgatactatcagtggccgagaaagttaatcaaattcaagagcactatcaggtattgtattttaatgaaggtaatgattttgaatcacaaccacgatttggtttaatggaggtttgctacgagtgggctagagggatgtctttcaaccgtatcacagacttaacagacgttttagaaggatcgattgtaagaacaattataagacttgatgaagttctacgtgaatgcagaggagcagcccgtgtcgtcggcgattcttccatgtatacgaagatggaagagtgtcaaaatctaattcgcagaaacatagtcttctgcccttcactgtatatg

SEQ ID NO: 46386 - DNA, 312 bp, Schizosaccharomyces pombe
atggctaccaaactgaaatccgccaagtcaatcgtgcctcttttggatcgtattctggttcaacgtatcaaggccgacaccaaaaccgcttctggtatctttctacctgagaagagcgttgaaaagttatccgaaggtcgtgttatttccgtcggaaagggcggttataacaaggaaggtaaactggctcaacccagcgtagccgttggtgatcgtgtcttgctgcctgcttatggtggaagcaacatcaaggtgggcgaagaggagtattcgttgtaccgtgatcacgagttgttggctatcatcaaggaa

SEQ ID NO: 46387 - DNA, 1500 bp, Schizosaccharomyces pombe
atgactatagatttaaatgttatacaaagtgacattatctcagcgcgtcgagctcctgaaaatagtctgtttatagatgggaaattcgtttctcctatcgagccagctgcgaagcccatccctttaatcaatccagcaactgaggagattattggcacttgtgcaaatgcttctgccaaagatgtcgattcagctgtggagaatgcttacaacacttttcgttctggaatatgggccaaatggcctggcaaacaacgtgggttggttttgagaaagatagctaaaatgatgagagaaaagcgtgaacttcttgctggaatagatactattaactgtggaaagccaaccccatacgcattgttcgatatagatagctgcgcagacatgtttgagtattatgctgaagtggcagaaaccgacaaccctacagttaaggttcccttacctaacaatccaggattttgcgcatttgaaaaacgttttcctagaggtgtcatcggtgtcattactccatggaatttccctctgaaaatggctttatggaagctggttccagctattgcaagcggtaattgcgtagttttaaaaccttcagagttagccccatggtcatgccttgaattcgcactgatttgcaaggaagcgggtttgcccgatggtgttttgaatgttatcattggatctggtaaagagtcgggagctgcacttagctgtcatcctaagattgcctatctagcatttacaggatccttggctaccggaaaaaagattatgcatgctgctgctgaaaatattgtcccgttaacccttgaacttgggggtaagtcacctctaataatttgtgaagatgcggatctttctctcgctattccttctgcagcctttgctattttctttaatcaaggtgaagcctgtactgcggcttctcgtttgatcgttcatgaaagtgttgcggatgaagtacttggcggcttagtgagtgaagctaataaactaataattggaaatggattggatcctcaagtaaccttgggccctgtagtgagcaaaacccagtttgaaaaaattgttagctacattcaatcagctataaatgaaggatgtaaatgtgtagtaggtggacttcccagatctgaacaaaaaggttattttattccacccaccgtatttacgaatgtgcaaactcacaacaagatttggagagaggaaatctttgggcctgtcttagctgtgaagacattccatacaaatgaggaagcattggagttggctaatgactctgaatatggacttggttccggtgttttttctacaaatcctaaaacccttgaatttttcagcaataacattgaggcaggtatgtgctcattaaataactatcatgttgttacacacgagcttccatggattggatggaagcactctggattaggtgttggcttatctaagcacggctacaatgagtacatgcgtctcaaacaaatcactcagtatgttggc

SEQ ID NO: 46388 - DNA, 1349 bp, Schizosaccharomyces pombe
atgggactaccccctaaaactattgttttagacaatggggcataccatataaaagctggatttgcaggtggaaaagttgtgtaagaagaagtgcatcacgtcaataaatttcatgtatcttttacttttttcagctaacgatagtttttagtgaaattccgaattgtttgacgagatcaaaagatggaaacagattatttttggggaatgaattggccaactgtaacgactttacaactttacaatttcgcagggcgcatgaaaaggtacagcatttatgagggagtattatttacgaacaaaataaatacaaagattatgtttactaatactagtaggggtatttggtccattggagcacagaaacagccgtatgggacttggtaatgcgcaatgtaggtgtgatggaacctagcatggcagactattctttactgcttacacagcccgtatttacaatgccttccatagaacacaatactatacaactcgtgtttgaggaattccaattcgatgcttacctcccttgcaccccagctgagctaattccttgggatcatggaagtttcacaatgaatcaagaagatgcgtatactggtcaacatggagaatgcgttttggtaattgactctggatatagctttacacacataattcctgtgattgatttctctgttcaagaacaagcggtaaagcgagttgatgtgggagggaaattacttacgaattatttaaaagaagtcatctcataccggaagtacaatatgatggaagaaacatacattgttaatgaaattaaagagtccgtttgttatgtgtctcaaaacttcaaggaggacatggagatatgtcacgaaaaaccacggtcaaaattggaaatttgttatgctttgcccgattacagcactggaaaacatggatatattgttagagatattaatcaaaaaatagagcaacaagttttgaatctttcaaatgagagattcatgataccagaattattattttccccatctgatatcgaaatacgtgaggctgggattccagaggcggtcatgcaaagtgtcacccactttcctgaaaatatacaggcaatgttgcttgaaaatgttgttacaataggaggaaactgtaaatttcccggatttcataaaagactatcatctgaattacggtcgctggcaccagctaattgggaagttaaagtttttgaaccttcagatcctatttgctttccatggaaaaaggcatctcatatgccgttggagcactggaatgcgaataaaataactcgttctgagtactcagaacatggagcaaacataatgacacgaaaaaggagaatataa

SEQ ID NO: 46389 - DNA, 1635 bp, Schizosaccharomyces pombe
atgaacctaggaagatgtcctctagctcctcgatctgcgaatatagtactcccgaaacatgatgccgtatccaaacaaaaggaatatcgaattgaggaaaagacaaacgaagcacaaagggaggaaattataacttggaaagacaacagggaagatgaaggagaagtgaaaaccgattttgaggttgttaataacgaaaatattatcacaaccacccctaaacatcaaactgttattacccctaaatcatatcgcaagtccgtaaaacggattaaacatgatgctcctcaaaatgaggatattcctgtcatgaaggggctggcccccattaatgctgatactgagtcgaaggcggaatccatggcagctgggaaagttttgggatctaagaattcctctcaaaaggctcggttacaggaatggaaaagacagtacaagaaggcatttcctcatttccgtttttatttggatggatgcgacccaagtgttgctcatcgagtgaaaaaacaaattcagcaattgggtggacatgttgagacgttcttctcaggaaatgttactcatgttgcaacagttcgggctatccaagatgtttcggttaagtatgctaaacaggatgtaatcactaaggctaggcaactgaacatgaagatttggtctatggaaaagctttgcaaccgcgtgttaaaaactttaatggagaatgatcaatgcacaaccaacgcacccaccaaacaggggaatgacttgagttatttgctttacgtagaaaaggtgcaaggaacgaacgaacgcgatttatctgttcctagacaggactttgtgcattttcgtggaccctacctttacgtgcatgacatagctaacatttacaaacctatactcttacgtgaatggcaaaaaccgcttcccgacagggacgttccttggccgacctttcgtgctactagtattggccggtgtccatttgtacctgaaacaaagtatcgtctcagtacttccaagtccttggttgctaaaaatgaccagcaattattgcaacgacagagtcaagaaccatcgctgattcttcgtgcgaattcgatgaaagcttccttgcctgatatatccaacaccgggatctctggaatgaacacaaataccacttataacaccaatatcaacaacacccctcaaactgccatttctggaattacccaagatacatccccttctataaggacaaattgtcatcactgtttggatgacggtatgcaagcatcgggtatagtacagtcaaacttgacttctgctgcaatgtccaataattctgctattcgctccggtagtgctgctagtgttccggtggtaacaattaatgggagagatatcgcagagttgaaaaagcgtattattcagcaaaagtctggcatgattggcaaggactactcttataaagcgatgcttcacaacacgagtcaacggaaaattcgtgtagatgcgaaacctggctattgtgaaaattgtcgggagaaatttgataattttgaatctcatatccgcagcagtaggcatcgaaggtttgccgagaataacgataattttaaagaccttgatgaactgtttgcccttgttcaacgtcccttaaggccagat

SEQ ID NO: 46390 - DNA, 1245 bp, Schizosaccharomyces pombe
atggacgtttcgactcaaacaagacacgcaacatattttcaagatgagaatcagctacaaaaggatcacatttatgtgaagaagaaaagtcacatcaagttaaatacgggtgttcgtgcacctttcaaggcagtagataacatcaatcaacaagatgaaccaacattgattgaagggaataatgaatcctccatctcttcgtccactggcgacacttttgaagaggattttgcataccaggacaaagtcgagatagaggaacggtcaattcgctccactcctaagtctattggagatgatgatttggaaaaccgtgagggcagctttgacgcacctgaaggaattcttacacacgggaagcatagactaccaacaattcccgagtggaccaaggaagatttagccgccctgtctgaagctgctgctcgattacaagctaacccatcgcctgaggatatagaaactgatccatccatggtaccagactatgatcctgagatatttcactacatgcaatctttggaaaggaagctggctccacctcctaattacatgtcagttcagcaagagattgactgggttacaagacatatgcttgttgattggattgtgcaagttcaaatacattttcgtttacttcctgagacattatttttggcggtaaaccttatcgaccggtttctttccataaaagtcgtatctttgcaaaaagtccagttggtaggtttatcagctttgctgattgcctgtaagtatgaagagatacaccctccaagcatctacaactttgcgcatgttgtccaagggatcttcaccgttgacgaaatcattagagccgagcgctatatgctgatgcttttggattttgacattagttggccagggcccatgtcgtttttgcgtcgtataagtcgagctgattcttacgatcacgacattcgcatgctcgccaaatatcttcaagaagtaaccttgatggatgaaatttttataggtgcccatattagcttcattgctgctactgcctactacttgtctatgcagatgttgggtcatttggattggactccttgccatgtatattatagtgggtacacggctcgtcaattgaaaccgtgtgccataatcattatggaatgtttggtcgatgcccctaaccatcacaatgccatttaccgaaagtactcggagaatagaatgaagcgagttagcgcctttgctcacaactgggtactaagtgtgatt

SEQ ID NO: 46391 - DNA, 4578 bp, Schizosaccharomyces pombe
atgacagaagtaatatctaataaaataactgcaaaagatggtgcaactagtctgaaggatattgatgataaacgatgggtttggatttccgacccagagactgcctttaccaaggcttggattaaagaggatctgccagacaagaaatatgttgttcggtataataattccagggatgagaagatcgttggtgaggatgaaattgatccggtgaatcctgccaagtttgatagagtcaatgacatggctgagttgacatacttaaacgagcctgcagtcacatacaatcttgaacagagatatctctctgatcaaatttatacctattctgggctctttctcgttgcggtcaatccttattgtggactaccaatctatacgaaggacatcattcaattgtacaaagataaaacacaagagcgcaagctacctcatgtcttcgcaatcgcggatttagcatacaataaccttttagaaaataaggaaaatcaatcgattcttgtaactggtgagtccggcgcaggtaaaacagagaataccaaaagaatcatccaatatcttgcagcaattgctagctcgactaccgttggctctagtcaggttgaagagcagatcattaaaacgaatcctgtgctcgaatcatttggtaatgctcgtaccgtacgcaacaacaattcttctcgttttggaaaattcattaaagttgagttttctttgagtggggaaatttcgaatgccgccatagaatggtatcttcttgaaaaatctcgcgttgttcatcagaacgagtttgaaagaaactaccatgttttttatcagcttttaagtggtgctgatactgctctcaagaacaaacttcttttaaccgataactgtaatgattatcgatatttgaaggattcggttcacattattgatggagttgacgataaagaagagtttaaaactcttttagctgcttttaaaactcttggatttgacgataaagagaactttgatttatttaatatactttccattattctacatatgggaaatattgatgtcggtgctgatcgctctggtatagctcgtcttctcaatcctgatgagattgacaagctctgtcatttgcttggtgtgtctccggagttattttcacaaaatcttgttcgacctcgtattaaagcaggccatgaatgggttatcagcgctcgaagtcaaactcaagtcatttcgtccattgaagcattagcaaaagccatatacgaaaggaattttggatggctggtaaagcgacttaacacttccttgaaccattccaatgcccaaagctactttattggtattttagatatcgccggtttcgaaatctttgagaaaaacagttttgaacaactttgcattaattacacaaatgaaaagttgcaacaattctttaaccatcacatgttcgtattggagcaagaagaatatatgaaagaagaaattgtatgggatttcattgattttggacatgatttacagccgactattgatttaatcgagaaagcaaacccaataggtattctttcatgtttggatgaagaatgtgttatgccgaaagcaactgatgctacgtttacttctaaacttgatgctctttggaggaacaagtcgctaaaatataaaccttttaagtttgccgatcaaggttttattttgactcattatgccgctgatgttccttacagtacagaaggttggctggagaagaacaccgatcctttgaatgaaaacgttgctaagttgcttgcgcaatctactaacaagcatgtcgctacactattttctgattatcaggaaactgagactaaaactgttaggggaaggacgaaaaagggcctttttcgaactgttgctcaaaggcataaagagcagctcaatcagcttatgaatcaatttaactcgacccaacctcactttattcgttgtattgttccaaacgaagaaaagaaaatgcacacctttaatagacccctcgttttaggacaacttcgatgtaatggtgttttggaaggaatcagaatcacaagggctggttttcctaaccgtttaccatttaatgattttagagtcagatatgagataatggcgcatttaccaacaggtacctatgtggaatctcgacgtgcttctgtcatgattttggaggagttgaaaattgacgaagcatcttatcgaattggtgtttcaaaaatatttttcaaagcaggtgttttagcagaattagaggagaggcgcgtagcgactttacaaagactgatgactatgctacaaacaaggatccgtggctttcttcaaagaaaaatttttcaaaagcgattgaaggacatacaagccatcaaattactacaagcaaatttgcaagtgtacaatgaatttagaacttttccttgggctaagttatttttcaatctaaggcccttattaagtagtactcaaaatgataagcagcttaaaaagcgagatgctgaaatcatagagctgaagtacgagctgaaaaaacaacagaattcaaaatctgaggtagagcgtgatctcgtcgagaccaacaattctttaactgctgttgaaaatttgcttactactgaacgtgcgatagcccttgataaggaggaaatattacgtcgaacacaggaaaggcttgcaaacatagaagattcgtttagcgaaacaaaacagcaaaatgaaaatttgcaacgagagtcagcgtcattgaaacagattaataacgaattagaaagtgagttactagaaaaaacttccaaggttgagactttgttatcagaacagaacgaactgaaagaaaaactgagtttggaagagaaggatttgctagatacaaagggagaacttgagtctttacgtgagaacaatgcaactgttttatcagaaaaagcagagttcaatgaacaatgtaaaagtttacaggaaactatcgttaccaaggatgctgaacttgataaactcactaaatatatttctgactataaaactgaaattcaagaaatgagactgacaaatcagaagatgaatgaaaagagtattcagcaggaaggttctttatctgagagtctcaaacgagtcaaaaaattagaacgtgaaaattctactcttataagcgacgtctctattttaaaacagcagaaagaagagttaagcgtcttgaaaggagtgcaagagttaacaataaataacttagaagagaaggttaattatttggaagccgatgtcaaacagcttccgaaattgaagaaagaactagaatccttgaatgacaaagatcaactttatcagctccaggctaccaaaaataaagaactggaagccaaagttaaagaatgtttaaataacatcaaatcgttaacgaaagagcttgaaaataaggaagagaaatgccaaaatttgtcagatgcttctttaaagtacattgaattgcaagaaatccatgagaatttacttcttaaagttagcgacttggagaattacaagaaaaaatatgaaggacttcagctggacttggaggggttaaaagacgtcgatacaaactttcaggaactttcgaaaaaacatcgtgatttgacctttaatcatgaaagtcttcttcggcaatcggcgtcctacaaggaaaagctttcgttggcgagctccgagaataaagatctctctaataaggtatcgagtttgacgaagcaagtaaatgaactttctccaaaagcatctaaggttcccgaacttgagaggaagattactaacttaatgcacgagtacagtcaactcggtaagacctttgaagatgaaaagcgtaaagcattgatagctagtcgagataacgaagaattacgctctttgaaatcagagttggagagtaaacgaaagcttgaagttgagtatcaaaaggtactagaagaagtaaaaacaactagaagcctccgttcggaagtcacccttttaaggaacaaagttgctgatcatgaaagtatacgtagtaagctttcagaagtagaaatgaagctggttgatactcgaaaggaactgaattctgctcttgattcctgcaagaagcgagaggcagagatacatcgccttaaagaacatagaccgtccggaaaggagaataatataccggctgtcaaaactacggaacccgttttgaaaaatattccacaacgaaagacaatttttgatttacagcaaagaaatgcaaatcaagcgttatacgagaacttgaaacgagactacgaccgtcttaatcttgagaagcacaacttagagaagcaagttaatgagttaaaaggggccgaagtatcacctcaacctactggccaatctttgcaacatgtcaacttggctcatgctattgaattgaaagctctgaaggatcaaataaatagcgaaaaggcaaaaatgttttccgttcaagtacaatatgaaaaacgtgagcaggagttacaaaaacgaattgcttctttggaaaaagtgaacaaagattcgttaatagatgtgagagctttacgagatcgcattgcaagccttgaagatgagttgcgcgccgca

SEQ ID NO: 46392 - DNA, 3825 bp, Schizosaccharomyces pombe
atgaagctctccaatgaactttttcatcggagctcgaaagaccatggtggaaagagccgaatttgtttagactcttcagaggacacttatcctcctcattcctcttctccaccatcttttcagaaacgtctatcgttttccgacttttctaccaccagactcttttctcctccttttctttctaaacgttcgaataattctccccatcggttttcttattcgcctcctcaacatccagcatccattaactctcgtagagtcgcgtcttacacggttcagtcatctccatcaagaacaacgtatcgacaattgccgaatgaacctcaaaattctgcagcctatactacttactcttcatttcctaatgccttatttgatgatttcagtcctaacaacccgcttgacacggacccctttttaacatctcctggaaacaaacaaaatactgtagattcgtttcgtccattacctgaaacgcctgtttctcctggtgggtccttagtgcatcctttaccacgtccaccccttccttcttctgtttcttcgcattcttctccttacagcaccacatcctccactagtctttactctctatacaatgacatatcgttatcctgctcaccagagccatatcttcctttatcacctactcgatcaccggctcgcactcctagtccgattcgtctttactcgagcgacgctcttcgtccacagtcgcctttaagcccttccgtcgaatatctaacacccccaaatccttatagtttaaaatctgatatttcctctacaagacagctaccaaagatacctgtccaagactatgcatctggaaaaatttcttctcctttgataactcgaactcacagacgtgctcaatcggaaaccctttttagcagctgtagagaaccttggttggtcggtaaattatacaaatggtgcaaagaagaagtgtttactgctcttggtggcctggtccacgaaggtgtgtctcgtcgagaagtagctcaggtgatggctacgctatttactattcacattgcatctatggaatttttgattgctgaaattatcgcgaaaaacatccttggtgattggattaattacggtcttgtggaagtcataaatcttgaaaagcttcaaattgctttcacatctaatgaacctccttctggtagtggagtacttccatttttgaccaacggcggctgttactcttacatttgtagatccagatcatgtccttccaaatatcaatgttatagctgtagatgtgctcgtaactcgtcgcttgaattcacttctctgccaggacagagtagcgatacttggagcattttctggaacatttcttctctaaattcattaccatcttctctcagtaaaagagagattgctaggcaaaataatatccacgagcttatttgtaaggaatctgattacgttgcagacttaaataccctagctgaactgtttagggacggaattgtgcagcagcaagatgcgattgttcccagcaatcgagtggctgactttattcaatctgtatttggaaatgttgaatcaatcagacaattgcattctcgactgttcttaccacaattaattatgagggaacgtctccagggcccagtagtttcaattattggtgatatcttactagagtggattcatgctgctaaatcctcttatattaattatgccaaacagttccctttagcagatgaaacttataagctagaatgtcaaaggaatacttactttgcacgttggcttgctgcttgtcgatcagatcctagatgtcgtcggttggatttccagcatttcttgcaaagacctactcaacgtttacaaagatacacgcttgagttggatacaattttaaagcataccgagcagtccagctgggattttcaattaataactcaagctgtcaaagaactgagagcaacttgcgaggaatgtgatgccgttatagctaccgtacttgaggccaatcgtattcgcgatctatcgtatcaacttctgtttaaaaatcatgaaagtgtcaatctagagctaagggatcctgaaagagagttcttttttgaaggaatagttcaacgtagaagtgattcccgcttggattggttggacatccacttgtttttgctcgataattacttgatcatggccaaagcaagaaaagacaaacgaacaaatgcttcaagatatgttgtttcaaaaaggccaataccattagatttgcttgttctaagccctaaaatggacgattttcaacttaaatcaaacactaataaatttcttggcagtttagctggcaatttaccacaggaatctcttaccactaagagtaaaaggaagagtaaggtgaatcttgaactaatgttcgatgccactgctgaaaagaataacgaaaactcaatgaactctgctgtatttgagaagtctcaactttaccccttcacaataaggcaccttggtgcttacaccgctagttatacactctacgttgagtcacttcagcttcgtaaactctgggttgaaaaaattaatgtcgcaaaaaaacgacactctcagaagataaatattaagaatccgtttgcattgaaagttgtatctgacgttgcctttcagtaccctccttccgacttagttaatggaaatgaaccattaaacagctttaatgaaattactttggttgaaggctcttcgattgatcgcgcactcaatgaggtagcgtggaaacacccaattgtaagtgaggagcttttgccagagcctattgcctatggcgatataagttgtattgcccagtttaatgactacgaaggtcatgtctcggttttgattgctacatctaccggtatctttttaggcgcatttggtgattccagtgacattcgcgattggaaaaagatctctagtcaaagacgcgttacccagcttggagttgttgaggaatttgatatcctattagagctacgtgacaaaaccctttatgctcataaattaagtcgtattattgaaatgggtctgatcgaatccaaaattgcagttgtcattggaactccgcatgccgtatcattctttaaaataggtaaattgtctgagggggcttctgttaaacgtgagcgaactttggttttttataaagagggactcggtaatactacaaccataatttgctgtgaaccagtgatcggcttaggacataactatcagaaaacatatgccttcaagagaaaagatgttacttccttcagaactctggatgattttcacgtaacggctaactgtcattcaattgattgctttaagtattcaattgctctttgtcacaataaaggcattgacgttctgcgtttggaccctaaattagcagttggttttccaagcccttcagtgcttaatgatacgttgtttcggaaccgaatcaacaacagtaagccgcttggcgtctttcgcatccacgatcctagcttatttgcatgctgctatcaattcggtgccgtgtttgtcaatggagagggtagtatggttaataaagagtgttggtttgattggattggcaaaccgaactctgttaccagctgtcatggatatctcattgcatttaatgatgaatttgtcgaaatatggaacacgcgaactaggaaacttaatcaaattatccaaggaaatgacattaaatactaccctagtaacagtgattggctagccaatgggaaatatataatgtttggcatggttcatcctcagtatcacgatcgccatttgatactcgctttaaataaggcaaaaacaaactccttcataattgaagat

SEQ ID NO: 46393 - DNA, 4051 bp, Schizosaccharomyces pombe
atggattaccggcatccaaatgcactcggtgtgaatgagagctcgcgtgcttatgaggaaatttttggtgctccaagaaaacgggagccggcgagaactgtaagtactcctgcgttcatggaaccggctccagtctcaaaaaaacctcttcctcctcccacgcgaaggcttcctcggaaacctttgccctttcgttccacgagtttgcagcctccatcgtctcaacctcctgcacctccaactcatcagagagaagcatctcctgtgaaaaatattgagcacagtgaatcttttccttccgtttttggtacttcaaataatcaccagatcgtcccattgactcttaaagacggaaatgattttggtgctctatatgcatctttaaacaccacaccccattttcctcaggtatcgaatcatgcgcccaataactctaattccccttctttgacttggcacacatcatccggtgatgattccaaccaaaatccttttttcgttcggcgtcagtctcagagtagcacgtctccggtttcggattcagtagatgagaacctcctttcagcagtctcttctgttacagagtccgtagaaacaaaccttcatctcgatcaaaattatccttacggctctcctgttcgttcgtctaaaaatccctttctctcttcaaattctcgattaccaactgatgattcttctcacactgttggttctcattcatttacttcaggaactcacccacccattgtttcttctaattccgcctttacacttcccaatgctgttactcctgcagctcaagcacctctcatacgtagtgttagtgaatatcctgctaacgtttctccacctgcccagtcccttcagctaccaaaatctactagcaatcccgcggatcttcatttaagcatagcttctgctagcagccataagaatattttttctgggttggacgtcttttctaatgtctttcatggtccctctaccacattacgagacagagaacatgatatgcgaaatcgctcatttgatcattctaccttggctcattatgaagcagttaagcagcagagacttggtgttgaacctactgcaaggtcctttacgttgagctcttataagtcccgtgcaagtggaaattccctaattaatgatcgaagctctacaacaacgccgacgtttgttaattcggaagctagctcgcctgttcataaaaataaacgaagacgcagaatatatgctgccttactttctcgtgttgccagcgaattgttagatagactacagctaggtgatatcacgaaagacggtttaatttattctaatgcctttactggcgatcatgcagtcaccgtgctaatgggtattatacatacttctgatagaaatctcgctttacttgtcggacgctctttagatgcacaaaaatttattcatgatgttacctatgatcatcgtcttcgtgattctcatcgtgaaatatatcagcttcaaggtactggttatcgccccttcttacgcgcaaatgataatgcatccattaacaacaaaaaccatcataaggaattggaggacaatgagtcgggcactcgaatctcaccgtccacgttaggtgacacttcttttccaaatggtatatttactttattgacgcattgttactctccaacatgtgcaaaagatcatccctgctattctatttcatgtcctcgacgattggaacagcagcacagactatttgccaaaatgcgtgcaaacactgaacagtcttcctccctagcgtttgatgataaggaacaaaaattgtggattcacagcgtaccccaggagattgcttatagtgtcagtgaccgggaaagaaagcgtcaagaagtaatttgtgaggttatctatactgagcgagattttgttaaggatttggaatatcttcgggattattggattaaaccactatgggcttcatcttgtatacctgaacgaaaaaaagaaaaatttattcgtactgtgtttttaaatgctttagaggttcaagcagttaattctaaattggctgaagctcttactaaaagacaaaactataaacccattgtggataatattgcggatatatttttggagcacgttccaaaatttgagcctttcatacgatatggtgcaggccaactctacggaaaatacgagtttgagaaggaaaagtcatctaatcctgcatttgctaagtttgtcagtgacgttgaacgtctgaaagaatcacgaaagctagagctaaacggctatctgactaaaccaactaccagattggctcgttatccattacttctagaagcggtattaaaatatactgatgagggtaaccctgataaacaagacattccgaaggtcattaatatcgttagaggatttctctcacgtcttaatgttgaaagcggaaaagcagaaaataagtttaacttgtttcatttgaatcaacagctggtctttaaacctggagaacattatgatttacatctgcttgatgcgaacagacaattaatattcaaaggacccttgaagaaaagaagtgctggttccacttcttcagagtctgcgtcggatgttactttgtttctctttgaccatgctttgttgatagtaaaaccaaagactattaataaacgtgaattattgaaagtttttcaaagagtatgttttttctattcatttaaattgttttttctaactagtatagcctattcctctattacttcttcaactattccttgttgatgataatggattaagaatcccttattcaagtaagcaacaactagcagctgtatcaaaagcagcgaatgggaagccaccttctagattttatccatttagcttacaacttttgggtcgtagagggtacgaaatcactctttatgcaaccactgaagttagtagggataagtggttagagcatattgacaaccaacaaacattgctacaacatcgtaaccagtggtttgagtctgttaccatttgctctaatttctttgttggtgataataaagtaaatgcgataggcgtttatgatagtggtcgtcgacttttatatgggactgacacaggtgtgtacgtctctcttcgaaaagcaaacagcccacttcaattcaagcctgtacgtgcgttaaatattcccaacatttcacagcttgaggttattgaagagtatagtttattgctactgctttccgataaggtgttatattcgtatcctttggaaatgattgatgcggatactactcaagcccctaaaaaagcaaggaaagtttctggtcatacaactttctttcgcgtaggaatttgtctgggtaaagttcttgtgtgtgctgtcaaaagttccgtcttgagtgctactataaaggtttttgaaccagtcactaattactctaaaacacggaacatgccaagcttgaaaaaattccttactgttaaccaagacccattgaggattgtcaaagagctttatatacccacggaatcaacttcggttcacttcctgaagaataaactctgtgtcggatgtacgagaggttttgaggtggtcagtctcgataacctagagacgcagtctctactggatccagccgatacgtctcttgaatttgtggagaagaaagaaaatgttaaacctatcgctatctatcgtatgaatggcggtgaatttcttttatgctattcccaatttgctttttacgtaaatcgagatggatggcgttctcgtcctacatggtttgttgtttgggaaggaagtcctcaaaactttgccttaagttatccttatatattggcttttgaacccacttttattgaaatcagacatgttgaaacctctgaattgatccatgtcatttccggcagaaacatccgtttgcttgctgatggaagaggaaagttaggggacggtggtgaaatattttatgcgtgcgatcaacgtggtgaaaattgtgagacaagtgttgtttgttcccttcgattgacgagtgctgctgcccacgccaaagagcagcatgtagacaagtaa

SEQ ID NO: 46394 - DNA, 1514 bp, Schizosaccharomyces pombe
atgtattctagaattgtattgaacgatgttgagaaaaaagttgttaatcttttgaaaaagactgctgattttattgaatctaaatccagcagcagttcgtcattggaagttagattggcaggaggatgggttcgcgataaacttcttgggctttctagtgacgatttagacgttacgttgaataaagttaccggtgttgactttgcaaattcaatatttgagtatgttcactctctcgactctgactcagttattccatataaagacgcacttggcaagctaactgtcaatcccgatcaaagcaagcatttagaaactgctaccttatccctatttgaccttgatattgattttgtaggacttcgtgcagaatcatatgatgataaaagtcgaattcctagcgttaccccaggaactgttgaaacagatgcattgagaagagacttcacggttaacaccctattctttaacatacgaacagaaaaaatagaggacattacaaagcgaggatataaagatttgcaaaccaaagtgttggtcacgcccatttcacctctccaatcatttttggaagatcccttacgaattttgagaggcattcggtttgcatccagatttgaatttacaattgatccgtcggtcgtttccgctatccaagatccgaaagtatgtaaagcttttgaaaaaaaggttagcaaggaacgtgtaggagaggaaattgagaaaatgttgaagggtgcaaacgcgaagctagcacttcaactgttatattcaacgaacacgtatcagtttacgttcgatactttgccagctgaaaaagaatttcaaattccaaaggcattggaagctaccgagtctttatttcagagtcttgcattgacgtttcctaaacttatgaaattaagtgaagatgagaaaattgggctatggctatatgttgctctaattccatggtctagtcaaactgttatggttaagaaaaaacaattttatattcctgcaatcatcgcaaaagacaagttgaagctcagaagtacatatgttaaccagttgaatcagtgctgcacattcaatccgatattcgatgaattagttaacgatacttccactaaaaattgctcatctattggcagcttaatacgacaattgaataaatcctgggaagtcgtgtttttaacatcggtcatatatagttgttgtaaaacaccggcagcatctgtatcaaatacatttagttcttataaatctctatatgactttatttatgacaaaaatttacaaaatgcttataacatgaagccattattagacgtatgtaattcttttatttctgttaacaatattgagcgaataagctaacaattttttagggaaaacagatcatgaaaaatgtgggagttaagcctggcccgcagctgaaagagactatggataacatgatttcctggcaatttaaacaccctgaaggaagtgtcgaagattgtgttgcataccttcaatccctaaaaatataa

SEQ ID NO: 46395 - DNA, 1773 bp, Schizosaccharomyces pombe
atggcagaagaattgaaagccaagggaaatgcggcgttctccaaaaaggattataaaacagccattgattactttactcaagcaattggtttagatgaaagaaatcacattttgtattccaaccgctctgcgtgttatgcttctgaaaaggactatgccgatgcactgaaagatgccacaaaatgtaccgaattgaagccagactgggctaaaggttggtcaagaaaaggcgctgctttacacggacttggcgaccttgatgcagcacgtagcgcatatgaggaaggcttgaagcatgatgctaataatgcgcaattgctaaatggtttgaaaagtgtagaagccgcacaaactcaagccgcttctggtgccggcggtttcaacccgttcgccaagttaggttctcaactttccgatcctaaattcatggaaaagcttgctagcaatccggaaacggcttctttgcttgctgattcggcctttatggctaagctccaaaagattcaacaaaatcctggcagtatcatggccgagttgaatgacccaaggatgatgaaggtgattggcatgttgatgggtattgatatcaacatgaatgcgggagagggcgctgcagaggaacaagagaagaaagaagagtttgctccttcttcttccacgccttctgctgactctgccaagcctgaaaccactaatcctcctccccagcctcaagccagtgaacccatggaagaagacaaaactgctgaggaattggaggaagcagccacaaaggaagcccttaagaaaaaagccgatcaagaaaagcaaattggcaatgaaaactacaagaagcgtaactttcctgtggctattgaacaatacaaaaaggcatgggatacatacaaggatatcacctatttgaataaccttgctgctgcttattttgaagcggatcaacttgatgattgcattaaaacttgtgaagatgcaatcgagcaaggtcgtgagttgcgtgccgactttaagctcattgccaaagcacttggccgtttgggtactacgtatcagaaacgcggtgatttagtcaaagctattgattactatcaacgttctcttaccgaacatcgtactcctgacattctctctaggctaaaggatgctgaaaagagtaaggaacttcaggatcgtgaagcttacattgaccctgacaaagccgaggagtctcgtgtcaaaggtaatgagctttttaaatctggcgactttgccaatgccattaaggagtatacagaaatgaccaagcgtgctccttctgatcctcgtggctttggtaaccgtgctgctgcctatctgaaggtgatggctcccgcagagtgcattcgtgattgcaacaaggcaatcgagttagatcccaactttgcaaaagcgtatgttcgcaaagctcaagctctttttatgttgaaagattacaataaatgtattgatgcatgcaatgaagcttctgaagttgaccgtcgtgagcccaataccggtaagaaccttcgtgaaatcgagtctcaattgtccaagtgtatgagcgcaatggctagtcagagacaaaatgaaactgaggaggagacgatggctcgaattcaaaaagatcctgaagttctaggaatcttacaagaccctgctatgcaagctatccttggacaagctcgtgagaatcctgctgctttgatggaacacatgaagaacccaaccgttaaaagcaaaattgagaagctgattgccagcggtgttattcgcctgggc

SEQ ID NO: 46396 - DNA, 1518 bp, Schizosaccharomyces pombe
atggatttggcaccacgtcccctcggtcgtcagcacagcaagtcgcaatcggcttttgcttttgacaacaccgctaccagtattgctgccagtactatgaagaatgagctgaatcacttggctagcaccgtaaaggatcccttggctaagaaggcctttcaaaaggagatggacaactttttcagcttgttcagtcgctatcttcaggaggacgctcgtggctcggaaatcaactgggaccttgtagagtctcccaagcccgagcaagtcgtcgaatacgataccattaccgaggcgggcggcctgtctcgtgactaccttaacaagcttgccgtcctcaagcttaatggtggattgggcactacgatgggttgcgttggacccaaatccatcattgaagttcgtgatggtaacagttttctggatttgagcgttcgtcaaatcgagcatttgaatcgtaaatacaatgttaacgttcctttcgttttaatgaactctttcaacaccgatgaggccaccgccaaggtcatcaagaagtacgaggcccataagatcgacattctcacctttaatcaatcccgttatcctcgtgttcataaggagactttactacccgttcctcacactgccgactcggctattgacgagtggtatcctcctggtcatggtgatgtgtttgaggccctcactaacagcggcatcatcgacacccttattgctcagggtaaggagtatttgtttgtcagcaacattgacaacttgggtgccgttgtcgacttgaacatcttgaaccatatggttgagaccaatgccgaatatcttatggagttgaccaacaagaccaaggccgatgttaagggtggtactttgattgattatgatggtaacgttcgtcttcttgagattgctcaagttcctcctcaacacgtggaggaatttaagtctatcaagaagttcaagtacttcaacaccaataacctttggttccatcttccctctgttaagcgtgttgtcaacaatcacgagctcagcatggagatcatccccaacaagaagaccatcaaacacaaaggtgagaatatcaatatcattcaattggaaactgccgctggtgccgctatccgtcattttaagaacgcccacggtgttaacgtccctagaagacgtttcttacccgtcaaaacctgctctgacttacttctcgtcaagtctgacctctattccatcaaccatggtcaggttgagatgaatcctcgccgattcggaggtaccgctcctttagtcaaattaggcgcacacttcaagaaagttgctgatttctctgctcacattcccagcattccaaaaatccttgaacttgatcatctgaccattactggtgacgttaatattggtcgcaatgttactcttaagggtaccgtgattattgtcgctagtgatgccaaccgtattgacattcctaatggttctgtccttgagaactgtgtcattaccggtaatctcaatatcttggagcac

SEQ ID NO: 46397 - DNA, 1836 bp, Schizosaccharomyces pombe
atgaaacttcgtttggacccttccactcaatctaattatcatgatgtctcaatcagtaagctcgattggcacgctcgaattgactttgaccaagagctgctccatggtaaagtatcctttgtgattcaatctgctagggtgtcccaagccctgtcccatattatccttgacacttcttacctcgaaatcaagaatgtaacgattaatgacatccctactcctttccgtgttgataagcggcgcggatttttgggttcagctttgcatatcgttcccgctgatgaaatcccttcctcaaaatcctgtatacttacaatcttatattccactactaaggattgtacagcacttcagtttttgaagcctgaacaaacgataggtggtaaatttccttatgttttttcggaatgtcaagccattcatgcacgttcattcattccctgtcaagatactccttctgttaaagttccgtgtacttttaagatccggtccaaacttcccgtaatcgcatcgggtatcccatgtggaacagctaatttctgcaatggctctttggaatacctgtttgagcaaaaaaatccaatccctagttatttattttgcattctcagtggtgatttggcctccacaaatataggtccacgttcttctgtatacacagagcctggcaacttgttagcttgcaaatacgaatttgaacatgacatggaaaactttatggaagccgccgagcaactaacacttccttattgctggacacggtatgattttgtcatccttccgccttccttcccatacggaggtatggagaaccctaatgctacgtttgctacgccgacacttattgccggagatcgctccaatgttaacgttattgctcatgaattagcccattcttggagcggtaatttagttactaatgagtcatggcaatgcttttggttgaatgaaggtatgactgttttcttggaacgcaaaattttaggccgtctttatggtgagccgactcgccaatttgaagccattattggctggggtgaattagaagaatcggttaaattgttgggtgaagatagtgagtatacgaagttgattcaaaacctcgaaggaagggatcccgatgatgccttttccactgttccttacgaaaagggctccaatttcctctatgaaatagagagggttattggtggtccttctgtttttgaaccattccttcccttttactttaggaaatttgcaaagtctaccgtaaacgaagtcaaattcaagcatgcactgtatgaatacttctcacctcttgggcttgcatctaagttggactcgattgattgggatacttggtaccatgctcctggtatgcctccggttaaaccacattttgatacaacgcttgcagatccttgctacaagcttgcagaaagctggactaattctgctaaaaattctgatgatccctccaagtttagcagcaaagatattgaaaattggtcagcgggccagaaatctttgtttttggatgttgtttatgaagctgtctcttttcctcacaattatattaaaagaatgggtgatgtttactcgtttgccgaatcgaaaaatgcagagttatctttccggttttttaaactcgcattgaagagtaaatataagccattatacaacactattgcagaacgtgttggcagcgttggccgtatgaagtttgttcgcccaattttcagactgttgaatgaggcagatcgtgcttttgcaattgaaacgtttgaaaagtataagcatttctatcataaaatttgtgcttctcaagttgaaaaggacttaggcttatctgaa

SEQ ID NO: 46398 - DNA, 3238 bp, Schizosaccharomyces pombe
atgcaagtagatcctgtagtatatcaactacaacgtgctgtaagtcaagatcccattgctgttaaggatgctgaagggcatttaaacaactggaaaaaggaaccaggtttctttggcaagctgtacagtatatttttggataaacaaaatgacatgagtttacgatggattgctatcattcaactacggaactccatagatataatatggaggaaaaatacaaaaatgtaagttaggagtagtctcgaagaatcaacctgtactgttagactttcgtaattgctaatgtatgattgtttggcaggtctttacttccagaagaacgtgactttatacgatgtaatgctcttttaggatctataaaatctgaaaacctcttatctattcaaaatgcgctggtcgtctctcgaattgctagattggattatcccaccgaatggccttctctttttcacgatcttttaggcaagttacagcagtcattgggtacaggagattacgatgtggctttaagattactaattactcttcatcacattatcaaagcaatggctgggaatcgtcttttgagatcgcgacagattttttacaaacttgctccagaattgcttacgattcttcaacccattttacattctagtttatcaagctggatgatgatacttgaatcttctaaggaaattaaagattctactttgttgtcttatatgcaaatatctcgatacacgcttaaggcatgtagacggttggttgtttttggtttccaaaatcctagtgaaagtgaatttagtgagcgtatgttagctttttgtgctgttcatcagcgaaaacttttgagtatgcttggtacaatgcttcaatcctcgcggtctccgatagtagttggggagtgcttagaaatggcttttgcacatgctttcttattcaataagccattctttgatttttctttctatagtccatgcttgactaagtttccagctactattgattacatttcattgcactatgattttttgggtcaaatcagttctcatctttcttcatacaaagaaaagtttgaagagagctcaaaaaattttgaaaaacttgtgattatgagcttacgagtatttatccttgtcatccaagaattctgcaatactaaatcgtcgcaccccgaaacggctcaagttctttacaactcatttctcgtagataatcgtataaacaatcttttggatttactcatcaccaaactactaatattaaaagaagaagattttgaagaatggacggattccccacaacaatgggtccttgaacaatcgacccaggatgttgagtttaacgttagggtaagttgattatgaatatgggttttttgataagcttatcattaacgataatatagccttgtgccgaaaaacttttaaaatgcttctttgatgcatatggagatattatcgtttcgccgttcaaggatatgatttacagcgtttttgagtgtccaaagacgttaacacaagcagttcaacaagacactttgatcagttctttcggagttggatatacccaattgaagagtatttttccttttgcaaaatggctacaggaagccgcagttcccaacatggcttccattaatgatattgggatatctagagtgtatcgacgaagaattgccatttttttatcgcaatggattgaagattcttcttcagaacaactccttgaggttatttacaaattgtattgctcatttctcaacttaacagatccttgcaatgacgccgtagtcattttaacaactatagatgctttcaaaaccgttttagatgattggaatttttctgagaattcatttctttctatcaaagaaaatttgtttgtccatgttctttctttgtttaaagcgtttgaatcagtcgatgctaggacttccatcttgtctttacttggtactttattggcaagggccggagaacatgttgctcccatggaaagtaccattgcttctctcctttctcaattatgggatggttggaaaaaggaaccgctgctgcgagcacgagttttggcagttatgcaccaattcgtcaatgtaagtgtttggctatatacaacagactgttttcttatactaatttctaggcgatcaaagcaaaatcttttgaattttcaacttttttatatacggtaatagaatattgtgtaaatccggaatctccagagcatgttattttcgaagcggatgcaatggaattgtggagcacctttctcatgtacatacaaaaattgccagaaacttttaccctacttatccctcatttattgtaccatctttcacaggccacgtctacccttccattcgttctaatgatagtaagcagttatcaacttttagacaataccgttttgatgaaggattactcatttaccatatttgaaaagttgaacgacttattagacgatgtaaaaaacgaaactttgcaagcactatgtaaaactgtatgtctactcattgaaactactccgatggatatgatttacgaatcattgctgaacagttcacttctgtcgaggctcctactctccattgcaacaaatgataaacaccctcaggtgttgattgaatatttattggtggtgtcacgcatctcattgcgcgagccggaattaatattgaaggtttgtcaaacgaaaaatatcaacatagctatgcttatcggcaactggattttattaaacgaccacataaaccactcgaaagatcgaaaactgaacacactcgccctcagctctctgctgcgaacaaatcatcccgacgttttggcagtgttggattctatcatgaatttatggttcagcgttttgagtgaggtggaagaggatgcgaatggagatgcaacgatttactataaaaatgatgactactcggctgttgggttttatctcgatgaaacctcagaagaaatgactcgacgaaagcaggtaagtgaatgagaggctagaaatatgtttattgtgtaaatgaaaaagttttatttgtttgcttttgttttattaatactaacttttattttagctgcttttaaaggatcccgttcatagtgttaactctcgctcattttttatttctgtatttatgttttgcagagacgctaatggtggaatggagaattttcaaaaccaatatttatcgacggtcaacccagcgttgttagaacagtttcaatccatgctataggaaaaaaga

SEQ ID NO: 46399 - DNA, 1728 bp, Schizosaccharomyces pombe
agtattcagcaaaatatcgaggacgagggcaaggtgaacgttcgcgaagtgaatcccgattcctatgctgaacgggaccatggctatactgctggcatattttcggatgctgaagaaaattttggcataactcagcaagtagcggactccactcaaaatcccacctcgaaacccaagtcccggcatgcacatttccacgagacggtgcacgagaatccttccgaatattcgcgctccaaatgtaaacaacctaccaacgaaaaagaatatgataaagccatcgaggctttagttgcaaaggccattgttgaggaacattccggccaacaatttcctgtatataaaggccttgaacaatacactctattacaaaagatgggcgatggtgcttttagtaatgtatacaaagctattcacaacagaacgggtgaaaaagtcgccattaaagttgtccagcgcgctcaaccaaacaccgatcctcgcgatcccagaaaaagacaaggcgttgaatcgcacaacattttaaaagaggttcaaatcatgcgtcgcgttaaacatcctaacatcattcaactcttggaattcatccaaaccccggaatactattacctggttttagagctggctgacggtggtgaattatttcatcaaatcgttcgcctcacctatttttccgaagatttgtctcgtcatgtcataactcaagttgcacatgccattcgatatctgcatgaagactgcggtgtcgttcatcgtgatatcaaacctgaaaacctgctttttgattctatcgactttgtgccctctcgggttcgtaaataccgtgccggagacgatcccgataaggtagacgagggcgagtttattcccggtgtcggcgctggcaccatcggtcgaatccgtctcgcagatttcggtctaagcaaagtggtttgggactctcacactcaaactccgtgtggcactatgggctatacagcccctgagattgtccgtgatgaaaggtattctaagggagttgatatgtgggctttgggatgcgtattgtacactattctttgtggattccccccgttttatgatgaaagcatttctttgttgacgaaaaaagtctcacgaggcgagtattcattcctttctccttggtgggatgatatttcaaagagtgcaaaggatttaatcagtcatttattaactgtcgacccggaatctcgttacgacattcatcaatttttagcccatccatggatttcgggctctcgggaacctacctttcctgccaccgatgctcctaacactgctcaacgcgaaaacccatttacctatgactttcttgagcccgaagacgttgctgctgccggttcagccgctcgtactcctggtgttaactcgttgagagaagtatttaatatttcgtatgcagcccaccgaatggaacaagagaagattaggaaacgtggtcaacgtggtaaccaaggaatcatgaattttatgggtgacatggatgatttgatggaggagaatgatgattacgatgatggtaccaagagcgttgaacattcgatgaaacgagtcaacctgtcaggtgaaaacgatcctagccttgcttcccgccaacctgctcaatcgcaacaacaatcatctcaaaggtcgcggaataagttcaaaggtttccaactcaacttgtcaaaggcaactttgtataatcgtcgacatcgacaaaaagtg

SEQ ID NO: 46400 - DNA, 3132 bp, Schizosaccharomyces pombe
atgtccgattggcggcttacagaaaatgtacttgaccaaaacatacctgaaactaaacccagggagtccaagactcgcctcgaggaaattcagcgattagcattgtttcaagaggaactcgacattatcgaagaattggatgaccccgtggatgtttggtatcgctgcatcgaatggctcttggaaacaagatttttgggcatggaaacggtcaacaaaatgcttgatgatgctattcagtacttagaaagatgtcgcttcgcgcttaatgatgttcgtcatcttctcatacagcttgcgaaaattaaacaatcatacgaaactcctgatgaattgcaacaggcggccaagcaattttaccaattggcatcgaaaggcataggccttgaactcgctttgttctacgaagaatatggttctttgctcattagaatgcaacgttggaaagaggcttctgaagtatttcatgcagctgtttctcgagaagcgaggcctttggttcgattgttaaggaacgctgctgagttctctcgtgcctacgatttgcataacgctcacccttctattcatgatgcaccctattcttctccatttcctcctcctcgtattgttttgggctcaaagccggtttcatcctctactcttccttcaaagcctaaatcctttcaggttttttccgatgcttcatcttcccgcgactcacaaaatgcttctgatttgcctcaggcaaaatccctagaatccgaagcgaatactccaaatcttcccctgctctatgataagagctctggtaagcgagttgagtattctgcttttaatttccttgctttgtatgaaaatggagaagaaaggtcaatggaagaatgtcgggcgcaacgttacctttcttcaattcaaccaaacactgctgcttctttcccgaaagtggtgccaaaaaatgaaatttcagtgcatcatgattcatcttcatccaatgtatcacctatttacaagaaccctgtggccgagcaatctgatactcctacacgttctttaccaaaaaattatgcttatgttgcaaagtctacatctcctgaattaaaagtttttgatacagtaatgcctgttgcattgtctccaaaaccagcacaaaaaccaccttctcctaccatacatacgaaagcagctctagcagatattttagatatttttaatcagcctcttcgttctgaatcattggaaaagtcatcaaagtctcctatttctgctcagtcatcctatttgggtacaccgctaaaaaatgacgaaaattcatctaattctggagcgacttctttaactggtcgctcacaagaagagcacttagactttataccctctttgaccccttcaaaaaactacccttctaaaatttattctcctaataaaaatctagacttttcgcatacagcatctaaggcagaaacatataaaaatagtaatgaactggaaaatgtgaaaagagagcaacctttttcagaacttttaccatctactcttcaagaggaaacggcaacaggaacaacttcgactacctttgccaatgcaaaacggagacccgaggattctaatatttctcccactaaccctaagaaattacacactttaccccgttcacctcaatattccactgttgattctaattctgttttgtcaccagctatgcctaaaggatatatgttcgttaatgagaaccaaagcatgaagcatgagtcctctgttagtaatccggtagccacgatcccacatgaaaacggaaaacatgactttggccagctttctcctatagaacataagccttttttccctaaaaatgatgatgaattgcctggtccttcaggatatcttactatgccttatgaagaagccatggcttctttatccaatttaccgacgctaataaatcccctagatcaatctttacgtgacttactttttcaagttttgcgcccatctttattgcgtgataaggactaccacgagcatgaaacttcctttgctttagttgaacatatagagtcatttgtctccaaaattaaacccaaggccggtggccctggacgtcgaagaagtagcaatcgacactctcttgatggccccgaattccatttattttatccacctaatacaaaccttagcgttatcagcaagcttggtcaaggcgcatttgctcctgtatatttggtgaaatccaaaattgaaactgaaaatggtgacgtctctcaaggcggcgcagaaaacaatgaatctaagctttttgctttaaaaattgagacaccaccttcgtgttttgaattttatttaaccagacaggcaatgacgcgccttaagggattgagagaaaccaattcaattcttcccgtgcatcagctacacatgtttcatgatactagtcatttattgatggactatcgtccgcaagggtccatattggatttagtaaacagtatgcataattccaccttttcatcttcgggtatggatgaaatacttgttgtctttttctccattgaatttttgcgcataattgaagccctgcatacccataaaattattcacggcgatttgaaagcagataatgcacttcttcgtctagaaaccgttgcagactctgagtggtctccgatatattctccggagggtttgtatggttggtcttttaaagggatttacctgatagactttggacgtggcattgatctttctttgtttgaagaaaaagtcaaatttatagccgattgggatactgatttacaagattgcattgagatgcgtgaaggcaggccatggacataccaaattgattatcatgggttagctgcgattatctataccatgttgtttggtcaatacattgaaactaggatagaggtaatcaatggtcaaagacgacaggtactgacgcaaagaatgaaacgctactggaaccaggatttgtggcatcgattgtttgatttactattgaatcccacattgcacgtttctgaagagaacttgccaatgacggaggagttaagcaaaattcgtatagaaatggaagaatggttagtgaaccattccactggaggttcgggtttaaagggcttattaaaaagcatcgaaaaaagaaaaatt

SEQ ID NO: 46401 - DNA, 804 bp, Schizosaccharomyces pombe
cctcgcaattttaaattacttgaagagctagaaaagggcgaaaaaggcctcggagagagttcttgctcatatggtttgacgaacgccgatgatattacattgtccgactggaatgcaacgattttaggacctgcccatgtatgtttctattggggtatatttcaagtgttaaattgatgtaaaaaaaatgaccggggactagctttgaaatttatgaagactttcgaatcaatacactttgaagcttatcctgttttaatacttttaactttcaatttgtactaatttgttattaatttagagcgttcatgaaaatcgcatttacagtttgaagattcactgcgatgccaattaccctgatgctcctcccatcgtcacgttcgtatctagaattaatttgcctggagttgatggtgaaacaggaaaagtatgtgtatattagagaaagtttgtaaaatacctcatgttctctgtaaattcttttcatagcaaatatcagtatattgtatgaaaatgagaatttggtgttggcttaacgaagagaagctaattttacgcgaaataaaaaaatcaagcttttttcagttcatactaacgttaattaggtaaatccccacaaaattgactgccttcgccattggaagagagaatactctatggaaactgttcttctagatttaaaaaagtatgtctattaaacttcgtatgaatgatcatcctaacttatgttttagagaaatggcatcctcttccaaccgaaaacttcctcagccccctgagggtagtacatttttttaaagcaaa

SEQ ID NO: 46402 - DNA, 2238 bp, Schizosaccharomyces pombe
atggccaaagttcaactgagcccgaaggagattaccctttttagaacagcattagtatgttaatcttctacaattaacaaattgaaaatttctctaaccctgtagaaatgctatgaaacaaaacagtacaaaaaaggattaaaggctatcgaacccctgttagaaaggcatccagagcatggagaatccttagcaattaagggaattttattacactctttaggtaataccaaagaaggatacgacaacgtacgacttggtcttcgcaacgatgttggatccggtgtttgttggcacattttcggactaattagcagagccgataaagattatgtacaggccgctaaatgttacattaatgctcataagcttgagaaaaacaactcgagtcttttgcgtgacttggcgttactccaatctcaacttcgtcaatacaaggctctagcagacactaggaatgctttgctgcaggacaatccaggagtacgtgccaattggagcgctttagcagtagctcaatttcttcgaggggaatacgctagtgcatataaaatagtggatgcatttgaatccactataaatcaaggtgtgcccgttgatacccaagaagaatccgaagccatgttattcatgaaccttgttatattaaaaaaagatggtgttgaggatgcctataagcatttactgtcaatagaaaagaaggtattggatcgggttgcgtttttggagactcgggcagagtacgagctttatctttccaaaatggaagaagccaaatcaaccatatatcttctgcttgatcgaaatccagacaatcaccaatattattataatcttcaaagagcgtatgggtatgaggatgccagtggtaaagtattggatagtgctgagtggttgaatttatattctcaacttgctaaaaggtatcccaaatctgagtgccctacgagactacctttagaaaagcttgaaggggatgagtttttaactcatgtagatctttacttgcgcaaaaagcttaagcgtggaatcccatctgtgttcgtcgatgtcaaatctttgtacaaagataccaaaaaatgcaaagttgttgaggatttggttagtaaatacgcttcctctctttctacgaccaacaaattttctgaagatgacgataattcacagattgaaattcccaccacgcttttatggacatattactttttagctcagcattttgatcatgttggtgagttggaaaaagctgagaaatatgttgatttggcaattgatcataccccaacgcttgtggagctgttcatgacgaaagctaggatttccaaacataagggagagcttcaaactgccatggagattatggatcatgctcgtaaacttgatctgcaagatagatttattaacggcaagtgtgctaaatatatgctccgtaatgatgaaaatgaacttgccgccaaaacggtatcgttgtttacacgcaatgaggctgttggtggtgctgttggcgatcttgcagatatgcaatgcctgtggtacatgcttgaagatgggaaatcatttgctagacaaaaaaaatttgctttggctttgaaacgttttagtactgtttttaaaatatttgatacttgggctgatgatcaatttgatttccacttcttcgcatttcgcaagggatctcttcgtacatacctggacttaatgtcttgggaagacagtgtttatgacgatccttcgtttagagaggctgcccaagggtctattgaaatctattttgccttatttgatttaccatttgctaaatatagccctaaattacccgattttgagaagctttctagtggagaaataaatgaagaagaggaaaagaagatatacaagaagctgaagaaggaccttagtaaacgattggaacgtgctgagaagctaaaagaggccgataaatctcgtgcaaaatctgaggacggtatgccggtaaagtatgatgaggatcctcttggggagaacttagttgctactagtgaacctttgaaagaagctcaaaaatgtcttgaaaaattactcccctatggagataaaaacccaagtgcttacattttggcggctcaactttacactcgtttgaaaaatttcgataccgctagtaaatacctcgaacaagctaaagtaattttgggacagaatgacccaactgtgatatctacagagaagttttataactctatcaaaactcagtctaac

SEQ ID NO: 46403 - DNA, 1053 bp, Schizosaccharomyces pombe
actttttcccttcccttactacaatcatttatcatgtcttcatacatcttgtttggtttggaaaaccctctgttggattactatgttggtggtgaaactgcaactcttgaaaagtatggcttgaagagcaacgacgccgtcttagcttctgagagccagatgggtatctacaaggagccatgcgttagctacagtgccggtggtgcagctcaaaacagctgccgtgctgctcaatacgtacttcctcctaactctactgttttcgccggctgcgttggtcaagataagtttgctgatatgcttcttgaatcgaacgaaaaagctggattacgatctgagttttctgttgatcccactacacctactggtgtttgtgctgtcgtcttgagcaacaacaataaaaatcgctccctttgtaccaacttgggagctgctaacaactacaagctcaaggacttgcaacagccgaatgtatggaagttcgttgaggaagcaaaggttatttacgtcggtggttttcacttgaccgtcagtcccgaatccatgttatgtttagctcaacatgctaatgagaataacaagccctatatcatgaatcttagcgctcctttcctctctcaatttttcaaggagcaaatggattccgttatcccatattgtgattatgttattggcaacgaagctgaaatccttagctacggggagaatcatggaatcaaaagtaccgacgtccaggagattgcgctggccttgtcttctgttgagaaggttaacaagaaacgcacccgtgttgttgtcattactcaaggagccgatgccacgatcgttgctaaagacggtaaagtaaccacttacaagcccaaccgcgtcccatctgaggaaatcgtcgataccaatggtgccggagatgcctttgctggtggatttattgctgctctttctcaaggccaaggaatcgattatgctgttactctcggtcattggcttggacaagaatgcatcaaggttagcggcactactcttcctcttcccaaaaagcagttccctttacct

SEQ ID NO: 46404 - DNA, 1437 bp, Schizosaccharomyces pombe
atgactgctccttctgcaactgctttctcctccgctaccactcagcccaccactgagggtaacgcttctatgcgcaagcgtactattcctgtcgtccccagcgttcccgaacgcaaatgggatcccaaggcccccaagcatatccaagaacaaccttggaccatgcaaaactggtggagacatttgaattggcttcattgtatgcttatctttggtcttcccatgatcgccatctatggtgtctttaccactcccttacaaaccaagactttgattttcgccattatatactacgcctactctggtttgggtatcactgccggttaccatcgtctctggtctcatcgtgcttacaaggctaagaagcctttggaatactttttggctgccggtggtgctgctgcctttgagggctccattcgttggtggtctcgtgaccatcgtgctcaccaccgttacaccgataccgacaaggatccctacaacgtcaagaagggtttctggtatgctcatgtcggttggatgatcatcttgcaaaacccccgtcgtattggtcgctccgatgtctccgatttgaactcggatccctttgtcatgttcaaccaccgtcacttcttgcccattgctagcttcatggccttcatcttcccttctctcttctgcggtttgttgtggggtgattaccgtggtggttatttctatgccggtgtctgccgtttggtctttgttcaccacgctaccttctgtgttaactctcttgctcacttgatcggtagccaaccctttgacgacaccaacagtgcccgtaaccacttcatcaccgccttggtcactcttggtgagggcaaccacaactaccaccatgctttccccaacgattaccgtaacggtcttagatggtacgaatatgatcccaccaagatcttcatctacattgccagtctctttggtcttgcctacaacctcaacactttccctgacaacgaaatccaaaagggtattgttcaacaaaagcaaaaggttttggaccgctggcgtgccaagcttaactggggtattcctcttgaacaacttcccgtcatggaattcgaagactttttggagcaaagcaagactcgtcccttggttctcatcaatggtgttgttcacgacatgaccggtttcgagcacccaggtggtcaaggccttttgcgttctgctttcggtaaggatgccactgctgctttcaacggtggtgtttatgaccacactaatggtgcccacaacttgctttccacttatcgtgtcgccgttgttcgcggtggtatggaggttgaggtgtggaagtctggtgccggtgcccaactccctatgaaggatacccaaggacaaaagattgttcgcgttggtgagcaaattactcgtattcagcctcccatcgaggctgctgccgctaac

SEQ ID NO: 46405 - DNA, 1353 bp, Schizosaccharomyces pombe
atgagtaccccatacgaacctgaatttcaacaagcctacaaggagattgtgggctccatcgagagctccaagctctttgaagttcatcccgagttgaagcgtgtgcttccaatcatttccattcccgaacgtgtcttagaattccgcgtcacatgggaggacgataaaggtaactgccgtgttaacaccggctaccgtgtccaattcaactcggctttgggcccctacaagggtggattgcgtttccatccttccgtcaacttgagcatcctcaagttcttgggctttgaacaaattttcaagaatgccttgacgggccttcccatgggtggtggcaaaggtggttctgacttcgaccccaagggcaaatccgacaacgagattcgtcgcttctcgcaagctttcatgcgtcagcttttccgctatatcggtcctcaaactgatgtaccggctggtgatattggtgtcacaggttttgtcgttatgcacatgtttggtgagtacaagcgtcttcgcaatgagtacagtggtgtcgtcaccggcaagcacatgcttaccggcggtagcaacattcgtcctgaagccactggctacggtgtcgtttactatgttaagcacatgattgaacaccgcaccaagggtgccgagaccttgaagggcaagcgtgttgccatctccggtagcggcaacgttgctcaatatgctgccttgaagtgcattcaagaaggcgctattgttaagagtatcagtgactctaaaggtgtcctaattgcaaagaccgctgaaggccttgtccctgaagagatccatgaaattatggctctaaaggagaagcgtgccagcattgccgactctgcttctctttgcaagaagcatcactacatcgccggtgctcgtccctggactaatgttggtgaaattgacattgctttgccttgtgcaactcaaaacgaagttagcggtgaggaagccgccgctcttatcaaacaaggatgtcgctacgttgctgagggctccaacatgggttcttctgctgaggccgttgaagtctttgagaagtctcgtgcttctggtgagggttgctggcttgctcctggtaaggctgccaatgctggtggtgtcgccgtttctggcttggaaatggctcaaaatgctcaattctctacctggactcatgccgaggttgacgctaaattggctggaattatgcaaaacatctttgaacaatccaccgatgtcgcctccaagtattgtgactctggctctaacaacattcccagtcttgtcgatggtgccaacattgctggtttcttgaaggttgctactgccatgcaagccgttggtgactggtgg

SEQ ID NO: 46406 - DNA, 1422 bp, Schizosaccharomyces pombe
atgtcgtataaattagaccaactcactcgtcttcctgaaaacaagaaatgttttgattgtgatgctccaaatccacaatgggcatcttgtaatttgggaatcttcatttgtttggattgcagtggacagcatcgtggtttgggagtcgaaaagagctttgtccgcagtattaccatggacaattggagtgaacgtcaagtgaagatgatggaggtaagcatcaggattgatacgggctattggagtttgttggttattttaccaaaaaaaaaacatatatatataataattcatttggctgagagggtagcgctattgatctgcgagtttgcttgccgctatttcgaattttttccaagtcatttagtgcctttttttgacaagaataatgtttaatgttaaaaacaagtacatgacgcgcaattgattatcacctgaagttataaaatgcaagctcactataatttcatcaatgacttgaaacaacatatatagcccacatttgttgcatgctcctgactaacttctatacaggttggtggaaattctaatgctaaaacattcttgtctacagacccgatgttttctgctgccggaagtattcgtgaaaaagtatgatctttgaaccttctatattttttccagtttaccttattttgattttattcacattgactaacacattttaagtacaataccgacattgctgaggacctacgacaaaaaattcgtgccgaagtagatggtgtcgaatgggtcaaagttgatcgtcctaagagcgtttcctctcatgcttctgtaacttcatcttcaactgttccaactattccatcagtttcaaaagaagcaaatgataaatattttgcaaagcttggttccattaattcccaacgccctgatgatttacccccttcacaaggaggtcgctatcaagggtttggaagctctaactctgttaatcccaattcttctgctagaaataacggtggctcttttttggaccaattatcatctaatcctgtttctgcacttagtcatggttggaacatgttctccagatctgtttcccaacagattcaagacgtaaataagtcctatattcagccagggattacaaaggtacaaacattttattgtatccaaaaaataaagtttctgttgtactgactctgtttttaggttcaagatcccgaaacaaggaaggattacatgaatgccattaataatttctctagtaacgttcaggaaggtgctaagcaatcatttacacaacttaaatcctttttggatgaaaatgtatattccgaaaacccccaaaacacccgcggtacttatgatgcggaaatcgactctccttattcagctctcgctgcctctcctccacctgaagactattcgaaaaagaatttcgataagcacgat

SEQ ID NO: 46407 - DNA, 870 bp, Schizosaccharomyces pombe
gatctatatggtggctctgatcgcttactctcttttaaccaaaggcaatatggatttaaagtggataacgttgatacttctgacttggcagcctttgaggcagctttgcgcccagacacaaacttggttttgattgaaagtcctactaatccccgtatcagcatttgtgatattcgggctattgttaaaataactcgttcaaaagccaaggatgccttattggtaatggacaatactatgctttctcctgtcctttgtaaccctttggactttggttatgatatagtttacgagtcggccacaaagtatctctcaggtcatcacgatttaatgggtggtgtcattgccacaaaaagcgatgagattgctaaatctgtgttttttaacatcaacgcaatgggtgctgctatggctcccttcgaatgtttccttctgttgcgcggtattaaaacgatgggattgcgtgttgaacgtgcacagcagaatgcaatagaaattgccaaattcttaaagagcaagggacttcaggtcaacttccctggattagaccctgacgctaagtcaaccgcaatcttttactcctttgcacgtggaccaggtgctgtaatgtctgtttttactggcgacgttgaagtctctaaaactattgtaaacactactaagctctttgaaatatcggtttcgtttggtgctgttaactctttgatcagtatgcccgcttatatgagtcatgcttctatcaagaaggaggttcgagacgctcggggattgagtgaagatttgattcgcatctgtgtcggcatcgaaaacgtcgatgatctcaaggctgacctcgaaaatgcccttgctcaagcaaattttaaacagaat

SEQ ID NO: 46408 - DNA, 1053 bp, Schizosaccharomyces pombe
atgaaagaaatgattaatctagacagctcctctgaacccagcatcgttacaaaacaattctctgtagaagaatgcttgagtaaacttaaagagcaacattgctatgtaccgatgagaacaattggtcgactaagactcaggaaatcttccgatcaaactgaaaaaaaatgttggaaagagaaactaatgaaaattcgcagcgaacttgaagaattatgggagcagtcgatgatgtacgaagaacagaaggaacttactcaattaggggaaatgttggatagattgtgggataaacacataaacagtgaagggtcaaagtcagaaactatcagtgacactgccattagtggtaatgatgatactatggaaaagagacttgaacaattttcagatgacactttgcaagataccctggaaacggaaaaaaatcttaacagtaaaacttctgagtccttgaagtcaccaactctctcatatccgttcgatttggatagccttgacaaacggatattcaaactagaatcaaaaatagggtatgctgatgaaccgcttagcgagcttttaaacaaatgtatggaaaaacttgaaattgttgagcaggatcctcaattttggcaatcccgaattgaatcatggaagcaattacttgctaaagattttttgaaacaccatgaaagaaatctttgttcaatagagaaacaaacgactttaaaaaactcttcgttaaaggaattgtgtacggaagaagatattgttatcatgttagagatttgttcttcccaacttcccttcgttgaacagtatatgcccatattaccattgttgttagaacggctaaagtctttacagaatatgcacaccgatgcggctgaagcaattagcagttggcagggttcaaaagatgtaatgatgactatgcagtctgagttgaacgaatggaaaaatacagttgaacgccttgatcattcaaaattttacacacaaagcgtagaagagatgaggagattatctgacactgtcacacagcttgaaaaacgcgttttaaaattgcaa

SEQ ID NO: 46409 - DNA, 1716 bp, Schizosaccharomyces pombe
atggttcgaaagtatggaattttcatcgacgctggatctagtggttcaagacttctaatttattcttgggactatgataccgattcctctttaagtgataaagtaaaaaaattaccattaatcgagacagggattggggatggtggtaaatggtctttaaaggttcaacctggaatttcttcctttgccaataaccctaagcatgtagggaagaagcatttgaaagaactcctggattttgctgctcatgctattcccaaagatgtacataaagaaactccggttttcctaagtgctacagctggtatgcgtttactgggcgttgatgcccaaaacaaaatactttcgcatgcttgtagatatattaaaaagaattacgatttcgacatacctaattgctcaaattcaatccgtgtaattgatggcaaagctgaaggtatgtatggttggctagctacgaactatctccttaagacacttgaagaaaaagatacgtcaacggttggttttttagatatgggcggtgcgagtgtgcaaattgcttttgaacttcccccatctcagctcaaaaattacaaggatagtatttcgaccgttcacataggactacaaaatggtcagcaattggaatatcctttgtttgttactacctggctcggttttggcgctaatgaagcttaccgcaggtatttgggactgttaatagaaagcgaaaacggaaaagttggcaacactttaagcgatccgtgttccttgcgtggacgaacttatgatatcgatgggatcgaatttgccggtactggagatttgaaacaatgcttgaaactgacttacaatctattaaataaagacaagccatgctccatggacccttgtaactttgatggaatatctattcctcctgttgattttgcaaatactgaatttgttggggtctcggaattttggtatacgactaatgatgtgtttgatatgggcggtagctatcatttccctaatttttacaaaaaagttgacgagtattgtggtacagagtgggaaaccatgctttcccgtctttataataaagagctgactccaagtactgatgaaaacaagcttgaaaagctttgttttaaagcatcatgggcgttgaatgtccttcatgaaggattcgacgttcccaagtcaaatacaagtagtaatgatgcaaaggatgggctctcggtaattcctgcgtaccattctccattcacgagtttagaaaaaatagaacgcaccgaagtgagctggaccttaggccaagtattgctttatgcatcaaatcagcaacttctagcaaaaccggaatatgctaattattatatggacccatacggaaagctaatcgcatccccttcaaaacattggatgaggttatttcctaataaattgttctttattctttcatttattttctgcttattctttctgttctctttggttttgttcgggtatgatccgaaaaggcgccaacgtttcaaaaaattccttctgcgcttgcaacgtcgcaaggctccgtacattatgtctgcaaatggaagttatgaggatatagcagatttttctgatgatttagaaatgagcagtccctctaagtggcatggacccccgatacgtaccacttcaagccatgttctcgcagacagactttcgtttactgctagtcgagagagaacgcctagatccccttttcct

SEQ ID NO: 46410 - DNA, 1479 bp, Schizosaccharomyces pombe
atgaatctaatctgctccattctgccgaaaaaagaaccttcctaccttaaattatggcgaaagcaagttatataccaggtattaacggacagatttgctttggatgaggataatttttatgcaaaagctagcggaaatctttaccttgggggtacatggaagggtattactcgtaaccttgattacattaaaagtctgggatgtacggcaatatggattagcccaatagttaaaaacatatctgagactacggattgtggtcaggcatatcatgggtattgggcacaagatatgactcagttaaacgagaattttgggacagaagaagatttgaaagaactagtcaatgcaattcatgagaaaaatatgctttgcatggttgacatagttgtcaaccatatgggtcatgccggaagcaaacccgtaaacttcttactttatcaaccatttaactctgggaagtattatcacaactggcagtttgtacaaaattacgatgatccccatgagacaattacaggttggttaggagattcacatgtgaacctaccagacattcgaaccgaaaagaatgaagttcgcaaattttttcaaaattgggtttctgatctaattaaacgttatcaatttgatggtatcagattggacacagccaaacatgtcgaaaaatccttcttcccaacatttattgaagcagctaatgtatttactacaggagaagtttttcatggagatcctaaagtcgtcggggattatcaaaaatatctcccttcgactttaaatttccctttattttttcaattgcgggaaacctttcttgaccccaaacattctatgttttcattttatgataaggccgtacttgatgttcgacattacttcaaagatgttaccgtcttgtgtaactttttggaaaatcatgattttcctcgcttttttcatgaaaccaaagacatcgccgtaagtctattgaacaatatttcaatttagtacctgcattttttatatattttaacatttatttagctggctcttaacgcattaactgcacttattttcatggacggtattccaattatctattatggacaagaacagatgtttgacggtggtagcgatcctgacaacagagaaggtctttggaaaagtaaatacaatacttccaatccaatgtttagacatctttcttcaatgatacgcacgcgtcaaaatttggttgagacctacccagagtttacatacgtgctatcttttcaactatacattgacgattcagtttatgtatttactcgtccaggagtcattatagccataagcaatgaaggctctacctcgtcgtttaaagttgaaatagatttgaaagaacactggaaagaagtgccttcaagttttacagatattcttactcagaaaaccatcccctgtaaagaccataaactgaagatcaaatcaaaaagtggcttgccaaaggtaagcatt

SEQ ID NO: 46411 - DNA, 3403 bp, Schizosaccharomyces pombe
gtcacgggtgaaactttagtagactcccaaaagtcactcattaataatgatacactcttgaatgagaaattaaaagaagactttgaagaaaatgtttccattggtacgtgtcggtgtgaccacttagtgtgaaaattacttatgaccgggttatttacattcatgttactaacgggtcatagacgttaaaatacacgaggaattgcgacgcgctttaccagattacgaagaaagcggttttcagagatttacttggcatataaagagctggcatgagttggatcgaagagctgtgagtccccagtttgcagttggcagtcggcaatttaaaattacctattttcctcaaggcactcttcaatcggctggatttacttcaatatttttggaatatattccaagtgaagaagaaaaattgagcaataagtatggttgctgttgccaatttgcatttgtcatttcaaatccaaggaagccttctttgagcgttgccaactctgctcattgtcgattttcaccggagattgtggattggggcttcactcaatttgccgagcttaaaaagctattatgccggcaagctcccgacgtccctccgattgttgaagatggcgccttacttcttaccgcctatgttcgaattcttaaagatcctactggtgtactttggcactcttttaatgactacgactctaaaatagccaccggatatgtaggcttaaagaaccaaggtgctacctgctatatgaattctctcttacaatccctttacataatacatgcttttcgacgaatcgtttatcaaattcctactgatagccctcaaggcaaggacagtattgcatacgcgttgcaacgctgtttctataaccttcaatttatgaatgagcccgtttccaccactgaacttactaaatcgtttggttgggattctttagattcgtttatgcaacatgacgtccaagagttcaaccgtgttctacaggataacttagaacgaagcatgagggatactaaggttgaaaatgcacttaccaacttatttgtcggtaaaatgaaaagttatattgcgtgcgtaaatgttaattttgaatctgctcgttccgaagattattgggatattcagttaaatgtgaaaggaatgaaaaacctagaggattcttttcgaagctatattcaagtcgagacgttagaaggtgataactgctattttgctgatacttacggatttcaagaagccaaaaagggtgtaatttttgaatctttccctcctattttacatttgcaattgaagcgatttgaatatgattttgaaagggacatgatgataaaaataaacgatcgatacgagtttccattagagtttgatgctaaagcgtttttaagtcccgaagccgatcagtctcagaattgtgagtatgttctttacggtgtattggtccattctggtgatcttcataatgggcattactatgcgttattaaaaacagaaaaagatggtccttggtataaatatgatgacacgagagtcaccagggctactttgagagaagttttagaagagaactatggtggtgattatatcatgcatcctccttttagatctcctgtcaaactaaaaagattcatgagtgcatacatgcttttatatttgcgcaaagataaattagatgaactcatgaatccagtttctgctgatgaaattccagaacatttgaaagaagctttgaatcccagtatccaacttgctgaacttcgcagaaaagaaagactagagagccatctgtatactaaagtgcaattaatcactccagaattttacagtgaacatcatgaatttgatattgccgattttggaaatgcttacaaagaagaaactatacctcaatttcgcattaaaaaggaggccaagttttctgagtttatcccaattgttgctgaaaaactgggctatcctcaggaatgtatgcgtttttggtatgttgtcaaaagacataactgtaccgtacgcgtggaatctcctgtgaacgaactgaattctacaatggaggaagtgaaaaacgtatggaattcacaaggtgaaatccttcgcttgtatttagaaatcaccccagaaaatgagctaagctcttctcttacacaccaaaatactggagaatggaatgccttcatttttgttaaatattttgatcgaaaatcgcaagagatttctggatgtggaactctccacgttaataaaagcgatgaaattcgttcaatatgtccgttactatgcgaaagagcaaatttaccgaagaacaccccgttaaatatatatgaagaaattaaaccggggatggttgattttcttcggttagaaaaaacgtttacacaaagtgaattgagtactggtgatattatatgttttgaaccatgccgcccatctgccttagaagatgatatcgttaactcaggttttgatagtgcccttaagttatacgactttttgagcaataaggttttggtattatttcgcccgcgatttattgaccaagatagcattattgaatttgaaatgctgctcgaccgaagaattaaatatgatgatctatgtattgaacttggtcaaaaacttggtattggtgctgatcatattcgacttaccacttgcaatccattgacttattctgctgggatggtagtccctaacgattcaaatattacactgtatgaaattttgtacagctcggaggaagaaatgccatctaatgttattttctatgagactatggacgtaagtctttcagacttggatcgtaagcgtttagtaagattacgctggctagttgacggattagctaatatcgaattagtcgaagcgtacatcaataaatctggggatatcaacgacctatttggtgctgtttgtgaacgatttccggatagcgatttgcgaaagaaaaaagttagggtatatgaggtttttgagagtagatatcatcgtgatctttcgttgaggactcttataaggaccattaatcctgccgctactttagttggtgaagtcgtacccttagaccagctgcagctataccccgaagagaaaattgtacaggtccatcatttccacaaggatattgcaagaattcatggaattccgtttagttttgtcattaaaccccaggaaaaattcatcgatacaaaactacgtcttgcagctcgcacacagtatccagaaagcattttcagcgttattaaattctgtgtggtggattttgataacaatagagttgtctatttgaatgatgaagacattacatatgatgttgttgaaaaactaaacggtacattggctttggatcgtgctaagaaagatagtaagaagccgaatatactcgaccgtgctattcagatgaaaaattag

SEQ ID NO: 46412 - DNA, 1827 bp, Schizosaccharomyces pombe
atgctttttcttcgtttctttattttcactttttttacaagcattttcacggtggttgttagtgagcctcctgtttctgctaaatttgctaaacgagttttatctgcaacttcctcctcttcttccacatgtcccgaatttattacaattttctcagaaggaccttctgaatacatcactactatttatccatcgtcaaagtcttctggccgcggtaccacaaatcacagcacaatatacaccacaatcaacagcggtactgtagcttccacatatactgtcacactggcagatggcgacgttgtggtcaaagacatagagcccactgcaggaacggtgactaccacgatcacttcaggtagtcacgagttcactaccactcttgctgaagccagtggtactgtccctggaacggttgaggtagttgagcctctagctggaactgttactactactattcattccggtagtgtagaatacaacaccactcttgctaccgcaagtggaactgttcctggtaccgttgaggttgttgaacccgctgttggaactgttactactaccatatactcaggcagtgaagagtttacaactactttggcatctgcctctggttcaatttcaggtaccgttgaagtaattgaacctacagctggcacagtaactaccactatttactctggcgaccaagagtataccactatccttgctgaagccagtggaactgttccaggtactgttgaagtgattgaacctgctgttggaaccgttacgaccactacttactcaggtagtgtagagtatacaactactttggtacctgcctctggttctgtctccggaaccgttgaggtcgttgagcctgcggttggaactgtgacgacgacattgcagtctgggtctcaagcctttacaaccactgtgcccgcctccggtagtgtatcgggaactgttgaggtagttcagccaactggtggcactgttactaatacagtatatgagggatctcagaccattacttcgactcttgcaacagctagtggtactgttccaggtactgttgaagttattcttcctgggcctagcacaatctattcgggaactgttgctaccactattacatatgatgtttctagtacgcctgcgtctactgttgttgttatccctactgctgtatgcaatggtgagcgtggtttgcaatatgccgtttataactatgatatttcctcttcgaaaaaccaattttgtgcaactagtggtgtaacagatgtttcttctttcacccagccagcctattttggatctagtgaccttgaccaatcctctcctctattcactggtgtcttgagttcatctgatagtgtgcctcaatggacttcttcttataatcttcctggttatccaccagacgctactgctatgggtagtacgagctctgcctgtaaggttattgtttatcaattctttttcagggttcctgttacagatacatttagtttggacgtcactaacgttgatgatgtattttatggttggttcggtgacaaggctatttccggatggtccaacacaaattacgatacctatgcttactggcatgctactaacggccaaaccggcattgcttcatttagcatgggttccttgactgcagacacttacgtcccagtcagatttgtcgttgcaaatggagctggtaaaggtgggtttgattttagcttcgtcgactctgaaggcaattcgtataatcccacatcctatgcttatacagctacttgcactgaaagtttcttgccatttggacaaggtaatgggggtgtggataac

SEQ ID NO: 46413 - DNA, 1560 bp, Schizosaccharomyces pombe
atgttttcttttcgtttttccactctagtcttcctttttttaagcatttttacggtggttcttagtgaacctcgtgtatcaattggacttgctaagcggactatatctcaaacctcctcctcttccttgtacacttgtcccgattatattacgattttttcagaaggaacttctgaatacaccacaaccatttatccttcctcaaagtcttctagttcagttgcgaaccatagcactatacgcacgacaattgatagcggaaccatagctacaacctatactttcactttaccagatggcgaaattgtaattagagacatagagcccgtagcaaaaaccttaacgactacaattacttcaggtagcctagagctcactaccactcttgctaccgcgagtggtactgtttctggaacgattgaggtagttgagcctctagctgggactgtaactaccactgtatactctggaagtgtagaacacaacactactcttgctaccgcgagcggaactgttccaggaaccgttgaggttgttgagcctacagctggaactgtaactaccactgtttactctggcgaccaagaatacaccactattcttgctaccgcgagcggagctgttccaggtactgttgaagttgttgatcctgcggctggaactgtaactaccactatttactctggaagtgtagagtacaacactacgcttgctaccgcgagtgaaactcttccaggaaccattgaggtagttgaacctctggctggaactgtgactaccactgtttattctggaagtgctcaatatgaaacgactcttgctaccgcaagtggaactgtttcaggtactgttgaggtagttgaacccgcggctggcactcttactactactgtatattccggcagtgaggcattcactactactgttgcttcaggaactgttgaggttgttgaaacagctgctggaactgtttatcaaacttcatgtatggatttaccactcacgtttagccttactgtagctacagctagtggaactgttcctggaactgtattggtttatgcgccgttcgctgggtactatactacgactatttattccggtagccagcagtatactaccacggtggctacggccgccggttgtgtatctgggactgttgaggttgttgagccaacagctggaactgtaacttccactgtttactctggaagtgctcaatatgaaacgactcttgctgaagccagtggaactgttcctggtaccgttgaagttgttgaacctacagctggcacagtaactaccactatttactctggcggtcaagaatacaccactattcttgctaccgcgagcggagctgttccaggtactgttgaagttgttgatcctgcggctggcacagtcaccaccaccgtttattcgggtagccagctatttactactgcactcgctactgcgactggaagtattccgggcactgttgaaattgttgaccctgctgcaggtactgtcagtattaccacatattcaggtagtatggagtatacttctactttg

SEQ ID NO: 46414 - DNA, 1205 bp, Schizosaccharomyces pombe
atgtctttgactgaaaaccttcaattattattaaatttggatagtctaccatccaaaaggtatgttatcgttacaatctagtcataaattcataaatcattcattaacaaatataccacagagaaaatttaataaaaagaaaagaatgtggtttaacaatcatgctttgcggagcctcaggtactggaaaaacaacgttcttcaatactctttttgctacttctttgcaaccagaaaaatcatatgaaacggctaaggagaccatagccaaaaagaccttagaagttaaaaagaataaggccgtaattgaagaagatggttttcatatcaatcttacggtgctcgacaccccagggttcggtgatttcattgacaataccagttgctggaatacggttgcagaatatttagacgaacaacacgaaaggtatctaattcatgatcaaaactctctccgtgtaccaaggaaagacactagagtccacgtttgtctctactttattacgccagtttcgtttggaatgcttcctttagatgtgttagctatgaaggagctatcgacccatgtaaaccttgtgccagtaatagcaaaggcagatacatttacaactcccgaattaacacaaataaagcaaaaaattagaaggatcctggaagctcaatcaatcgacgttttccatccatcaacagagtattctgattacgaaactgccgaattactagattcatccttaccttacgctatcatttccagtgtaaatgaagtttgcaaagacgatggggaaaaatcgcaagggcgtcgttacccatggggaacctctgaaatatatgaagaaacacattgtgattttttaaaattgaagaaattgctaattaataggcatatgctcgagcttataaatacaactgaaaccaacatctatgaacgatatcgtagagagcagcttacgaatcgaaagagtggcattcctaagctgaaaaaagagcattacgaacgcttgaacaatgagaaacgtgcgattcaacaaaagataacacaaatgactaatgaaactgaaagcttctttcaggccaaagaagagaaaatgattgaaactcgagatgctttgaattcggaactttctgaatatcacgaaaggatccgtgctttggagacccaaattgaaagtttgaaaagttacaagggccgcggtcataaaaaatga

SEQ ID NO: 46415 - DNA, 1205 bp, Schizosaccharomyces pombe; identical to SEQ ID NO: 46414

SEQ ID NO: 46416 - DNA, 3018 bp, Schizosaccharomyces pombe
atggttgctactgattcttccgatcaagttgcgaaattcgatgtttcgcacaaaatcattgaagatattgtttattctctttccaaccgtatcttttcttacgcggaacacgttcctttgaaccgttatttgactcagtggaacaactctggtcgcagaaacggattttccaacaatgttgaacttttcaatttggaggctcgctctggcgcttccgctttcttgttgggctcttacactgcagcaatctcttctcctggtgtctactccatgatgacaccttccagctgtttatcgcttttgaaccccttgctttctaatattattcctttctatggagctagtaagcctcttgttgttcatgtcgcagctttggcctacctcgaacaaacctattgcgctgataacgtgagtgttttagacttttcttacgccaacaacttcaccgttttcgcttcgcaatctaatgtcgaggctgctcacctcgctttggccagtacattggctgccaaggctgctcctgtcattcatgtgtatgagccggatgccattgtcaccacaactgatcccagccttcctcttctcgattccaacgccgtggttgagtgcttcaactcttaccaatccgaagctgatcctgtctccaacgcttccaaggctttgaagcatgtcaacgattactttaacacttcgtatgctccagccgagtattacggatctcaaaccgcttctaaggttattgtaacttttgggaagtctgaaaccgtcgctgctcgcgcccttttggctgccaatcctgatgtgggcgttctttctatccgtatcttcccttttgttgctgaaaacattttcaatgttcttcccactacttgcaaatctcttgttgttctttcccaggttcgctctaccgctgtcggaacttcttccatctactattccttcctacttgctacactgttgagcactaaaccttcagcgcttgctatttccgagcatcgctactccttagtagagtccgtcaccttgagctctctctttgatgctcttcacgagaccctgcaattgaaagctgctactcccaaagctgttcatgttgataagagcatcaacgtttgggaatctgatgtcggtgattccttggtgctttcgttagtttctgcctatagaaccgataaatcgagatctgttgccttccgtcctttgtttgacaacttgaccttggctggcgtccgttttaccgttgcccaagtttctacggccaacgctgttttaacagatgttgttaaagatgttgatgctgatattactattttaactactgatcgacttcctttacattatcgtgttctcgccaaggctgctgaacattctatttgtttattacagtcctccatcgcaccagatgaagcaactaagaaacttccatacgaatttatcgctgatgctttggagaaaggagtgaaattagtgcttattgatcccaaaaagtttgccatcgatgcctcgaacttgcctttgttggtttcatttattcaactcgtcaagcctggtttaggtgttgacgaggctttggctgttttggctaagcaaaataatttaactgacacgaatttgaaagatgctgttgactcacttaagcaatctctctcgttcattaatttagacgcctcggctttgaaggatcgcgagccctcggagaaggagttgccaagtaccgcgaaggaaacttcgtttgctcccaacgctgtgaagactttagatgaggatatcacccctcaatcttccaactggcagacagtggccaagcagatcatcttccccgaggcttacaaaaagaaggacgcccttcgtcctgacgtttcggagaaggtctttactgttcacgtgagagctaacaaacgtcttacgcccgccgagtataaccgtaatattttccacatcgaattcgaccttggcgacagtgggctcacctatgacattggtgaagctttgggtgtttacggtgttaacaataaaactcacgttcatgatttcattgaggaatacggattagatgctaacgagcttatccacgtcccgtccattcaacatcctggtcattgggaaacacgcacagttttccaagcactttgtcagaacattgacatttttggtaaacccactaaaaaattccatgagcaactgcttgaattcgagactgatgagaaggagcgtgccgatctgcagattttaattagccctgctggagctcctgatttcaagcgtcgtgctgaagtagatatgcttacctatgctgatgtattgaaagagtttaagcatgctaagctgactgctgcacaaatcgcacaaatcgtaccagtcattaagcgtcgtgagtattccatttcttcttctcaaaagaagcacaatgacagtgttcatttgctggttgtcgtggttggttggaaggatggtatgggacgtgatcgctatggccaatgctcgcactatctttccaatttgaaggtgggcgaacctctttgcgttgctgtcaagacttctgtcatgaagttgcccacgtcccccttgaagccaattgtcatggcaggtttgggaactggtttagcaccattccgtgcctttttgcaattcaaagaatggcaacgtatgcagggaatcgaatctggtgacatcttgttatatttgggttcccgtactcaaagagaagagtatctgtatggtgaggattgggaggcttatcattccgccaatctattgacgcatattggacaagctttcagtcgtgatcaaccctacaaaatctatatccaagatgttatgcgatctaccaaagacatgttaaagaaggctcttatggatgaggggggttccttttacttgtgtggtcctacatggcccttgcccgagatcaccagtgttttagaggaagtgatccagagcagttatgatgagccagtcgatgctcgcaagatcattgaacaatggaaggaagagcgtcgttttgtcatcgaagtttac

SEQ ID NO: 46417 - DNA, 2072 bp, Schizosaccharomyces pombe
atggctagtaatcagccaaataacggtgaacaggatgagcaactcgccaagcagacttctaaactgtcgatgtctgcaaaggcacctacgtttacgcctaaagctgctcccttcattccttctttccaacgtacgttttttaattagaacaccatccatatgtcttgagatgattgcttgttttaagtaaaaaaattattaacttcttgctaggccccggatttgtacctgtgaacaatattgctggtggttatccttatgcccaatatacaggccaaggacaaaacagcaactcgccacatcctacgaagagttatcagcaatactaccaaaagccaacaggaaacactgttgatgaagataaaagccgtgtccctgatttttctaaaaagaagagttttgtgcctcctaaaccagcaattcccaaaggaaaggttttgtccctgggtggaaacacctctgctcctaagtctacaaagcccattagcatcagccttggtggaacaaaagctcctacaactaccaaaccagcagcacctgctgcacaaagcaaaacagagacccctgcacccaaggttacctctgagtcaacaaagaaggagaccgctgctcctcctccccaggaaactcctacaaaatctgctgatgctgaactagcaaaaacaccctctgctccagcagcggctcttaagaaagctgctgaggcagctgaacccgccactgtcactgaggatgccaccgatttacaaaatgaggttgatcaagagcttttgaaggatatgtatggaaaggaacatgtcaatattgtttttataggtcatgttgatgcaggaaagtctaccctgggtggtaatattcttttcttgactggtatggttgacaagcgtactatggagaaaatagagagagaagctaaagaagctggtaaagaaagttggtatctttcttgggctttggacagcacttctgaagaacgtgaaaaaggtaaaaccgttgaagttggtcgtgcttactttgaaaccgaacaccgtcgctttagcttgttggatgctccgggtcataaaggttacgttacaaacatgattaatggtgcttctcaagctgatattggtgttttagtcatttcagcgcgtcgtggtgagtttgaagctggttttgagcgcggtggtcaaactcgtgaacatgccgtattggctcgtacacaaggcatcaatcatctagttgtcgttattaataaaatggacgaacctagcgttcagtggtcggaggagcgttataaggaatgtgtcgataagctcagcatgtttttgcgtcgtgtcgctggatacaactcaaagactgatgttaaatatatgcccgtttctgcttacactggtcaaaacgttaaggatcgtgttgacagttcggtttgcccgtggtatcaaggtccatctttgctagaatacttggattctatgactcatttggaacgcaaagtgaatgctccattcatcatgcctattgcctccaagtataaagatttgggtaccatcttagaaggaaagattgaggctggttcgattaagaaaaattcaaacgtattggttatgccaattaatcaaacccttgaagttacagccatatatgatgaagctgatgaagaaatctcttcttctatttgcggtgaccaagttcgtctccgtgtccgtggtgacgattcggatgtccaaactggttatgttttaacatccactaaaaacccagttcatgctactactcgtttcattgcacaaattgcgatccttgagttgccttcaattttgacaactggttattcttgtgtaatgcacattcataccgctgtcgaggaagtttcatttgccaagttgctccataaacttgacaaaacaaaccgcaaaagcaagaaaccccccatgtttgctaccaagggtatgaaaattattgcagagttggaaacacaaactccggtttgtatggaaaggtttgaggactatcagtatatgggccgtttcactttgcgtgatcagggtactacggttgcagttggcaaagtcgtaaaaattttggattag

SEQ ID NO: 46418 - DNA, 711 bp, Schizosaccharomyces pombe
caacaaggagctggaaataaattacgtcctgttaccattaagcaaattctcaatgcctctcaagttcacgctgatgcagaattcaagatagatggcgttgaagtcggacaggttacttttgtaggagttttacggaacattcacgctcaaactacaaacacaacatatcaaatagaagatggaacaggaatgattgaagtaaggcattgggaacacattgatgcgctatctgaacttgctacagacacctatgttcgtgtgtatggaaacatcaaaatattttctggaaaaatttacattgcttctcaatacatccgtacaattaaagaccataatgaagtccattttcatttccttgaagcaattgctgtacacctacatttcactcagaaagcaaatgctgtgaacggagccaacgctccaggctacggaacttccaacgcactaggctacaataacatttcttcaaatggtgctgccaactctctggaacaaaaactagctgaatattcactaacccccgcacaaatgaccgttatgcaagctatccatagtgcaccagagacgaatgaaggtgttcacgttagacaacttgctcaaagcgtgggtcccggtatagaccttacggcggttactgattttcttcaacaagaaggaatcatctacacaacaattgatgaaaatcattttaaaagtgttttacaagaccaa

SEQ ID NO: 46419 - DNA, 1014 bp, Schizosaccharomyces pombe
atgggaaatagtaactcaaaaagtgttaaaaacgacaaagaaaattttgaggatccaaatgccaccaattttgaaagtgtttctcagttcaaaattcgaaatgttattgggaaaggaagctggagtacagtgttcgtcgtgaaacatcgtcaaactaagcaaaggtttgctcttaaatgcatcaataaaaagaaacacgacgagcataagatcaagaagctaagaaatgaggttctattattacaatcattgaaccatcctctactatgcaagttttactctgagtttgaggatgaaacgaaaatttacttagtaactgatttaatgcttggtggagatctccgataccatatttcccaaagaaaattcaatgaatcggtcattcgtatttggatggtagaactagtatctgccttgatttatatacattcaaagggggtgcttcatcgcgatgtaaagccagataatattttgttggatgagaagggacattgcaagttggctgactttaatgttgcagctaaagtgcatacctcatcttctccttctaaatcaaacatgactgttggtcgcgttgggacccctgtatatatggctcctgagacattaattcacgctgtttcttataaagaatcagactggtggtccttaggtataacattttacgaatgcctttttcaagtgcgaccttttcccaatcatcttttgatcaattggattcgagcttcagaggaagaaaaggcttcatcagcagatcgtttatcttctgctcttcatatttctcgggataaaaagctaactactatctcgaaagatgctcgttcagctgttatggcttttctagaaatggacattaagaagaggttgggtcactccagcaagaaacttcaaacacatccatttttttgctctatctctttggagaccgtttccaagggcaacctgactcctattttccgtccgaaatctggaaaagtatatgttgacccaattttagatttggaggctactttt

SEQ ID NO: 46420 - DNA, 3159 bp, Schizosaccharomyces pombe
atgatttataaacttgctgctcggtatccaattcaagtgattgccattgtgggcatccttgtctctatggcatatttttccttcttggaagccttaactcaagaagatttcccagtattaattcgtgctttaaaacgatttggtattttggatggatttccgaacactcgtctacctaacgagatgattttaaagctaagtagtgtccaaggtgaggatgcctcggtttgggaacaaattcctgccgcagagttgggtggagaaggatttgttgattttgatatcacccaatggtattaccctgcgaatgcaaaggtcgatgttgctcaattggtagagccatatcgtaatgactgcattttccatgacgcttccggtgcttgccatttcttttttaaagaggtcggcaattggactgtatctagtattgcattaccatcgaatctcgccaatccgcccatcgattacttccttgacagttctagtactgtcattcaaagaattcttcctgcaattcgtgaacacggcatttcatggtcgtggttacttcagttgatcgctcgcacttggatgaatactttaaagatcgctagccaagcttctaagaccgaactgttaattgttggtactgcttatgcttgcatgttgatatccattgtgtctctttaccttaagatgcgtcgtctaggatccaaattttggctattttttagtgtcctgctttccactttgttctctgttcaattcgcaatgactttggtacgtgcatctggtgtacggattagccttgtctcgttgattgaaagtttgccttttctgataaatgtggttgcccttgataaagctgcagaattaacgcggcaagttatcactcgatgctctgtctctgactcccattctcctatgcatgaagatattgcaaaggcttgccgcaacgctgcaccgcctatcctccgtcatttttcttttggaatagtcgttttggcaattttttcgtattgtaattttggtatcaaacaattctttttgtttgctgctgtcatgatttatgatttactcttactgttctctttctttgtcgccatactcaccctgaaacttgagatgcgccgctataatgctaaggatgatgttcgaaaggttcttatagaagagggtctctctgagtctacggctcgtcatgttgcagacggcaacgattcttcggctactacttctgcagggtcacggtattttaaagttagatatggaaccaaaatcattcttttcatattcattgccttcaatttgtttgaactttgttctattccgttcaaacattatgctgccacttctgctgctgctgctcgattaattcctcttgttcgctctcaatatcccgattttaagtcacaaaggcttttggatgatggagtgtttgacgacgttctttctgctatttcttcaatgtccaacattgaatcaccaagcgtccgtttactaccagctgttttttacggtgccgaattatccagcacttcttttctatctactatccattcgtttattaacaactggtctcactacatcagtgcttcgtttttgtcaaaatggatcgtctgtgctttatctttgagtattgccgtcaacgtttttcttttgaacgctgctcgattgaactccatcaaagaggaacctgagaaaaaggtggttgaaaaagttgttgaagtcgttaagtatattccttcgtcgaatagttcatccattgatgacattcagaaagacgaaatcgctcaagaatccgttgtacgttcgcttgaggaatgtatcactctttacaacaatggtcaaatttcaactttaaatgatgaagaagttgtgcagttaaccttagctaaaaaaatccctctttatgctttagaacgagtacttaaagacgttaccagagctgttgtaattcgccgaacggtcgtctcccgttcatctaggacgaagacacttgaaagctctaattgccccgtctatcattacgattactctagggttttgaatgcatgttgtgaaaacgttataggttacatgcccttgccccttggtgtagctggtcctctcattattgacggtaagcctttttatatccctatggctactactgagggtgcattggttgcttctactatgcgtggatgcaaagctattaacgctggtggtggtgctgttactgtattgactcgtgatcaaatgtcccgtggaccatgtgtggctttcccgaatttgacgcgcgctggtcgtgctaaaatttggttggatagccctgaaggccaagaggttatgaagaaggcttttaactctactagccgttttgctagacttcaacatattaagactgctctagctggtactcgtcttttcatccgtttctgtacgtctaccggtgatgctatgggtatgaatatgatttccaaaggtgttgagcatgcacttgtagtaatgagcaatgacgctggttttgatgacatgcaagtgatcagtgtatcagggaattattgtacagataagaagcctgctgctattaattggattgatggtcgtggtaaaagtgttattgctgaagctattattcctggtgatgctgtcaaatcggtattgaaaactactgttgaagatttggttaaattaaatgttgacaaaaacctcattggtagtgctatggctggcagcgttggaggatttaatgctcatgctgctaacattgtcacggcagtatatttagcaactggtcaagaccctgcccaaaatgttgaaagcagtaattgtataactttgatggataatgttgatggtaaccttcagcttagcgtgtcaatgccatccattgaagttggaacaattggtggtggaacggttttggaaccgcaaggtgctatgcttgacttgctcggtgtgcgaggtgcccatatgacctctcccggtgataattctcgtcaactagcacgtgtcgttgcagccgccgtaatggctggtgaactgtctttgtgttccgcacttgctagtggccatttagttaaatcccatatcggactcaatcgaagtgcgctgaatactcctgctatggactcttctgccaagaaaccagcgactgatgctctaaaatccgttaactctcgagtaccgggacgt

SEQ ID NO: 46421 - DNA, 5511 bp, Schizosaccharomyces pombe
atgcacgattcttcctggacagaagctgatatactcggggtatgcagttttctagacataccaaagacaaaaattgatcctttacttcaggtggacgcgtttacatccatattaatacctttaattagtaaaagcaaagattatgaaagtataaaaaatgatcgtatagttacagaagtcaattacgagcaacaattgcgaaattcggagaagaaactacttcaatcaaacgaacgttacgatttattagaggatgagcgcaagcttttagagaatgaactctctcaaatcaaagaatatcttagggagaaatcctcttcatatgacactgttttgcacgattgcagttctctcaaaagtgtaaatgaggcattaaaacaagctcaggatcaaaatttgaagcaaactgctcaacttcaaaatcttttatcagataaagaaaaggaagttgaaaagaaaatcactatcattaaagatctaaaggatgcccttgccagttctacccatcaagttttggagcttcaacatacacaacaagaaaaagcatctttgcagactaactatgagtttgagttgcaaaaattaacgcagaaaaattcgattttggaaaataataacacctggttaagccgagagcttcagggtgtgaacgacaaattgttatctcttcatcaggaggcctctttggaaaagtctcaactaagttctcaattatctgacgctgttttggaaaaagatgcgctacaacggaaagtgagttctttgtctcaacagtttacagaaagtaatttacgatatcagaatattgtagctgaactctccgaaatgcgaaagcaatatgagttttcgcaagtttcttttgaaaaagagatttcttcacaaaagcaaattagtgagttgtggatggagaaatgtgaggattgctctttacggctcaaagagttgcagaactcaaacggcgagttggaaaagctattggaagctgcacaatcatcttttgaagaacagcttgaatctcataaggaagcagaagcttccttgaaatctcaaatcaattttctagagaaagaggtatcaagtttagagtctcagctaaagttggctaatgagcgtcttcggcattatgatgaaatagaaatctcagatatgagtgaattgaaatactcaaatttactaaataatagtatgaaaggctttaaaggtcagtcctccgtctctgacttgtattccgagcgtttatactataaacagaagtatgagcaaacatgtcaagaggttgaaaggttacaacgtagctataaccatgttatggaagaagcgaatcttcagcatcctttggttaaagaacagtttaagcgatttgctcatatgcaacgggaaattgttgcaatgagtgagcaatatcagaagtcattggaagactgtcagaaagccaagtcccgttacgagcaattagagacactatttaaagataaatgcacagagaataagcattatgagcaagagaccaaagatttagcgcgacaggtgcaagttttacttcatgaactcgatttgtgtgagaacggcatagtgctaggcgtggatagtagaaagaagattaactcctatgttgaaaaatcgctcactgaagatgaaactgatacggatcaaataatttcaagcaggctagttgtatttcgtaatattagagaattgcaacaacaaaatcaaaatctactgtctgcagttcatgaattagctgatcgtatggagaaagacgaaaaacctgatcttgatggagccgagattcaagaagaaacactgataaaagctaacgaaactattgatcaacttactaaaatgttggaggaggtgagcgatcagttacgctactctttaaaggaacgagacttttttagatcactagttcaagagaatgaaaaacttttagatatggcgcctgcaactcctaattccaaattgaatactaatttaattgagcagacttcttaccagcgttcgcttattcgacttgaacagctaactaatgaactggagtcccttaagtcaatttctcgtaacaaagaaaaaaagtttgaggaagctatctcatctctccagctcgaaaaatctaatattcaattgcaacttacctctttaacatctgaacgaagcttagcccttgaaaagctaaatgatctggaaaaatcacttgttttatctgaaagaagtaaagatgaacttgatgaaagctataagtctttacaagagcaacttgcttctaagaaaattgaagttcaaaatgtttcttctcaattatcaatctgtaatagccagcttgaacaatccaatcatattgttgataatttaaaaagcgaaaacctgcttttaacttccgtcaaggataagttgaaagccgatttatctaatttggagtcgaaactttcgtccctgcagcaggataatttccatatgaaagctcaaattgaatcttcaaatcaagagtatacggcaacagtggactcaatgaatagtcgaatacttgaactttctaatgatcttcgagttgctaattcaaagctatctgagtgttccgatgatgttcgtagacttactctacaaaattcatttgatttgagggagcatcaaacattggtgcttcaacttcagtctaacatcactgagttaaaacaagacataacattgcaacgcaccgtgcgaaatcagttagaaatacaaaccactgagttgaaagagcgcttaaagtttatggaagaacggcaggagaacttgcaatctaaattaatcgcggctaataaagacacgacacaaaatcctgataatgttgaagtcgaggctatatctattgaactggaaaggacgaaggaaaaacttcgcatggccgagcttgaaaagagtaatattcaacaaaaatacctcgcttcagaaaaaaccttggaaatgatgaatgaaacccatgagcagtttaagcatctagtagaatctgaaattagcacaagggaagagaaaattacgtcccttcgctctgagttgttggatcttaataagagagttgaagtactaaaagaagagaaagagtcttcgtccaaggaacttgccaaacaacttgaggatgctgttcgtgaaaaggatagtgcactttctttcaaaaaagattatgaaaaaattcgttcagatgcggatcgtgttattacctctttgaaagaagatattgaaaaagaaagatctctaatgaaggagtgtcattctaattacgaatcagagatcgttagtcatgggcgtaccactcaaaaattgcgggatttacgtactgaatttgacgaggtgaatacgaaatatttaaagctcaaagcaaattttgaacagcagcactcaggactttcaggtgctgaaaaggattggaatattcagcggaaagccatggaagatgaaattagctccttgaaagattacattttgggacttgaaaatcaaaataaactactacattcgcaatttgattctcttagtcaacaaataactgttcttcaacagaattcttctgaaaatttaaatatatctgccaatttagaagccgttcaagataacgatttacgtgaacttgttagctacttgaggcacgaaaaggaaataatggataataaatatgagttaacaattctggataatagaggtttgaatcaacaagtcaagtctttgcaatccaccgttgattcattgcaactcgagctcaaccgtctgcagtctctgcctgtgtcaaatgaccaaacagatacccccattatcagcggaagtcaagaagttcagttactttatgaaagtaatagtgtccttagaaaggacaatgatgctaaacttggaaaaatacaagagctggagaaagaggttgaaaaactgaatgcttcattgaatcccttacaaactgaaataaatgaacttaaggcagaaataggcgcaaagacagcaagtctgaacttaatgaaggaatacaattctcgatggaaattaagatttcagtccgttttgaacaagtatgagcgtgttgatcccacacagttagaggagttaaagaaaaattgtgaagcattagaaaaagaaaaacaagagttggaaacgaaacttcaggagacagcaaaagaaaccgatacatttaagcaacaggttaattctctaaacgaagaggtggaaaatttgaagaaggaagttgagcaggcaaacaccaaaaatactagattggcagctgcttggaatgaaaaatgtgaaaatttgaaaaaatccagcttaacaagatttgcccatctaaagcaggaattgaccaacaaaaacaaggagttaacctctaagaatgctgaaaatgaagcaatgcaaaaagaaatagagtctctaaaggattccaatcatcaattacaagaatcggcttccagtgatgctgaacagatcacgaaggaacaatttgaacaactcaagtcggagaaggaaagaactgaaaaagagctagcagattctaagaacgagctagaacacttgcaatctgaggctgtcgatgctgacggtaaaactgaaatttcaaatcttgaaaaagaaattcatgaattacggtctgacaaagaaggacttgtgcaacaagtacaaaacttgagtgcggaattggcagctttacgagagcattcaccgacccaaggaagtttagagaatgctgatgagattgcaaggctacgttcacaacttgaatctacgaaacaatattatgaaaaagaaaaggaaaccgaaattttggctgctcgctctgaactcgtcgcagagaaagaaaagacaaaggaagagttagaaaatcaactcaacgaaaagtcacagagaataaaggaacttgaggaacaagctcaaaaaaattcttcggaaaatactcatgacaatattgatgacatgattaagcagcaggttgaagaaaagcttaaagaaaattctgccaactttgatgttaagttgaagaaggtggtagctgagacagaatttcggagcaaagctaaaatatctgtgtatgagaagaaaactagggatcttcagaacaaaattacacaacttgaagaaactattgagaatttgaataaacagctatccaatcctgaaaagactgatgaatctacgtcttctgtaacagaaacaaagcctgttacttccaaaccaacagctagcaaagctgatgttggtcagaatgctacagaagcttcgtcagccaagagagaaccttccggtaaatctctgagtgcaagacttcaaggaacaggcaaacaaaaaggtgttcaacgacccgctgtttcgcgtcctgttcctatgaaaccagacagtggaaaactctcaataactggagcttccaaacgaattgctacttcaaagaatgctgcccaaaacgctaaagaactgtcaagcactgctaaatccggctcccttaaaagacaacgtgacgatgcgaacaaaggaggatccagttcgaaccaaaagaaagcaaaa

SEQ ID NO: 46422 - DNA, 1050 bp, Schizosaccharomyces pombe
atgactattcctgacaagcagttggctgccgttttccacacccacggtggtcccgagaacgtcaagttcgaggaagtccccgtcgccgagcccggtcaagacgaggtcttggttaacatcaagtacaccggtgtctgccacaccgatttacacgctcttcaaggtgactggcctcttcccgccaagatgcctttgatcggtggtcacgaaggtgctggtgtcgtcgtcaaggtcggtgccggtgtcactcgtcttaagattggtgaccgtgttggtgtcaagtggatgaactcttcttgcggtaactgcgagtactgtatgaaggctgaggagaccatctgccctcacattcaactttccggttacaccgttgacggtactttccaacactactgcattgccaatgccacccatgctaccatcatccccgagtccgttcccctcgaggttgctgctcccatcatgtgcgctggtatcacttgctatcgtgccttgaaggaatccaaggtcggccctggtgagtggatctgcattcccggtgccggtggtggtcttggccatcttgccgtccaatacgccaaggctatggctatgcgtgttgttgccattgatactggtgatgacaaggctgagctcgtcaagtcctttggtgctgaggtcttccttgacttcaagaaggaagccgacatgattgaggctgtcaaggctgccaccaacggtggtgcccacggtaccttggtcttatccacctcccccaagtcttacgagcaagctgctggctttgcccgtcccggttccaccatggtcactgtttccatgcctgccggtgccaagctcggtgctgatatcttctggttgaccgttaagatgcttaagatctgcggttctcacgtcggtaaccgtattgactctatcgaggctcttgaatacgtttcccgtggtctcgtcaagccttactacaaggtccaacccttctctactcttcccgacgtctaccgtctcatgcatgagaacaagattgccggccgtatcgtcttggacctttccaag

SEQ ID NO: 46423 - DNA, 1023 bp, Schizosaccharomyces pombe
atgtcttttcaaatattacctatcccaatgtgggtaggaactcaagataattatgcatatcttttgttgtgcgaggaaactcgacaagcagcgattgttgatccagccgaagtaaatgtgtaagtattaattatcgaaagctattcatgagaaacggaagaatttttatcacttgacactggtgttatatagccaagaagacatgacaggcatggctcccagagaaagtgtttaagtttgactgaataatccaaagcttggaattgatcttttttattcaattctatgctgacaaagctccagggtaatgccaattttgaagaaaaagttgaagaacaaggagattgatttgcaagccatcctcacaactcatcaccatgcagaccattctggagggaatttgaatcttaaaaaagaattccctcatgttacaatttatggaggctctgatcaaaatggtgtttctcatgtgttgcaggataaagaaacattgcgaattggaaacgttcagattgaagctctccatacgccttgccatacacgtgatagcatttgcttttatgcgcacagctcaaatgaacatgctgtattcactggggatacattgtttaacgcaggatgtggacgcttttttgaaggaacggctgctgaaatgcatattgcattgaacgcagtactatcatctttacccaataatacggtcatctatgtaagcgattcatttttatttttttttatttttttttattttttttttcctaacaagtttcctagcctggacacgaatatacaaaatcgaatgtgaaattcgcctcaaaacatcttcaatcagaggcattaaatcatttggagggtctttgcaatcacaaccaatttattgcaggccacataacgatggggcaggagaaacaatttaatccatttatgagggtaactgatccagaactgcaaaagcatctgggtcttaacgatcctatcaaggtgatggatgaactacgcacgttgaagaaccaaggatagatt

SEQ ID NO: 46424 - DNA, 1179 bp, Schizosaccharomyces pombe
atgcaacagtcacccaccgcaggcaaggtaagttaaataaaaacagagtcttgcttattaaaacagatcattaactgtaaagctgctgtagcatggcaaccagcagctccactgtcgattgaaaatgttcaggtatttcccccacgagtgcacgaagtaagaatcaaaatcgtaaattcaggagtctgtcacactgatgcctacacactctctggaaaagatcctgaaggtcttttcccagtaattcttggtcatgaaggtgctggcattgttgaatccgttggtcctcaagttacgacagtccaagtaggagatccagtgatcgccttgtatacaccagaatgtaagacgtgtaaattttgcaagtccggcaagacgaacctttgtggacgcattcgcactactcaaggaaaaggtttaatgccggacggaaccagccgcttctcctgtaatggaaataccttgttgcatttcatgggatgctcgacatttagtgaatataccgttgtagcagacatatcagtggtagcaattgaacgattggcacccttagatagcgtctgtcttctcggttgtggtatcaccactggctatggagccgcgacgatcactgctgatattaaggagggtgactcagtagctgtttttggtttgggaagtgttgggctagctgttatacaaggagcagttaaaaaacgtgcgggccggatttttggcatagatgttaatcccgaaaaaaaaaattgggcgatgagttttggagccactgatttcattaaccctaatgatctccaaagtccaattcaagatgtactaatacatgaaacagatggtggattagactggacctttgattgtacaggtaatgtgcacgtaatgcgatccgctttagaagcatgccataaaggttggggacaatccattgttatcggtgtagcagctgccggacaagaaatttccaccaggccgttccaacttgttactggtcgagtatggagaggatgtgcatttggaggtgtgaaaggacgaagtcagcttcccgatttggtgaaagagtacctagatcacaaattggaaattgataaatatatcacacatcgtcgacctctcaaagaaatcaatgaagcattcactgacatgcataacggcaattgcattaaaacagttttatcgattcct

SEQ ID NO: 46425 - DNA, 1563 bp, Schizosaccharomyces pombe
atgagtagcattaaaagtaaaacgatcatcgaaccctctgaaaatgacatagagaaaggagaggtcgacttcgtaagctcttcaatctctaactttgaagaagcatacgaggaaggcccttctctaaaacgagagtttaagtcgcgacatgtaaacatgatttctgtagctggtgccatcggcactggcttggttattggctcaggctcggcattgctgaaaggcggaccaggaagccttttcattgcatatttaatgaccggaataaatttgtatgtcgtacttatttctttaggagaaatggctgccttttcttcagatgacaaaggtttcagtggcttttcaagccgttatgtggacaaagctttaggatttgcaacaggatggaattatttcttcaaatacgctatcgtctacccgacaaatttaacggcagttggtattgtgatacattactggcgaccagatcttaacgtaggtatttgggtagccgtttttctagtggtgattttagcaataaacttattgcatgttaaatattttggcgaagttgaattttggctgtcagcagtgaaaattttagttttggtgactttaattattacttgtattgtgattacctctggaggaacacctgtgcatcacaaaattggattccattactggcgagatccaggtgctttcgcaccttacttagtagaggggtctactggaaggtttttggggttttgggcttgtctagttcagtcatgtttcgcttatgttggatctgaggttgtaggcattgcatttggggaggcaccgaatccagaaaaaactatccgaaaatcttcatttcaatctttgtttcgtattgcaaccttctatgttattggtgtgtttgtattaggactctgtgtcccatacgatagcgatattttgtcaagcaatgcttcaaaaggtaatgccgctgcatccccctttgtagtagctatcaaactggctcaaataaaagttatgcctgatgttatcaatgcctgtcttcttgtgtttattattagttccgccaattctgatatttatattggatccaggactttgtatgctttagcaaaagaaggatatgcccccaaaattctgatgcttcaaacaaagcagggaataccatgggttggatgcttagtaacgtcttcctttggccttcttgcgtttatgaacactaaaagctcttctgcaacgatctttggatatttcagtagcgcagttactgtattcggtaccatcaactggataaacatccttttatcttacatatgctatcacagagcaaccattgttcaacaaattcccacagaacgtattccttttcgtagctggggtcaaccatatatagcttatgcttcattaatattcactggtttgattacgttttttaacggatacaatgctttcattcacggatttaagtatagatcatttattacttcttatataggcattgctgcctatgtgattatgattttaggatggaagttcacattcaaggcgaagcgcgtaacatcatctactgttgattttagaaag

SEQ ID NO: 46426 - DNA, 1217 bp, Schizosaccharomyces pombe
atgggcatacccaaatcatcaatttatttttgtatactattattctgcattatttcattctatttacagtcttctaaagatgggcctaaggaactaaaagtcaagtatgtatttctaaaaaaagccacagcaaagcaaagaggagagtcatccttgacagattcagattattttcctaagcagcccaatatgaacgctactttgtttatgctttgccgtaatagagacattaaggacgctcttgtttccatacaaagcgtcgaggatcggttcaatcatcgctatcattacccatggacatttatgaatgatgccccttttactaaagaatttataacagctacttcaaaaatggtgagtggggatgctacctatgtccaactcaacaacgaagagtggggaattcctataaacatcgatttaaatcgtatgttgaaatcaattcgggatatgaccgatgacaaagtaatatatggattttcactgagttatcggatcatgtgtcgcttcaattcaggatttttttatcgaaacaaagccctttcacattatgattattactggcgcgttgaacccggcgttgaatattcttgcgatataccttagtaagtgcacaagaaaaattgactatttaactcttgtttttgtaatatgatagaattttgtcactaaccaattctttaagtgatccttttcgaaagttgagtgacgagaataaggcgtatgggtttgtcatatcaatgacggattattatgaaaccctcccttctttatggaacgttactcgagattttattcaccaaaacccacaatatcttgcacaaaataactccttggattttatcgttaatgaccaccaggggttaagtggtgactacaatctctgccatttttggagtaattttgaaattgccaatttaaatttctttcgaagtcctgcatacacagactactttgcgcacttagataaaaattatggatttttttacgagcgctggggggatgctcccgtacattcactggcagcatcgctatttctgaacaaatcgcaaatacattactttgaggactttggttattaccatttaccctggtaccattgccctacggatgtacagtcgcatgcgacagctagatgtctatgcgatccgactggtacgattgattatttacccttctcttgtgctattaaatggttagaaaacatcaatagttaa

SEQ ID NO: 46427 - DNA, 1257 bp, Schizosaccharomyces pombe
gtttagcttacccacaaagatccaactcctgatacaaccagttgcaatattatcaagaaggaaggggcgaatattatatcagtttatgcacgctatccagtcgtagctgctaaaggtgagggctcctatttgtttgacaaggaaggtcgtaaatacattgacttcacctctggcgtagctgttacatctttgggtcatgctcatcctgaagttgctagacttgccgctgatcaatgctccaaattagtccatagtagcaaccttttctacaacgagcctgccattgagctatctaatgtcattaataattctttggcaaaaaatagcggtattgctggccccacaaaaattttctttgccaattgtggtactgaggccaatgagacagccttgaagttcgctcgtaaggcagcgtttgagaagtatggagaagggaagagtcaaattgtttactttaataactctttccacggccgttctttgggatctcttagtatcactgcgaaccccaaatataaacgtggtttccaaccattacttcctgatgtcgtccaagccgtctataatgaccctgcatccatagagcaatttgtcaatgacaaaactgcggctgttattgtcgagcccgttcaaggtgaaggtggtatttgtcctgccaagcctgaatttttgattgctttgcgcaaggcctgtgataaggttggtgcttctttaatctatgatgaaattcaatgcggacttggtcgcagcggtgatctttgggcccatagtatcgttaaggatgtcgctagtcccgatattatcacagttgccaaacctttggctaatggtctacctatcggcgccaccattgtctccagtaagatcgctgctgaaattcaccctggtgaacatggcagtactttcggaggtaatcctgttgcttgccgtgtaggcacattctgtgttaatgaattagggtcatccaagattctacaaaacgttagaaagcaacacaaggctcttacttcacgttttgatgactttgttgccaaataccctaatcttattcgtggatatgctggtcgtggtcttcttcttggtttgcaatttaccgagccccctgctaaatttattgagcttgctcgtcaacaaggtcttttactcttaccaggtggaaacaacaacacccgtgtccttcctagtttgaatgttaaagatgaggttattgctaagggtttggatatcatggagagcactttgaaggctttaagtaag

SEQ ID NO: 46428 - DNA, 1539 bp, Schizosaccharomyces pombe
atgagtgacgatagatttgcagaagatgaaattatacagcaaagacggaaacggaggttggaaattttaaagaagtaccaacagactggcaatggccattcggatttgtcaattccagagaaaaagctaaaagaagatgtcgaccaagtctctacaacgaaacctatcgaagctgtaccaaaaatgaaaaccaatgcatctaaaattgagattaacaaagaaggttctaattctaatactaagcttgatgtaactaatagtactactagtgattccccctctatcaaatcttctgtacaaattgaagatactgaagatgacatgtttgcagattctccttcgccttctgttaagcggcaaaacactgggaaaggtatttccactctaactaggagttttgcagatatgcaggataattgggacgatattgaaggttattataaggtagttcttatggaggaattggattctcgttacatcgttcagtccaaccttggtaaaggcatgttctctacggtggtcagtgctttggatcggaatagaaatcaaactttcgctataaaaataattagaaacaatgaggtaatgtataaggagggactcaaagaagtatcaattcttgagcgactgcaagcagcggatcgtgaaggtaagcagcacataatccactatgaaaggcatttcatgcacaaaaatcatctttgcatggtgtttgagatgttaagtcttaatcttcgggacattttgaaaaaatttgggcgtaacgttgggttgagtataaaggctgttcgtctgtatgcctatcaaatgttcatggcattggatttgttgaagcaatgcaacgtaattcattcagatatcaaaccggacaatatgctggtgaacgaaaaaagaaatattttaaaaatatgtgaccttggttctgcttcagatgcctctgaaaatgaaataacaccgtacctcgtgagtcgattttatcgtgctccagaaatcagtaagtctaaataaacgccaaattgcttataattccaaaaatatggaaattgaattcttcttctcattacttttgtactcttttttcaagatctaacctttaaaatagttttaggctttccttattcgtgtccaatagatacatggagtgttggatgttctttatatgagttgtatactggtcaaatactatttcctggccgaacaaataaccagatgcttcgctatatgatggaatgtaaggggaagttcagtcataaaatgttaaaaagaagtcaatttttaaatgaccatttcgacgcggatttcaatttcatacaaattgatcatgaccccattacaaatcaagaaacgaggaaacctgtaaaattctctaagccgaccaaagacattcgatctcgtttaaaagaagtcccaacttcaactgatgaggaatttataattcgacaagagcttatggatcttttggaaaaatgtttggagcttaatccagagaaacgcgtaccgcctgaagtagctttgaagcatcctttctttataaaaaaa

SEQ ID NO: 46429 - DNA, 1593 bp, Schizosaccharomyces pombe
atgttttggagattgggccagggatttggatttcaaagctcaagcgccattgaggcgattttggataaaccggaagatgagattaatttaaaggagttgttagaagagaatggggttttggacgaatgtaaaagccacaaccccaaacttttagaatacctttgcaagccggaagtacttagccagctgattgattatattttggaggttgacgaaacagagataccttctgccgatggtggttatgaagagccggaacataccagactttcctacatagcgagtgaaatcctcagtagcgacgtttggtccatctgtgaggcttgtgtggaaaataagacattgatggtgaaactttggtcctttttggatagcgagggcccattaaacccattgcaagcatcatactttgcaaaggtcaatgaacattttctggataaaaaaaccgaagaaacggttgcctttatccaatctattgataactttgtagaaaagatcctccgtcatgcggaaacaagcgcaatcatggatctgttgctcaaattcatttcaatggatcgttgcaatactgctattggaattgctgactggttgtattcgcagggattaatacaatccttactgcgtctacttagcccatatgtggatcccgacgtccagtttactgttgctgatgttataaaagcaattatcgctatttctgccaattctaatgaacccggagttattggacctaactccctttcacgagaactagtatccagacaaacaataactacactaactgattacatgaccgattctaaagctcctcactctgccacttctcttattaatggcgtcagcatcgtaatagaactaattcgtaagaacaacagtgactacgatgttacacccgttttgcaaatgcctcttgacacgcatcctcctactacccgtgatcctatttaccttgggaccatgttgcgtcttttcgccgaaaaaattcctgtctttcaaaaaatcctccttaaaccttccaccgagtccgacctcatgcccaccagttttggtaagatcaagcctttaggttttgaacgtttccgaatttgtgaactttacgccgagttgcttcattgtagtaatatgtcccttcttagcgatcctaatggtgaagccatggtaatgcagcgtgaccatcttcgtgattatcttttccgccataatagctgtgcacgtgatcttgtcatgagcgacgaggacgatgatgattctactttttccgataaaaattctaaagattttaaggaaactgaagacatgaacggggctgaagatatgcacggtcgtgctccgcaaatcactaaggataaccttaatttgactactactgattccccaatgtccgaggctgaacccgttagtgaagaagaatacaaggacgttatggaaaccgctaaagcactacaccatggggacgatgatgcggcttctgatacttcttacgaaccccttccggaaagtgttattgaggatgctaaaaagctccctgttattggcgattttctaaagattgaatttattcaaaataatgtaattccgactattcttgat

SEQ ID NO: 46430 - DNA, 4086 bp, Schizosaccharomyces pombe
atgtctttgcatagtaaaaaatccacttctacggttaaggataacgaacattctttggacctttctatcaaaagcataccttcaaatgaaaaaaacttttcaacagagaaaagcgagaatgaggcttctgaaagccacgtggtagatgttgtcaaagatccttttgaacagtatactcctgaagaacaagaaatcctttacaaacaaattaatgacacacctgccaaactttctggataccctagaatcctttcatacgccgataaatgggatattatgctgcaattggcaggcaccattactggtattggtgccggcctgggtatgccattgatgtcccttgtatccggtcagctggctcaagcttttaccgaccttgcctctggcaaaggagcgtcatctttccaacacactgtagatcacttttgtctttattttatttacatcgcaattggtgtctttggctgttcatatatttacactgtaacctttattattgcaggagagcggattgcccgtcgtattcgacaagattatttgcatgccattctttcccaaaatatcggttatttcgatcgtctaggtgccggtgaaattaccactcgaattactactgatacaaactttattcaagatggtttaggtgagaaggtcggattggtgttctttgcaatagcaacctttgtatctggttttgttatcgcttttattcgtcattggaagttcacattgatattgagttcaatgtttccagccatttgtggtggtatcggcttgggtgttccctttattaccaaaaacaccaaaggtcaaatcgccgtcgttgccgaatccagtacatttgtggaagaagtgttttccaatatcagaaatgcttttgcttttggtacccaagatattcttgcaaaattgtacaataagtacttaataactgcacaacgcttcggtatcaataaggcaattgcaatgggtttaatggttggatggatgttctttgttgcgtatggtgtttacggtcttgcattttgggaaggtggacgcctcctacatgcaggtgatttagatgttagcaaattaattggctgctttttcgccgtccttattgcttcctatagtttggccaacatttctcctaagatgcagtcatttgttagttgtgcctcagccgctaaaaagattttcgacacaattgatcgtgttagtccaattaatgcttttacacctactggtgatgtagtcaaagatattaaaggggagatcgaattgaaaaatattcgatttgtttatcctactcgtcctgaagttttagtgctggataacttttctttggtatgcccttctggtaaaattactgctttagtaggtgccagtggtagcggcaaatccacgatcattggacttgttgagcgattttacgaccccattggtgggcaggttttcttagatggtaaagaccttagaacgctgaacgttgcttcgctgagaaatcaaatatctttggtacaacaagaaccggttctgtttgctacaactgtgtttgaaaatataacttatggcctgcctgatacaattaaaggtaccttgtctaaggaagaattggaaagaagagtttatgatgccgctaagcttgccaacgcttacgactttattatgacattacccgagcaattttcaactaatgttggacaacgcggtttccttatgtcaggaggacaaaaacaaagaattgcaatcgctagggccgttattagtgatcccaagatcttattgttggacgaagccacaagtgctttagactctaagagtgaagtgcttgttcagaaagctctagataatgcatcgagatctcgtaccactatcgttattgctcatcgtctttctacaattcgtaacgctgataatattgtcgtagtgaatgcaggaaaaattgttgaacagggctcccacaatgaattgttagatctgaatggtgcttatgctagactagtagaagctcaaaagctatcaggtggagaaaaagaccaggaaatggtcgaggaagaactggaggatgctccgagggaaatacccataacgtcttttggtgacgatgatgaagataatgatatggctagcctcgaggcccctatgatgtcccataatacggatactgatacgttgaataataaactcaacgagaaagataatgtcgtgtttgaagacaaaacccttcagcatgtagcttccgaaattgttccaaacctacctcctgcagatgtcggtgaacttaatgaggagcctaaaaagtccaaaaagtcaaagaaaaacaaccatgagattaattcgttaacagcgttatggttcattcattcttttgtacggacaatgatagagattatttgtctattaattggtattttggcttctatgatttgtggtgcagcttaccctgttcaggcagctgtttttgcaagatttctcaatatcttcactgatctctcatccacagactttttacacaaagtaaacgtgtttgctgtttattggcttattctagctattgttcaattcttcgcttatgcaatttccaattttgcaatgacttatgcaatggaagcagttttgcaaagaattcgttatcatctatttcgaacattgcttcgtcaagatgttgagtttttcgaccgtagtgagaacacagttggtgctattactacttctttatcaacgaaaattcagtctttggagggattgagcggcccgactttaggaacctttttccaaattttgaccaatatcatttcagttacgattttatctttggctacaggatggaagttgggtttggtgaccctttcgacctcccctgttatcattactgctggttattaccgtgtacgtgctcttgatcaagtccaagagaagttgtctgctgcctacaaagagtcagctgcgttcgcatgcgagtcaacttcagccattcgtacagtcgctagtcttaatcgcgaagaaaacgtttttgctgagtattgtgattctctcatcaaacctggccgtgagtcggcaatcgcatcattgaaatctggtttattcttttctgctgctcaaggtgttacctttttgattaacgcattgacattttggtatggttctaccttaatgcgcaagggcgaatataacatcgttcagttttatacttgttttattgcaattgtctttggtatacaacaagctggtcaattctttggttactcagcagatgtaacaaaagcaaaggctgctgccggtgaaattaagtatttgtccgaatcaaaacctaaaattgatacatggtcgacggaaggaaagaaagttgaatcccttcaaagtgcagcaattgaattcaggcaagttgaatttagttaccctaccagaaggcatattaaagttcttcgtggtttgaacctcactgtgaagcccgggcagtttgtcgcattcgtaggatcttctggctgtggtaaatctacgaccattgggcttatcgagcgtttctacgattgcgacaatggagctgtattggtggacggtgttaatgttcgtgactataacattaacgactaccgcaaacaaattgcccttgtctctcaagagccaacgttgtaccaaggtactgttcgtgagaacattgttttgggcgcatctaaagatgtctctgaagaagagatgattgaagcttgcaagaaggccaatattcatgagtttattcttggattgcccaacggttataacacactttgcggtcaaaagggctcttccttatctggtggtcaaaaacagcgtattgccattgctagagcattaattagaaatccaaagattctccttttagatgaagcaaccagtgctttagacagtcatagcgaaaaggtcgttcaagaagctttaaatgccgcctctcaaggtagaaccacggtagcaattgctcatcgtttgtcttctatccaagatgcagactgtattttcgtatttgatggtggtgttatcgctgaagctggtactcatgccgagcttgttaaacagcgcggtcgttactatgaacttgtggttgaacagggattgaacaaagca

SEQ ID NO: 46431 - DNA, 1966 bp, Schizosaccharomyces pombe
atggacctactgggccttaaagaattagacaataacaaactagtatcaaaggcaaaagaaaatggagtcgaattttctgatttatttttactatcaagcggctatttacgagacagggaaaatgcgtcagcaagtgtgtcttcgaaaaatgaacgcatggtgctcaacgaagaaagacaaaattgctggacgaaaagaaatgatcctaaaggtttaacttactaccaattactaaagcccagtgaagttgaaatacttagtcgacccgagacaagaagaaagcggatggcctgtcaagttttcttcctcaattactatattagcacaattgagtaccataaactaaggaaggaaagattggaagaatttacagcgtgtacatcgtcattaaaacaatctaaacagaagcgactatggaaagagcattgtggaagggaaagagcatttttgagaaaaaaaagaaccaagattcaatgtagccatttcgatttattagtaaagcttggacaaggaggatatggttctgtgtggcttgctaaaaagcgcaacacacacgaattgttagcaatgaaaatgatgaaaaaatcaacattacagcaacttaatgaagtaagaagacactattaaagatcttaaaagaaaactaacaacggctcaggtgaaacacatattgaatgaaagagatatactaacgaatactaattccgaatggcttgtaaaactgtattatgcctttcaagataaggaaaaagtatatctagcaatggaatacgtccctggaggagattttcgaacttttttgactaccaaggggcttttgcatgaaaatcaaacccgattttacctagcagaaatggtcgctgcaatcagtgcagtccacaaactaggttatatgcatcgtgatttaaagcccgagaactttttaattgatcaaaagggacatatcaagcttagtgactttgggctaagtactgcaattgttacatcgaatcaggtaaatcgacttcaacatgcactagtgagcgcggttaatcctcagagaccttatttaacacaaaagcaaagaagaaacatttataaagcgcttttggaaaagaatgagaacaaggtaaagacattttgattcaaacgtaaactaaaaaaaaattaggtaaattccgttgttggatctcctgaatacatggctccagaagttgtttacggaaagaaatacgataggaccgtagactactggtcacttggctgcatatgttatgaatgtctggtaggatatcctcccttttctgggtcaacgctccaagaaacgtggactaatctatactactggcgagaaatgttgcagagaccctccaaaaatgaaaatggaatttacgacaaaaaagcgagatcggtttcagacgaggcatggtctttcatcaccaagtgtctaacagaaccaacgtcaagatttcaaagcacaatcgaaatccaaaagcatccattttttaagagactccattggaacggtttgcggaaaagagctgtgccaccatttgttccccgcttggagaatcaacttgatacttcctattttgatgatttcaatgacgaacaggtactagatgcgtacaaagatgtgtacgaaaagcaaaggaaggcagagcaaaaagcaaaaagcaatggagttatgaacggtaatcaaagacaatttcttggtttcaccttcaagtatcgacccaacgcaagaaagccactggtgggtcggcatcgtgaaaagcgacaacttcgcaaagagaaaccggagaagaaaaataatagcactaaacaaaaggatttaatcaccgttagtcataacaaaggcaccactgctattgaggacctggatgaggacaagcgatcaaaaacaaagggtcacaaaactaagtcatcaagagtccatcggcttctggaaagaaaaggcaaagacctgtatgaatttttgctctaa

SEQ ID NO: 46432 - DNA, 1524 bp, Schizosaccharomyces pombe
atgtcaagcatcagtatagacgaaaagctgaaagatcccgagagtgtccaaaataaggaaattctcgatgtcgacgttggcgatctctcgccaaaaggcgtggatgctgctttcaattacgcccttgatgtcgactacgatgagatcgatccagaaacggagcgtagattggtacgcaaaatcgattgcacaatcttccccgtcatgtgtctagtatactgcatccaatttttggacaaaacttcaaattcctatgccgttatcatgggtctcaaagaagacttgaagatggaaggtcaaatgtatagttggtcaggtactgctttctacttgggttaccttgtcttcgaattccctgcatctcttcttcttcagcgctttcctttatccaagaccttgtgtgttttcttagtcatttggggtttcttgctttgcatgacctcagttgccaactatcctggctttatcgctcttcgtgtgcttctcggtatgatggaatctgccgccagtcctggtttcattcttctcactgctcaatggtacaagcgcagtgaacaacaacttcgtacttccgtatgggtcgcttttaatggtttgggtcagatccttggtagctgcatggcttatggtttggccaagaggaccagtcttcccatgagaggttggaagcttattttcattatttgcggtgtcctcgccattttcttgggatttgtcattcttgccgtcgttcccgacaatcctttcaaagcctggtttctcactgaagaagatcgtaagttggttgtcaagcgtcttcgtgccaacaagcaaggtgttggtaataatcactttaaattgtatcagtttaaggaaaccatgcttgatattcgtacttggattatgtttgtctcatccgttcttttgaatattcccaatggtggtatcggtacattttcctctcttttaattaaaggtaccatgggttatgatacccttcaaaccttgcttatgggtcttcctgccggcgcttgtgaatttggtggattgatcgcctttgggtttttgagtttgttcattcataaacgtatggttttggctaccatcaccacatgtattgccttgattggatcctgtttgctttctttcgctggtcctcctcgtgcacagcttgcaggttactatttattgatggtttctccaggtgccatgattgtcatgttcgccatcatttcttccaacgcctctggttatacaaagaaagtcactgttggtgttatctatcttatcggatactgtgtgggaaatttaatcggccctcaaactttcaaagctgctgacgctcctgaatatatgcctgctaagaacaccatggtcggttgttatgcagcaactttagtcacatttcctgctctttactatgttaattggagagaaaacaagcgtagggatcaattggctgcggagggaaagattgagcatcgtcccaatgctgaatttgaagatcttacagattttgagaatcttgatttcagatacacttta

SEQ ID NO: 46433 - DNA, 1305 bp, Schizosaccharomyces pombe
atggtttctgagatatcggacctcagtttagccaaggagaagtcggaggctcaattcattgcgagaaatccgaaatccaatgatttccattgcaaggcttgtgattctttgccaggcggaaacactagaactgttcttcatggagctcctttccctattttcattgaagctggatatgggtcgaaacttcgagatgtggatggacatgagtatacggattttcttaatgagctaactgctggtatttacggccattctaatcctgtgataaaaaaagcgcttatgcagggattcgacgaaattggaatttcgttgggaggaactactacttgcgagctaaactacgcagaagcgttgaaaagtcgctttctcagcattgagaaaataagattctgcaactctggaacagaagccaatatcactgctataattgctgctaggaaattcactggaaaaagggctgtaatcgcaatgcatggaggttatcatggcggtccattgagctttgcgcatggtatttcaccatacaatatggatagtcaagatttcattctctgtgaatacaacaatagcacacaatttaaggaattggtgaactcttctcaagacattgcagctgtaattgtagaagcgatgcaaggagcgggtggtgcaattccagccgacaaagaatttatgcagacgattcagctagagtgtgagaaaaatgacattgtatttatattggatgaggttatgacctcaagacttagccccggcggtttacagcaaatttattgtttgaagcctgatttgactacgctgggcaaatacttgggtggtggccttccttttggtgcatttggtggacgcgccgatattatgagttgtttcgatcctcgattaccaggttctttatctcattctggtacttttaacaacgacacccttacattgacagctggatacgttggattgactgaattatatacacccgaagcagtaaaaagactcaatgcgttaggggatgggctccgcaaggatattgagtcttattgccataataccaagatgtctattacaggcttaggatctattatgaacattcatttcactgaatctggtcgcgtaaattcttacaatgatacggctggtgaggttattgaacttaaagatcttttgtggatggatttattaaaggaaggtttttggattgctcgccgggggatgattacactttcacttgtccttacagaatccgaattggaagcgtttaagctaacaatcaaagcatggattcatagaaggatgtctcttattagaata

SEQ ID NO: 46434 - DNA, 1986 bp, Schizosaccharomyces pombe
atgacgaaaaatcctgtcgatcacacactcattatagaacctccggttcgtcttcatggcgatcccaccgtccctaaacctaacattgctagtttggatgagtataaacgtatgtatgaagagtcaattaatgacccatccactttttggggtaacatggctcgcgacatgatgacttgggacaaacaattcagcactgtcgtccaaggttccatcgacaaggcagatagtgcttggttcgctgatggtgccatttccccttgttataatttagtcgatcgtcatgccattgctcgcccagacgccgttgccttgatttatgaagctgatgagcccaatcagggtcgctatatcacctatcgcgagcttttggcttccgtttctcaatgtgccggtgctctccagtccatgggcgttggtatgggagatcgtgttgccatctatatgcctatgattcctgaaacaatcattgccatgttggccattgttcgtttgggtgccattcattctgttatttttgctggtttttctgcagagtctgttgcagaccgtgtcaatgattctgagtgtaaagttatcattaccgctgatgaaagtcatcgtggtggtaaacgaatccctttaaagggtgtcgttaacaaagcccttaccgaatgtcctaccatcaagaaggtactcgtcttccaacgctctgctgagcctaccgccagtatggttgaaggtcgtgatgtctggtggcacgatattattccaaagttcccccggtattgccctcctgcagtcgttaatccagagcatcccttgttccttctctacacttctggaagtacaggaaaacccaagggtgtcgtacattgcactggtggttaccttcttggcgctgctgctacttgcaaatacgttttcgatttgcatcccacggatcgtatgggttgtgctggtgatgtcggttggattactggtcatacctatattgtatacggccccttaatgcttggtgctgctactcttgtttttgaaagcacaccagcttaccctgattactctcgttactggagtgtcgttgagcgtcacagactgactcaatggtatattgcaccaactgccattcgtcttcttcaacgtgccggtaatgaatttgtcaagcacgatcgctcttctcttcgtgtcttgggtagtgttggtgaacccatcgctccagagtcatttatgtggtactacgaagtagttggtgagaaaagatgtgctgttgccgatacttattggcagactgaaacaggttctcacattgttacttctttgggacctgtgacacccatgaagcctggttctgctacgttaccctttttcggtatcgatgcagtcatcattgatcccttgactggcaagatcattgaaggcaacgatgttgaaggtgttcttgctatccgcagtccctggcccagcgctgctagaactgtttggcgcggtcacgatcgttacatcgacacctacttgaagccatatcctgggttctacttcaccggtgatggtgctacccgcgataaagatggttacatttggattcgtggacgtgttgatgatgttgtcaacatttccggccatcgtctgagtacagctgaaatcgaggctgctttgttgtctcatgacgctgtcgcagaatccgctgttgttggtgttcatgatgagctaaccggtcaagccgtcaatgcctttattttattgaaacctggctatgaagctacagtcgaacttgaaaaggagttgatcatggcggttcgatcgacaattggcccctttgcatctccacgcaagttaattttcagtgatcttccaaaaactagaagtggtaaaattatgcgccgcattctccgtaagattttggctggtgaagtcgaccagattggagacttgagtaccttggctgaccctaaggttgttgagcacatcatccatgctgttcattatgcccatcagaagaagccc

SEQ ID NO: 46435 - DNA, 687 bp, Schizosaccharomyces pombe
atggctcaattcactttatggtcgcatgctcatggtcctaatccatggaaggtggttcaagcgctgaaggagttggaccttacctatgaaaccagatatgtgaatttttcaaaaaatgagcagaaatcccccgaacacttagccttaaaccctaacggtagagtacctaccttgattgatcaccacaataacgattataccatttgggaatctgatgccattttaatctatttagctgacaaatatgatacggaaaggaagatatctttgcctcgtgaccatcctgaatactacaaagttatacaatatttattttttcaagcttctggccaaggcatcatttggggacaggctggatggtttagcgtctatcatcaggagctagtcatatctgccattacccgttataggaatgaaatcaaacgtgttctaggagtcctcgaagatatccttaaagaccgtgattatctcgtggccaaccggttcacaattgctgacttatcattcatttcatggaataacttccttgaaattatttttgcagaaggaaagttttcaatcgaggaagaagtgcctcagctcgactttgaaaaagagtttcctagaacttattcctggcatcaaagacttcttgccagacctgctagcaaggctaccttcgaagaaagatcaaaggctttggataat

SEQ ID NO: 46436 - DNA, 1743 bp, Schizosaccharomyces pombe
atgtttttgaaatatattttagctagtggcatttgcctcgtctctctcttatcatctacaaacgcggctccccgtcacttatatgtaaaacgttatcctgtcatttataatgcttccaacatcactgaagtcagcaattctaccaccgttcctcctcctccattcgtaaatacaacggcccctaatgggacttgtttgggtaactataacgagtatcttccttcaggatattacaatgctaccgatcgtcccaaaattcattttactccttcttccggtttcatgaatgatccaaacggattggtatatactggcggcgtctatcacatgttcttccaatattcaccaaaaactctaacagccggcgaagttcattggggtcacacagtttccaaggatttaatccattgggagaattatcctattgccatctaccccgatgaacatgaaaacggagttttgtccctcccatttagtggcagtgcagtcgtcgatgttcataattcttccggtctcttttccaacgacaccattccggaagagcgcattgttttaatttataccgatcattggactggtgttgctgagcgtcaggctattgcgtataccactgatggtggatatactttcaaaaaatattcaggaaatcccgttcttgacattaattcacttcaattccgcgaccccaaggtaatatgggatttcgatgctaatcgttgggtgatgattgtagctatgtctcaaaattatggaattgccttttattcctcctatgacttgattcactggaccgagttatctgttttctccacttctggttatttggggttgcaatatgaatgccctggaatggctcgtgtgcccgttgaaggcaccgatgaatacaaatgggtactcttcatctccatcaatcctggcgctccattgggaggatccgttgtccaatactttgttggcgattggaatggtacaaacttcgtccccgatgatggccaaactagattcgtagacttgggtaaggacttttacgccagcgctttgtatcactcgtcttccgccaatgccgatgttattggagttggatgggctagcaactggcaatacaccaaccaagctcctactcaagttttccgcagtgctatgacagttgcacgaaaattcactcttcgcgacgttcctcagaaccccatgaccaaccttacttctctcattcaaaccccattgaatgtttctctcttacgagatgaaacactatttaccgcacccgttatcaatagttcaagtagtctttcgggctctccgattactcttccaagcaataccgcattcgagttcaatgtcacactcagtatcaattacacagaaggctgcacaacaggatattgtctggggcgtattatcattgattctgatgatccatacagattacaatccatctccgtggacgttgattttgcagctagcactttagtcattaatcgtgccaaagctcagatgggatggtttaattcacttttcacgccttcttttgccaacgatatttacatttatggaaacgtaactttgtatggtattgttgacaatggattgcttgaactgtatgtcaataatggcgaaaaaacttacactaatgactttttcttccttcaaggagcaacacctggacagatcagcttcgctgctttccaaggcgtttctttcaataatgttaccgttacgccattaaagactatctggaattgc

SEQ ID NO: 46437 - DNA, 1734 bp, Schizosaccharomyces pombe
atgagcagcgaatcgcgtgaaaatgaggtcaaagctgagacaaaagatgaaattgcgaatgatgggagtcctcagttaaatggtgataataacatacaatcaagtgatggtcataacgacgaaaatgaagagtcgttatcgaggaagcgtgactcttctggtgcgactgtgggcgatttgaaacaagaggaaaaagaatctatgcccaaaaaagaacctgaaccgactgttaaaaagattcgtggcagtggaatgcctccgcctcaacaaaaatattgtttggcaattgtaagacaattaaaaagaaccaaaaattccgcaccatttaaagtcccagtagaccccataaaacaaaacattccagattatccgacaattgtaaaaaaccccatggacttggggacaattgaaaagaaattaacaagttacgagtacagcgttcctcaagaattcattgatgacatgaacctgatgttttcaaattgttttttgtataatggaacggagtcaccagttggatcgatgggtaaagctttgcaagaggtatttgagcggcagttaaaacagttgcccgacgcagaacaacccgcagctgctcccgtgaaaaagtccaaacaaaagtcggcctcaactgctccccctcgtactagaagaaactcatctgttagctctacatcagccagcgttgctgcgtctacagctcctaaagctgcttctccagctgttctcccggaaggtaaacccaggcgccgtaaaaacaactcgcaaatgcgcttttgctcaactgtgttaaaggaattatacaaaagacaatacgagtcgtttgctttccccttttatcagcctgttgatcctgtagcttgcgattgtccggattattttgatgtcatcaaagaacccatggatctcagcactatacaatccaaattgaacaaaaatgagtattctactcttgaggaatttgaaagcgacatccttcttatgtttaacaactgtttcacctataaccctcctggcactcctgttcatgtgatgggccgccaattagagaatgtatttaaggaaaaatgggaagctcgtcccaagtttgatgatgcaaccttggttaaacaacaggaggcggaaacagatgctttattcgataatggtgaggaagaggaggctttgatgtccgaggaagaaatcaatggagccaagtttgctgctgtggataagcagatatctatgctacaggacacattggaggcaatgaaggcaaaaaagatgaaccgtatgaggaaacctcgtcgccgtgatctcaccaaggaatatggtcctattacctatgctatgcaaaatgagcttgccgagcgctgtaattacctcagtgctgaacaactttcaaatgtcgctgaaattttacgtgaagagatgccttggcttcgtgatactgatgaaattgaaattgatgtcggcaatatgaaaccagaagtattccatcgtatataccgctatgtttgcaaacccgacgccgattcctctgaacctgcttcacccgtccttatgccaactaagccagagaagaaaaagggccgcgtactttctgaaacggagcaagctgaaaaaatcagacgtttgcaacaacaattagatcgttttgctggcaaaacgtctcccacttctcccgagtcaaataacgctgctaatgtttccgattctgaaagtgacaatgaaagtgaaagtagtgaatctgct

SEQ ID NO: 46438 - DNA, 1890 bp, Schizosaccharomyces pombe
atgaaattatcttcctttggattatttctcgctctccagcttttgccggccttgggccttccttctcgtatcgatgaagtagacgtttcagacccagaactaatcggattattgaaacccgataacgttgataagccagcaaactctatacccctttccaagcgtagcacaagcccatcgtatgcgccttatactgttgcttgccctagtggctctctgcttcgacctgcctccgatggccttagtactggtgaacaagaatttgttgacaaacgtgtctcaaaggttaacagtgcattggaaagctttatttcaaaaaccggcttaaaaatcgatacaaaaagtgtgctgaatgacacagatggccctcgtttgggaattgcaatctctggcggtggatttcctgccatgttaacgggagccggcgctattaatgcatttgatgctagaaatggtaacactacgtctcttggtggtattcttcaatcttccatgtaccttactggtctttctggtggctcttggcttgtgggatctgttgcggttaacaactttgccaatattactttcttgcacgacgacgtttggaacctggaccacagtctcttcgctccctatgacgacgcttttgagaacttttatatttaccaagagtggtttgagcaagttctgcaaaagaagaatgctggattcaatgtctccattactgacctttggggccgtgctttggctcttaagcttgtcaatcctttgactggaggtgctaatactacattctctagtgtaacaaatgaaacgtggttccaggatggtgaatttccctttcccatcatcattgctgataatgtcatagagggtgaaaccgtaatccctttgaacgacactgtctttgaatttacacccatcgaatttggtacttgggacactggggtggaatcatttatacccatggagtatacaggtacacaccttattaatggcattcctcttaatgaatcctgtgtgcgtaatttcgacaacgctggtttcctcatgggtacctcttcaaatgtttttagcggtatccttcctgcgacaaatgcatcactcaccgctagtaataatacctttaacaatgctgtccttagtttcctcgaaatgcttgccgaagatcaattggatgtaggtctttatcccaacccttaccaaggttatggaaatgcttccaatacaaccactaccaatcccttggagccgtatcccattattgaattaatagacggtggctcagatagtgaaggtattcccttttggcccttgcttcatccacaaagagacgtagatgttatttttgcgattgacgggggttatcaaagcgcaacgagtggatggccagatggatcgtccctagtttctacatatgaaagagttttagccactaactcctctggcgttcgtggtttcccatatattcctgataccaacacatttttggctcttggtttgaacactcatccaactttcttcggttgcgacggtagaaacaccacagccggaaaccataccgttaatgacgatactcctcctcttgtagtttacttccccaactatccttggactatgtatgcaaatgtcactacctacactgttcaactggaagatactttgtccagtggaatgattgaaaatgccgctgttgctgctacccaaaataacagtgattcatttgctgtctgcgttgcatgcgctctcgttcaacgttccttggaacgcaaaaacatgtcgactccaagtcaatgtgcttcttgctttaatcaatactgttggaatggaacaattgcaagcacgaccgttactacatatgcacctacagttctgtcagccaagatttagtatgcaacgctcacgaca

SEQ ID NO: 46439 - DNA, 2733 bp, Schizosaccharomyces pombe
atgaggtttcaaacgaccgcaataagtgattatgagaacagctctaatccttcatttttaaaattttctgcaggagacactatcatagttatagaagtgctcgaggacggttggtgcgacggaatttgctcagaaaaacgaggttggttccccacgtcgtgcattgattcttcaaaaattcaaaattttttttcaagttttcattcatcgaatgagaaagacccaaatgctcaatgttgtgcgccgtttcacgtagaggctcatcttcaagattctgcatggtttgagaaacacggagtgcaagcgataaatagtatcccttcttcagaagagttcttaagaaaaaatcttcaaaatgacattcaccaccttgtaaaagggattctcaccaccgctgccgctgtgtcacaatctataaaaaaggaaggcactcaagtgatcgtttttggaattgaaactgttcgtagtatggttctttcatttcccttgataatcctttctacattagatgaaaattttctctcagaagtcgcgcaagtgttctcctcattaaatttattgccagagttgagccgaatgggttgcacttatggtgaactttgcatcagatttactaagcttttgaagcaattggctaataagtttttgtttttcttcaggcccgatgtttccttcccttcttactttttgggctctttgatagcgcatgaaatacatttcttgccatgggattttaatatgctctgttccaattctgtacaatcagcacatacaaatctccaacctgatattacttcctttgttgcaattttgtcactttcacacgaagcttaccattgcactgagaatgaattttggaatttagaagcacagaagctaactgaaaatacaacccaaaaagtactacagctagttgcggaagatgcactagaagcttggaaactagatattctagaggacatcgatagatgcattcaatgttgtaggcgattcttgtctgcaaatcaaagaataaattattcttcctctgaaaataaccctttttctttcacttctcaagatgttgaagccttgaaggatgaactgtcttctaacttatgtgatttatatttgtggagtatcgacttggagcaaatctcacctagcgattgtttactggacaattattccctttttgttgatttactagtaaccttgaaagtatcccttcttcggatcaagtcaataattgttcaattttcagaaagaattgtgtttctttctctagaatacaaattcctcacaaatatccaaccagaattgaatgatgcggagaagtcccaacttgatggttttgacctcaataaaaccaactggttcgactctaaaggattagtttgttatttaatgaaacagacttcaccagagccattattgatccgaaaccttttgttttcattttggtcatgtaatggtaaaattgaacaagatggaaaaataaaaacagccactttagtgttcattataaattaccttctaaggacagatatagatagtacattttttactactatctttttaaacacatacgctagtatgatcagttcttcagatttattttccatacttggagcacattttcggttcatctgctcattaaattttggaaaaatttcttttatttctcacgaattttaccgagttagtaagaggtttttggatatacttcttatttggttcgaatcgtatcttgttgaagagttggacaattccaagtcaatattctttttgtttaaaatttataaagtttttgaagtctttgtagttccacattttgcatctgctgaagaattattgcattctttatcacacctacttcatcatccctctacaaaaagatcacataaaatgctagagggaaaagagctatcccaagaattagaggatctttctctccataattcccctgatccaattatatataaggatgaattggttttacttctacctcctcgtgaaattgcaaagcagttatgtatcttagagtttcaatcattttcacacatatcaaggattcagttcctaactaaaatctgggacaatcttaacagattctcacccaaagaaaaaacttcgaccttttatttgtcgaatcatctggttaactttgtgaccgaaaccatcgtgcaagaagaagaacctcgcagacgtaccaatgtgctagcatattttattcaggtctgtgattatttgagagagcttaacaattttgctagtttattttccatcatttctgcgttaaattcctcacccattcatcggctgcgtaagacatgggcaaatttgaatagtaaaacattggctagttttgagcttctaaacaatttgacagaggcaaggaaaaatttcagtaattatagagattgtctggagaactgtgtcttgccatgtgtccctttcttaggtgtttacttcactgatctgactttccttaaaactggaaataaagataactttcaaaacatgatcaatttcgataagcgcaccaaagtcactagaattttgaatgagataaaaaagtttcaatctgttgggtacatgtttaatcccatcaacgaagttcaagagcttcttaatgaagttatatcgagagagcgaaacacgaataacatctatcaaagaagtttaactgtagaaccacgtgaatctgaagatcaagccttacaacgcttgctaattgattctggcattttt

SEQ ID NO: 46440 - DNA, 1137 bp, Schizosaccharomyces pombe
atggagcctggaatacctccaatgattgataaagctccagcttatagtcatgttttgattgctggaggtatcggaggagccacggctgatttcttgatgcattctttggataccgtgaaaacaagacaacaagcggctctatatacgaacaaatataacggaatggtaaaatgctactccacaattttgtgtgaagaaggtgtttttcatggcctttacagtggagtatgccccatgcttattggcagtttgccggctactgctttgttttttagctcttatgaatatacaaaacgacatttgatgagtaattataaccttcctgaaaccctttgttttttattagccggatttgtcggcgatttgtttgcttcagttgtttatgtcccatccgaggtaagtattgcatatagtgggaagaccaaatatttctgaaaataaatttccagtttttatccttctaaaggtttcccgctgctttatgaaaaacagttgtatactaacgagcgtttttcataggttttgaaaactagactacaattgcaaggacgctacaataatccccatttccagtcaaattacaattatccttcatttcgaggtgccgtcaaacagattgcaaaacaagagggaatgaaaacctttttttatggttatcgtgcgactattttgcgagatattccattctctggatttcaacttttattttacgaaaagcttcgtcaagttgctcaaaaagaatgtggtcaaaaagatataggtgtgtttcgtgagctcatcaccggttctttggctggtgctggcgccggctttttaacaacacccttagacgttgcaaagactaggcttcaaactatgataagaacaacagataaagtatccgatgacattaacagcgggcgttacttttttgccaaggacgagaattccaaatccaaatctgctgcatctcttgtaaaacccaaaatcggtattcgtcatgttttgggaggattgtataaatccgaaggtttactgggtttgtttcgtggatttggtccacgtatattttggacctcttctcaaagctcattaatgtttgtcttttacgagggtattatccgtttgttcaataaaaataatgttttagagcgggac

SEQ ID NO: 46441 - DNA, 1137 bp, Schizosaccharomyces pombe; identical to SEQ ID NO: 46440

SEQ ID NO: 46442 - DNA, 1040 bp, Schizosaccharomyces pombe
atgactgataaatacgcgttctcccttactacattttcacctaacggtaaactcgttcaaatcgagtatgctttgaatgcagtcaatgctggtgttacgtctgttggaattaaaggtactacataatcatgggttctaaaataatataacctgtgtattccctttggaagcgttttttgtttttgtgttataaatactaacataattatagctaccgacggtgtagttttggcgacagaaaaaaaacccactagtgagttagcgatcggtgcttcattggaaaaagtttgtgctattactccagacattggcatggtatgtctacatataggtttcagtgaagtcaaaaattggaatttcggattctaacggttttatgtacaggtttatagtggtatgggccccgattttcgagtgctcgtggataaatcgcggaaagtcgcacaaaccacatataaaaaaatatataacgagtatccccctactaaaatactcgtccaggaaattgcttcagttatgcaagagtctacacaatctgggtatgctttttatcattaaatcgattttatttaaactatattatgttagatgcaacattgtttaagtaaatttgtttctctcatcttcattattctgttttttttttactctactttaagctaacttcattatttagtggtgttcgtccgtttggtgttagtctcttggttgcaggaatggatgaaaaaggtccttctctctatcaagttgatccttcgggcacctattttgcttggaaagccacagctatcggcaaatcatctacagctgctaaaacatttttagaaaagcgttacaatgatgaacttgagttggatgatgccgtgcatacagctattttagctttaaaagaaacttttgagggtgaattaactgaagataacatcgagatcgcagtagtctctacgaaacctacggatagtggaatcgttggcgtaccaggcggacatttttgtcgattgtcccagtcggagattcgtgattatctcgaccaagtataa

SEQ ID NO: 46443 - DNA, 1123 bp, Schizosaccharomyces pombe
atggttagatcacgagtttctcctggattgaaattacaatccgatgcatcaaaccaaagcaatgataaagagaacaagttactggcctacgtaaatgataatagacatttttcactcattaggtatgatttacgtattcttgtttacaccattgcgaaaggactttgcaaaaggattcattacttgaaatactaactagaggattgtagagccctccaccttgcagacttgattactttaatgaacgggttttgcggtgtcatgagtatattttcaagtttacgttactgcctaagcggacagcaatcagctttccatttatggaatgcaatgtactttatgccatttgcgttgttttttgactttttggatggtaaagtggctcgttggcgtgggaaatcttccttaatgggtcaggaattggatagtcttgctgatctggtatgtataacttctcaaatctgttccgagactattttcacattggttgctttgacatgataaaaacacgaggaacatgataagaggcttctttggttgaattttttcttcattttagctaagtcgagctttttttttttgcttctcgttttttacattatgtcggtttgttcaatgagtctgaatttttctcaataaacatgcgattgcgtataattcttgattatatatattttttctctctcttatccggtctttttatatcattatactaacaaaatagatttcatttggcgtatctccagccgtctttgccttttgttgtggattccaaacgttccttgataccgttatactttccctttttgttttgtgtggtctaactagattggctcgttttaatgtttctgtcaattccattcctaaagatggatctggcaagtctcagtttttcgaaggaacgcccattcctaccaccctctccttagtaaccgtttgcggagtttgtatcttaaagggaaagactcatgaaaatctaccttggggtgagtggtgtggaaacacaccttttgcatttcacccgcttgtggttttgtttgtgttgagtggaattgctatgactagtaagaaactcaaagttccaaaaagtacgtttctattacattcgctcaaatatgtttag

SEQ ID NO: 46444 - DNA, 1812 bp, Schizosaccharomyces pombe
atgtctgttgaagtagataaatcttctcattcgaagcctaaaattgaaaaaaagagcaagagaaataaaagaaaatggcttaatgacgagaataagactcatgttactgcttctgaggctgccattgagagattgaagaaatccgctagcttttcacaagctgcacaacaagctttaaagcaatcgagaaaggaagacaatgagcgagatatagaaatgcaggatgttgatgctgaagctcaacctcatgatttgttaccaattccacaaccatcagttgaagactttgtagattcaaaaccgcatgttaaaaatatcacctctgtcttgcctaaatggctagctgagcccataactgtcgatcctaatacaactgtggaattctcgtctttaaatatatctagtaaacttgtcgagcgacttcaaaaacagaacatcacccgtggatttgctgttcaggctgctgtattaccgttactcttacaagatggaagacacggtccgatgtatagttatggtggagatgtttgtgtaagtgcagctactggcagtggtaaaactctttcgtatgtgattcccatcgtccaatgtcttagtcaccgtacagtacctcgtttgcgttgtgtggttattgttcccacacgagaattgacagtccaggttgctaaaacctttgagtattatatgtctggtgccggtttacaagtttgtgcctggactggtcaaaaaagtttacgacatgaaacatatcaactaaatggtgatgagaacgaatgtcgtattgatgtgttggtgagcactccaggtcgattagttgaccatatccgaaatgacgaaagtttctctttgcaacatttgcgttacatggtaattgatgaagctgaccggttgctcgatcaaagctttcaggactgggtggatactgtgatgatggaaatatctcatcctaaatgtcttcagaataaatcaaatatcttggatttagatcaaaatatttctcccacatttttacctgatattgacacacttttaccatatcgtttaccttctcctttacaaaaacttgtattttcagcaacgttaactagagacccttcaaaaattgcatctcttaaacttcataatccacgtttggtcctcgttcaaaataaagatatggaggttgatgatggtggagaaattgaggacgatgcaattgtatttagtgttcctcctactttgcaagaataccacgtctctgtcagttcagaaaaacctatactactttaccatttaatacactcaaaaaatttgactaatattctttgttttgtcaagtccaatgaggcagcagctcgattacaccgtttactggaattaattcatgaatccttgaatcaaagtttctcctgtgggttatttacctcatctttatcaagggatgagagaaaaaaaattatcagtaggtttgcaactggcgatttgaatttgttggtgtgctcagacctgatggcgcgtggtattgacgttgctaatactcaaaatgtgattaattatgaccccccgttaagcgttcgtagctacgttcacagaattggacgtactgctcgtgctgggcgtgaaggttttgcatggacacttgttcaaagtcatgaggggcatcatttttcgaagctggttaagcaacttagaagaaccttacccataaaacgtataaagattgagttttctcatatttcggaagagtttgtagtcgcatatgacaaggcgcttgaggcccttcgtgtggaagtattcaattcacgttatccacaacaaaagtcctttttaact

SEQ ID NO: 46445 - DNA, 3877 bp, Schizosaccharomyces pombe
atgagcgttgggaacgttggcaagcaaagggagaaaacaaaagattcatcagctaaaacaaagcagaaaaccctctttgggtttttctccaaaatcccgaatgtgaaacaagagaagtcggattctacattatctagtagttcgaatcacgactctaatcatgatacgcctgctgatgttgacaacagctccaatgtgaacaaaaactcttcgtctccggaacgcgaattgccaacgagtccttctcatcatgcgaataccgagatagattccagttcatctatgcttcctcctccatcaagtgatccattttcctcaccgctttctagcagcctacaccgatcatctcctaaacgccctcatgattctttgggcgaggagtcaccaggtaaattgcttcgcacgtctgtgaagcaagagcccgactctgaagaagaaatcgattctccgacgaaaaagaaaagttttaaaagtttggatacatcaatatttcaagctgaagatcaatttcgtcatcctgtctcgtcgaagctggaaaattcggaattatctgaagtcgacaagccttttatagcttctcggcgttcaaggaaggtatgggtaattgagtgatacatattactttagaagaataaaaggggaaatacgcactttacccctatattaaccagatttttgttttaattaattatgactaacaatatgctagcctgtttcctacgctgaaagtgatgaagacgaagacttcgacgatgcacctaccaaaggatctcgtcataaaagaatcgtttctgatgacgaatcggatgactacgttgagcccgatcatatttcggaagcctcatctgaggcatccttgcctattgatgaagtcgaatctatggatgaggatgttgatggatattcagatcattccgtttctgtggctgctccaattcccaaaaaggaatctcgaaaggagagttccaattctttgtatgaaagttatcggctaggctctcaaattgccagtccaagcccttcggtctcgggttctgcatctcccacaaaatcgaataaaaacggtgtcctgaacagagaagaaaaaagaaggcaaagaatggaggcatttaaaaaagaaaacaacgaacgttacgagtggttgctagatgttcgagatgctgatcaaaatcgagtgggtgatcctaattatgatccgcgcacattgtatatcccaccttcagcttgggcaactttcaagccatttgagaaacaattttggaaaattaaaaaggaccttatggatacagttgttttttttcagaagggaaaattttatgagttatatgagaatgatgccgctatcggacatcaggtattttccttaaagttaactgatagagttaatatgaagatggttggaattcctgaagcaagttttgattactgggcatctcaattcattgcaaaggggtatcgtatagctcgagtcgaccaattggaaaccgctttaggtaaagaaataaaagatcgtcaacgaactcagaaggaagaaaaagtagttcagcgaggccttacccaagtcttaacgagcgggacccttgttgacgaggcaatgctgacttctgacttgtcaacatattgtatggctattaaagaaagtcttcaatctgacaacgaagagccttcttttggtatctgcttcattgatacctcgactggtggttttcatatgtgtgaattcactgatgatatccacagaactaagcttgacactttattaacgcaagttcgccctaaggaactcatccttgagaaatcaaaaatttctcaaaaatcgattagagcgataaaatactgtgtgtcttcatcttcaatctggaattttatcaagccgtatacggaattttgggataacgaacgagtcgagagagaaattatagcaggagactatttcaaaaatggtttagaaggtgctccaaagatactaaagtcgtatcttagtgaaaagcctctagccatcagtgcatttggtgctttattttggtatttacgacaattaaagttggataaggacatgtgttccatgggtaattttgacgaatatgacgcttctcagcagtcaacttccctacttatgaatgggcagactttaaaaaatttagaaatattctctaactcttttgatggtggatcggaaggcactttgtttcatttgctctgcagatgtgtcaccccttttggtaaacgtttatttcatacatggctttgtcatcctctaaggtccggtactgcaataaatgcacgacttgatgttgttgagttaatagccgacaaccctgttattcgagataccatttgggggtttctacataaacttcctgacttggaacggttgatatcacgggtgcatgccggaagaagtaaacccgcagattttgttcgagtattagaaggattccaacgaataaatagtgcatttgatcagcttcgcgaggaattcatggaagtcgctgaaggaactttactaggagagataattcaaagtgcacctaacatgaaagaggaattagaagcatggacccgagctttcaattggcaaaaggcttcagaagaaggtgttttcgaaccagagattggctttgaagccgaatatgatacttctcaaaaataccagtccgaacttaaaaacgaattgtatgcgcttttagagcaatacaagaagcagctaaggtgctcgtctcttaattttaaaaatattggtaaagaggtttatcaggtcgaagtcccaagcgatgttaaagtaccggttaattggtgcaaaatgtcaggtaccaaaaaaaccaatcgatactataatgatgaactacgaaagaaaataaagaaattactagaggcggaagagcttcatttagcaattatgtcgcgaatgcaggagaaattttatattcgattcgattctaattatgagcaatggttggctttaattaaatatactgcatctattgattgctttttcagccttagtcaagcagccgcagcgttgggtgagccatattgtagaccggaaattattgaacagaaggacggacacttgtattttgaggagttgagacatccttgtataaacgcaagtgcggcttcaactttcgttcctaatgatgtcgttttaggaggtgaatccccaaacatgattgttttgaccggtccaaacatggctggaaagtccacattattgcgtcaagtctgtattgctgttataatggctcaactagggtgctgggttccggctaaacgtgctagtataacacctatgaccagcatttacactagattaggtgccaatgatgatataatgtcggcacgaagtacttttatggttgaactttcggagacaaagaaaattttggacgaatgtggacctaaaagtttggtaattttagatgaactaggtcgtggaactagtacttatgatggtcacgcgatagcttacgctgtacttcatcatttggtttctaatattgggtgtttgggatttttttctacacattatcaaagtctttgcgttgattttatgcatcatcgacaagtacgattgatgcagatggctgcagctgttgatgaaaaaatcagacgtgtaacgtttttgtataagctggaagatggtatttgccctaagtcttacggtatgaatgttgctagtatggccggcttacctgagaaggtaattgatgcggccgaagagaaggcctcggaacttgagcaagcgtctgccagcttcattaacgcaagcgatgacattgctttaatgagtgatttccttcaagtgttgcgcatatcaaagtcaattgaacctttgacagcagtgaatatacctctcatacttgattcgtttgaa

SEQ ID NO: 46446 - DNA, 1947 bp, Schizosaccharomyces pombe
atgttttcaatcttcaaacgccgatctgttcaggccgctttggctgcttcgggtctagttggaggcgccgttttctactctgatttcattaaaagacccgctccttctcacttcaatccccaatttaccccgtttaccaaatcgttagcccctccgccatctcgtgaaacgcttttaaaaaacgtcgaagatatatcaaaattcgatgtcctcattatcggtggaggtgctaccggtacaggtgttgctgtcgatgccagcaccagaggacttaatgtttgtttgttagaaaaaactgattttgccagtgagacttcatcaaagtcgactaaaatggctcatggtggtgtgcgttatctagagaaagctgtattccaattgtctaaggctcaattagatttggttatcgaggctttaaatgagcgtgcaaatatgttgagaacggccccacatttgtgcacagtgttgcccatcatgatccctgtatacaaatggtggcaggttccatatttctttgttggttgtaaaatttacgactgggttgctggttctaagaacttgagagcttctaccattttctcaaaagagacaactgtggccattgctcccatgctcgacgattctaatctcaaggcttcatgcgtctaccatgatggctcctttaatgacactcgcatgaacaccacgctagcagttactgcaattgacaatggtgcaaccgttttgaattatatggaggttaaaaaactattaaaatcaaaagacaacaaacttgaaggtgtacttgccatcgaccgtgaaaccggtaaagaatatcaaattaaagccacttctgttgtcaatgctaccggtcccttttctgacaaaatcttagaaatggatgctgatccccaaggtgagccacccaagactgcccagtttcctagaatggttgtcccttctgccggcgttcatgtcgtcttgcccgaatactactgtcctcccaatataggaattctcgacccttcaacttcagataatcgtgtcatgttcttcttaccatggcagggtaaagttatagccggtaccacagataagcctttgagtagtgttcccactaatcccacaccatctgaagacgatatccagttgatattgaaggagctacaaaaataccttgtgttccctgttgatcgagaggatgtcttgtctgcatggtgcggtatccgacctttggttcgtgacccatccacggtccctcctggcaccgatcccactactggagagacgcagggtctagttcgttctcacttcattttcaagtctgataccggattacttacaatctcgggtggaaaatggacgacataccgtgaaatggcggaggagactgttaatgaactaatcaaggaccacgacttcggaaaggcattgaagccctgtcaaactaaaaaactcattttggtgggtggtgaaaactattataagaattattctgccagattgattcatgaatatcatattcccttaagactcgcaaagcatctgtcccacaactatggatctcgggccccattaattttggagttatattcgaaaaccgatttcaacaagctgcctgttacgttggctgacaaggaagtattcgctccatcttctgatgcctcgagtgataaaagcgtttcctatgcatcctttgatgaaccgtttactgttgcagaattaaagtattcgataaagtacgaatacactagaacacccaccgatttcttagcccgtaggacccgtttggcatttttggatgctagacaagctcttcaagccgttgctggtgttacacatgtcatgaaagaagaatttggttgggatgatgcgacaactgacaagcttgcccaagaagccagggattacattggaggaatgggtgtatcatctgaccgtttcgatgttaaacagttcgaagtcaaa

SEQ ID NO: 46447 - DNA, 1110 bp, Schizosaccharomyces pombe
atgggccaaacactctcagaacccgtactcgacaaacattcgagttctggcggggatcgatggcttcattttggcgtttcacacatgcaaggatggcgtatttcgatggaagacgcgcattgtgcgttgctaaactttacggattccaattcttctaatcctccgacaagcttctttggggtctttgatgggcacggaggcgacagagtcgccaagtactgcaggcagcacttaccagatatcattaaaagtcagccgtctttttggaagggtaactatgatgaagctttgaaatctggttttttggctgcagacaatgcgttaatgcaagatcgggacatgcaggaagatccttcgggatgcacagctaccactgccttgattgtcgaccatcaagtaatatattgtgcaaatgctggggactcgcgaacggtcttaggtagaaagggaactgcggaaccactttcttttgatcacaaaccaaacaacgacgtggaaaaagctcgaatcacggctgcagggggattcatcgactttggtcgagtgaatggtagtttggctctttctcgtgccattggagactttgagtacaagaaagacagttccttacctccagaaaaacagatcgttacagcttttcctgatgtcgttattcataacatagatccagatgatgaatttttaattctggcctgtgatggaatttgggattgcaagagctctcaacaagtcgtggagtttgtaagaagaggcattgttgcgcggcagtctttggaagtaatttgtgaaaatcttatggaccgttgtattgctagtaacagcgagtcctgcggtatcggatgtgacaacatgactatttgcattgttgcctttttgcatggtcgtggtcttgaggattggtataattggattacacagcgcgtcaactcgggagaaggtccttgcgcacctccatcttatgctgagttgcgaggacctaacactatagcggatgcaagaaatctgcagttggaatatgatcatatagctagccatgagtatggaagcggtgatacatacgatagcgattcagatgatgaaaccattgcctacgatcgctattaccttcat

SEQ ID NO: 46448 - DNA, 915 bp, Schizosaccharomyces pombe
cacgattattccgatatggacaactaccctcgtccttctcacgctgattatacctacttggagaaatacggtgtcaaggcatcttcgggtggtggtcgatccagtgcccgtgaaaccattggacgagtcgcggctggtgcaattgctgaaaagtatctcttagaagcttatggtgtcgaaatcgttgcctttgtttccagtgtaggcaaaatagccattccattgcacgaaaccgcttcttccgccatattggacccagaggatgatacatttgaatctcctataaccgctgaatatctgaaattcctcaataaaattacgagagaggaagtcgataaaaccactgttcgttgtcctcatgctgcgacggccgccaagatggctgaacgtattactcgagctcgtgataaccacgattccatcggtggtactgtaacctgtgtgatccgtaatgttcccaccggtcttggtgaaccatgttttgacaaacttgaggccaagcttgctcatgccatgatgagtattcctgccaccaagtcttttgaaattggctcaggccgtgaaggctgcaaagttgctggatccaagcataacgatcttttttaccgaaatgctgatactggcaagcttggtaccttgaccaataacagtggaggtgtccaaggtggtatttccaatggcgaaaacgtttacttcaccattggctttaagtctcctgctaccatcggcgtagaacagtcaactagccgttacgatggtagtgacggtgttcttgctgccaagggtcgtcatgatccctgtgttgttccccgtgccattcccatcgttgaagccatggctgctcttgtcgttatggatgctgtcatgattcaacaaagtcgtattgcctctcgaaacctactccccaatgctcaa

SEQ ID NO: 46449 - DNA, 2142 bp, Schizosaccharomyces pombe
atgtctagttcaaatgaacaaatttgtttggacgaagattgggtaagtttaatactaatattataactttattaattaataatggtcagatacaaaaatttggggatagggaaattgaatttgtggatgaagctcaaaaatccgaagttgatgagacagaaaagtctataaaacgctttccgttgtccgtattacaaagaaaaggattagcacttatcaaccttagaatcggagttgtaaaaactggatttggtggtaaaacgtacatttaagcattcgaaacgacataatgactcttttttaactcatttaatttgtagaatcattgattttgaaaaagatccagcgttctccaatggtgaagaattaccagcaaactctttttcacctggtgatgttgtcagtattcgacaggattttcaatcctccaaaaaaaaacgtcccaacgaaacagatatctcagtggagggtgtggttacccgagtgcatgaaagacatatatctgttgctttaaagtctgaagaagatattccttcttccgtcacgcgtttgtcagtgtaagttttaatcaatgtctccttacaaaaaaatgactgacagttgaaaagcgtcaaattggtgaatcgcgttacgtatgaaagaatgagacatactatgttggaatttaaaagaagtatcccggagtatcgaaactcacttttttacaccttgattggaaggaagaaggcagatgtttctatagaccaaaaattaatcggtgacattaaatatttcaacaaagaattaaatgcaagccaaaagaaagcagttaaattttccattgcggtcaaggaattatcactaattcatggtccaccaggaaccggtaaaacccacaccttagttgaaatcatacagcagttggttttaagaaacaagcgtattttggtttgcggtgcttccaatttggcagttgacaacatagtagatcgcctaagcagttctgggattcccatggtccgcttagggcatcctgctaggctccttccatcgattttggatcattctttggatgttttatcacgaacgggtgataatggagacgtaatccgtggaataagcgaagacatagatgtatgcttaagtaagattacaaaaactaaaaatggtagagagcgtcgtgaaatttacaaaaatattcgggaacttcgcaaagattatcgaaaatacgaagctaagacggtagcgaatattgtttcggcaagtaaggttgtgttttgtactcttcatggtgctggatcgaggcagttaaaaggccaaagatttgatgcagtgataattgatgaagcttcacaagcgttggaaccacaatgttggattcctcttttgggaatgaataaagtgatcctggctggcgatcatatgcaactttcaccaaacgtacaaagcaaaaggccttatatatctatgtttgaacgattggttaaatctcaaggagatttggttaaatgttttctaaatatacaatatcgaatgcatgaacttattagtaaattcccgtctgatacattttacgatagcaaattagttcccgctgaagaagtaaaaaaacgcttacttatggatttagaaaacgtcgaagaaactgaacttactgattcaccaatttacttttacgacaccctggggaattaccaagaagatgatcgatcagaggatatgcaaaatttttaccaagacagtaagagcaatcactgggaagctcagattgttagctatcatatatcaggactactagaagctggacttgaagctaaggacatagcagttgttactccctataacgcacaggtagcccttatacgacagttattaaaggaaaagggaatagaggttgaaatgggcagcgttgataaagtgcagggccgcgagaaagaggcaattatattttctctagtcagaagcaacgatgttcgggaagtagggtttttggcagaaaagagaagactcaatgtagccatcacaaggcctaaaaggcatctttgtgtaattggggatagcaacactgtaaagtgggctagtgaattctttcaccaatgggttgattttttggaggaaaatgccattgtgatggatattgatgcaaccatgtttgagtaaact

SEQ ID NO: 46450 - DNA, 1515 bp, Schizosaccharomyces pombe
tctttcttatgggttcctgtctctcaatatgcttatagagcgatatcaactaaggctttgagacatgttctaaacctgtcatacgattttcatttgaataaacgtgctggtgaggttttgaccgccttaactaaaggaagttcgttgaatacgtttgcagaacaagttgtgtttcagattgggcctgttttgttggatttgggagtagccatggtatacttttttattaagtttgacatttattttacgcttattgtgttaattatgacactttgttactgttacgttacggtcaaaattacatcttggcgtaccgaggctagaagaaagatggttaatagctggcgcgagagttatgctgtgcaaaatgacgcgattatgaatttcgaaaccgttaaaaattttgatgcagatgactttgaaaatgaacgatacggtcatgctgtggatatttatcttaagcaagagcggaaggtactatttagccttaattttttaaatatcgttcaaggtggaatatttacattcagcttggcaattgcttgtctattaagtgcttatagagtaacattcggctttaacactgtcggtgattttgtcatacttttgacatacatgattcagctacagcagcctcttaattttttcggaactttatatcgttcattgcaaaatagcatcatcgatacagaaagactacttgaaatttttgaggagaaacctactgtggtggagaaaccaaatgccccagatcttaaagtcactcaaggtaaggtaatattctctcatgtttcatttgcatatgatccacgaaaacctgttttatcagatatcaattttgttgcacaaccaggaaaagttattgcgttagtgggagaatcaggtggtgggaaatctacaattatgagaattcttttacgattcttcgatgtcaactcgggatccataaccattgatgatcaagacatacgaaatgttacgttgtctagtcttcgatcttcaataggtgtagttccccaagatagtaccctttttaatgatactattctttacaatattaaatatgctaaaccttctgcgaccaatgaggagatttatgctgctgctaaggctgctcaaattcacgatcgtatattacaattcccagatggttataattctcgtgtcggagaaagaggcttaaagttaagcggtggtgaaaaacaacgtgtagcagttgccagagctatcttaaaagatccttcaattatccttctcgatgaagctacttctgctctggacacaaatactgagcgacaaatccaggcagccttgaatagacttgcatctggccgaactgctatagtaatcgctcacaggctctccaccatcaccaatgcagacttaattctttgtatttcgaatggtagaatcgttgagactggcacacacgaagagttaataaagcgtgacggcggagcttacaaaaaaatgtggtttcaacaagcaatgggaaaaacttctgctgaaactcat

SEQ ID NO: 46451 - DNA, 2047 bp, Schizosaccharomyces pombe
atgcaaccgcaggaggttgatttaatggagaactcaaccatgcgaaatggagcaagagttttaccaccagaagccatatccaagcgccatatcggcccttatattataagggaaacccttggtgaaggttcttttggcaaagtcaagcgtaagattgctaatatttaatatcatgagaatagagactaacgtacttgtagtcgctactcattacaaaacgcaacagaaagttgctctcaagtttatctcccgtcaattgctaaagaaaagcgatatgcatatgcgtgtggagcgtgaaatttcatacttgaagcttttgcgacatcctcatattattaaattgtatgatgtgataaccacgcccacagatatcgttatggtaattgaatatgcaggtggtgaattgtttgattatattgtagaaaagaaaagggtaagtggtgcggtttgcgagtttttgttacagtaaatttcagaagtgatgttggattggtttgatttgtcaaaatgtacaagttatccgattgtcttttttaaaaatagaaaaagataaattgtttttgcatctgaaatgttgctgatgaaggcttgtttacaaatttgaatgcacgaatttatgtatttgctgactgtttttaaagatgactgaagatgagggtcgtcgtttttttcaacaaattatatgtgcaattgagtactgtcaccgtcacaaaattgtacatcgcgatcttaaacccgaaaatttgttgttggatgacaatctcaacgtaaagattgctgatttcggtttatcaaatattatgacagacggtaatttcctaaaaacgtcctgtggcagtccaaattatgcagccccggaagttatcaacgggaaattgtatgctggtccagaagtcgatgtttggagttgcggcattgttctctatgtgatgttggtgggtcgtcttcctttcgacgatgaatttatccccaatttgtttaaaaaagttaacagtatgtttggccacttttttttctacttatctcttgctaaacgtatttaggttgtgtttatgttatgcctgattttctttctcccggagcacaatctttaattcgccgaatgattgttgcagatccaatgcagaggataacaattcaggaaatacgtcgggacccttggttcaacgttaatttacccgattatttacgtcctatggaggaggtccaaggctcttatgctgattcacgaattgtcagcaagcttggtgaggcaatggggttctcggaggattacattgtcgaagctttacgttcagatgaaaataatgaagtaaaagaggcttataacttgctacatgaaaatcaagtaatccaagaaaagagtcatctctccaaatcaaaacgagtcgattcttttctatctgtatctccacccgcattttcagaatatacttctgaattgcaaaagaagtcaaaacaggagcttatcgatcctactttagaaggaccgcgttggacagtctccgaccctccaacatatgctaaacaaacaattgacagtaacatatgtgtccttgtgcctacggcagaaaaaaataaacttgaaatgaggactcttgccgatgctgctagtgctgtggatacgagccaatccactcgcaaaaagagtcgccgtaacaaatggcattttggtgttcgctgccggggcgatgcacctgaaattttgttggctgtgtatcgagctttacaacgtgcaggagctcagtttaccgttccaaaaccagtaaatggaaaatatcgatcagacatgtataccattaaaagtcgttgggaaattcctcattgtaaaagggaaggaaaaaatacttatgcttatattgagttacaactttatgaagttatgcccgggtgttttatgctagatgtgaaatctaatggttacaaagatatttattctcatcctgaacgaacagctgatcatggcatggatgatcttaagtcatctttcccatttttagatttgtgtgctatgctggtgtgcaagttattttctgcatgatttatt

SEQ ID NO: 46452 - DNA, 1344 bp, Schizosaccharomyces pombe
atgggtttgaagctgtgggtgaaacagcgcagaagtcttccgtttatcattggaacaatagccattgctttgtttacggaccttttcctctatggaatcattactcctattctcccattttcccttgtggaccgagtgggtatttctcctgatcgggtgcagagcgtaatttctacactacttgctgtttatgctgttgcaaacattgccgccagttcaccgattgggtttttggcggataagtttttaactagaaaagttcctatgcttattggtcttatatttctcacttctgcaactgccctgctgacgtttggtaacagcgttcccatgctgatcgtggctcgtgtacttcaaggtttatcggctgctgtagtatggactgtcggtttagctttactcgtagatgttgtaggtgcagacaacgttggttcgacgatgggcggaatttttgggtttatctctttaggcgaaattatagcaccagtttttggtggtatagtatatgaatctttgggctactatgcctcctttggtgtttgttttattattttattattagatattgcattgcgttttctaatgattgagcctcgtgaaatgaagaatgattctactctgcaagatgtagagcgaacctctattttacaacgtcaggatacacaagatcatgaattaaaacccaagcgaagtggtttgttcagttctttatgcctacctatctactccttgttacatcataaacaaatctttggtccattctggactagtttcgtcaattcgtgccttttctctgcctttgatgctactattcctttagagctgaaaacgctttttgactttaattcgctccaatgtggtcttatgtttggagtgttgagtacaccatattttttttgtggtgcttgggctggtgcaatggttgatcgccgtggttctcgtactataggtaagcgtgcgtatgctattttgggatgtacgttgttcctcttgtgtattcctcgaacaaatactagtcttaacatttatttgttctctgctttcctggctattaatggagtggttttggcattcacatcatcccccggttttgttcaatcttctcattacgttgctgaatatgagctcgaacatcccactttttttgggcataacggaccctatactcagctctttagtgcctataatattgtctattctttaggtatgattattggtccccttgttgcaggcttcttgcgcgatcaattcaatttcataacatccattgcatgcttgtctcttttgtgtttttccgctagccttatggctaactcatgttttactgatcggcttgactctgaa

SEQ ID NO: 46453 - DNA, 1278 bp, Schizosaccharomyces pombe
atgaattccactactccgacttatcatctcattcccaaaggcggtaagcatggcgagttccgacaggaatctgacacctttggtcccatacaagtccctgcagaaaagtattggggtgctcaaactcagcgttctcttcaaaactttcgaattggtggtgaaaaagagcgacttcctcttcccttagttcgcgcatttggagttttaaagcgtgcggctgcttctgttaatcgtgaattcggtttggatcccaaacttgcagatgccattgaacaggctgcccaagaagtcattgatggtcgtttggatgataacttccccttggttgttttccaaactggctcgggcacccaatccaatatgaacagtaacgaggtaatcgctaatcgtgccatagaaatccttggtggtacgttaggttcgaaaaagcccgttcatccaaacgatcacgttaacatgtctcaatcttctaacgacactttccccactgttatgcatattgcctctgttttgcaaattcacactcatttacttcctgccatgaagcacctccaccgggccttgaagggtaaggaagaggagtttaagaacattatcaaaatcggtcgaacccacatgcaagatgccactcctctttctttaggtcaagaattttccggctatgttactcaggttggttatggcattgagcgcataaacaacgctcttcctcgtctttgtcttctcgctcaaggtggtactgccgtgggtactggactaaatacttttgaaggatttgacgtgaaggttgctgagaaggtttcaaagcttacaaatattgagtttaagaccgcccctaacaagtttgaggctcttgcagcccatgatgcgattgtggagatgagtggtgctttaaatgttattgcttgttctcttatgaaaattgctaacgatattcgtcaacttggttctggccctcgttgtggtttaggcgaattgatccttcctgctaatgaacctggaagttcaatcatgccaggcaaagtaaaccccacccaatgtgaagccttaacaatggtttgtgctcaagtaatgggcaatcatgccactattactgtcgctggtgcctccggacactgtgaactcaatgtttttaaacctcttttagcaaagaacattctaagcagtattcgtcttttaggggatgcttgcgagtcttttactgatcattgcgttgtcggcattgagccaaattacgaaggtattgcccgtcatcttcgtgattccttgatgcttgtt

SEQ ID NO: 46454 - DNA, 1041 bp, Schizosaccharomyces pombe
atgaagggaagccatccaaatgcaggttccctgttggaaccacttcacaagttgaacccattttctgaaaattctacaagtggacatcgaaaaaacgctagtgatcattcggcggatggagaaactcgaccgattgcaattgagatgaaggatagtaaaggcaacacagtcccagttggtaactcgcgccctagtaaagcctctaactggcttgctggactgatggaggataaaaaccaaagatggcgtaggtctatggaggatactcatatttgcttgtatgattttgggggtaatcaggacgacggcttcgttgccgtttatgacggacatgctggcattcaagcatctgactactgtcagaagaatcttcacaaggtacttttggaaaaggttaggaatgagccggaccggctggtcacagacctaatggacgaaacatttgtcgaggtcaacagcaaaattgcaaaggctactcacaatgacatttgcggttgtaccgctgcagttgctttctttagatatgagaaaaaccgcacccgccgtgttctctacacagctaatgcaggtgatgcacgtatcgtattatgccgtgatggtaaggctattcgactttcttacgatcacaagggatccgatgccaatgagtctcgtcgtgtgacccagttgggtggtctcatggtacaaaaccgaattaatggcgttcttgctgtcacaagggccttaggtgatacctatcttaaggaattggtcagtgcgcatcccttcaccactgaaacccgaatctggaacggtcatgatgagttcttcattatcgcttgtgatggcttgtgggatgtagtatcggatcaggaagctgtcgactttgttcgcaatttcgtaagccctcgcgaagccgctgttcgcctggtagaatttgcattaaaacgtcttagtacagacaatatcacttgtattgtagttaacttgactcgcaatcccggtgatctcgatgattcaggacttaccgctgataatgattcatacagtaatgactattat

SEQ ID NO: 46455 - DNA, 1035 bp, Schizosaccharomyces pombe
atggtgaaagtcatatataaatttgcagtttttgctgccgtcaactttttcttgatgagttccatcgttctttacttcaacaatgaattcttgatgtttgcagacagatgtaccaaggacatcattccttccgaagaactaagatatttacgccaagttcttaatgattcaattccttccaaagatgaaccgttgccaactttgaaacttgattccttgaacgatatttcaggggaacctgttattccaaaaatcattcatcaaacctggaaaaccacagaagtgcctgaaggatggaaaggtgctcaacagagctgcatagatttacacccagattacgaatacatcctttggactgatgaaatgtctcgtaatttcattgctgataactatccttggtttttgccatacttcgatgcttaccctttcaatgttcaacgagcggatgttattcggtacttcgttctttatcattatggaggaaattacattgatttggacgatggatgtcgtcaacggttagatagtcttctctattatcccgtatgggttcgcaggaccgaccctgtaggcgtttccaacgatgttatgggaagtgttcctcatcatccatacttcgaactgatcattcaaaacctcgaaaaaaatgcgaagtcatattggcttccctacttgactatcatgttgagtaccggtcccctttcaatcagctttctctgggaaaagtacaaaagacaactacccaacccacccgcattttacgaccacattcgtgttttacttgaaagggattacaagttttccaacgactcttatttcaccttttatgaaggatcgtcatggcataataacgatgcaggcattatcctttgggctaaccgtcaccttgcatatgtaatcgttgcaggattttgtctttactttatccttagctatatgtttttctccaagctgttggacagccgttatgtccaaagatttgtcacatcgaaacgtaaacaacctacacttcctcttgctcttcaagaagacgtc

SEQ ID NO: 46456 - DNA, 1488 bp, Schizosaccharomyces pombe
atgattgtttcctggtccttgaaagacgccgttgttgtagtcgttggttcaggaaaaaatgcttaccgacgggtgaatttatgtttaagtgaaaattcttctaaaattttttggttttgtcgcagctccgctgatggtggatttgacgttggtcatcttcagcttgacgcaaaaaaatcggatgctattgaaattcttcccatttctgaatttgatcccgttcgttcattaacgacgctgggaaaggaggagacagattttttggtggatgctgttttcgtgtcagagtccaaccaccatgaaaaggaaattttacatcgtacgtgcaaaaggtaccgaatcccattaaacatcattgataatccttctttgtgctcctttactctaccagctacgtggtcagaaccacctcttcaaatttctttaagtacttcatcaaatggttgtcgtttagctcaaaggctgttgagacacgtggtgagtagccttccttccggtatgccagaagccattgagcgttttggccgagtgcgagcgatcactaaaactccagaaaaaaaacagtggatcaatcatgttagtgatttttggcccctcgagaagttggttcggatgacagaggacgatcttcttgccatagtttctgacaacttctctcttccactctcatcaagccaatcttcttcacttgccaactcctatgaaagtttatcaaccaccttggacaagccttcattgacgcttgaccctgaggcttttcctactcataagcgaggttcaatagctttaattggaagtggacctggctctcctgatttacttactgttgctgccagaaaggctataatgaaagccgattatgtactagccgacaagctggtaccagaagcggtattacagttaattccaaggcatactccactatttattgctagaaaatttcctggaaatgcggataaggcacaagatgaacttcaccaggttgcttttgatgctttatctagaggtgattatgttgtccgtttgaagcaaggtgatccttatatttatgggcgaggcggtgaagagtatctattctttacacaacacggttatgtaccaacggttattcctggcatcagtagtgctttgatggcccctatctctgctggtattcccgttacacatcgtggagtggccgatcaatttcttgtgtgtactggaactggtcaaaagggttcgatgcctaaaataccttcttttgtccctacacagaccacagttttcctaatggctttacaccgactagaaattcttgtgcaagcactaattgaaagcggttggcctagagtgttaccggtttgtatagctgagcgcgtctcttgccctgatcaaaggttcattttctctactttggaagacgttgtggaagaatacaacaagtacgagtctctcccccctggtttgctgattactggatacagttgtaatacccttcgcaacaccgcg

SEQ ID NO: 46457 - DNA, 783 bp, Schizosaccharomyces pombe
atgtcgactccccctgctaatgtcactaccgcccatgtgttggatttgtttagcctcaagggcaagaactgcgtcgtttttggcgccgccaaaggtatcggtttcagcatcgctactgcctttgctcaagccggaggtaatgtaatcattacctacctcaccaccgatcccactgaaaaggccaagaaactggccgaggagacgggtgttcaagttcataccctcaaaattgacatctctcgctctgataccgtcgaggccggcgtcgaggaaattcaaaaaatctttaaggagattcatgttgtcgtcgccaacgccggtatgcccttccgtaggtccgttctcgattctcctcctcatgaattcgaaaaggttatgaacattaacaccaattccgtctatcgcgttgcctattacatggggaaaattttcaaaaagcaaggtttcggaaatttgatcgcaactgcctccatgtcggctactatcgtcaacgctcctcaacatatcgctgcgtattgtgcctccaaggctgccgttcgacaactttgcaaggctttagccgttgaatgggccgaatttgctcgtatcaactcggtctctcccggatacttcgctacggacatgcctggctatgaatttttaaaacaatgggaaccctatgttccctttaaacgtcttggtttgactcccgagttacgtggtacctatctctatctcgccagtaatgcttcttcctttgttactggtttggatttgattgtcgatggcggttatacttgtctt

SEQ ID NO: 46458 - DNA, 915 bp, Schizosaccharomyces pombe
atgtttgacttggatgaatggatcgctacagtaaggaagtgtaaatatcttccagaacaccagttgaaacgattgtgtgagatggtaaaagttattttaatggaggagtccaatatccagcctgtgcggactcccgttactgtttgtggtgatatacatggtcagttttacgaccttttggaactgtttcgagtaggtggagaattgccaagcacaaattatatatttatgggtgattttgtggatcgaggttattttagcttagaaacttttacgttatttatgcttttgaaagcaaggtacccagataaaattacattgcttcgtggtaatcacgaaagtcgccagatcactcaagtctacgggttttatgatgagtgtcaaaccaaatatggaaatgcaaatgtttggaaatattgttgccaagtttttgattttttgactttggcagcggttatcgataacaaaattttatgcgtgcatggtggattatctccggaagttcgcacattggatcagattcgtattcttgcgcgtgctcaagaaattccccatgaaggctcattttgcgatttgatgtggtctgatccagaggatattgaatcttggactgtttcgcctcggggagctggatggttgtttggttctaaagttactaccgaatttagtcaaatcaacgacttgacattgattgctcgtgctcatcaacttgttcaagagggctacaaatatcattttgccgataaaaatcttgttaccgtttggagtgctcccaattactgctatagatgtggaaatgtggcaagtgttatgaaagtagatgaatctttggaaccggaatttcgtattttctcggctgttgccgacgaagatcgtaccgttccccctagcagaaaaagaagcgagtatttcatc

SEQ ID NO: 46459 - DNA, 1950 bp, Schizosaccharomyces pombe
cacatcaatatgagcaaatcaatcggaattgatttgggtactacctactcttgtgttggacacttttccaacaaccgtgtcgaaattatcgccaacgatcaaggtaaccgcactaccccttcttatgttgcctttaccgataccgagcgtctcattggtgacgctgctaagaaccaagtcgccatgaacccccacaacaccatctttgatgccaagcgtttgatcggccgtaaatttgatgatcctgaggttcagtctgacatgaagcactggcccttcaaggtcatctccaaggatggcaagcctgttttgcaggttgagtacaagggtgagaccaagacctttacccccgaggaaatctcatccatggttttgatgaagatgcgtgagactgctgaggcctaccttggtggtaaggtcactgacgccgtcgtcactgtccccgcctatttcaacgactctcaacgtcaagccaccaaggatgctggtcttattgccggtttgaacgttctccgtattatcaacgaacccactgccgccgctattgcctatggtttagaccgtagcaaccaaggcgaatccaatgtcctcattttcgatcttggtggtggtacttttgatgtttctcttcttaccatcgaagagggtatctttgaagttaaggccactgctggtgacactcacttgggtggtgaggactttgactcccgtcttgtaaaccactttatccaagaattcaagcgcaagaacaagaaggatatcaccggtaacgctcgtgctgtccgtcgtcttcgtaccgcttgtgagcgtgctaagcgtactctttcttcttctgctcaagctagcattgagattgactctttgttcgagggtattgacttctacacctccattactcgtgcccgttttgaggagctttgcgccgatctcttccgtaaaaccatggagcccgtcgagcgtgttctccgtgactccaaggtcgacaaggcctccgtcaacgagattgttttagtcggtggttccacccgtattccccgtgttcaaaagcttgtctctgacttcttcaacggtaaggagccttgcaagtccatcaaccctgatgaagctgttgcctatggtgctgccgtccaagctgctgtcttgactggtgacacttctgagaagactcaagatcttttgttgcttgatgttgctcccctttccatgggtatcgagactgctggtggtgtcatgactccccttatcaagcgtaacactaccatccctaccaagaagtccgagatcttttccacttactctgataaccaacccggtgtgttgattcaagtgtttgaaggtgagcgtgctcgtaccaaggactgtaacttgcttggtaagtttgagctttccggtatcccccctgcacctcgtggcgttcctcaaattgaagtcacttttgatgttgatgctaacggtattttgaatgtctctgctctcgagaagggtactggtaagactcagaagattaccatcaccaatgacaagggtcgtctttccaaggaggaaattgaccgtatggttgccgaagctgagaagtacaaggctgaggatgaggccgagtccggtcgtatccaagccaagaaccacttggagtcttatgcttactctcttcgtaactctttggatgatcctaaccttaaggacaaggttgatgcttccgacaaggagaccgttgacaaggctgtcaaagagaccattgaatggctcgacagtaacactactgctgccaaggatgagttcgaggccaagcaaaaggagcttgaaagtgttgctaaccccatcatggctaagatctaccaagctggtggtgctcccggtggcatgcctggcgccgctcctggtgctgctcctggtgctgctcctggtgctgcccctggtggtgacaatggtcctgaggttgaggaggttgat

SEQ ID NO: 46460 - DNA, 576 bp, Schizosaccharomyces pombe
atgagtttgcaaatcggtaaacctgctcccgacttcaagggtactgccgttgttaacggtgctttcgaggaaatcaagttggccgattacaagggtaaatgggtcttcttgggcttctatccccttgactttacctttgtttgtcccactgagattgttgctttctctgaggccgcctccaagtttgctgaacgtaatgctcaagtcatcttgacctccaccgattccgagtactctcaccttgccttcatcaacactcctcgtaaggaaggtggccttggtggcattaacattccccttttggccgaccctagccataaggtttcccgtgactatggtgtcttgatcgaggatgccggtgttgctttccgtggtcttttcttgatcgaccccaagggtgttttgcgtcaaatcaccatcaatgatctccccgttggccgttctgtcgacgaggctctccgtcttctcgatgccttccaattcgttgaggagcacggtgaggtttgccctgccaactggcacaagggttccgataccattgacaccaaaaaccccgagaagtacttttccaagcac

SEQ ID NO: 46461 - DNA, 3436 bp, Schizosaccharomyces pombe
atggaaaagcggaatgagactggtaataatcgattaaaaaggtctaataacagagggaaatcgaagaaggattggaaagacgcctctgtggaaacaacgccgcgagaaacttcagtcgacgaagataatactagtgttttcgaggatgtggaagcacaggacagtcgacaaaaacggttctcttctacgttagaaggaaacaggttcgaagaattgagaagtcttcgtgagaaggaacgtgaagtagcaatccaaaatggcttaatcgatgatcctacgaaaccaagacaactagatgaggccgtaacgtttgttggtacttgccccgatatgtgtcctgaatatgaacgtgaacaaagagaatatcaaaataatttggaacggtgggagattaatccagaaacgggtcgtgtcgataagaatcttgctgtaaaggcttttcatcgtcctgcggccggtaatgagcaagcgttaccctcagatgttcgaccacctccagttttaaaggtttgattttttttttcttactaatcctcttgattcgcaaatttatttatatatgtatttccaaaaagcttttcaaaggttcttactagatttgagttcgatatgaattctagcctccagcttaaattctacctttctatatttatataattcattttgcgattctaggatgttatctattttttctttctcagttgcatttttattcacacatgacttagaaatcgctcgattatttggttgataaaatagtctgtggtcctgatccacttgagaatacacatttctttgtacgtgaccgtactcgatctattcgacaggattttacacttcagaattgtcgtgatttggatgcagttgcttgtcacgaacgtatagcccgatatcatatattatgtattcatcaactgtgtgagaagaaacaatttagcgctcaacaagaagttgaacagttacgaaaaggtagtaaacttaaaatgctgattttgtgggacttgaattttttatgagcattttagttagcagcactctttcttttcatatattttatcatactaaccttttagtattgcaatctttatgtgaattttatgatgatttaagaaaagttaaaattcgatgtccaaatgaaccagaattccgaagttatgcaattataacgcatttacgtgatccggatgttgtcagacaatcccaaatcctaccaatagaaatatttgacgatcaaagagtgcagctagctcttcgattgtcagcgctggcgcaaaaaaataatgagcgggttggtcatatccttccgcgaaacaccgaagcatgtcctaatctttacactcggtttttcaaattggttcaatctcctgccgtaacatatttaatggcttgtcttttagaatctcacttcatgtctattcgaaaaggtgctctaaaagccatgcgtaaggcatttatgtcagcccatgccaatttcccctgtggggatttgaagcgtatactacattttgatactgtagagcaagccgcttcgttttctcggtactacggactagaagtctctgatgataatggcgagctcagtataaatctgaataaaacagcattctttaatggtatgtgatttataaattacaggactaactcataagattccaaacctgattttcgacagttgttttcacaaacacttgtcgagtccaaacttcaaaatcgctcatttgctgatattataaacggttctcgttacaatatagaccgggtttctccgaacacagctttttcaactaatattcctttatcattgccattcgctaataaagagccacaacctattgctggttttaaaaaaaatacacctgagacttcggtagtatcaaagaaccttagtacttttaatgggaaatttaacgtaaatgctcctgtttttactcctcgatcttttcctactaaacctttttctgctactgacatttcgtcagtccaacccacaaacctaccaaatggatccactaacggtacggaaacatttattcctcctgttcaaaattcaatcacctcaaataaggaagctgtgaaacctattaaaaataagccaaaacctatttccttcgagtctttatctgctgtaggtaatttaatcatatctgattccctctctcgaatagttcgtcaaattttgcaaaacttatacactgaatgggttcatgaaaaaaccaatttagtttttgcaactatgttccgtactattttccgagaagttttgcttgatggtattgcttctgaggtatatctaaaatctctgaaaaagcatgctatatcacagatctccgttagagctcatcattcgtgggtaaaaaaacaagaaaaaatgatgttggagatgcgtgagaaaaatcgtcaagaaaagtacttttctgttttgaattctgtagtcaaggctgaaagttcaaatataacaaggctgcctataaagagaacgttttatggggataccaggaatcttgataaagcttcggaaaaattgcgcgctgaacacgatcgaactcgcagattgtggaaaccagtattaatggattcacttttttctaatttacaaaaatttcctgtatatgaagattggcatttattgatttttaatgcttccacaagttcaatgatgaaaacatggctgtgtgccaagttcagcttgaaagaaactaacaaaacatcattttggcattcttcgtataatttattcaatcggcaatatcatgttgatatgccggataatgtatcagatttaccccaaactaggctatgttatggtgcttgcgtttataatgttggtttacttgatgaagagaaaagaaaagatttagctaattcagacttgaattcgtctccgaaactcattcaaggcaatgatagtcgaagtgcgcatgaatcctcggcaaataaactattttcttttgtgcatgatatttcgaggttaacaattacgaagctaccacttttgttaattttttggtccgacagtaatttggatatgcagggaatcacacaaaaataccgctttttggaactgattacttccacctggtcagcaatttcaagcattcatgttttaacaataacaaatgatcgagacatggatttggagcacagtttgaaggtattattagacaatgttacggttgaaaaatcaccctttgcccaactggaggaattggaagtagtgcgcaagaaaagagaggcagaaattgaggcaagttctaaaacggttaagagactcgctagcaacaataaatttctaacggattccaatgttgaaggtttattagaggccccgacgagtcttgaaaactcgttagtggaagacgataaatgggcatcgctacgacaaaaaataaaagcagctagagatctcttgaaaaaggttgaaactttttattaatcc

SEQ ID NO: 46462 - DNA, 1167 bp, Schizosaccharomyces pombe
atgaatagtacagaggaaattgatttgtacaatcgctggaaagcgctagagcgccaattagaaatgctggatttacaagaaggattcatcaaagaagactgtaaatcactcaagcgagaattaataagagcacaagaagaagtgaaacgaatacaatctgtgcctctagtaatcggacaattcttggaggccattgatcaaaatactgctattgtaggaagtacaactggatctaattatgtcgttcgtattttaagtacacttgatcgagagcttttaaaaccttcagcaagtgtcgctcttcaacgacactcaaacgctttagtcgacattttaccaccagaagcagattcatctatttctatgcttcgtccagatgaaagacctgatgtttcttatgctgatgttggtggtttagatgttcaaaagcaagaagttcgtgaagccgttgaattacctctaacacaaggcgatctttatcgtcagattggtattgatcctcctagaggcgttttactttacggtcctccaggtaccggtaaaacaatgcttgtaaaagctgtggccaactcaacagctgccaactttattcgtgttgttggatctgaatttgttcaaaaataccttggtgagggtccacgtatggttcgagatgtatttagaatggcacgtgaaaatgctcctgctattatttttattgatgaaattgatgctattgctacaaagcgttttgatgcccaaaccggtgctgatcgtgaagtccaacgtattttgattgaacttttaacccagatggatggttttgatcaaggtgctaatgttaaagtaatcatggctactaatcgtgccgacactctagatcctgctcttcttcgtcctggccgtttagatcgaaaaattgaatttccttcctaccgcgatcgtcgccaacgtcgacttgttttccaaaccatcacagctaaaatgttgctttctcccgaggttgacttggatacatttattatgcgaccagatgcatctagtggtgctcaaattgctgccatcatgcaagatgcaggtcttttagctgtgcgaaagagtcgtggcgtcatccttcaaagcgacattgaagaggcttatgctcgtgccgttaagcctacagatatggaacagtttgctttctataaa

SEQ ID NO: 46463 - DNA, 1888 bp, Schizosaccharomyces pombe
atgcgaaatacgcacaatccgaatgaaactgaagcatcagaagatgcagaaaatgatactcaaagcgaatccgaccttagttttgatcatggatcaagtgaaaaactaaaccgagcttcattaccaaagacgcaaaatagtgccatcccgcagtctaatgctttaaatactacaccaaatgagtcaacgtctcagatcgattcatcgccgaagattccctctgcagtcccacatatctctactccaaatccgtctagcggtgcatcgactcctaacataaaacgagtttcggattttaaatttggcgaaatccttggagaaggatcatacagtactgtattaacagctaccgaaaactcaacaaaaagagaatatgctattaaggtgttggataaaagacatattatcaaggaaaaaaaggaaaaatacgtcaacattgaaaaagaagctttgtgcatcctctctaagcatcctggatttattaagctattttatactttccaagatgctcacaatttgtattttgttttgagtcttgctcgaaatggtgaactgttggattatatcaataaggtatgtataaataatgttcatgcagcttgatgatggatagcttactgattattacaatcttgtcttttttcttattaaatgttttattttttgcttacacataatttagttgggacgatttaacgaaatatgtgcacaatattatgctgcacttatcgttgactcaatagactatatgcatggacgaggagtgattcaccgtgacttgaagcccgaaaatattttgctggatgataatatgcgtacaaaaattaccgactttggttcagcaaaaatattaaactcttcacatggcagtcatgaagaagacacacaccatgctgacaaaccacaggctcattctcgatcgtttgtaggaactgctcgttatgtatctcctgaagttttaagtgataaaattgctggtacggcttccgatatttgggcgtttggttgcattcttttccaaatgctagctggcaaacccccttttgtagcaggaaatgaatatttgacattccaaagtattcttcatttgagttatgagataccacctgacatatcagatgtcgcttctgatttgattaaaaaactgctagttctagatcctaaagatcgcttaactgttgatgaaatacaccagcatccgttttttaatggtatcaaatttgataataccctttgggaacttcctcctccccgtcttaaaccttttggtcatactagcgtcctcagcctttccgttcctaatgcatctaacaaacacgaaaatggtgatttgacctcgcctcttggtgttccatcgatggtttcagcatccaccaatgctgcaccctctccggttggtacttttaaccgaggcactctattgccgtgtcaatccaaccttgaggaggaaaacaaggaatggtcgagtattcttcaagacgatgaaaaaatctcaaaaattggaaccctcaatgtttatagtatgtctggtatcaatggaaatgatgcctttcgctttttctccagtctttttcgaaaaaggaaacctcggacctttatacttacaaattttggtcgatacctgtgtgttgcctcggacggtgaagggcgaaaaacagttaaagaagaaatacctattaagagtgtaggcatgcgttgtcggatggtaaaaaacaatgaacatggctgggtagttgagactccaacaaaatcctggtcgtttgaagacccgaatggaccggcttctgcttgggttgagcttctagataaggctagctctatttctcttccattcggtaatcattctgttaccagcttttcaagaagcattgctagaagtgctgtctaa

SEQ ID NO: 46464 - DNA, 2052 bp, Schizosaccharomyces pombe
gattgtttaaagaattttgcaattggaaaatatgccattttatttgtgattgaagtttctcccagtatgcttgatcctgtcgatgaatttactcccagctctttgcagatggcacttatttgtgcgtaccagctggcggctcaaagagtaatcacaaatcccagcgacataatgggtgtattgctctatggtactgtaagtttaatgctgcatttaaattcaccgacgtttacttctgccattaaatgtctctaaccacagcgcaggagtcctctacgggccgattcgcaaatcaaatgatgcttttagacattgatcctcctgatgctgaacgtattaaaagcttacaaagctttgaaaaaggtaaaagcttttaaccgattactttctttcatgctttttccccactgattactaattttgttcaattgtttaagatttccaattctcaaaagaaaaattcaaaccatgctcttgtcaagtttctctgtctagtgtactttatcattgcagtgttatatttactactaaagctgaaaattttgaaaaacgcttatttttaattacagataatgaccatcctgcttgggatgcaactgaacgcgatattattttgcagcgtgctaaagatttaagggacttggatattcaagttcatccagtatttttggatccgcctacacattcctttagaataaacatattttattctgactttttatatatcgtttatggtaggcaagatgtgtctaatctagtcaacaggggtcaagctcagctgcaacatatgctcaatatgattacagctttacaaaaaccgaaaagagctcattttcatttgaaaatggatcttggtaacgacgtgagaattggagttgaggcctttatcttgttgaaacgtttagaatcagccaaaactaattgggtgtatgcaaaaggtgagcgatttgccgtagcagttcctcaaagcaaacaagtcagttttgctacgaaaaaggagcttaaaaaggatgaaataagaagatcgtatagctacgggggatcatctgttgtctttggctcagatgaacttaacaaggtgagatcatttgagcctcctacattacggataattgggtttcgtgacttttcaactctaaaaccctggcactgcttaaagcctgctgtatttttgaggccgaaagatgatgaaataattggaagtggtgccgttttctccgccatccataaaaagctgctggcttcaaacaaaattggtattgcatggtttgtttcgagaccaaatgctaacccttgttttgttgctatgctagcgacaccggggtctattcacattcgagacgattttgaattaccgctaggtatatttcttgttcaacttccaacagcagatgatatccgtagtctcccgcctatcaatccgaatccgatatccatgcctagcaatttaatcgaaacgatgcaacgtattttacgtggtatggagctgcgttcataccagccaggaaaatataacaacccatctttgcagtggcattacaaagttctccaagcgctggcgcttgacgaagaaattccgactgactttgttgataatactctaccaaaatacaaagctattcaaaaggtatgaaagctttagttgccttgtacaaccatgttaacattttagcgcgtcggggagtacatgggcgatgttaataatattgtcgctgaatatcgtaacgatatttctgataaaaacggaataaaagaggaagaagaggatcagggaccaattgtgaaaaaggctcgaatagaaaagagtggaaaacctatatttgctgaagatgatcgtctgaagcagctttacatcgaaggagttttggacaaggagataaaagtaagtacttcatttatcttgtaagatcttgattagtaacagttcatatgaaggcgttaaaagttagtcaacttaaagatattctcagggatcgtggacttagagtgagcggtaaaaaggcagatttattagacaatctaacgaactatgtcaaaaaattataaacaaga

SEQ ID NO: 46465 - DNA, 1527 bp, Schizosaccharomyces pombe
atgataattaaaaagaaagaatcatttaaatctcctggaagactatggagggtcacaaaaataagaaaactcactgccgcaaaaaaaaatgaattacaaaatagaaaatgtaatcaggcttcgaacgaagaaaaaaaaattttatacaaaagtaactttttagaccgtttcattccttcaaaagcaaattcggatgctttccgaattatggagaacgcgtttaccgaaaagctcaacacccaggagagtctgctacccgatatattaaacttgaatgtcaaaggagtattgcattataaagacaacaaaaagcaaaaaacgactcgtttaatagagagtacaaactaccaaagacaaacgatacacggtgcttctagttcattggtaatagaagtagaagaaaatggacatttatcaaatatgcaaggaagtttatatgaaacacctttacgaatcctagacgctcctggtttactggatgacttttatatttctcctttggcatggtcaactaatggagaattagcagtcgccctagcgcaaaatgtgtatttgtggagtgaaatctctggaccttccataatggaattgagtcctacgacatacgaggtaagcagtttggcttactcatcagacgggggttttctagcaattgctagagtgaacggctttgtggaaatttggaatcgaaagacaaaaaataacaggtgcgattataaatttcatcatgatggagacattagctgcatggcttggagcccaatcaattggactctcttagtaggaggcagtacagggaacatatacgtttaccgtcgaacaaaaagcatgatgcgtagagttcacactatcaaaaaagtccatcaagaacaagtttgcggattggaatggaactacgatgggactcagtttgcaagtggtggaaacgataacctggtatgcatttttgacatcgattcgctagagaacaaaaagttttactggattcacttggctgctgtcaaggctctggccttttgtccttggcaaaaatcattgctggcagttggtacaggttctaatgatcagcaaatttatttttacgacacgtttcgagggcaccgaatccacagcttgttctgtggtgcacaagttacctccgtcatttggtcaagaagatataaagagttttgctatagtttgggctattctccagaagggactaactctagtttaattgtctatcgatggcctcaactgacaaaagttttcgatattccatctgcagcaattgatggttggggacaggatttgagaacgatcatggcgatacacacgcatcgcaagtactctaacaatacttgggaagagggtgaatacgttgtggttgctaacagcgatgaaacagtaaaattttataagatttggggaaacgaaatgcaagagattcataatgatagagttttgtaccgagaaggaatattcggtagtcatatcttagaaatgctggaaaacattcctgagcaagtgttaactaatggtgttcgt

SEQ ID NO: 46466 - DNA, 1189 bp, Schizosaccharomyces pombe
atggcatccaattcgatcaagatttttgctggaaactctcatccagagcttgcggagaaagtcgcgagaaggtatgagttggttcggtagctctacgataaaatttgagggtttcgtagagctggtgaaaaatgtgaaagaaacgctcctgtagtctgggaattgatgggcgtttggtgaatttcatgaatagttaatgaactaactaaaaatttgtaaatagaattggccttagcttgggaaaggttgctgttgttcaatattcaaatcgtgaaacttccgtcacaattggcgaatccgttcgtgatgaagatgtgtttattttgcaaactggatgtggttctattaacgatcatttgatggaacttttaattatgattaatgcttgtcgttctgcgagcgcccgtcgtattaccgccattattccctgtttcccctatgctcgacaagacaaaaaagataaaagtcgtgctcccattaccgctcgattggttgccaatatgctccaaaccgctggttgcaatcacatcattaccatggatttgcacgcttctcaaatccaaggtttttttaatgttcccgttgataatgtatgagtgcaaagatgacgttgtttgagaactatttgtctttatatgtattctaacatactatttagttgtatgccgaaccttctgttttacgatatattcgtgaaaacattgataccaccgtgaaccctactgtcatcgtatccccggatgccggtggtgctaagcgtgcaactgccttggcggatcgtttagaccttgattttgcattaattcacaaagagcgtcagaaagcgaacgaggtgtctcgtatggttttggtgggtgacgttcgtgataagcttgccattcttgtagacgacatggccgatacttgtggaacccttggtttggccgccaagactttgaaagataacggtgctaaggctgtgtatgccattgtaacccatggcatcttgagtggtaaagcaattaaagttatcaatgaaagtgctttggaaaaggttatcgtcaccaacaccattccccatgatgataagcgcagtctttgcagtaaaattgaaaccattgacatttctggtgttttggcagagtgcattcgtcggattcatcatggtgagagtgtttccgttctttttagtgtcgctcctgcataggtt

SEQ ID NO: 46467 - DNA, 1299 bp, Schizosaccharomyces pombe
atgttaaccagaagtgtgctgagaaaagcacctcgcgctttttctccctttttacaaaaaagaaatctagctttacatgaatatatttctcatgatattctcagaaagtttggtgtggacgttcctcgtggtgctcctgctcggagcggtgaagaggcagaaaaggttgctcgtgatcttaaagtcacagatttggtagttaaagctcaagttctagcaggcggtcgtggaaagggccaatttgacagtggcctgcgtggaggagtacggcctgtttatgatgctacagaagcgagaatgtttgctgaacaaatgatcggtcataagttaattaccagacaaactggtcctgctggaaagatttgcaatgttgtctatgtttgcgagaggaagtttattcgtaaagagtattacttcgctattttaatggatcgtgagaaccaatgccccatgatagtcgcctccgaccaaggaggtgttgacattgagactgtagcagctgaaaatcctagcgctatcatcaaacgatctcttcccaacagtccaaatcttgaccctcatatcgcagaagaacttgttgacaaactcggcttttcctcttctagcaagccaaaggccgttgacgcaatcgtcaaactttacaaagtattcaatgattgtgatgctacacaagtagagattaatccccttgctgaaactactgatcacaaggtgttgtgcatggatgctaagctgaactttgacgataatgccgaatttcgtcattccaacattttcgttttgcgggacatttctcaagaagatcctgatgaggctagggctgccaaggttgggttgaactttatcaaattggacggtaacattggttgtttggtcaatggtgctggtctcgcaatggccactatggatatcatcaaacttcatggtggtgaacctgctaatttccttgatgtcggtggtaatgctaatgctgaagcaattcgtgaggcattctctctcatcactaatgatcccaaaactactgctatctttgtgaacatttttggaggtattgttcgatgcgacgttattgccaaaggtcttatctcggtagtatcagcgttgaatctgaacatacctattatttgcagacttcaaggaaccaaccaaggtgctgccaaagaggtaatcaacaactcaggtctccgtattttctcatttgatgatcttgatgaagcagctaagaaggcttgtcgtttcagtcgcgttgtcgaaatggcacgtgaagccgatgtgaatgttagcttcgagctacctttg

SEQ ID NO: 46468 - DNA, 3849 bp, Schizosaccharomyces pombe
atgtttgctgttcaagggaatcagaaatttccgaaagggttgaccaaggataatatacaatctctttatcaacaatggcaggtaatgagaaaccaaggtgctacggaggaaaataaccccgagtttgctcaaattagttccattttaaggatggttcaaagagctcattatgcccgtatgcagcagatgcggaaccaatcttctgaatttcctgatgctgagaacaccaatcttcgaaagcagcaggatactcttcctactacaggatttaacaatctcccagaaggaaaagctggtatgcaaactcttcctggtaggcctgcttctaatggaccaacccctcctaaccctggcaatggaaatgtcggattaaacaatccttcctacatgaatagtcaagcatcgccaaacattatgaatgctcctttacaaagggatacttcagtacctcctgcacctagtatggttcatccacatacaaatacgaatgcgaatagtaataatttgaaagtgtatgcgaaccaactatcccaacaaaacacctccaatcccacttatcataatgcttatgatatggcatccatgatgaaaaatggttctcgtatgaataactcttttcctcctaccacaccttatccacctgctaacgacactactgtcaattcctctcttcctcattcctttgcctccccttcgtccacatttgaacaaccacatacagttcaatcgagagctccgtcagttgatacaacatcaagttctcacagctttagtgctaggaatatacctgctaatgtctcgatgcagcagcaaatgggccgaagaggctcgatacctgtaaacccatcaactttctcagcttcttcccctccgtctggttctatgttggcttctccatacaacgggtatcagaatgatgctgcttcctttgctcattcgaagctcccttcttccgcaaatccaaatactccttttaactctacggctactgtagacgttggtgcagccggttcgcattttccctatcctcagccctctaaccttgatgctattaatgctaaaacatactttcaatcttcttctaattccccggcaccatatgtatatagaaataacctaccgccttctgcaacttcttttcaaccttcttcatctcgatcaccttcagtagatccaaatactgtgaagtctgcgcagcatatacctcgaatgtctccctcaccctccgcatcagctttaaaaacacaatctcacgtaccttctgcaaaagtgcctcctacttccaaacttaatcatgctcaacttgctatgctgaaaagtcagatagttgcatataactgtttgaattccccaaatggacaagtccctcctgctgtgcaacaagccatatttggcagggtctatggagcttcgaatgaagtttctccttcaatgccatttcagcaaaacgttcctcaaatgtcgtctgtaaagaaggatactcctacaagagatgcaaacatgcgtacctctaaggcaccctacattcagaatattccaaatcaatttcaaagacgagcctattctgctacgattcctgtcaagaatgagtctcttgcaaaaccatcagtttcacctatgccgttacaacagtcgactggaaaaaccgaggttgctaaaagagcacagtttcccacaaacgtcaactactcttcttgcgtagatccaagaacttatgttaaaacgcctattcccttcagtaagttttcctcttcggaaaacctatcgctcatcccatcactcttgcctcctagtatatcatgggatgatgtttttctctcttctgagattgcaattgcttgttcaattgctaacagaattgattttctagaaaaggagaacaggccaaagtcggtgaacaaaaaaatattgcaacaagacaagtcaaaatcaatgattgagttgcgttgtctgcgtttattagaaaaacaacgatctctacgcgagacaataaattcagtcattcctcactcggatagtttggctgcaggaaatttaagacttatgtttcgaaacgtgaaacggcaaacgatgcaagaagccaatttagttttagcccttgctgagaaacaaaaaaccgaacatgccatgagacaaaaagaaaagcttctaactcacctaaggtctatcatgctgcacagaaagtcaattgtgacaaaagtggacaagcagaataaagctaaaactcagcgatgcaaggatattataaattttcatgcccatctagaaaaggaagagaaaaaacgaatcgaacgtagtgctcgtcaaagattacaggctctccgtgctgatgacgaagccgcatatttgcagttactagacaaggcgaaagatactcgtatcactcatcttttaaaacaaactgatcagtatttggaaaatcttacacgtgccgtccggattcaacaatccaatattcacagtggaaatacttctggaaaaggtagcaattctgccgaattagaagccccaattagtgaggaagataagaatcttgattattttaaagtggctcaccgtattcatgaagaggttgagcagccaaagatttttgttggtggcactctaaaagactatcaattgaagggtcttgaatggatgttgtcgctatacaataacaacctcaatgggatcctggctgacgagatgggtttgggtaaaacaatccaaactattgcgtttatcacatatttgattgagaaaaaaaatcagcaaggaccatttcttattatagtaccattgtctactctaacaaattggattatggaattcgaaaaatgggctcccagtgttaagaaaatagcttataaaggccctccgcaattgagaaaaacattacaatcccaaatccgatctagcaatttcaacgtcttgctcaccacatttgaatatatcattaaggatcgtcctttactttctcggattaaatgggttcacatgattatagatgaagggcaccgtataaaaaatacccaatcaaagttaacgagtactttatctacttattatcattcccagtatcgtctcattttgactggtacacctttgcaaaataacctaccagagctttgggctcttcttaactttgtcttaccaaaaatcttcaattcaattaaaagttttgatgaatggttcaatacaccttttgctaatactggtggacaagataaaatagggcttaatgaagaagaagctttacttattataaaacgtttgcataaagtccttcgaccatttttgttccgaagacttaaaaaagacgtcgaaaaggagctacccgacaaggttgagaaagtcatcaagtgccctctttcaggcttgcaattaaaattgtaccaacaaatgaagaagcatggtatgctttttgtggatggtgagaaaggaaaaacgggtattaaaggactacagaacacggttatgcaacttaagaagatatgcaatcatccgttcatatttgaagatgttgaaagagccatcgatccatccggaactaacgtcgacttgctttggagagctgctggcaagtttgagctgttagatcgtattcttccaaagctgtttttaacaggtcataaaacccttatgttctttcaaatgactcagatcatgactataatggaggattatttgcgatcaaagaattggaaatatcttcgtttagatggttcaacaaaatctgacgatcgatgctcccttcttgcacagttcaacgatccaaagtcagatgtttacattttcatgcttagtactcgtgctggtgggttgggtctcaacttacaaactgctgacactgtcataatttttgatacc

SEQ ID NO: 46469 - DNA, 589 bp, Schizosaccharomyces pombe
tccaatgaggagatagaaagaattcgcaagcgttttattaaaatagatgctaaccaatctggctctattgaccgaaacgaatttttgtcgattcccagtgtagcttctaacccacttgcttccagactgttttcagttgtagacgaagacggtggaggagatgtggactttcaagaatttattaatagcctttctgtattttcagtgcatggcaataaagaggaaaagctgaagtgtaagctcaatcaacttgtcgttcctttgcaaattatgttctaacattattgttttatctagttgccttcaagatttatgatattgaccgtgatggttatatttcaaacggagaactttatctagttctgaaaatgatggttggcacgaatcttcgggaagatcaattgcagcaggtatgttatagacaaaacctcttatctcaaaatctgactcctattataactagattgttgacaaaaccattatggaagttgataaggatcgcgatggaaaaattagctttgaagagttcaaagatattgtcagcggttccaacgttactagtagcatgacactcgattctttttgatga

SEQ ID NO: 46470 - DNA, 1137 bp, Schizosaccharomyces pombe
atggtagcagataccaaattatacgattgtttggaggtccgccccgaggcctctgaggcagagttaaagaaggcatatcgaaaacttgcacttaaataccatccagacaaaaatcctaatggtgagaagaaatttaaagaaatttctcttgcttacgaagtattgagcgatccccagcgccgtaagctttatgaccaatacggtatcacagaagggaatgctgctccaccaccaccgggtgctgaaggtggccctggtgcaggctttggcggcttcccaggcgccggacctggtggagctcgaacattccactttaatatgggtggcccaggtggagctcaatttttcagtgccagtgatccgaacgacatttttgaaagagtatttggtcatgcctttgctggcggtggaggcatgggcggaggaatgggtggaatgggtggtatggacgatgatatggacatggatggaggttttggtacgcggactcgtggaggtggtatgcctggcggattcgctaatatgtttggcggtggtggagcaggtcctcacgccagacgtagccatccatcttttggtggatcccgtcctagtcaaccccccgctcaaaacgaggttatcactcgaccccttaacgtgagcctggaggatctatttaccggatgtaccaagaagatgaaaatatctagacacataattgatgcttctggtcaatcggtgaaagcggaccgaattttggagatcaaagtaaagcctggatggaaagctggcactaaaatcaagtttgctggtgagggtgatgagaaaccggacggaactgttcaagacattcagttcgtgctagctgaaaaacctcatcctgttttcacacgctctggtgatgatctccgtatgcaagtagagctatccttgaaggaagcacttctgggcttttcaaagcaaatttcaactattgatggaaagaagcttaaagtatcttcgtctttaccaactcaacctggttatgaaattacgtatcctggattcggtatgcccttgccaaagaatccttctcaacgtggtaatatgatcattgagtgcaaggttaaatttcctaccgaacttacgcctgctcaaaagactgctgcagaagccttt

SEQ ID NO: 46471 - DNA, 417 bp, Schizosaccharomyces pombe
atggttcgcttcaaatcccgatatttactttttgaagtattatatcctgaagcaaaagagttttttgactatcctactatcccttctgatagttctataactacgtctagtctttctaaaataattagaaccatggttgcagaaaatttcggtgatgttggtattggaaaggttgcatctagtctaactgtaaaatatttttcacctaatacatctactggcattctgcgggtctcaagacagcattttcgtttggcatgggccgcattagttttaataagggaattatatggcaagcctgtaataattcgcgtggttcgtgtatctggtacaataaaaaaggcagaattagctgccattgaacgaaataaatcagaaattcataacatctctctgatggatgaacctattgaagtt

SEQ ID NO: 46472 - DNA, 4613 bp, Schizosaccharomyces pombe
gttgttgcgaaatgtagtcaatgctggattccagatgagcaaagccaatggatccctggaagcataaaggattgtcgagttgaaggtgagaaagctttcttaacggtacaagatgaaaacgaaaacgtacgaaaattattattttctttggtatcccttttgggtcaattgagattaattagctaatgtgatcttgttaggaaactgttattacagtgaagccagacgatttaaattatgaaggaagaaacggcctcccgtttcttcgatccattaactcggatgctgatgaccttactgatctttcatacctaaatgagccgtcagtgttggatgctttgtcaacaaggtacaaccaacttcaaatttatacgtattctggcattgtccttatcgcagtaaatccttttcagagactgccaaatttgtacactcacgaaatagtacgtgcttattcggagaaatctcgggatgagctagatccccatctctatgctattgctgaagatagctacaagtgcatgaatcaagagcataaaaatcaaactattattatatctggtgagtcaggagcaggaaaaactgtttccgcaagatacataatgcggtattttgcttctgtgcaagcacttattcaatccaccgattccaattttcatgaagctccacaattaactgctgtcgagaatgagatacttgctacaaatccgattatggaggcttttggtaattctaaaacttctagaaatgacaattcttctcgctttggtaaatatattcaaattttgttcgacggaaatgctacaatcattggtgctaaaattcaaacttatcttttagaaagatcaagattagtatttcagcctaatcaagaaagaaattatcatattttctatcagattttagctggttcatcctcggaacaacttgaaaagtggaaacttgttgagaattctcaagaatttaattatttaaaacagggaaattgttctacaattgagggcgtcaatgataaagaggaatttaaagctacagttgatgcattaaaaacagttggcattgataatgatacatgtgaatgcatatttagcttattagctgcattgctgcatatcggtaacatagaggttaagcattcaaggaatgatgcatacattgattcaaaaaacgaaaatctgataaacgctacttcattgttgggcgtggatccttcttcattggtgaaatggttaacgaagcgtaaaataaagatggcctctgaaggtattttgaaaccattgaacgaatttcaagctgtagtagctagagactcagtagcgaaattcctttacgcttcactcttcgactggctggtagctactattaataaagccttgatgtactcagctgataaatcgaaccagacggctaaaagttttattggtgttctagatatttatgggttcgagcactttaaaaaaaattcatttgaacagttttgcatcaattatgcgaacgaaaaacttcaacaggaattttatcgccatgttttcaaactggaacaggaggagtatgctgctgagggacttaactggtcctatattgattatcaagacaatcagcaatgtattagcatgattgagagtcgtttagggattctttcccttttagacgaagaatgccgaatgcccacgaacagcgatgaaaattgggttagtaagttgaacgatgcattctccaagccagaattcaaaaatagttatcagaaatcaaggtttggtaacaaggagtttacaattaagcattatgctcttgacgttgtttactgtgccgaaggatttattgataaaaaccgtgatacaatatccgatgagttgttggagctttttacaaattcagacgttccctttgtcaaggatctggttttattccgtcttgaacaaactgcacccccagccgataccaaaaaaataaaaaccaagccaaaaagtaatactcttggttcaatgtttaaaagctctttggttagtctaatgagtaccatcaacgaaactaatgctcattatattcgttgtatcaagccaaatgaagagaaagaagcctggaaatttgataaccaaatggtggtttctcagttacgagcatgcggtgttttagaaactataaaaatatcttgtgctggttttccctcccgttggacttttgatgagtttgtttctcgttattacatgttggttccctctgccgtaagaactacggagtctttgacctttagcaaggcaattttagagaaacatgctgatccgactaaatatcaaattggcaaaactaaaatattttttcgttcaggtgtgacgccccttttagagagtgcgagagacaaagctttgaaacatgcagcacatcttttgtatgaagcgtttgctgttaattactataggactcgttttcttctgtctcggaagagagtcaggagctttcaagccgttgctcatggtttcttatctcgtcgccatacggagtacgaattactttcttccaatattattaaacttcagtcactttggagaactgcattaaagagaaaagaattcatacaaacgaaaaattctatacttaaagtgcaaagtataattagaggctttttattaagacagactttagaggaaaagacaaagcatgatgcaacattaattattcaaagtctttggttaacatttaaagcccataagcactacaaagaactacaatattatgcagttcgtatccagtctctttggaggatgaaacttgcaaagcgacaattgacagaattaaaaattgaatccactaaagcgagtcaccttaagcaagtatcttacaggcttgaaagcagattgtttgagatttcaaaacagttggacaactcggagcaggaaaataacaagttcagggaaagaatcgctgaattggagtctcatctgtccaactatgctgaagcaaagttagcacaagaaagagaacttgagcaaactagggtacttatatcggatcaatctcaagatggggaattaaaggagttacttgaagagaaagaaaacgctttgattatgatggaagaggagatgaggcaagtcaacgatgcgaataccgaacttttaagagtaaatgcaactttgaagtcgcagcttaaaaattacgatatgattattgttgagcaaacctctcagttgaaagagaaaaacaggataattgctagtctgacaaaagccactaaaatactgaattcggcctctagtatcgaacagtcgcgcaattcggaagagaaatcacgtcgtgatagttcattgatggaaatgcgtactcaaaaagagatgcttgtgctattaatgaacgatggcttgaagcacgatcttgacaaactcacagaatatgcaggtagaacatttacaactcttaaaactctattactaaaggacaacgatgttgaggctcagaaacttgatcatttgtttttagcaaaactactttttataataatatcacaaatgtggaaatcaaatctgtgtcaggaaagtgttgccttggttgagcgttactgtgtccacactttagaatacgtatttcaaaagacatcatctgctaatgagagacctgacatcggattttgggttgcaaatacacatgcgctcttggcttttgtttatactaagcagcaggcgtttaaacattcctcggctttcactcttttatccaccgaatctcatgaatcagtgcaaaccatttttgagatgattgaatcacatctgtcaaaaatctttttcgaatgggttaggcaagtcaataattttttaaagccattgattgttcaggcaatgattattactggtacaaatacggatgctggagatgagaatcgaaaactacggattaaattttttgagaaaccaaaatacaaaatcaccgatgtaatacatgtactaaataaggtgcatgattcttgtcaggcctataaagttaattatgaaatatataatgcattgattagaagcatatatcgattcattaatgtggaggcattcaattcactttttattgatgaacgtggatcttggaaacgtggtaccaatatttcatacaattatcatgttcttaaggattggtgtctagaaagtggtgttccggaagcttatttgcagctcgaagagcttttacaaacctccaagatactacaatttgtgaaagatgatccaaattatgtggccagggtccgcgacttttatgctcttaattttctgcaaataaaaacactcttacatcgttatgactatgctgactacgaggctcatgtaccgaaaaaaactatgtctgaattgtccaaaaatattgttgctgaaggcatcaatcaaagggaacaacttacttacgaagtgttggattatagactacaagatagttttgaggaatctccatctcttgaaaaaataaagataccagatgattgtaatgttacctatttgcgtcgtatcatcgaccttgctagtgcagaagaaagtgttgagcaagctttgatcactgtaggcaacgtagccgacaatgatgtacagaactcgagcgacgaagaaaatcaagtaccaaatggtattaaagtttaa

SEQ ID NO: 46473 - DNA, 5865 bp, Schizosaccharomyces pombe
atgtctggaaataatgaaaatgtttcaggtattactggtcatgatgctgtctcggatgatcagtacgcttacgattcagaggtttatgatgaccaaaatgcataccaacgccagcctgctgatgcgtattccaatgaggagtttttggatcaggctgactacgattctatgtatggagagggttacaatgggtatgattaccctactggtgtaactgaaagttatggagatgaatacactcctgtcgacaccgcctcttcaggtatcaatcaatattccactgaaaaaggaaaatttactcgtccttcagatgaatacgagtctgagtattcagattacaatgctcagccctcagatgccaacaatttttacaatttgagaggcgatggtagatacaacgcttatgatcctagttccgattcgttggctaacgtctacaacagtgtgccttacggtagcagtccgtatgattttagcaactcttcttttgttggtaattcgggctcaggtaccccattggatggcgatagtggttcattctatgccgatagcgctaatctcacaaatcgtgagccttatcctgcctggactcctgaaaacgaactccctttaactaaggaagagattgaagacatattcattgatctaaccaataaattgggtttccaacgcgattccatgcgtaatatgtatgatttttttatgtgtcttttagattctcgtgcttctcgcatgactccagatcaagcactgcttacgcttcatgccgattatattggtagtgatattgctaactataaaaaatggtattttgcttctcagatggatcgggaagatgcagtcggtcttgctaatgttggcatttatggtggtaaagttacttctatcaaagagaaaggaaagttcttttctcgaaacaaaaaagcccctaaagttgttaagcctccaaggaagtctcgcttcaagcgcaagaagaaaaaggagcaacccgaggaggcggaagacgaatacattgatgttaataccgatgattctttagaatccgccgaatatcgttggagatctcacatgcgctcaatgactcaattcgagcgtgctcaacaaattgcattgtggcttttgttgtggggtgaggcaaacaatgttcgtttcatgcctgaggtaatagccttccttttcaaatgtgcttacgattatattatttcacctgaggcacaaaacgtcactgaaccagttcctgaaggatattacttggataatattgtttccccactctaccaatatatgcacgatcagcagtttgaaattatcaatgggaaatatgtacgtcgggaacgtccacatgaccagttaattggatacgatgatattaaccaacttttctggcatgctgagggtatagcacgtcttatttttgaagacggcactcgtcttattgatattcctgcttctgagcgttttcataggcttccagaagttcaatggaatcgtgctttttataaaacttattatgaatcccgttcttggtttcatcttattaccaatttcaatcgtatttgggtcatccactttggtatgttttggtattttactgctttcaactctcctactctttacacaaaacctttccatcagcgcgatggtcccaagccaacaggtgcttcccaatgggctgctgttgcttgtacctctgttgtttcttgtattatcatggctgctgcttctttgtgtgaatatctttttgtcccccgtcgtttccctggatcaaaacccatttggaagcgtttatgtatcattgttttaatcgctatcattaacttgattcctatcgtctatatcttcggtttctcaagtaagcatcaacagcgtagtggtcgacgtatcgctgttggtgtagttgcatttttgatgtctattgctacatacgtctacttttctcttgtacctctacaaagtacatttggaaaattgtccgtgaaagattctcgtaaatacttggcaaacaagtatttcacttcaaattttgcaccattaaaatttgataaccaagcactctctgttattatttgggtctgtgttttcacatgcaaatttgctgaatcttatttcttccttaccttgtctatcagagatcctattattgttttgagtaccatgcgaccttatctttgctctatttattgggcgggtagcagattatgttttgtccaaccaaggatcattttgggtatcatgtattttactgacttgattctcttctttttggatacgtacctttggtatattattttcaatactatcttctctgttttaagatcattcgtcttaggtatttcgatcctcacaccatggagaaatatctttagccgtatgccccaaagaatttatggtaaaattttggccacgaatgacatggaaattaagtacaaacctaaaattttaatttcacaaatttggaatgcgattgtcatttctatgtatcgtgaacatttactttccattgatcatgtacaacgtcttctgtatcatcaagttccagctgaagaaggacgtaggactcttagaacccctacgttttttgtctctcaggacgataatattgttcacactactttcttccctgcaaattcagaggcagagcgtcgtctttctttctttgcacaatctttagctactcccattccagaaccagtacctgttgacaacatgcctactttcactgtattgattcctcattatgctgagaaaattcttctatcattgcgagaaatcattagagaagaggaccagttgtctcgtgtcacccttttagaatatttgaaacagcttcatcctgttgaatgggactgttttgtgaaggatactaagattctggtagaggaaaatgctccatatgaaaatgattctgtctctgaaaaggaaggtacatataaaagtaaagttgatgatcttcctttttactgtattggtttcaaatctgctatgcccgagtatacgttacgtacccgtatttgggcttccttaagaagtcaaacgttgtatcgtactatcagcggttttatgaactatagcagagctatcaagcttttatatcgtgttgaaaaccccgaaatcgttcaaatgtttggtggtaacacagatcgtttggaaagggagttagatcgcatggctcgtcgaaaattcaagttggttgtctcaatgcaacgttatgcaaagttcacaaaggaagagtatgaaaatgccgaatttcttctcagggcttatcctgatttgcaaattgcttaccttgacgaagatcctcctgaagaagaaggtgcggaacctcaattgtttgctgctttgattgacggtcactctgaaattatggaaaatgaacgtcgtcgtccgaaatatcgtattcgtttgtctggtaatcctattcttggtgatggtaaatctgacaatcaaaacatgagcttaccattctatcgtggtgaatatattcaacttattgatgctaatcaagataattatcttgaagagtgccttaagattcgaagtgttcttgctgagtttgaagaaatggagaccgacaatgttaacccctattctgaaagtgctcgtgaaagaaataagcatcctgtagctattcttggtgctcgtgaatacattttctctgagaacattggtatattgggtgacgttgcagcaggcaaagaacaaacattcggtactcttttctctcgtacacttgcgcaaattggcggtaaacttcattatggtcatccagattttcttaacggtatctttatgactacacgtggcggtgtttctaaagctcaaaaaggtttacacgtcaacgaagatatttatgctggtatgaatgctatgcttcgcggtggacgtatcaagcattgcgagtatttccaatgtggtaaaggtcgtgatttaggttttggctcaattttgaatttcaacacaaaagttggtactggtatgggtgaacaaatgttatcccgtgagtattattacttaggtacgcagcttcaacttgaccgtttcctttctttttattttgctcaccccggtttccatcttaacaatatgtttattatgctttctgttcaacttttcatggtggtccttatcaacttaggagcaatttatcacgttgtcactgtttgttattacaacggtaatcaaaagcttagttacgacactagtatcgttccacgtggttgttatcaattgggacccgttttgtcttggctgaagagatgtgttatttcaattttcattgtgttttggatttcgtttattccccttactgtgcatgaattaattgaacgtggtgtttggagagctacaaaaagattcttcaagcaaattggttctttctcccccttgtttgaggtttttacctgccaagtgtactctcaagctattacctcggatcttgcatacggcggtgctagatatattggtactggtcgtggttttgctactgctcgtttacctttctccatcttgtattcacgctttgcagtcccttcaatttacattggagctagatttctaatgatgttgttgtttggtactatgactgtttgggttgcgcacttgatctattggtgggtgtcaatcatggctctttgtgttgctccatttttgttcaatcctcatcaatttgattggaacgatttctttgttgattatagagagtttattcgctggctttcgagaggtaattctcgttctcatgccaattcatggatcggatattgtcgattaacccgcactagaataactggttacaaacgtagggtactaggtcaaccaagcgataaaatttcaatggatactccacgagcaaagtttacgaatgttttctttagcgatgtgttaatccctgccttgttagctgctggtgccattatcccttacttctttatcaattctcagcctggaaatcccatgtttatcactgatccaaataatccaagcccatatgttcatgacacaaagacaggtactaatcccattttgcgacttgttattatctctctcattcctattgcagcaggctttggtatgtcaggtttctttggtggtatggcttgttgtttgggtccagcctttggattgtgctgtaaaaagtttccatctatttttgctgcaattgcccacacgatccaaattttcatcttcattgctatttttgaagtctgctggttccttgatggatggtcattacccaagactgtgttggccttctgtgctgttactgcaattcatcgttttatcttcaaaattttaacactattatgtttatctcgtgaggtcaaacaagatagtgctaatatttcttggtggagtggtaaatggtatggcaaaggatatggctatcatgcctttactttgcctgctcgtgaatttgtctgtaaagccatagaacttaatttgtttgctactgatttcttcttgggtcacttattactgttttttatgcttcctgtgatttgtatcccatatattgatcgttggcattcagttcttcttttctggttgcgcccaagtcgtcaaattcgtcctcctattttctctaccaagcagaatagactgcggaaacgtattgttcgtcgttattcagccttgtacttttcaattttggtaatattccttattcttattattgttccattggcagctggtgcagaaatccgccaaggattaactgcttctgaggctgttgccaagggtgctgttggatggaaccaaactaactcttcaattggtagcggtatcattcaaccaagggacacgaattatactgctaattattctttctggtacgacagataccatttcgaattcaataccacttac

SEQ ID NO: 46474 - DNA, 1611 bp, Schizosaccharomyces pombe
ggtttgagagctgaaattggtgctggcttcgctcgcatgaactgtttgaccgtgattcaagcctcacaaggcttcgctgagtatttgcttcaaaccgtaccatcagctgcaaagctgggtgtggtaattggacacgatcataggcataagtctaatacttttgctcgacttactgctgcagtgttcttgcaaaaaggattcaaaacgtatttcttcgatcatcttgtccatacccctttagtcccttttgccgttaaaaccctagggactgcagctggtgttatgattactgcttcccataatcccgcagcttataacggatacaaggtctattggggaaacggttgtgctatcattcctccccatgacaagggaattgctgcatgtatagaaaaaaacttaacgcccattacttgggacaaaaatttggttgaaaatcataaactagcagatcgggattttgcagttggtcttttaaaaaactattggtctcagctccacgaattccattccgaaaacaacttttccttggaaatgaaatctttgaaatttgtttacactcctattcatggcgttggattaccatttgttacttcagcattacacttatttggcgaacaaggcgatatgatttctgtacctcttcaagattctccaaaccctgactttccgactgtgaaatttccaaatccagaagaggagggggcattggatttggcttacgagcaagctgatgctaatggtatttcgtatgtccttgcaactgatcctgacgcagatcgtttcgcctttgcagaaaaaattaatggtgcttggagaagatttaccggagatgaagttggttgtatccttgcctattttatatttcaagaatacaaaaacgttggaaagccaattgatgatttttacgttttgtcaactactgtctctagtgctatggtaaagtccatggccaaagtagaaggattccatcatgttgaaacacttactggatttaagtggttaggcaataaagcattagaattggaaaaacaagggaaatttattggattggcatatgaagaagctcttggttatatggtaggtagtatagttagagacaaagacggggttaatgctttgattacgttccttcatcttttgaaacgccttcaacttcagaatctttcaattaccgaggtttttgagcaaatgtctaaaaaatatggttattacactacgcaaaactcatatttcctttcacgcgacactcccaagcttcgtgctttggttgatgccttgagacattatgacacaaaatcgggttatccggcaacccttggtagtaagaaaattacaaatgttcgcgaccttactacaggttacgactcaagctccacggatggtaaagctactttaccagtttcaaaaagttcagataacgtaacgtttgagcttgaaaatggagaggtaattatgactattcgcacaagtggtacagagccgaaacttaagttttatatctgtgctcgcggacattcgcttgaagattccataaagaatgctacagaagttaaacaggctatcaaatctgaatggtttcatccccaacagaacggactggaagagcca

SEQ ID NO: 46475 - DNA, 754 bp, Schizosaccharomyces pombe
atgaatcatatttttcgtcgctccattcccatcactgctcgattaccttccttaggaattcgctctttagcaactgcaactgcttctgctcatccccctgtccagttgtatggtttagatggtatgtactgtaaaaggtgatttttaattgctaccattttgactgatatcttcattgtcatccaaaagtctgaattttttgtcttggtaattaactcttttctcttatttaggttcttatgcttcttctctgtataccgctgcagtaaaagaatccaagttggacaatgttgagaaggccttaaataaactgtctggtgttcttcaacagagaccggaatttgaacaatacatttctagtccttggttgactcgtgaggataagaaaatattggttagttctttgacgcagatgactggaaatgaaccccttttgaagaatttctacaatgttttgttagacaatcatcgtctttatctcttaactcgtattcagaaacaattctctactttgatgcgcgctaaaagaggagaaattgaagttaaaattacttcagctactcctctagattcgaagatcctttctcgtctcgaatctcggatagctaaatcgaaatatggcaagggtaaattactggttagcaataaagttactccttctatcatcggtggactaattgttgaaattggtgataatattcttgatgtcagtgttggttctcgtctcaacaatttgaacaagctcttaagtggt

SEQ ID NO: 46476 - DNA, 2487 bp, Schizosaccharomyces pombe
atgaaaactccaaaatttatcacttacgttactcgtggtttcaaaggacttgaatcgaaaagcgttgaaaacaacaaagaccatatcgtagaaaactcgagccctatcgcctcgaaatttcatgaattcgatgagcaaaagaaatcttttgaaatcataaattatgctggtcacgaaaagtttgttgacgacattactgaaagagaatcctcagtaccaggaaatgctgtttacgatattaccgtcagggacattgatgcaattgtacctgtaacggacgatgttgatatacccgcatcgagtaagtcaaagctaatcctactttttccttttttttttttttttagaagctgtcattcaggatttccattactatcccttcaaccttgatattaacttctcactttctttgtagctttcaggatgtggatactggcatttggtcttgctaccgttattgcaggcgttgatgctttctttttgatgcgttatccttcggtctccattgcagctatcgttgctcttcttgtagcatatccattgggtcagctctggtattatattattccacagtgggaaataaaactcccaaggggtatacgtgtttcacttaatccagggagattcaaccgaaaggaacatgcctgcctatatatattcgtcaacatttgtgtctccgcaaaactagttaacactttaattatcgaacaaataaagttttttggagttaacatcggaattggtagagccattttattcaatttatgtagttatctttcgtcattcggatggtcaggtctcgctttgccaattctagtgtatccgccaacattgatttggccttctgttttgagtagctgcgcacttttcaagatatttcacgacaatgataatactaaggcctgcaactggacaatctctcggcttcgttactttttcatagtttttgttgcttctttcatatggtattggtttcctgatctgatctttcctgctttaagctccttgggtgcttggatcagttggtgtaagccttccagtgcagttctatctcaaatatttggggtaaagactggactgggtcttttccctcttacgctcgactgggcccaaatttccagtttaagtaatcctttgatcactccctggtgggctacatgttgtatttttacatcctttgtgttttggatttggattgtacttccagggctttactatcaaaattactggcaagttgcgcatttccccattatgactaacagtatttacactgtttcggggaaaagttatgatgctcaaaaagtggttgattcgaaatgggagttggtaactcaaaagtatcaagaatattctccggttatgcttcctattgctttcatcataaacatagccttgtcattaggcgcattttcttcaatgatgatatcttttttccttcgttttcctaccgatgtcattcagccaatctgtcacgtttttaaatattcagacattcacactaaacttttaaagaaatataagcgtgttcattggggattttatttggcatcaataatagtttccttaggattaggcttcgcttttacagaaggatggcatgatattcagattagatcttatggatttgtggtctccatggttattggagcagctttgtacataccgctttcattaatcgagtctcgttccagcttcactataagtatgcaggcttttttcgaaatagtggcggctttctggtttaatggacaacctatggcattgctctacttctactcatttggatttgggacattacagcacgctatgcatatgactcaaagcgccaaaattggccattatatgaaagtccccccacggttagtcgctgctcttttgtttacaagtggaatttggtcatctctggttaattccgcagtaactggttggatcatgtatcacgttagagacgtgtgtacttcaaatgcggaaaataacatgacttgccgatctccaaaaactcaattcaatagtcatcttatctgggggttagttgggaatcacattttttcatcagatggtcgctattcatttgtaatgtggtttttccttgtaggtgctgtcgtttcagttgttgtttatttgcttcagataagttttcctaaaagctcttggaaacatgtcaatccagctctcctcctaggcggcgctgctcagataccgagtgtcacaggaatcaactattcaacctgggctgcagtcgccttttgtttcaattatttaattcgtcgtggttattattcgtggtggaagaaatataacttgataactgctgctgcaatggattgcggagtcgccattgctggactattcatatatttttgcgttgtatatactggtggttcaagtaactttagctggtggggaacgactgtaagttcggcgggatgtgacaaaaaaggttgtgctcatttatctgtttcggatattagcaaaccttctggatgg

SEQ ID NO: 46477 - DNA, 1160 bp, Schizosaccharomyces pombe
atggcttccaaacaaagagaaaatgtgttcccaacgagaatgtacgctcgaatgctcttaataagtagctaattttattaggaccctgacgactatgaaaacacgtcttaagggcgctcaaaccggtcattctttgttgaagagaaagtctgaagctttgaaaaagcgatttcgtgaaatagtagtaaacattgagcaagtaagtgcctgaatacgcctagttatcttggacatcgaattattcattttgaataaaaataaccgtcatatgtaattcataaaaatttgcagcaattcaaatttttgctaaaaaatgttcccttggcacaataggtatttgtctgtttcctggtcatttacaaatctactgtgtattataggtattttaggattctactccttgttcagactaggcatattcgttcgcatgaatccgttaactaatgatatcttgataggcaaaacaaaagatgggccgtgtgatgcaaattgctgccttttcgatggccgaagttggatttgccatgggcaataatattaatttcgaaatccaacaatcagtcaagcaacctcgtctgcgtgtacgatcaaagcaagaaaatattagtggtgtattccttcctactttcgagatgaatttggatgagagcatagatgattttcaattaactggtcttggaaaaggtggccagcaaattcaaaaagctcgtcaggtttatgaaaaggcagtggaaacactagttcaactggcatcttaccagtccgcttttgtcttacttggtgatgttttgcaaatgacaaatcgtcgtgtaaattcaattgaacacattattattcctagacttgagaatactattaagtacatcgaatctgaattagaagaactagaacgtgaagattttactaggttgaagaaagtacagaagaccaaggagaatgctgaaaaagcagattccgttactaaagaagagcatcaaggtggcagcaatactttacaacagacaaaagacgtcggcggagcgattgcaccagctgctgaggttggaaaggaagtcattaatgaggtcgagaatagcaaggatgacacctattctttaccctctacttctacggacgatgaagaagaaaacgattctgatgaagaagtcatcttttaagca

SEQ ID NO: 46478 - DNA, 2094 bp, Schizosaccharomyces pombe
ggaaagacaagtttcttgtattccggatgctcaaaattcggaggacggttgtttaacaatagcattgttcatggatggctacgaactcggagctatgcattagcttcggggcttcatccccttagaaaacaaaagcttgcgcattttgaagatttggcaaatgctaatatgtcagacccatatatgcaggctaaattgtataaggagctagctgataacttccccgaagcaattataagccgttatgaaacacaaggagttgccaggaactccgcatgtgatcgatattatcaagaggctttgcgaaaaaaatcgtggagcagaagtttatcgaacaacatatccttatctcaatcatcttcttcacctgccacctctagtttcagtgatccaaaagcattttcggcaggcgtaccaaaattcacatccgatacatcttctaccgtttcctcgactccttcacttaatcattctttgcaaaattccatgccaccttcgactcctactccacctccggtatgggcacccacgattgtttcatcagcattgggcacaagtagtaaaactcctgtctatgtggtagttgatgaaccgagatttacaaaatttttcagaatttttaaattcattgctggtcttagtgtggcctcctattttgttcttttaggaatgagtatttttgctgaaacttcaggtcttaacaatataatgaccaacactactgagcaagaacctatggaggagcgagctattaatgttcgcttctctgatgttcaaggtgttgacgaggccaaggaggaactggaggaaatcgttgattttttgcgcgatcctactcattttacacggttgggaggtaaattgcctagaggtgttttgcttacaggaccacccggaactggaaaaacaatgcttgctagggctgttgctggagaggcaaatgttccttttttctttatgagtggcagtcagtttgacgaaatgtatgtaggtgttggtgccaaacgagttcgagaattgttcgctgccgctagaaagcaagctccttccattatatttatcgatgaattggatgctattggacaaaaaagaaatgcacgagacgccgctcatatgagacagactttgaaccaattgctagttgatttagacgggttttcaaaaaatgaagatttagctcatccagtcgtttttattggtgctacgaatttccccgaaagtttggatcctgcgctaactcgtccagggcgtttcgatcgccatatacatgttcctttacccgatgttagagggcgtctggcaatcttactgcagcatacacgacatgtacctctcggcaaggatgtcgatctcagcattattgcaagaggaacctctgggtttgctggggctgatctagctaacctaatcaaccaagctgctgtctatgccagtaaaaacttatcaaccgcagtcagtatgcgtgatttagaatggtcaaaagatcgaatacttatgggtgctgaaagaaaaagtgcattcattactccagaaaataagctaatgactgcctatcacgaaggtggacatgcattagtagctttatttaccaaaaatgctatgagaccctacaaggctactattatgcctagaggtagtagtttgggaatgacgatttccttaccagatatggataaagatagctggacgcgtgaagaatatcttgctatgcttgacgtcaccatgggcggtcgcgccgcagaggagcttttgtacggaaaagataaaataacgtctggtgcacataatgatatagacaaggctactcaagttgcacgccgtatggtaacggagtttggaatgtctgaccgcattggcccggttagtttggaagctgaaatggataatctctcacctgctacgagagcgctagtggaatcagaaatcaagtctttgcttgaggcgtcatatgaacgttcattatctttgcttaaatctcacaagaaagagttagatgcattagctactgctctagtcgattatgagtttttgaccgctgaagagatgaaccgtgtcgttaaaggagaccgtgatttacttcgtaataagctaagt

SEQ ID NO: 46479 - DNA, 1611 bp, Schizosaccharomyces pombe
atggaggcagcgccttctgagaaagttcctgccaagaagctatcctcctcagaaaacctcgacattggagtttccgaagttgtaacagttgacgcagcggaaaataattcaaatggaatcaaacgtggattgaagactcgtcatgtatcgatgatggcccttgctggtatcatcggtccaggtgtcttcattggtatgggcagtgccctgcatattggtggtccggtgggtctaattgtcggctttgccatcgttagtattgttgtttttggggttatgctgagtatcggcgagtttaattcgctatttgatttcaacttcaatactcatgctgctcgatgggttgacccagcatttggagccgctatcggatggaactatgttatcgtatggcttaccaacatcgcagcagaatatacatctttaacatctattcttcaatattggggcccccatgtgccatcttatggcttttttctaattttttggggtttttttacgtgttaccaaatgctaggtgtgtcagtgtttggagaatctgaatacattttggctttcattaaacttctatttattactggattctacatatttgcaataatttacgcagctggaggaattcctcatcataagccgcccaacttgtttaaagaaatgccattggcacacggatttgggggtatagtttcagcatttgtatatgccggtgtcttttttagtggtgtagaatctgtatctatgactgcagctgaaagcaaaaatccaaaaaaagctatcccgcttgctgtgagacaaacgttctggagaatcttgtatgtctattttggtatctcaatctcttacggtatcaccgtagcatggaatgacccaaatctttcgtcaggctccaaaactctcaagtctccaatgacaattgctataatgaatgccggttggaatcacgcaggtgattttgtcaatgcagtcattttaattacttgcctttcttccatcaacagtggtatatatataggaagtcgatctttgtataatttagccaaggatggcatggctccaaaaatttttaaaagggttgataaaagaggtgtaccatgggttgcggtccactcagtccaccttttcgggtttctttccattatgaattacagcacaggtgctgtcaaggcatatggctatattatcaatttagctggtgtgtctgcattcattgtgtggacagcaatcatattcgttcactttcgtttcagacgaggctgggtaaagcaaggctatgccttgtctgatttaccgtttaaatcacctctttatccctttccccagcttataggattcgttataggaatcattctcacactagtacaaggatggacggtttttaaaccatttgctgctggcgattttgtcgatgcctatatacttctacccctgtttttcgtcatttggctatcttataaatttattaaaaagacaaagtgggtatcttatgaagacatggacttcataaacggcagacgagttattgaaccaacctattcaaatgaacagtcttcagataaagaaaccgaagacggcaaaaaaacaagtttctggaacagagtttggaaagaagta

SEQ ID NO: 46480 - DNA, 1248 bp, Schizosaccharomyces pombe
atgacggttgatcttagggaagagaaagagctcgcacagcaaagatttaaagaaatttgcaagcatgcgaaaattgttgatacacacaatgacttcccttacctgctgagagttcaattacgaaataagctgcagctggcggagtttgattttgagaacggtttaactagtcacacggatcttgtaaaaatgagacaaggtcaagtcggagttcaattttttagctgcttcattgaatgcaaaaatccgaattacctgtaccaagactttgatacacctactactgtggtgcgcgatacactagaacagattgacgttactcgcagattggtttgcaaatacaataatgatttgaagtttgtcgattgtgcagacgatgccatagcagcgtttcgaaataatgggaaaattgcaattgctttgggagttgaaggtttgcaccaggtggatacttctctggctgtattaagacaatattactcacttggtgtgagatatataactttgactcataattgtgataacccatttgctacggcagctagttccattactgggggccttccagacagaggtctttcagcgtatggaattgagtgtatttttgaaatgaaccgactcggtatgatggtggatttatcgcatgtaagccaccgcactatgcatgacgccctcgatgtaaccaaagctcccgtaatattctcacactcctccgcatacacacttacagagcacgaaagaaacgtccgagacgatgtattggaaaggctgaaaacgaatggtggtgtcgtacaagtcaacttttatcaagatttcattcgtaagcctggaagcgaccgtgcaacaatcgatgatgctgcagatcatatcttacatatcataaaggtagccggttgggagcatgtcggtttaggatccgatttcgatggaattccccaaggccccaagggattggaagacgtctctaaatatcccgatttgatctgtaaaataattgaaaggacgaatgccacaaacgaacaaattgaaggattaatgggtttaaatgtgctccgggtttggaaaaagaccgagttagtggcattgcaactatctaaaaaattggagcccattgaatcaagttggtctggaagaaagtgggagttttacagctatgctaaagagtttccagagctatttccagacgcctataaactgaatgaaaagagtactgtttggaattatgatcagcctttgaacattgagaaa

SEQ ID NO: 46481 - DNA, 1007 bp, Schizosaccharomyces pombe
atgggatccttagaagtaccgtgcattgacctttctgaaaatgatacttccattgtcgtgaaagaattgctcgatgcttgtaaaaattggggattcgtttctttgaagaatcatggaattccgctagatgaaatagatcgtacatttaagcttgcagacaaattttttgatattcctgtagaagaaaagcagaaatatttgttcaagggtggccgattacatagtggatacacagggcattttggtgagaagttagatatggaacaccagtcgagaggtgatttgaaagaatcctatgatttagcaggatttccagatccaaaattagaaaacctttgtccgtttattgcggagcacatggatgaatttctccaattccaaaggcattgttataaactaacattgagattattggatttttttgccattggatttggaattccgccagattttttcagcaagagccatagctctgaagaggacgttcttcgacttttaaaatacagtatacctgaaggagttgaaagacgtgaagatgatgaagatgctggtgcacactcagattacggttccattaccctgcttttccaaagggatgcagcaggtttggaaattcgtccacctaattttgttaaagatatggattggatcaaagtaaatgtccaaccagacgtagttttgtaagtcttttcctgactccttattctaaccatttacatagggtaaacattgctgacatgctccaattttggactagcggaaagttgagaagcactgttcatcgtgttcgaattgaccccggtgttaagactcgtcaaacgatcgcatactttgttactcctgatcctgaaactcctttgagtccactgttcgaagaaaagactggaaaagacattgaaactgttactgccggagaatggatagatggtcgtataaacttcacctatgggtatagtgcaccaccaaaaggatatttaggaagccaaaatgatggtattgtggcataa

SEQ ID NO: 46482 - DNA, 4001 bp, Schizosaccharomyces pombe
atgtcctacgcaaattatcgttatatgaaagcaagagcaaaacgatggagaccagagaatttggatggaattcaaacatcagacgaacatttaataaacctttttgcaaaaatattatcgaagcatgtaccagagatagggaaattcgatcctaataaggatgttgaaagttacatttcaaaacttgatcaacactttactgaatacccttcattattcccaaatgagcatactaaaagacagtatacattgaatcacctagaagaattagagcaacaattcgctgaacgcatgttttctgagaatggaagtcttacatggcaagaattactcagacaaacagggaaagtacaaggatccaacaaaggtgatcgtttaactaaaacatttgaaggttttagaaatcaattggacaaagttcaatttataaggaaactcatgtcaaaagcaaatgttgatgatttccatactcgcttgtttatattatggatgctgccatattccttaaggaaattaaaggaaagaaattactggaaatcagaaatcagtgaaatttatgactttttagaggacaaaagaacagcctcgtatggtaaaactcacaagcgttttcaactgcaaaataaaaatctaggaaaagagtccctttcaaagaaaaataacaccactaatagcagaaacctgaggaagacaaatgtttcgagaatagaatactcatctaacaaattcctaaatcatactaggaaacgttacgaaatggtattacaagctgaacttccagacttcaagtgctcaataccctgtctaatcgatacgggcgctcaagcaaatattataacagaagaaactgttcgagcacataaactgcctaccagaccctggtcaaaaagtgtgatatatggtggagtttatccaaataagattaatcgcaaaacaataaaacttaacataagtctaaatggaatatcaatcaaaacagaattcttggttgtaaagaaattttcgcatccagctgctatctccttcacaacattatatgacaataacattgaaatatctagcagtaaacacacgctctctcaaatgaacaaagtttcaaatattgtcaaggaacctgagttaccagatatctataaagaattcaaagacattactgcagaaaccaatacggaaaagctaccaaagccaataaaagggttagaatttgaagttgaactaactcaagaaaactacagattacctatcagaaattacccgctaccaccgggaaaaatgcaagctatgaatgatgaaattaatcaaggattaaaaagtggaattatacgagaatctaaagccattaacgcctgtccagtaatgttcgttccgaaaaaggaaggcaccttgagaatggtggttgactacaaacctttaaataagtatgtcaaacccaatatatatccgttaccacttattgaacaattacttgctaaaatacaaggttctacaatttttactaaacttgacctcaaaagtgcctatcacttgatacgagtaagaaaaggagatgaacataaacttgcttttcgctgtcctcgtggagtttttgaatatctagtaatgccttatggcatatctacagctccagcacattttcaatactttatcaatacaatacttggtgaagccaaagaatcacatgtagtatgttatatggatgatattttaattcattcaaaatcggaatctgaacatgtaaaacatgttaaagacgttctacagaaattgaaaaatgcgaacttaattatcaatcaagcaaaatgtgaatttcaccaatcacaagtaaaatttatagggtatcacatttcggaaaaaggatttacgccttgtcaagaaaatatagacaaagtcttacaatggaagcaacctaagaatcgtaaagaattacgacaatttctaggttctgtcaattatcttaggaaattcattccaaagacatcacaattaacacatccactcaataatcttttgaaaaaggatgtacgctggaaatggacaccaacacaaacccaagcgatagaaaacattaaacaatgtttagtttctcctccggtgctacgacactttgatttcagtaaaaagattctactggaaactgatgcttcagatgtcgctgtaggagccgtattgtctcaaaaacatgatgatgataaatactatcctgttggatactattcagcaaagatgtctaaagcacaattaaattatagcgtatcggacaaaaaatgcttgcaatcattaagtctctcaaacattggagacactatttagaatccactatcgaacctttcaaaattttaacagaccatcgaaacttaattggtcgcattactaacgaatccgagcctgaaaacaaacgtttagctcgttggcaattatttttacaagacttcaactttgaaattaactacagacctggatcagcaaatcacatagctgatgccttatccagaattgttgacgaaacagaaccaattccaaaagattcagaagacaatagtatcaactttgttaatcaaatctcgataaccgatgattttaaaaaccaagtggttacagaatatacgaatgatacaaaattgttgaatttactaaacaatgaagacaaacgagtggaagagaatatccaactcaaagatggcttactaattaacagtaaagaccaaatcttattacctaatgatactcagctgactaggacaattattaaaaagtatcatgaagaaggtaaattgattcatccaggcattgaacttcttacaaacattatattacgtagatttacgtggaaaggaataagaaaacaaatacaagaatatgtacagaactgccatacatgtcaaataaacaaatctaggaatcataaaccttatggacctttacaaccaattcccccatcagaaagaccttgggaatctttatcaatggattttattacagctttaccagaatcatctggttataatgcacttttcgtggtagttgaccgattttcaaaaatggcaatcttagtaccttgtacgaaatccattacagcagagcaaacagctcgaatgtttgatcaacgagttattgcttatttcggcaatccaaaagaaatcattgcagataatgatcatatttttacttcccaaacgtggaaagatttcgcacataaatataatttcgttatgaaattttcgttaccatacagaccacaaactgatggacaaactgagcgtacaaaccaaactgtggagaaattactaagatgtgtatgtagcacacatccaaatacatgggtagatcatatatccctagtgcaacaatcttacaacaatgcgatacattcagcaactcaaatgacaccttttgagatagtacatcgctattcaccagctttatcacctttagagttacctagctttagtgacaaaactgacgaaaactctcaggaaacgatccaagtatttcaaacagttaaagaacacttgaatacaaacaacataaagatgaaaaagtatttcgatatgaaaatacaagaaattgaagaatttcaacctggagacctagttatggtcaaaagaacgaaaacaggttttcttcataaatccaataaattagcacctagttttgcaggaccgttctatgtgttacagaagtcgggtccaaacaactatgaattggatcttccagattcaatcaagcacatgttttcatctacttttcatgtttctcacctagaaaagtatcgacataattcagaactcaattacgctaccattgatgagtctgatattggaacaattcttcatatcctagaacataaaaacagagaacaagtactctacttaaatgtcaagtacatttcgaatctaaatccgagtactattatgtcaggatggactacattagctacagcgctacaagcggacaaagcaattgtcaatgattatattaaaaacaataatctaaatatctga

SEQ ID NO: 46483 - DNA, 1392 bp, Schizosaccharomyces pombe
atgaaagagacttttcaggtcggcatcataggatttggcgatatgggtcgcttgtatgcagagtacatcagtaaggcaggatggaggtaagtaaataatttttgttctacaatctacaattagctctccttttcaaagtgcctttagggactttttctattagcaccttctaacatcataaatagagtaaatgtttgtgatcgaccggaaaattacgaatcaatacaagcgacttatggaaatgggggatataccgttttaaaggatggatttcaagtttcacgaacgagtgactacattctgtacagtgttgaagctgaacatattgataaagttgttgctctatatgggcctgcaactaaagttggagcgattgtcggaggtcaaacatcatgtaaggctccagagatgaatgcatttgaaaaatacttgcctgaggatgtggacatcatatcttgtcattccatgcatggtcctaaagtgaaccctaagtctcaacctcttgtcataatacgacatcgagctagtgatgagcattttgaaattgttaacgaaatactctcctgcttcaagtcatcagtcgtgtacttgtctgccaaagaacacgatcgtatcactgctgatactcaagctgttacacatgctgcatttcttacaatgggattggcatggcacgctaacaatcaatacccctgggaaataaatcgctggtgtggtggtattgaaaatattaaaatgaacctttccatgcgtatttattctagtaaatggcatgtttatgccggtcttgcaattttaaatccagaagcacaaaggcaaattcaacaatacgcctcttctgtaactgaattattcaaattagcaattagcggaaaggccaaagagtatgaggatcgcattcgcaacgctggaaagtttgtgtttggtgaaaatatggatcgcaactcaagtggtcttttgttaagtgatgaattattagaccaatatagcatatcaaacattccaaaggatgaatctaaaaggaacagtcatttaagtatattggctatcgttgattcgtggtcaaaacttgggatacatcctcaaaaccacatgatttgctccactcctttgtttcgattatgggttggtgtttccgaatacgtgttcagacatcctggcttacttgattcttgcatatatactgctaccaagcataacgatttctctcccgatgatttagaattcgtagttgctgtcagatcatggagtgaatgtgtagctgctaaagattttacaacttacaaaaaacggttccttgaaactcaagaatatttccgtccaaggtttgaagaagctacaagggtaggaaatgctatgattagcaaacttcttgagaacctgcaaaaaatg

SEQ ID NO: 46484 - DNA, 2937 bp, Schizosaccharomyces pombe
atggattctctgtcggaaagttctacttcttcatatcacggaaaaagaccgcggtccttgagcgaggaatcgcaaagctcttccaacatggatgatatttcacaaaaatcaatatctttgggtgatgcttcagaaatatcaaagaaccttccttctattgcagaacaaaagcagttaataggcgagttggtaaacaatcaacccgaacttgagttgggacaggttgacaattacattctttcgtatagttggtatgaacgactctgctcgtatttggcagaggatggtccctttcctggaccggtagatcaagaagatattgctgatttagaaactggaacgttgaagccggatttgcaagaagagattgattttaccatcatttctcgagatgtatgggatttattggttcgctggtatggactaaaaggacccgaatttccaagggaaactgtaaacctgggctcagagtcgcatcctcatttggtagttgaagtttacccaccaatcttttcattaacactgttgagcaccaatgctgtggacgcgaatgagtctcataagcctaaaaaaatatctctttcctcaaaaagtactttagaggatctattggaaggggttaaatataccctttctctccccagtgatcagtttaggttatggagagttgacacggatcagcctttgcatagaactatcgatccctcatcttttataaaaatcaattcgaaagaaattatcgattttttagaaaaatccaagactttggtagaactgggaatggacagtagctgttcattagtggctgaatgcatgataaatgaaacatggccagtagaccgtgcgcttcgcctacaattcttaattcagcagagaaataatcaatcatctaatgaagaacaaaaacaagaaaaaagggttccaggaacctgtggtcttagcaaccttggaaatacttgttatatgaattccgcactccaatgtttaacccacactcgtgaactgcgtgacttttttacatcagatgagtggaaaaatcaagtaaatgagtcaaatccccttggtatgggtggccaagttgccagtatatttgcatctcttataaaatctttatattctccagaacattcctctttcgctccaaggcaatttaaagcaactattggtaaattcaatcattcttttttgggatatggccaacaggattctcaagagtttttagcttttcttctagatggactacatgaagatttgaacagaatctatcaaaagccgtatacctctaaacccgacttgtatgaagtggacgaagagaaaataaaaaatactgctgaggagtgctggagattacataaactaaggaatgactctcttattgtagatttatttcaaggcatgtatcgtagtacccttgtgtgccctgtttgtaacaccgtctcgattacctttgatcctttcatggatcttacccttccattacctgtcaagcaagtatggtcgcatactgttacctttattccagctgatacaaatcttactccattagctattgaggtagtactcgagagtaaggcggcgacgattgaagaccttgtcaaatatgtcgcagaaaaatctggatgtagcgattacaggaaaatattggttactgaaacttataagggaaggttctataggttccttacacaactttccaaatctttgttaatggagatttctgaggaagatgaaatttatctttatgagttagagagaccgtacgaagatggatctgatgacattttggttcctgtctatcatatatctgatgattctacaaattcggcaaactcctatatgagttcacgcgattttggtcacccatttgtcctgcaattgtcagacaatgaagttactgatgcttcctttataagtgaaaagctcaaacttaaatatcagcaatttacaactttaaaaaacttaaaaaatattgactcgttggagtctttggaacttggccacgaagatgaacaagtgcaaaaaggtccgttggatgttgatatggatcatagtcagacaccattgtttgaaatgagagttttccatgatcggtttgaaaaaatccctaccggttggaacatgagtgtttctaacttgcctttgttaaccgaacgggataaaaaggatttagaatcgacggtcgatcctttagatgctcattcaattgaggaagaagatgacagtgagttcaaagacgttgcacccggttcatatcctgagccttcgaagagtaacgaaaacaccaagttgaccgcaaaggaaaatgatcgtttgcttattcagggtgacttgctggtgtgtgagtggcctgaaaaatcctatcaatttgtatttagtgtggcaccttcttctcctcaaatgggacgttcattgtggctagaatcaaaaacaatattgtcggacaaaaaggatgattctgaagattctcgtaccattactttgaatgattgtttagatgagttcgaaaaaacggagcaactgggtgaagaagatccttggtactgtcctacatgcaaagaatttcgacaggctagtaaacaaatggaaatttggagatgccccgaaattttgattttccatttgaagagatttagcagtgaaagaaggtttagggataaaattgacgacttagttgaattccctattgacaatttagatatgtctatgcggacgggtagctataaattgtccgaaaaagaaaatcctaaattaatttatgagctttatgctgtcgataatcactatggcggtcttggaggcggtcattacacagcatttgctaaaaatcccgacaatggacaattttattgttttgatgattcacgggtcactcctgtatgtcctgaagaaactgtcacctcagctgcatatctgttgttttatcgccgaaaaacaagc

SEQ ID NO: 46485 - DNA, 1785 bp, Schizosaccharomyces pombe
atggaaaaatctggtggaatacgtgaagagagttctgaaaaaactttttcggactttaatttagatcctagattgcaaagagccattcataaatgtgaatttgaaaaacctacttcagtccaaagcgaaacaatccctttagcattagaaggaaaagacttggtagctcaagcaagaactggttctggtaagacggctgcttatttgattcccattttggaattactgttgaagcaaaaacaaatcgatgaaaatcaacgtggaatttttgctttgcttttagttcctacaagagaattggctcaacaagtatacaatgtattggaaaaacttactgctttttgcagcaagcatattagatttatcaatgttgcgacgaatagctctgataccgtacaacgtcctcttcttctcgatcttcctgatattgtaattgcaacacctagtcgttgtgttgttcatgtcgcatctggtgtacttccattggataagttaaaattccttgtaatcgatgaagccgatttaatgctctcttttggatataacgaagacatgaaaacccttagtaggtcccttccccgtggtactcaatccttcttaatgtctgccacactttccaagaacattgcatccttacaaaagttagtttgtcggaatccgtttatcttagcagtaaaggataaagaagcaagtggaaagttaactcagtacgttgttaaatgctctgagcaagacaagtttttgctagcgtacatccttctcaaactcagattaattaaaggaaaaatcttgatttttgtgaacgaaataaaccgatgctaccgactaaaactttttttggagcagtttggtctgaagagcttagtgctcaactctgagcttcctgtaaactcccgtttacacatcttagaacaatataataaaggcttgtatcaaatcattattgctactgatgaaagtggaatgatgggtgaaatagaagaattggaaaataatgttgattttgtcgaagaagaagtaatttctactgatcagccaactttagataaaatgaaggatcaggagaatgcagatgtcaatgatgaatccattttagctgctgcaaaggacaaatccaagaaaaagaaaagagttaaacaagataaggagtatggtgttgctcgtggtcttgattttgaaaatgtggcttgtgttctaaattttgatatgcctagtaacacaaaatcttatatccatcgaatcggcagaacagcaagagctggaaaacctggaaccgctatgtcttttgtagtgcccaaatcagaggttggcaaacataagcctacgagtctggaatcctgtaaaaaagatgagtccgttttacgtcgcttagaaaaaaagcaaattagcctacaaccttactcatttgataagaatcaaattgatgctttccgctatcgtatggaagatgctcttcgtgctgttactaccgttgctgtttcagccgcaagagctgctgaattgaaacaggaattacttatttcagagaagttgaaatcttactttgctgaaaatccagatgagttactatcattaactcacgatactgtttccagtgttcgccttggtcacacccagagacatctccgtcatgttcctgaatatttattaccaaaaggaatgcaagccgttaacaaggacattggctttgtaccatttaaaaagaacaataggcgaaaggtatttaaatctagaaagaatcctaagcatcggcacgaccctttacgctctatgaagcgtaaatct

SEQ ID NO: 46486 - DNA, 1476 bp, Schizosaccharomyces pombe
atgcgtgcctttcgccttgcttccggtgttttgagaaatcgaaaagtcattttaggtattggtgctggttcgttaataacagctggcaatattaagattcgcaatgacagcaaattcgatgcgttttttgccaaaggatttcctgatgaattgcagcaccgttctctcttcagcgtcctccgtagtgcctttgtctatgaaatttgttctcgagcttggctagtgaagctatcgctaggtgcgatgagtttatgcgacgtcttccatctatcatttttatacaatccgttttgccgctatacattttacaaacatttctgtggtggcgagacgcctcaggctgtcatggctacgatggatacgttgcaagcagcaggtattacctcttgtttgaattactctcgtgaagttgacttggacggcgatatggatgtaaataagatcgcttctcaaggggtagtacctcctcaggttcctgttccttctgagaagaaccagaaagtgttacgacaaattgcggacaaggcttttgaatcaaacatgcacatcattgatatggcaacctataagcctggaactgtttgcgctgttaagcttaccccattcattaatcctctggttttacaacgatacaactccattttgaaccagtatccggtagaatcagcgtgtaactatttggagcatctgaagtctcctgaattatcaacttatgaagttagcgaattaaagaaattttgggagtatgccgacaaactgtgtcaatttgcaaaagagaaacaaatcccactctttattgatgctgagcaaacttatttccaagattgcatgcatgccgtcacagttgacttaatgagaaaatacaataaggaggttgcaatcgttcataatacttatcagttgtatttgaagaaatctagaaaaattatggacgaccacatcaagaaatgtgttgctgagggctggctaatgggcgcaaaactcgttcgtggtgcttatttgaactcggaaccaagattcttaattcacgacacaaaagccgagacagacaaagattttgattcagctgtggaagctataattgccgcagctgccaaatttgctccaggtgaccctgcctctgcttctgacccgattgcctctcgtaaaggaaaatggggaattatggttgctagtcacaataagaaaacaatgtttgaatcggtgaatttggcagaaaccaaaaaagttgactttacgaaaacctctttctatttggctcaattgttgggtatggctgatgatattacctatgctttggcttattctcagcgcaatcaacagcccaatttttgcattgtaaaatatgtttcttgtggacctatcagtgaagtccttccttacttagtacgcagggcacgtgagaatattgatgctcttgatagatgtaaagaggaacgagcctactaccgacaagctcttcgtcgtcgtatattt

SEQ ID NO: 46487 - DNA, 781 bp, Schizosaccharomyces pombe
atgtctaaacagaatcgtggacgtttgattgttatcgaagggttagaccgctcaggaaagtctacccaatgtcagcttttggttgataagttaatttctcaacatgaaaaggctgaacttttcaaatttcctggtaagagttatttctgtttcttggccgactaacttgttacgtttactcgatagacagaactacagcaattggaaaaaaaattgatgactatctaaaggaatcggtccagctgaatgaccaagtaatacatctgcttttttctgccaatagatgggaaaccattcaatatatttatgagcaaatcaacaaaggtgtaacctgcatactagatagatacgcattctctggtattgcattctctgcggctaaggtatattatctcctcttggataattcgtgaattacagaagactgaggatatagactctatagacgatatatgaagttactaacattaagtagggactcgattgggaatggtgcaaaagccctgatcgtggtcttcctcgccccgatttagtaatttttctaaatgttgatccgcgtattgccgcaactcgaggacaatatggagaagaacgatatgagaagatagagatgcaggagaaagttctaaaaaatttccaaagattacaaaaagagtttagggaagagggactcgaatttataacacttgatgcctcttcctcgttagaggatgtgcattcgcagattgtggatttagttagtaacgttaacattcacgaaaccctagacgtattataatag

SEQ ID NO: 46488 - DNA, 1044 bp, Schizosaccharomyces pombe
agaatagatgaagtggaaccatctgaaaaagaagataatgtagaaagacagacgaagaagtataatttcgagattgatgaacctgaagaacaagaaaagaaagatgagaaggaagatgataaagaggaaagcccttctaaatctttggaagagatatctcaatcagtttcacctgtagaggaggagcctcgtgatgttcggtttaaagagctgtccactccttttagttaccctatcaatgatcctcctgagggtcgtcctgttcgagtttacgccgatggagtttttgacttgtttcatattgggcatatgagacaactagaacaggccaaaaaagtatttcctaatgtgcatcttattgttggtcttcccaacgatcaattgactcatcgccttaaaggattaacagtgatgaatgacaaggaacgagctgaagcccttcgacattgtaagtgggttgacgaggtcttagaaaatgcaccttgggtaattaccccagaatttttggaagaacacaagattgattttgtcgcccacgacgacattccatatgctagcgatgattccggagatatctatcttccggttaagaaggttggtaaatttattcctacaaagcgtacagagggtgtttctacatccgatctcattactcgaattattcgggactatgatcaatatgtgatgcgaaaccttgctcgcggtgtaaaccgaaaggaattaaacgtttcgttgtttaagaagaatgaacttgatcttagacaccacattaaggttcttcgtgatacattgagaaatcactgggtttctacaactcgtgatctgaaggctgatatcaaatcatttttgtcaatggcgactaccgattatcaattgcagaagaatcctctgcacggctctagtgaaccttcaagtcctggtcccacaggatttttaggtggtatcaatcgttggatgcaacgtaggtctagcagtcattatgacttacctcgtgtcggcaatgagatagctgcttcaagctcttcagcgactgaagaaaatcat

SEQ ID NO: 46489 - DNA, 1536 bp, Schizosaccharomyces pombe
atgtcttttactactttatattcagctattcaaggtgatgctagtgcgagagccttggtagccccttctttaaatgcagaactatcattcagtgagcttcgaattgctattatggatcttcagcgccaaattgccagccttggcataaaagttggagaccctgtaaacattgctattcccaatggcttggaattcgtcgtagctttttacgctgtttcttggcaaagagctatttgtgggcccctgaactccaactacaagcaatccgagtttgagttttacattgatgatctgaaaagtaaactcgtcattgttcccgaaggctccgttgccgcaaatacccctgctgttcgtgctgctaagaaattgtctgtcgcagtggccgaacttgcttggtgtcccaagtctcgattagttcgcattgttcactttgaaggagccaaaattaatgctcctcaaccacttggtcttcctcaacccgacgacgttatgcttgtcctacatactagtggtaccactggacgccctaaagtcgttcctttgactcacaaaaacttgtgccgtagcatccataacattactacctcttatagattggatccaagagatacttcttacgttgtcatgcctttgtttcacgttcacggtcttctttgtggcctcctttctactttagcttctggtggatgtgccgttgtacctcccaaattctctgctcacagcttctggaaggagtttattcagtatggtgctacttggtatactgcggtccccactattcatcaaatccttctccgtactcctcctcccaaacctcttcctcgaattcgtttcattcgttcttgctcttctcccttggcaccaccagtcttaagcaaactagaggctaccttccgtgctcctgtccttgaggcatatgctatgaccgaagcttctcatcaaatgactaccaatcccttacctcctttggtacacaaacctcattcagttggtaagccttttggagttgaactcaaaattttggaccagaaaggtaacgaaatgccccaaggaaaagagggagaaatttgtgttcgcggaatcaacgttaccaagggttatttgaacaatcctgctgcgaataagtcatcctttaccaaagatcgttttttccgtactggtgacgagggcaaacttgataaagacggttacgtttttattactggtcgcatcaaggagcttgttaatcgtggtggtgaaaagatttctccagctgagattgacgctgttttaatgcaacatcctgatgtttccgaagctgtttgttttgctgttcctgacgaaaaatacggacaagacatccaagcagctattaaccctgttgctggaaaaacagtaacccccaagcagttacatgactatttagaacagaaggttgctgcttttaaaatccctaaaaagttttactttactgatcgtatccctaaaactgctactggaaaagtgcaacgtcgtttggtctgcgacgcctttttcaatcactccaaggccaaactc

SEQ ID NO: 46490 - DNA, 1035 bp, Schizosaccharomyces pombe
ggcaccgttggacagcgtttcattaccctcctttccgatcatcctgagtttaagatcgctgttcttggcgcttctgctcgttctgcgggaaaaccatatgcagttgctactaaatggaaacaatctattgcaatgcctaaagagatttcccaaatgagtgtaaaggcttgtgatcccaaggagttttcggaatgcgatattgtgtttagcggcttagatgctgactttgctggcgaaattgaaaaaagttttcgtgatgctaatttagtcatcgtttcgaatgctaaaaactatcgtcgtgagcctaccgtgccacttgttgtccccaccgtcaacacagatcatttggacgttatcaagtaccagcgtcaagaaaacaaactggatcgtggatgcattatcactaactctaactgttctactgctgctgttgtagtacctttgaaagctctacaagatgcttttggtcctatcgctcaaacaaatgtagttagtatgcaagctatttctggtgctggataccctggtgtttccagtcttgacattttggataacatcgttccatttattggcggtgaagaagaaaaaattgaatgggagacacgtaaaatcttgggctctgtcaatagcacaatttctggatatgagttgactgataacgttgtttctgctcagtgcaatcgtgttcctgttattgatggccatttgatgtgtatttctgtgaagtttgccaagacctctcctactcctgatcaagttcgcgaagtattggcaaactatgtttctgaacctcaaaagttaggctgctacagtgcccctaaacaagccatttatgttttcgatgattctactcctgaccgccctcaacctagactcgatcgtaacaatgaaaatggttatgcagtatcagttggtcgtatcagatctgattccatctttgatattaaatttgtctccctcgtccataacacagttttgggtgctgctggtgctggtattttgaatgctgaagttgcggtgaagaagggacttatg

SEQ ID NO: 46491 - DNA, 1416 bp, Schizosaccharomyces pombe
atgattgctgcaacacccgctaaatccaaaccatcggatgtcaacttggaacagacgttcaaaggtgtttctgaaacctcaaaaattgaccttcgaaggtctagggccgcttaccgacctctggaattatctcctactccctcgatttttgctcgtaattatcaacgtaatgcggtagactttactggattttttgtgttattttgggttgctgtctctattatgattttcatgagctttttagaaaatttcgaattgactggaagaccagttgttggcactatttttaaatactttcagtctaatttgttagatctggcaaaggcagaccttgctatgtcttcaatgtttctacttgcttttcctttccaaaagatttttgctttgggatatctgcggtggtatggtttaggcgtttacctctattccattcttattttactttttttaagccattgtgttttacgctgctgtcttagcaactggtcctggacgcatcgtgctatgtttattcttcattctatggtaatccttatgaagcttcattcctataacgttgtcaacggttggtattcttattgttatcattcgttaaataagcttcagtcaaaaaaaaccgatcttgatgatgatgaacgatcctcagttgagttttatgaacattgtctcaaccatcatggtaatacttatccggaaaatttaaccataccaaatgctttggatttccttttcatgcccagcttatgttatcaattatactacccaagaaccgcccatgtgcgaattcattatttgattgaatgcgctttgggaacgtttggttgtatctttcttttggtcattatttctgatcatttcatggttcctgtacttgctaaagccattcgaaccattattgaagctcctgaagacgcatctgctacttattttgctatacgtttaggccatactgtagcatttttgatgttcccatttatgcttagcttcctcctcgtgttctgggtcatttttgaaggagtttgtaatttcagcgcagagattactagatttgccgatagaaacttttatgatgattggtggaattgctggacttgggatcaatttgcccgaacctggaataagcccgttcattactttctccttcgccacgtttatgttcccctcaactctttcatgtcaaagtctttatcgacttttttcacgttctttgtctcctctgtattacatgaacttgttatgggatgtatcactttaaaaatccgcggttacggtttgttttttcaaatgactcaaatcccgtatatcattattcagcgacagaagtttgttcgaagacatagactgctgggaaatattgcgttttggttttctatcataattggtatcgctcttattgcagctctttatatcttattt

SEQ ID NO: 46492 - DNA, 2794 bp, Schizosaccharomyces pombe
gtcacgggtgaaactttagtagactcccaaaagtcactcattaataatgatacactcttgaatgagaaattaaaagaagactttgaagaaaatgtttccattggtacgtgtcggtgtgaccacttagtgtgaaaattacttatgaccgggttatttacattcatgttactaacgggtcatagacgttaaaatacacgaggaattgcgacgcgctttaccagattacgaagaaagcggttttcagagatttacttggcatataaagagctggcatgagttggatcgaagagctgtgagtccccagtttgcagttggcagtcggcaatttaaaattacctattttcctcaaggcactcttcaatcggctggatttacttcaatatttttggaatatattccaagtgaagaagaaaaattgagcaataagtatggttgctgttgccaatttgcatttgtcatttcaaatccaaggaagccttctttgagcgttgccaactctgctcattgtcgattttcaccggagattgtggattggggcttcactcaatttgccgagcttaaaaagctattatgccggcaagctcccgacgtccctccgattgttgaagatggcgccttacttcttaccgcctatgttcgaattcttaaagatcctactggtgtactttggcactcttttaatgactacgactctaaaatagccaccggatatgtaggcttaaagaaccaaggtgctacctgctatatgaattctctcttacaatccctttacataatacatgcttttcgacgaatcgtttatcaaattcctactgatagccctcaaggcaaggacagtattgcatacgcgttgcaacgctgtttctataaccttcaatttatgaatgagcccgtttccaccactgaacttactaaatcgtttggttgggattctttagattcgtttatgcaacatgacgtccaagagttcaaccgtgttctacaggataacttagaacgaagcatgagggatactaaggttgaaaatgcacttaccaacttatttgtcggtaaaatgaaaagttatattgcgtgcgtaaatgttaattttgaatctgctcgttccgaagattattgggatattcagttaaatgtgaaaggaatgaaaaacctagaggattcttttcgaagctatattcaagtcgagacgttagaaggtgataactgctattttgctgatacttacggatttcaagaagccaaaaagggtgtaatttttgaatctttccctcctattttacatttgcaattgaagcgatttgaatatgattttgaaagggacatgatgataaaaataaacgatcgatacgagtttccattagagtttgatgctaaagcgtttttaagtcccgaagccgatcagtctcagaattgtgagtatgttctttacggtgtattggtccattctggtgatcttcataatgggcattactatgcgttattaaaaacagaaaaagatggtccttggtataaatatgatgacacgagagtcaccagggctactttgagagaagttttagaagagaactatggtggtgattatatcatgcatcctccttttagatctcctgtcaaactaaaaagattcatgagtgcatacatgcttttatatttgcgcaaagataaattagatgaactcatgaatccagtttctgctgatgaaattccagaacatttgaaagaagctttgaatcccagtatccaacttgctgaacttcgcagaaaagaaagactagagagccatctgtatactaaagtgcaattaatcactccagaattttacagtgaacatcatgaatttgatattgccgattttggaaatgcttacaaagaagaaactatacctcaatttcgcattaaaaaggaggccaagttttctgagtttatcccaattgttgctgaaaaactgggctatcctcaggaatgtatgcgtttttggtatgttgtcaaaagacataactgtaccgtacgcgtggaatctcctgtgaacgaactgaattctacaatggaggaagtgaaaaacgtatggaattcacaaggtgaaatccttcgcttgtatttagaaatcaccccagaaaatgagctaagctcttctcttacacaccaaaatactggagaatggaatgccttcatttttgttaaatattttgatcgaaaatcgcaagagatttctggatgtggaactctccacgttaataaaagcgatgaaattcgttcaatatgtccgttactatgcgaaagagcaaatttaccgaagaacaccccgttaaatatatatgaagaaattaaaccggggatggttgattttcttcggttagaaaaaacgtttacacaaagtgaattgagtactggtgatattatatgttttgaaccatgccgcccatctgccttagaagatgatatcgttaactcaggttttgatagtgcccttaagttatacgactttttgagcaataaggttttggtattatttcgcccgcgatttattgaccaagatagcattattgaatttgaaatgctgctcgaccgaagaattaaatatgatgatctatgtattgaacttggtcaaaaacttggtattggtgctgatcatattcgacttaccacttgcaatccattgacttattctgctgggatggtagtccctaacgattcaaatattacactgtatgaaattttgtacagctcggaggaagaaatgccatctaatgttattttctatgagactatggacgtaagctttcagacttggatc

SEQ ID NO: 46493 - DNA, 1827 bp, Schizosaccharomyces pombe; identical to SEQ ID NO: 46412

SEQ ID NO: 46494 - DNA, 1560 bp, Schizosaccharomyces pombe; identical to SEQ ID NO: 46413

SEQ ID NO: 46495 - DNA, 1205 bp, Schizosaccharomyces pombe; identical to SEQ ID NO: 46414

SEQ ID NO: 46496 - DNA, 1383 bp, Schizosaccharomyces pombe
tccacaatggcaactcaagacgctgatattattattattggtgccggtatcaccggctgtgctttgggcgccgctttgggccgccaaggcagaaaagtgttggttttggaacgtgatatgtctgaacccgatagaattgttggtgaattgcttcaaccaggtggtattgaagccttagagaagatcggcatcgccgatgctgtcgaaggcattgacggtcaatggacttctggctatcaaatcttttatggcgattcaaacgtttccgttccttaccccagcaagcccaatggcggtgcataccaaggaattggtttccattatggtcgctttgtcatgaaccttcgtaaagcacttacaagcacccccaacgtcactgtaaccgaggccaccgtcaatgaacttttacgcgatgaaactggtgaggtgattaccggtgttgttaccagttctaaaaagtccgagtcccctgtcgagtacaaggctcccttgaccattgtttgtgatggttgcttttccaaatttagaaaggctttcatcgatcaccctatccaagtcaccgatcacttcttgggcttgattttgaccaatcccgattacatcgctcctggtcgtggtcatgtaattttaagcaaggttgctcctatggtcctttacccaatttcctctactgaagctcgtatcttaatcaactaccctggtaagaatttaccccccatggagactcttaaaaaatacgttttagaatcatgcgtcccaaacatgcccgaaaagcttcgcccttccctcaaggccgctgtttataacgatcgtcttaggtccatgcctaaccaatttttaccccccactgtcaaccgtaccaaaggtatgatcctcgttggcgattcaaacaatatgcgccatccccttaccggcggtggtatgactgtttgctttcacgatgcctatcttctttcccgattcatttccccttccgctgttcccgatcttctagactacgagcgcattttaaaccaaatgaacaaattccattggaagcgtaagggttacagttttgtaatcaacgttctttccattgctttgtacaaattgtttacccctaaaaatcgctatatgaaggctcttgaatcgggctgtatcgattacttcaagcgtggaggtaattgtgttgaaggtcccattcgtttattaggcggtttagaccatagcccttctcatcttatcggccacttctatgccgtctgtctctatggtatttaccaatatgtcttgtctggtcctgctttgcttatgcccgtccgtatcatcgaatccttattgattttcttacaagcttcgctagtaattatcccttatatccttagcgaaatgtcatcctaagtt

SEQ ID NO: 46497 - DNA, 4386 bp, Schizosaccharomyces pombe
atggaagtgcctcgcgcatctcctaaccaagagccgttatgttcgatttcaccgtcctccttggtgatcaatgaaattataactgtcgtgacggcaattagaaaaaccacgagatggaggaattctggtgttgcatccattttaggagtctcaacacttaaagacgaatttctggctgatggtttagaaagccgatggaaaacaaatggcgaaaaaagcagtagtatccgatatccattggttatggagttttcacagttaaaagaagatttgacgaaccgtgctagcttaaatggatacgatagtttaaagcttctctctccgtttttgaggacaatcaagtccccacgaatgacaggttatataactagcttatgtttatcagctatactcaaattcttttcttttcgaatcatttctgaagaatcacccaatttagcactgtcaatgcgtaatctatcgtttgctattactcaatgccgttttgagagcttcgatgcttcacaggatgaggctgtattgttgcgagtttctaggctaatggaagaattgttaagaggtcctggaaaagctgttttgagtgatgattctatttgcgaaattgttgaaacagggctcagtatgtgttgccagtctaggctttcccaagttttacgctatagtgctgaattatcgatgacatctatccttgaaaagatatttgaacgcttgaagtacattgatgtgaaaacggatagtgaagatttttgggacgcatccgaagaacactctatcaaaggagaggagttccattacaaaaaaatcaccgaaggcgatgagatttcaaatgaaatcgatcccttcggtattggttctattcgcgaagtttttcgtgtactagtttcctttattgactttggcaagcaaaagttttctgataatattaaagccatggcattgagatttataaacacagccttagaggtctctggttcacatattagcgattttccttcgcttcgagtactcatcactgatactttatgcaaatcacttctacagctcattcgtagtgatcatacagctttgctgacaaattccttgcttgtaatgactactttacttcaagcaatgcccggctctcttaaattgcagcaagagttatttatctcttatttaatatcttgtctccatataccttcaaccacacctcgtgaacgtaatgttgaaacatctttgcacaaggtagtttcttcgttagacctgagtgaggagattagtccagatcgtgccacaccaacttcgtttactgagagaaaaagatttgctttcgacacgagaaatagacctcctgaagttcgtgagcttatcgttgaatgtctcggatctttatcccgcatcccttattttttgatagacttgtatgtcaattatgattgtgaccctcaaatgtcagaccttgccattgatctgctgaaagttttgacaagaaattgccttgttgactctgctcgctattcaactgctaatgtaccaccactttgcctcgacgctcttttaaatttcatttactattttcatgagcatttacaaccttgttataatgaccccaataatactttcaaagatgatgtcgctaagacattaatcgaatcaaaaaagagaaaagcaattattattgaaggtgccgagttatttaatgaatccccttcagatggtattgcctttttaactcagcattctatcatcaagcaatccgacaatcctacttgtattgttgaattcttccattctactaatcgtcttagcaagcgagttttaggagagtttctgaccaaaggttccaattctcatattttaaatgcttttataagtgcattcgattttaaaggaaagagaattgatgaagcgttacgacttttacttcagtcgtttcgtttacctggagaatctcaattgatagaaagagttttagaaacattttctcattattacatgagtgcgaatcctgattccatgtcctcaaaagatgccgcgtttgtcctttcctactcaataattatgctaaataccgaccagcataacccaaacatcaaatctcaacgtcgaatgactttagatgatttttgccgtaacgtacgcggtgtaaatgatgggcaggattttgatcgaaattttttgtctgaaatttacaaagcaataaaagaaaatgaaataattgttgccgaagagcatgacactgagctttcatttttatatatttggtcaaagttacagcagagcgtgaaaataactgagccattcaagcgttcgagttctaacgtgcatgataaaattgtttttcttgaagtttggaaatcgataatggccgctttaatatacgtgttttctactgcgacagaagatactgtattctatagggttgtcaatggaattcagcaagctacggaagtggctgcagcatatgaattgaacgaaccggttgattatgctattgagcgcttttgtcaatttactgcgctcgatccttcttctgtgccaggtactcaattaaatactgctattaaagtggaagaccgtattattacagttagtgaattaagtgtacgttttggaagggattttcgtgctcaattggctcttctggttctcttttggataagtagtaagtttggtaatatcatagacgcaagctggcccttgttggttcagctcaccatttgtctagcccgaaataacctaattgataattcgtttttacctggtttcaagctgtttgggtatcaatggtttccatttcctgaacctccgttgaattctgggaaacccgcgttaagcaaagaaggaggtttattgtcagcattatcttcatatttatcaagttatgcaaatgatgaacctccttgtccaacagatgaagaaattcaacatactttatgtactattgattgcatctcttctgctaaaattgacaatttcttaactaaattggtcgatctcaagcaacccggattaaacaaacttctggactctcttcttagtctatcaaatccgtcgactagccttctgactgatgaaaacacagtggatgataacaaagtttcgtctgtagaagcactcagtaacatccagtctgcaatagtagctgatctgctgacatcgttatttttgggaactagagaatcactcaacaaattggaaagaagaacccaaattttgtcatatcttctatttcaaattgaacaatctggggatgagaaagttatcaaccaactctctctatatatcttcgagatgttcatggatgacgacttgaagttaagcgagaactcagaagactggggtttattcagtaagctgtgcaatcttttgaacgataaaaatattgttgtcagaaatcagagcttatcactttttcatcagttggtaaacaagtacccctttctacttgaaagttggataggactccagcttgtccaatccgctgttaatacaaatacagcagatattgatgatttatataggctgcttagcaaaatccctactaatttacttgatcttccaatgtttcaagtatatttaggttgcgttgatacgctaattcagactattgtgaaacaaatcgcgcagattttgtcaaagcaaaaaaagggagcttcaaaagggcttccgtttgataagtctatacttgataaccatagtgcagaattgaacgatgcatttaatttatttttaaaagcagcagttgagtacaaggttgactccaatgaaagttctgaacattttcaagatacaagatggaaaattatttacgatcatgtttgtaagctttgcctctcgcgaagtcgttctttaagagcagcatctttgtcatgtttgcagcgaatagtcgtggaacagttagatcagcctcacgaagttagttatactatggctctcttccacctggtgcttcttccaactatggaaaacatgatcactgttttaaccgagaaaccagagcataaaatattcggtctagcgcaagcccaaatgtttaatataatttgcaaaactgtgctgattgatatgaatgtgttgtcagcccaaaaggagatgctgcatacattatggctaaagttaatggacgtggccataaaattaagttcaatccatggttcagagtctatggctgaggtaatggaatctatcaagaatgtttttatgattttacacggtgctggagcactcgcaggacccactattgaggtcgatccagaaattcctgatcatctgataaaaacttggaatactacatggaataaccttttcatatactatccagaattatcaaatgacttaaatatcaacaacgaagccgaaatgaagaaagaaaacctaaaaaatccctcacaaacgactactgtt

SEQ ID NO: 46498 - DNA, 2676 bp, Schizosaccharomyces pombe
atgtcttctcttgcatctcagggtaataatgcttcaactcctgcatatcgttatgggtttcaaacttcagaagttggggacaggccaactgtaagtatgccttcacaacctgagtcgagtgctatgctcgaggatgatggaatggtgaaaaggaaaccttttgctgctataggagaagccataccaaaggtaattgatacaaccggagaatcagtacgtgaagcctttgaagagtttttattgtcattttctgatgaccgcgttgctggaggtgatgctctcccttctgcatcacaagagaaatattatgttcaacagattcatggattggcaatgtatgagattcataccgtttacgttgattataagcatttaacctcgtacaatgatgtgttagctcttgcgatagttgagcaatattatcgattttctcctttcttacttcgagctttacaaaagttgattgaaaagtttgaaccagaatattatagaagttctctttctcgtgaaaatgcttcactttcaccgaactttaaagccagtgacaaaacatttgctcttgcattttacaatttaccctttcgatccacaattcgggacttacgaacagatcgtatcggtagactcacgactattacaggtacagttactcgtacttctgaagtacgccctgaattagcacaaggtacttttatctgtgaggaatgccacactgtagtttcaaatgttgagcaagcatttcgctatactgaaccaactcaatgccctaatgaactttgtgctaataaaagaagttggcggctcaatatttcacagtcttcttttcaggactggcaaaaggtgcgcattcaagaaaatagcaacgagattcctacgggttctatgccacgaactttggacgtaattttgcgcggagatattgttgaaagggctaaggctggtgacaaatgcgcatttacgggaattcttattgccgttccagatgtctcacagctaggaattcctggtgtaaagccagaagcttatcgagattctcgcaattttggtggtagagatgcagatggtgtgacaggactgaagtctttaggtgtacgtgatcttacatataaactatcttttttagcttgcatggttcaaccagatgatgcaaatgataaaagcggtgcggatgtcagaggggatggttctcaagggatcgaagagcaagatgaatttttgcaatcgctttctcaagaagaaattgatgatttacgtgcgatggtgcattcagatcatatttattctcgtttgacaaactcactggctccctctgtttatggtcatgaaataattaagaaggggattcttttacagttaatgggtggtgttcacaagttaactcctgaaggtataaatcttcgtggcgacctgaacatttgtattgtcggcgaccccagtacttcgaaatcacaatttcttaaatacgtttgcaattttcttcctcgtgcaatctacacttctggaaaggcatcatctgcggccggtctcacagctgcagttgttaaggacgaagaaactggggattttactatagaagcaggcgctttaatgttggctgacaatggaatatgtgctatagatgaattcgataaaatggatctgtcagaccaagttgctattcatgaagcaatggaacaacaaacgatatctatagcaaaagctggaattcaagctacattaaacgcacggacatctatccttgctgctgcaaatccaataggtggccgctataaccgaaaaacaactttgcggaataacatcaatatgtctgctcctatcatgtcacggtttgatttattcttcgttgtactagatgagtgcaatgaatcagttgatagacatttagctaagcatattgttgacattcatcgtttacgggatgatgccatgcaacctgaatttagtactgagcaacttcaacgatatatcagatatgcaaggactttcaaaccaaagttaaatacagaatcttgtgccgaaattgttaaaaagtacaagcaattgcggatggatgacgcgcaaggtgctggtaaaaattcatatcgtattaccgtgcgacaactggagtcaatgattcgtctatcagaagccattgcaagagcaaactgtgtagatgatattactcctgcatttgtcaacgaagcatactctttattacgtcaatcaattatccatgtggaaagagatgatattgaggttgaagaagatgatgcagaggcccaagaacttgagaatgataatactaatacaacaaatggcaatgataatgtttcttcggaagaagctttgcagaaaccaaaagtaaaaattacttacgacaaatatgtttcgattatgaacggaatattacaggttttacgccagcgctctactgaaggtgtagatggagtaccagcgggagacctagttcagtcatatctcgagcttagggaagaccaattccataccgaggaagacatcatctatgaggttggtcttgtgcgtaaggtattaaccaggcttgttcacgaatcgatcatcatggaaattcaaaatttaactgacagcgccgtgaggcttccttttgaagaacgcgtattttcaatacaccctaactgtgacattgatgctctactgagcaatggcgatgttccgaac

SEQ ID NO: 46499 - DNA, 552 bp, Schizosaccharomyces pombe
atgtcgagcccaaggcgcagaattgagacggacgttatgaagctgctgatgagtgattacgaggtaactcttgtcaatgataatatgcaagaattttacgttaggttccatggaccgtctgaaaccccttactcaggtggaatatggaaagttcatgttgaactgccaagtgagtatccttggaaatctccaagtattggatttgtaaatcgtatatttcatcccaatatcgatgagcttagtggaagtgtttgcttggacgtgataaatcaaacttggtctccaatgtttgatatgattaatatttttgaggtttttcttccacagctactccgttatcctaatgcgtcggaccctctaaatggagaggcagcagctctattattgcgagagccgaatacctactatgccaaggttcgagattatatcgctcggtatgctaataaagaagacgctgatataactttgaacgactcttcagatgatgacaccatgtcttctattgacactgaatctggcgatgaaattgctggtccaatggactctgatttt

SEQ ID NO: 46500 - DNA, 1153 bp, Schizosaccharomyces pombe
atggcatcttcttccaatataaaacatcgtctttggttagacgggtgcatggatttcttccattatggtaggacttttctatcaattatctctagtatatctaatcacctaacactctataggtcatagtaatgccattcttcaagctaagcagttgggcgaaacgcttgttattggtatacattcggatgaagaaattaccctaaacaagggaccgcctgttatgactcttgaggagcgttgtttatctgctaacacttgtaaatgggtcgatgaagtggtaccctctgcaccatatgtgtttgatttggaatggatgagaagatatgggtgtcagtatgttgtacatggtgacgatatatctacagacgccaatggagacgattgttatagatttgctaaagcagcagaccaatacttagaagttaaaaggacggagggagtgagcactaccgagctcctagatcgattacttagttcggttcctttagagatttattctacacctgtatcggtactttcttcccaaattgatctcctcagaagatttgcaactgattccgacgggctaactccttttactgatgtttttatatataacactgagaagccagaaacccttatttcgggcacaaccttgctaaggttgaatcccgaaaagaacataatatacattgatggtgattgggatttgtttacagagaagcatatttctgctttagaactctgtactcgaatgtttccgggtattccaattatggcaggtattttcgcggatgagaaatgtttcgaaaagcctatgcttaatctgttagagcgtatcttgaatttactacaatgcaaatatatatcttcaatcctcgttggtcctccaccagcatctttgtttgcatcttctaaatacataaagttatgttttgatgagcagatctcgaaagtatattacccaatattttccactgacgtgagcataccagcgcttgacattagcctttccaataccccaaataatagtttttataaatttgataagctgggttctgatttgattaagcagcgggttatgttacgtcggcagcattatgaagaacggcagcgtcgaaaaatgggtaaaaatgctacagaacaaacgaccattaaaacttacgcataa

SEQ ID NO: 46501 - DNA, 1191 bp, Schizosaccharomyces pombe
atggatattcggccagctcgtataagtgaccttactgggatgcagaactgcaacttacataacttgcctgaaaattatcagttaaaatattgtaagttcaattcattgtaattcttgctgcacggcaatgaacttccagtattaaaacaatgattcttattttctaatttaatgtagacctttatcatgctatttcttggcctatgctttcttatgttgctactgatccgaaaggacgtgtcgtaggatatgttcttgcaaaaatggaagaagagcctaaggatgggatccctcatggtcatatcacaagtgtctcagtaatgcgctcctatcgtcatctaggacttgctaaacgtctcatggttcaaagtcgtaagtgttaattgagagcgaagtagattacggatatatccaaggaggagctagagggaaatcttaagcttttttgcagttgttatcgatgattattccaatatgtatatattttattttgtgcaagacttggtctgctaatactttgaattgttcatttggtgagttggttttttccttgcaacaattcattttttttacctaatttgttttcgacaatgtttccttcctgctgattccttgatattttcggtccattccttaaacaaaatttttttaaaaaaagtaaaagatactaactacttaaatgaacagaaagagccatggtcgaagtttatggcgccaaatatatgagtcttcatgttcgtaaaagcaacagagctgctattcatctttatcgtgatactttgcaatttgagtatgtttttactcgccatcattgaagagattctaacattattttagcgttcaagggattgaaagcaaatattatgctgatggtgaagatgcttatgctatgcagtaagtactttgttgtaaaaactaggttggggatggttgcatggatcgtttaatgagtattctttccaaaaactatatacaatctttgtgacaatcgttctttctttagtttggtcaacttctgtataattacctacgttgtttcagacaatatatgactgttcaacgtcatcacaactatctaggttactaacaatttttagcaaagatttttctactttgaaattcgatacaccagaaaccaacgacgaactagcaaaaaccgttcaatctcttgcattgaacaactaataaaat

SEQ ID NO: 46502 - DNA, 1986 bp, Schizosaccharomyces pombe; identical to SEQ ID NO: 46367

SEQ ID NO: 46503 - DNA, 612 bp, Schizosaccharomyces pombe; identical to SEQ ID NO: 46368

SEQ ID NO: 46504 - DNA, 1267 bp, Schizosaccharomyces pombe
atgaaaaatgacttgattcttagggctgcaaagggtattatactttcgctttagcaatttgtaagcgcttactcacattatgaaataataggagaagaagtagaacgtcctcctgtttggattatggtatgtaaaaaaaaagatgattataaatttgctaacgttcttttagaggcaagctggaagatatcttcctggtacgtgcacgacttaaacttgatcgtttgcactaacgagaccatagaatatcataagcttcgtgctaaacaaagcttttttgagatgtgtcaaacacctgaaacggcgtgtgagctaacacttcagccagtcacccgctttaaaggtctgcttgacgcagcaattatttttagtgacattttagtgatccctcaagcattagggatgcaagtggttatgcttgagcaaaaagggccgcattttcctaaacctctggttgtgcctgaagatattgaccttttagaaaaaactcccaacatctcggctaaattgggatatgtaatggatgcaatttctttgactcgcgaaaaattagatggacaggtccctttgatgggattttctggtgctccttggactattatggcctacatgattgaaggaggtggctccaaaacttttgcaaaagctaaatcttggctttttcggtaccccgaggcttcccacaagcttcttaaaatcattaccgatgccacggtttcatatctgatacagcaagtatacgctggagcacaggtatgagttaactctgattattttctatactaattcaaataatatatagctacttcaaatttttgattcctgggctggtgaattatcccccgaagactttacggagtatgcatacccttatctggtgcgaatatgtcaagaagttaagcaacacttgaagaaaaagaaacgagacgaggttcctatgattgtttttgcaaaaggtgcttggtatgcaattgaccaattgtgtgattcaggttacgatgttattggtttagactggacggtcagtcccaaagaggctgtccgtattcgaggtaatcgtcgtgttacattccaaggtaacttggatcctaacattttatatggcacacgcgaaattattgaagcccgtaccaaggaaatgatccaagattttggaggcggaaaacaaggctatattattaatttgggtcatggtattacacctggtgtcaatccagatgatgttcgcttcttcttagagaaatgtcatcaatatggctctgcgtaa

SEQ ID NO: 46505 - DNA, 348 bp, Schizosaccharomyces pombe
atgaagttagccatcggtaggcttttaagcccattatttttgaaaaatcctcagaaacccttgatcattactaaacgattttattcgacacccggagaacgaaggataaaggacatactcactgagaagctttcacctagttctttgagagttatcgacgtttctggaggatgtggcagcatgtatcaagttgcaattaaaagcaaagccttccaagggaagaacactttggcgcagcaccgtctagtcaattctatcctcaaagaagaaatcagaaatatgcacggactgaatttgtctaccgaagtcgaagacgatatatctgccggcggatcgactacaagttca

SEQ ID NO: 46506 - DNA, 3501 bp, Schizosaccharomyces pombe
ttcagcaagttgcaggatcgttcctccttgttaggagagaagtttaccaaggtgttggtagctaatcgatctgaaattgctattcgtgtcttccgaactgctcatgaactttcgatgcacactgtcgccatttactcgtatgaagacagactgtcgatgcatcgtcaaaaggccgacgaatcctatccaattggcaaggtcggtcagtacagtccagtaggagcttatctggctattgacgaaatcgtcagcatcgccaaacgcaccggtgccaacttggttcatccaggatacggtttcctttccgaaaacgccgaatttgccagaaaggtaaacgaagctggcatgcaatttgtaggcccctcccccgaagtcattgactctcttggtgacaaaacgaaagctcgtgcaatcgccattcgctgtggtgtcccagtcgttcctggtactccaggtcccgtcgaacactatgaagaagctgaggcttttgttaaggaatatggcctccccgttatcatcaaggctgccatgggtggtggtggccgtggtatgcgtgtcgttcgttctgccgataccttgaaggagtcatttgagcgtgctcgttctgaggcccttgcttcatttggtgatggcactgtgttcattgaacgctttttggataaacccaagcatattgagattcaacttatggctgataaggctggaaatgtcattcatttacatgagcgtgattgttccgtacaacgtcgtcatcaaaaggtcgtggagattgctccggccaaagatttggatcctaagatccgtcaagcactttatgacgatgccatcaagattgccaaggaagtgaagtattgcaacgccggtactgcagaattcttgctcgatcaaaaaggacgtcactattttattgagattaatcctcgtattcaggttgaacatacgattactgaggaaattaccggtgtcgatattgtatcggctcagttgcacgttgctgctggttttacccttccagaaattggtttgacccaagataaaattagcactcgcggctttgctattcaatgccgtgttaccactgaggatcctaacaatggctttgctcccgacattggtaagattgaagtttatcgttccgctggtggaaatggtgtccgtttggatggtgctaacggtttcgcgggttctgtcattactcctcattatgactctatgctcgtcaagtgtacatgccatgatgctacatatgaatatacccgtcgtaagatgattcgttcattaatcgagttccgtgtccgtggtgtcaaaaccaacattccttttgttttgcgtttattgatgcacgatacttttatccaaggaaactgttggacaacttttattgatgacactcctgaattgtttcaactttatcgttcccgtaatcgcgctcaaaaacttctggcctacctcggtgatcttgctgtcaacggcagctctattaagggccaaaatggtgagccagctcttaagtcggagattgtcatgcccgttttgttagacagtacaggaaatcaaattgatgtttctcatccatctgaaaaaggttggcgtaaattattgttagacaacggtcctgctgcctttgccaaggctgtgagaaatcacaagcgtggtcttatcatggacaccacttggcgcgatgcccatcaatccttattggctacccgtgttcgtaccattgatctggtaaatattgctccatatacgagccatgcccttgcttccgcttattctttggagatgtggggaggtgccacctttgacgtctctatgcgattccttcatgaatgtccatgggatcgtttgcgtagactccgtaagttggttcctaacattcctttccaaatgcttttacgtggtgccaatggtttatgctattcaagtttgccggataacgttatttactttttctgtgaacaagccaaaaagaacggtatcgatatcttccgtgttttcgatgccttgaacgatgttaataacctttctcttggaattgatgctgccaagcgcgccggcggtgttgttgaggccactatgtgttactctggcgatatgttaaatcccaagaagaagtataaccttgattactatgttaaccttgttgataaaatggttgaaatgggtattcacattttaggtatcaaggatatggctggcgttatgaaacctaaagctgctcgtcttcttatttctgccattcgggagaaacatccagagttacctattcatgttcacacccacgattctgccggtactgctgttgcttccatggctgcggctttggaggcaggagctgacgttgttgatgttgcaactgatagcatgtctggtcttacatcccaacctagctttggcgccgttttggcctctgtcgatggtactgataagcaattggagtttgataacaatcaattacgcgaaattgatagttattgggctcaaatgcgtttgctttactctccgtttgaatctgaaatcaagggtactgactcagatgtgtataaccacgaaattcccggtggtcaattaaccaaccttaaattccaagctacctcccttggattgggcactcaatgggctgaaactaagaaagcgtacattgaagccaataaattgcttggagatattattaaggtcactcccacttcaaaggtggttggtgatttagcccaatttatggttcaaaataaacttagtgctgaggatgttgagaatcgtgcgaccactttggacttccctgcttcagtactcgatttcttccaaggcttaatgggtcaaccatatggcggttttccagagcctttgcgtactaatgtacttaaaggtcgtcgtcaacctttgactgatcgtccaggtaaattccttcctgctgctgatttcgatgctatccgcaaattattgtcagagaagtttggtgtttcttcagattgtgatatcgctgcctacacccaatttcctggtgtctttgaggaatatcgtcaatttgtcgatcgctatggtgatttgaccactgttcctactaaattcttcttatctagacctgaaatgaacgaagaaatgcacgttgaaattgatcaaggtaagactttaatcgttaaatttgtcgctcttggaccattgaaccctcgtactggacaacgtgaagtttatttcgagttgaacggtgagaaccgccatgttactgttgaagataagaaagcagctatagaaactgttaccagacctcgtgctgatcctggtaatcctggacacgttgcagcccccatgagtggaacaattgtcgaaattcgtgttaaggaaggtgcgaaggttaagaagggagatattattgctgttttaagtgctatgaagatggaaattgttattagtgctcctcacagtggtgtgctcaagtctttggccgttgttcagggtgattctgtgaatggtggtgatttgtgtgctgttcttgaacacgag

SEQ ID NO: 46507 - DNA, 1338 bp, Schizosaccharomyces pombe; identical to SEQ ID NO: 26174

SEQ ID NO: 46508 - DNA, 2202 bp, Schizosaccharomyces pombe; identical to SEQ ID NO: 26173

SEQ ID NO: 46509 - DNA, 933 bp, Aeropyrum pernix
atgctagagcatctggtgcaggctgttgctgtaggtcacgctcttgtcgatctcaggctgtacgttgagagaataccgggtgtagacgaagaggcggtgattaaggatgagacgagaagtgtgggaggttctgcggcgaacgtggctgtagtgttgagaaggttaggggttcagtcaggcattattggaaagatagggctggacgacttcgggaggatagccgtggacaatcttatgagagaaggagtggacatctctggcctccgagtatctctgcgggataggactgggttctccgtggttgtgcgtgacaaggaagggtcgataactatttacagttttaaaggcgctgctgaaaagctcgagccaggggagattgacgcggacgctataggtagatcaaaacacgtacacgttgccagtctaaggcccgatactactcttaaaaccgtagagatcgctaagaaacgttccataactgtttcatgggatccgggcagggttttatcgaagatgggagccgagaggcttgccaatataatttctaaagtggacatcatctttgttaataggaatgaggcgaagaatcttacagggtatcatgattataggcaagctgcaaggcaccttaaaaaacttggtccaaaaattgttgtgataaagctgggagccagcggatcatacatcctttatagtgatggtgaggtattcgttccagccataaagccggagagagttgtggatacaactggtgctggcgattcttatgcggcaggctttatagcgggtcttctcaggggctacactatagaaaaagcctctttgtatgctactatcgtcgcctcaataaaagtatctaggcttggatctaacgcagctccctctcatgaggaagtggttgaaaaagccagagagctcggggtggagatttag

SEQ ID NO: 46510 - DNA, 1542 bp, Aeropyrum pernix
gtgaggaccggggggttactggtggggggttgcgacagcatactatccatagacataggtacgacgagaattaaggcgggcttagtggactgcaacaccctcgagataactgggagggggagcgtttccacccccgttagctaccctaggaagggatggtcggagcaggatcccgaagagctttggcaggctatagtccgggcttcgtcggcggcgttagaagggtttgaggcgagccgtgtatccggtgttatattctctacatacctggccggtgttgttcttttagaccgggacaattacgagttaacaccgataataacctggctggacgagagggcccacggcctccccagggagctgttcagcggggtattgaaggtctcaggatataatctcctccacctcgtggacctgctaaggctcaccggaggagcacccagcaagacgggcaaagaccctctctccaagatggtttggctccgggagaataagcccgacttgtttaccaaagcccacaccataggaacgctcaagacatgggtcctcgcgaaaaccgccgaagcacgcctggtaagccccgacgacgcccatctcacatggctagccgacacccggggaggcagggcggtctggagccccaggctagcgaggcgctatggaataccccttgaaaagctaccagggatagctggtccgaccgacgtggctggcgggctggtatcaagtgcagcaagagaccttggccttccacaaggaatacccgtaattgtgggggctggcgacatcgcctcctcagcagtgggctccggagctctggccgccggggagtatcacatatacgtggggaccagcagctggataggggtacacagtaccaggaggcttctagacgttagacactatatagggagcctcctctcagccaagccaggagagtatctcgtaataggagagcaggagatagcgggtgggatgatagactggatcttggatgtgactggcatggactacagagcagtggaggacatccactcgatacccccaggctccgaagggttaatagccaccccatggctgtacggcgagagaacaccaatagacgatccccacgccaagggggtgctcgtcggcctcacactcagacacactaagaaacacctagtaagggccgcagtagaaggtgttgcattgaacatcgcctgggcaatggagcacatgacacgtctcgccggtaagccaaagctggtgagaggtgttgggggaggttttagactcagaacgcttgccaaggttatagccagcgcactcaacgccacaatagaaactgtcagccagccagagatggcgggagttagaggcgccggagccctggctgccgcggctctaaaggggagtagcatagaatcggaagcgggaaaaataccagtatcgtggagggctgaagcagattctaacgcttccaaggcgtataaagatctactccaaatataccaggagatatacagccggttgaaaagcgtgtttagacggctctcctag

SEQ ID NO: 46511 - DNA, 762 bp, Aeropyrum pernix
gtgctacctttggggcaagcccctgttatttacgaggaaagaaacggggttgccataatccggctcaacaggcctgaaaagctcaacgccctgaatctagaggcgtggatgcaactgggcgagtatctccgtaaagcttgtaggagcgggatcaaggctgtagtcataacgggtagtggcagggcttttagctctggcgacgatatccggagcatgtactcgttggaaagtcttgaagactccctgtccttcttcaaaacactgcacggagccttagaggctatggcacgctgtagaaggcccatagtggctgctgtcaacgggctggccgtaggagggggcgccgagattcttctactcgcagacgtggttctagcctccagggaggcgtggtttgccttcccagagtctcacataggccttatccctcccctcctgtcaacactcggtaggagcgttttcggggagaggaaagccagaatgctgggaataacgggggcaaagctggatgtcgaggaggctaaagctatggggttagtagatgatgttgtcgagcccggagaactcgaggctaaggctttagaggtggcggagtcgcttggcttaataccagaccagtccgtggcagagatacgccgggccacagtagaaccttatagagttgagctggagaacatggtgaacaggcttgccgagctcgttctaactaaggaggctaaggagaggatgcggctgttcctagagaggaggaagaaagagtag

SEQ ID NO: 46512 - DNA, 2760 bp, Aeropyrum pernix
gtgtatgtcctgaagaggctcgagctgagaaacataatgagccacttcaacaccagtatagatttccgcgaaggcttcacagctatcgtaggccgcaacggcgcggggaagagcactatactcgaggcgatactgttcagcataaccccccatcaagcgcctaggaggtcgagcatgataagcgaaaactctagtcgaggagaaatataccttgccctccagtccagcgagggccggctactcgagttgaggaacaagctgatcaggagaggggggggtacgaatacggaagcggccatcatcaccctggaggggcggaggatcgccagcaagcccacggggtacaaagaggagatccataagatactcgggctcagggggctgcccaaccccgcatcgtacatagagaaggcgataataatctcccaaggaggactccaaaccctcgcagaaatcctgtcagaacctaaggagctgagagacctccttgacgccgccctaggctatgccctgctcaagcaggccatatcaaacatcggtgatgtggttctaggcgtttccccggacgggagtcctgtcaagctcggctccaagtctataaccaggcttcagtcagggtacatgacgctgaggaacgaggtcctgggagttgatagggagataagggaggcttccaagaggctggaagagcttgagagggagagggaggagcttgagaggcgtgccagggatctcgagtcagaagccaaggccttacagagcgagatagggaaactagagactatggaggagatgcttgtcaacgttaccagcatgattaggagcgagaggtcgaagctggataccatcaacacacgcctaagatatgcggaatcaaagatctcatccatcgatgacctcgagaagcggagggcggaactcagggcgaaagcttcgctggctcacgaggtcgccgagcttgcaagacttcagagccgattggacaagctggggagagacttggaaatgattagagatgctgtagaaaagctggaagtatcgcgcaggctcaaggagattgagtctgcgaggagggaggctgagaacaggcttctcgaggctagatccagcattaaagaggagcagaggcgatacactctcctcgactatcgtgtcaccaggggaaggagcatagtcacaaacattaggcgagtactatccgaatgccgctctaaagacctatgcggcagcgaaaaaccggagtctgtattggaaaggctagacgccgtgataaacgatctagaatcaaaagcccgggctctagaccaggaagcatcagccctggaagcagaagccaggaggttagtccaggccttatcaatgctagaggagagtggagggagcgcgagatgcccggtatgcggagccgagcttccccccgggagggcagaggctatagccagacactataggcacgaggcggaaagattaaggaaggctgccaaggagaaggctgctgaggctgagaaggccagggctgaggcctcccgcctacaggacaagcggaggaggatagagctactattatccaggctgaaccagcttgaggaaggcctgcgcgagctagggttccaaactcccgaggacctcgcgaaggccgagcagaagctaagaatgcttagagagaggctggaggagcttagaaagcttgagaacagtctcgaggagaaggttaggaatctatcccgcgaggaagttgcactgcgagaggctaagacaagagccctagaggttttacagcgtctaggcataaaggaggaggaggctagggagaagcttaagaccttgagcagcgagtcgaaaaagctcgagaggatgctcgtctcgaaagcggaggacctggccacgaggcttggaatcacagcgtacaggagcctggacgacctgctcgaaaaagcaagagaggctctagaaggtgttgacaaggagctatcagccatagagaggaggcttgaggaggctcgccggctgaaagaggaggctgcgaagctaaaatgggaggctgagcaggttatgaagaggcttgaggagctggaggctgaggagaagaagctgaggaaggaggtttctaggaagagtgagattgaggctaggctgaaggaggttcagaacactctcgcggagttggacgacaggatcagcaggattgacagggagatgggagagctacagacgagaattagagagatgaagtctaggaaggccagtggcgaggaagcactaaagctctacctacccgccgctgcttccaggaggattatggaggagataggggagattgcctataggaggctcttagcagtgctggaggacgagatgaacgatatactctccaggttcaacctagacgtggctggcgtggagattagggagaaggcggctagggagatagaggttaaggctatcggcggcaacggcgcctacaggccgcttgaggccgtcagcggtggggaaaggacggtcctggctctctcattcgtactagcactgaataaggctgtcggcggtaagctgggtttcttagctctcgacgagcccaccgctaatctagacgaggataggaggaggagcctggtagaggtcctcagaggcatcagcgtcgagggcctggtaaggcagctcgtggtggtgactcaccacgaagacgttagggattatgcagacaccatctgccttgtaacccgaacccagcagggaagcagggttgaatgcacctactag

SEQ ID NO: 46513 - DNA, 1206 bp, Aeropyrum pernix
atgatatgcctccccaggtactggactctacggcgtttttcaccgttgctcattgtaaccagcccttccgaaaccggtttagaactcgctcttcaggacattattttgattaatcaggagcccttcactctttacaaaaatggggggttagtattgggagtcaaccttagggagttgattcctcccgaggctaggagggaggtggagcttagggctctctcggggtatgttctagcgcttgacgcgtataacatgctctaccagttcctcaccgccatcaggcagcccgacggcactccccttttggatagggagggcagggttacaagccacctcagcggcctgttctacaggaccattaacctggtggaggagggtattaagcccgtctacgtcttcgacgggaagcctcctgaaatgaagagccgggaggttgaagagaggcttaggaggaaggcggaggctgaggcgaggtataggagggctgtcgaggcgggagaggttgaggaggctaggaagtacgctatgatggctgcgaggcttacgagcgacatggtggaggagtcgaaggagctgctggatgctatggggatgccctgggttcaggcgcctgccgagggtgaggctcaggcagcctatatggctaggaagggtgatgcatgggcgacggggagccaggactacgatagcctcctgttcggctcgcctaggcttgtgagaaacctagccataacaggtcgtaggaagctcccgggtagggatcagtatgtcgagataaagccggagatcatagagctcgagcctctgctcagcaagctggggataacaagggagcagttgatagcggtgggtatcctcctcggcacggactacaaccccggcggtgtgaggggttatgggcctaagacagccctaaggcttgttaagagcctgggagacccgatgaaggtgttggcttccgtcccacggggggaatatgacccggattatcttagaaaggtgtacgagtacttcttgaacccccccgtcacagacgactacaagattgagtttaggaagccggatcaggacaaggttagggagattcttgtagagaggcacgacttcaatcccgagagggtggagagggccctcgagaggctggggaaggcttacagggagaagctcaggggcaggcagtcgaggctcgacatgtggttcggatag

SEQ ID NO: 46514 - DNA, 960 bp, Aeropyrum pernix
atgggtgaggacaagagggagataaaagacataacagatctaccgggagtcggccctaccacagcccagaagctgatggaggccggctacaccactctcgaagccatagcggcggctacaccccaggaggtgagccaggcaacaggtataccgatactcacggcccagaagatagttgacgccgcaagagaagctcttaacatagacttcaagaccgcttacgacctgaagatcgagagcatgaacattaaaaagattacgacggggagcaggaaccttgacgagctgctgggcggcggtatagagactaagactataacggagcttttcggtgagttcgggagcggcaagactcagatatgccatcagctatctgttaacgtccagctccccgaagacaagggaggcctcgagggtaaggcggtatacgtagataccgagggcaccttcaggtgggagaggatagagcagatggctcgtggtgtaggtctagacccggacgaggttatgaagaacatttactggataagggctataaacagccatcaccagatagcgatcgtggataagcttttcactatggtaaagaatgataacataaagctagttgtagttgactctgtcacaagccacttcagagcagagttccccggcagggagaacctggctatgaggcagcagctgctcaacagacatctccaccagctcatgaggcttgcagacattttcaacgtagctgtggttataactaaccaggttatggccaggccggacgtcttctacggagaccctacccaggctgtgggaggccatgtgttgggccacgctcccggcgtcagggtgtacctcaagaagagcagggggaacaagaggatagcaagggtagtagacgctccacacttgcccgagggtgagacggtcttcgccataacggagtggggtataagggatccagagtag

SEQ ID NO: 46515 - DNA, 801 bp, Aeropyrum pernix
gtgcttggcgtaggaaaaataggcggtgcaatagtcaagtcgctactcagctgtggcgcggtcgttacaggcactggtaggcggagggaaactctcgagaggatttcacgcttaggggctgaggcgactgttgacaacaggctagcggctaaggtttctgacgttgttatacttagtgtaaaaccctaccagctaccgcgcctccttgaggagatccgggatgtgatggaggggaagatagttgtaagtgtagtggccggagtaagactttcgaccctttcccgagccttggagggaagccatgtctatagggcaatgccaaacataaacgctctcatagggaggagcacaactgcagttgctgagtatacaggagacaagcgtgcctcctttgtcgagtcaatactctcctgtatgggaagcgtttactggataccggaggagtggatggacgtgtggaccgcccttgtggggagtatgcccgcctatgtggcggttatgatagactctctaaccttgggcggagtctcggctggcctgcctagggaggtcgcctttaaagctgtaatagatactttaggggctacagcagagcatctaggtaaaagggatatacatccgtccgtccttagggatgaggttacaaccccggcaggtaccactatagaaggcctcaaggttattgagggggagggcgtcgacgccgctctaatacgtacggtcgaagcagctgctagacgggcggcagctattggagaggctattgataatgaagttagaagaagtctcaacctgcggtag

SEQ ID NO: 46516 - DNA, 792 bp, Aeropyrum pernix
gtgtcctctgaggccaccctagactcagagtttaccgattataaggctatgtttagatacgaggctaaggtgtttaaggaactagtagacagcgtgtctaaaatcctggacgagggcctgtttataataacaggagagggtctgaggcttagaggcatggatccggcgagggttgcattagtcgacatagaaataccgtcttcatcattcttcgacttctacatggctggggatgtcgagcgtgtggagctaggcgttaacatggagactcttaagggtgtagtggcgagggcaaagaagggtgaccagctggaggtaagggttagggaggataaagtcctgttcatcgtcgagagcgttgtcctgaggaggtatcttctccccaatcttgaagttatagtggatgttcctgaggatatctccctcgagttcgacgccaccgccactgttatagctgacgttgttaagaaaacactgcgtgatgtcgagcttgtgggagatattgtggagttcgacgctggcgaggattatctttccataaggagtgtaggtcctgagaggagaagggtagagaccaggctaactagggagagccccgccctgatagaccttgaggttaaggagccggccacaagcaggtacgacgtgggctacttgaagaggatgcttggtgtggctaagatagctgagagcatagagctgtcgttctccaccgacaagcctttgaagatggtgttcaagtcgccggacggcagtagggttacctaccttttagctccctcgacaggttag

SEQ ID NO: 46517 - DNA, 1041 bp, Aeropyrum pernix
gtgtcgctcatgtctgtagttaaagtcggtgtgaacggtttcggcactataggcaggagggtggccctcgcaataacacttcaaaaggacatgaagcttgtgggcgttgttaagaggaccccggactatgccgccctctacgccgcgtccagggggataccgatttacacacctactgctaaggaagcagaggagtttgagaaacgcggcataaaggtgggaggcaccctcagagagctcctcgcccgggttgacgttgtcgtcgacgccacgccggagggccagggagcgaagaacaagcccctctacagggaggcgggtgttaagcaggtataccagggcggggagaagcctgaggttgccgaggccagcttcagcaccctctgcaactacgaggagagcaagggaagggggagccttcgggtcgtgtcatgcaataccaccggccttctaaggcttatatgcaccctgaacagggagttcggggtcgagagtgtcagggccgttctcgtgaggaggggagcagatcctaaggaggttaagaaggggcctatagactctattgttcttaacccaccgaccctccccagccaccacgctgtagacgtaagaacagtgctaccctggcttgacataaaaactgccgccgtagcagtgccaacaacgttcatgcatatgcaccacgttaccctgaaattggcaaagcctgttgaaaagagggaggtgcttgaaaccctggcatccgccccccgtataatgctagttagcagtggtgacactggtataaagtcgacgtcgcagctcgtagacgcagctaggttatcgaggatgggctatgatatacccgagctcgtagtgtttgaggagagcgttgctgtggatgggagggaagttatgttgttccaggcggtacaccaggagtctatcgtcgtgccggaaaatatagatgccataagggctgttgcctcgtcccctctaaccctggacgaaaccttgaaggccactgacgggagcctgggcctcaggaaaaccctgtggtag

SEQ ID NO: 46518 - DNA, 1233 bp, Aeropyrum pernix
atggggggcaggctcgctactctggacgacgttgatgttaggggtaagaaggttatagtccgtttcgaccttaatagccctgtaggtaatggaggcgaaatactggacgactcccgtatagctgaggctgcaggaaccctaagggaactctgcgataggggtgcagcggtggtcgctctcagccaccagggcaggcctcttgaaagcgatttcgtcagcctggagagacatgcatcattactgtcaagatattcgggcgttgaagtgagatttgtgatggatgtaattgggcctgaggctctaaggacagttgcatcgctgagaccgggagaggcagtgctgcttgacaatactaggataattagcgaggactttattgaggctgagggcactgtccatgctagaggtattatggtcaccaggctctccaagctagctaacatgtatgttaacgaggctttctccgcttctcacaggagccaggcaagcattgtcggctttccctacgtcctcccctctgcgggcgggcgagtcttggagaaggagatccgctcgctaaaccgagcagtatcctcgggtgagagacccaaggtcgtcgtgctggggggcgcgaagctgaaggatgccgtcaggatagtggactacctatcctcatctggagttgcagacgaagtgctgaccacgggcctcgttggcctcctcttcctctatgcccgtggctacaggcttccgagagacgtgacaaagctcctggaaaagaaggggggtgaggaggctatagcgaaggctaggagaatcgttgaggaggggagaagggttaggacccctatagacttcgttgtggaggttggcgataagatctacataaagcctgcggacgagctgacagagggtgtgccaaaggacatagggccgtcgacggtagagtattttagagcgaagatgaggggtgccagggtaatagtgatgaggggtcctgccggggttatagaggaccccaggttcaggaggggcactgtcgagctggtcaaggccgccctgtcttcaggcgcctacactgtattcgggggcgggcatttcagggctatacttagagatctccccgaacatcttagtagtaaggtgggccacttgagcaccgggggcggggcactcttgtattatctgtcgggacggcccctccccggggttaaagccttagtagactcggcgaggatatttaatctggtttag

SEQ ID NO: 46519 - DNA, 2100 bp, Aeropyrum pernix
gtgaacgtggccgaggagatgcttagtggagaggaaaccctggctgtgggcgagaggttcaagacattcttagagaacttcagaacagaggaggggaagctaaagtacgtagaagcgatccgcaggatgataaactatgaagagactagcctcgaagtcgagtttaaggacctctaccgctacgaccccctcctcagcgaaatccttctagagaagccgagggagtttctgaaggaggcgtccgaagcccttaaagagattgtcgcgcaggagagccccgagtatgcgcaggggagggtgtttaccccccggtttacagggctcttcgacacggagaggattagagatataggtagcgatcacgtggggaagctagtacagataaacggtatcgtgaccaggatgcacccccgcgccactaggatggtgcgagctaggttcaggcacgacaggtgtggagccgagttctggtggcccgccaacgaggacgaggttctgggggaaaggattgagaggcctagcatatgccccgtgtgtggggagggcggggggaagtttaccctagtcagggacaagagcctgtacatagactggcagaagattatggttcaggagaggccggaggacgtgcccggcggccagatacctagaagtatagaagtccacctgagcagagacctggttgagaaggttagaccgggggatagggttaagatagttggtgttgtagggctccagtcgttctcctcctcaagcacgctatacagcctctacatggaggcgaacagcatactcctggaggagaagatcctggaggaggtgagcataacaagagaggatgaggagaagatactccagctctcccgcgacccatggattaaggagaagataatagcgagcatagcccccacgatatacggccactgggacctcaaggaggccatagcactcctcctcttcggcggcgtgccgaagcagaggcccgacggcaccaggactaggggtgatatacacgttctcttcgtgggagaccccggcgtggccaagagccagctgctccagagcacagcacaggtggcgcctagggtagtctacacgacggggaagggtagcacggcagccggcctcacagcagcggtgctcagggacccgaggacgggcgagtacttcctggaggcgggcgccctagtacttgccgacgggggtatagccgttatcgacgagttcgacaagatgtctaaggaggacaggggcgtcatacacgaggctatggagcagcagaccgtgagcatagcgaaggctgggataaaggctaccctcagcgcgagggccagcctacttgctgcgggcaaccccaagttcggctactacgacccgtcccgcagcttcgtcgacaacgtagacctcccggcacccataatctcgaggttcgacctgatattcgtggtccgggatgtgatagagaggagtagggacgagatgctagccagctacgtcctggagacccacactaatgtcgagctgttcaagcctgagatagatccggatctgctgaggaagtacatagccttcgcgaggaaacacgtcaagccaaggctaacgccccaggctaagaagctgctgaaagacttctacgttgagatgaggagcagcgccctccaccactcgagccaagagggcgcgaagccagtgcccataactacgaggcagcttgaagccctcatacgactgacagaggcgcacgccaggatgtccctgaagcaggaggctaccgaggaggacgccatagccgccatacgcataatgaccagcgtgctgcagagtataggcctagacctggagaccggtgagatcgacattgggataataatgacgggggcaagctttaggtcgagaaagataatgtccgaggttctagatcttataaaaagcatagtggaggaggagaggggcggtcaaggctgcgtcagggcttcggagattgtgaggaggctgggtgagaagaacataccagaggagaaggtgagggacgctatagacaagctgtacaggcaggggctgataatagagattaggaccgagtgctacaaggcggtctag

SEQ ID NO: 46520 - DNA, 768 bp, Aeropyrum pernix
atggtgtatacactcttgtcaacccccaggaccgccctaatacttgctggtggtaaagggaggaggtttagaccatacacagatctcatacccaaacctatgatacccctcggacgatctgaaaagcccctgctagagtatgtcgtaaaaatgctggccttgcagggagtcgagaatatagtcctacttgtcggctacaagtggcgctacatctacaactacttcggcaggggcgaaaagctgggtgtcaagatagattatagcatagacgatgagagatacagcggaacgggagggagcgttcttaaggctctagaggagggtagggtttccgatgaggacttcctagtttggtatggggacataatagccgaggtcggcctcgcctcaatgtacagtcttcacaggcaacatgatgcctcagcgacactagcggtggcggagaggtaccaagttcccgtcggagttgtgaaagcggggcgagaaggcgtcatagaggatgtggaggagaagccgtggataggagtcaacgtcttcataggggtggcgatatttagaaaagaggccttccgcgaggcagcagaaggcctgggaaccagcttcgacatcatgggggacatgatgcctatactagtgaggaagtccaaggccgtagcctacatctacgacggcccctggttcgacgtggggagtttggagaggtatgagaagcttagagaagatgtcatatcgaggctcgagcggaaactgttccccgagagcatataa

SEQ ID NO: 46521 - DNA, 930 bp, Aeropyrum pernix
gtgccaccggtgtactcgcaacccgagttgtccattagcatcgcaggcctacgtctccagcgacccgtcggcaatgccagcggcatcctaggctgggagcccagggaggccaggcttgtggaggagggtggtggagggtttttcgttgctaaaagtgtcacataccagccgagaaagggctatccccagcctcacctctaccctgtggcgggtgggattgttaacgccgtgggcctcgcaaaccctggttttagagaggcttcgaagatgctcgctcagactgtggaggaggcgtcgataccggttatagcaagtatagctgggggcgctccgggcgagtgggttgagatggcctcaacgctcgaggaggctggtgtttcggctgtagagctcaacctgagctgcccacacttcgctggcggaggcctcgagctgggtcaggatccggctgcggtggctagtgttgtgtctgctgtcgcctcgaccctaaggatacctgttattgccaagctcggctacagcgataggctagttgacgctgcttcgaaggccctagaggctggtgcgagggggctgactctgataaacagcatgagggcgatgaagatagatgtatacgctaaaaagcctgtcctgggaaacagggtcggcggcctctccggcaagccgatccaccccatagctgttagggcggtttatgaagtctatggggagacgagggcggacatatttgctgctggcggtgttgaaagctgggaggatgcggtggagttctacctagctggggctaaggctgttcaggttggagccgccttcatcacgatagggccccatgtcctccgctctatcgttgaaggtgtaagaaggtatctctgggtagagggtttcaggagcctgcaggatattgtggggtacgcgcatagagcctaa

SEQ ID NO: 46522 - DNA, 648 bp, Aeropyrum pernix
gtgacggcaaggagctatagggaggtggtgagtgctgttgaggagaaggtcgcctctctccggggaggcaggctcttcatattcctgggtggagaccactccataacatatgccactctcagggccctaaggtctttttataggggtaggctgggcctggtatatctcgacgcccatcctgacctttacgacgagtacgagggcgacaggtatagccatgcctgcacgctgaggaggatagtggaggaggggttcgtcgatccgcgagacgttattctcgcaggcgtgagggcggcaacccccagccagctggacttcgccgaaaaggcaggtataaccgtcctaggcgttgaggaggctgaggacctggcggcttatttgaaagagggcatgccgtactacatctcctacgatcttgacgtgctcgatcctgcctacgcgccaggtgtgggcaaccccgagcccggcggtctatctaccagggagatggtgaggattattaaaagccttccagaggatgtgctggcgttcgacgttgtcgaagcatcaccgccccacgacccctcggggctgactctcttcaccgcggcgaaaataataagggagactctggcgagagcccgccctcccggctggggagaggtgtga

SEQ ID NO: 46523 - DNA, 1410 bp, Aeropyrum pernix
atgggtggtgccgggttgtcgaggaggaggcttttcgggactgatggcgtgaggggcgttatagggtcggagctgactcccgagttcgtcctcaggcttgccagggccattggggcttactttggcaggggtagtaggattctcgttggcagggataccaggtctggaggggagcttttcgagggtcttgtggctgctggccttgctttcgagggcgtggaggtccacctcgccggcaccctgcctaccccagctctgcagctttatgttagggatcacggctacgatgccggtgttatggtgactgcaagccacaaccctccggagtataatgggataaaggttgtgggtggtgatggtgttgaggttcctagggatgtagaggagggcattgaggctctattctgggagggcaagttttcgactgtcgagtggaggagcgtcgctggccagcccaaacgcgtccacgacgccgtcgactattatgttaacagggtggttgaaaacgtttcagccttcacccagcgcggcggcggggagagggttgtcgtggactgcggcggcggggcaactagcttcacaacagtcgagatactaaagaggctgggggccaggcctatacccctcagctgcaagcccgaccccctgttctcctccagggatccggagccgactcccgatactctggggccagcggctagtctggtgaggtcctcgggtgcagtatttggcgtgggccatgatgctgatggggatagggctattgtaatcgatgatagaggccgggtcgtgtggggcgataggagcggcgccctcctggcagggtttgtcgccgaggtggggctggcgaagggcccgctcaaggtctacacaggcgtgtctagcagcatagttgtggaagactatctacgcccccgcggcatagaggttgtttggacacccgttggagcccccataatagccagggctatactgacccaggggggtatagcagcctttgaggagaacggcggctacatgcacccaccgcaccagtatgttagggacggggggatgaaggcggccctcctattggctatgctgagggcgacgggggagagcttgtcctcactcctggatagactccccagctaccacccgataaaaacaaagataccggcgtctagggaggaggcgctatgtgccgtggaggctgtcaagcaggagttccagggcgagaggatggtcaccatcgacggtgtgaaagtcataggcgaggggtactgggttctcgtaaggcccagcggcacggagcccgttgtaaggataatgttggaggccaggagcgaggaggaggctagggcgttgttcgagagggtgcttagggctgtcaaggaaaagtgcggcataccctccggcggcaggacctag

SEQ ID NO: 46524 - DNA, 1341 bp, Aeropyrum pernix
atggcgggagacagcagctccgacgatattgggggcgcgaggatcatagagatatacaggaggtacggcggcaagatagaggtcatgccgaaggttcctgtatcgggtgttgaggactttgcaatatggtacacaccaggagtggcggaggcgagcatcaggataaacaaggacccggacgagagcttcgagctcaccagcaggtggaacatggtcgccatagtaaccgacgccacacgggtcctcgggctgggcaagctgctgccagaggccgcgtaccctgtgatggaggggaaggcactgatattcaagctgttcggcggcgtggacgctgtgcccatagtacataggcgccgggagccgggcgctttcgcaagccttgtcaaggatctggagcccagcttcggaggggtcaacttggaggatattgagagccccaagtgcttctacctcctcgacttcctcaggatggagctggagataccggtgtggcacgacgaccagcagggaaccgcggcggccagcctagcggggctgataaacgcgttcaagatagtgggtaagaacctcagagagtcgaggatagtcctcctgggcgccggggctgctaacatagccctctacaggttcctcaaggcttatggcgtcaatccgaggaacatagtggtagtagacagcaagggggtcctccaccccgagcgtgaggatatggacaggcttctcttctctaacagatacaagtatgaaatcgccctggagacggaggggggcgggctagcgcctgggagtagcttggaagaggccctcaggggggctgacgccctagtcgccgcctccaggcccgggccaggggttgtcaagaaggagtggataaggggcatgtccagagaccccatagtgttcgcactcgcaaaccccacccccgagatatggccgtgggaggcgagggatgctggcgctagggtcgtcgcgacaggcaggagcgacctgcccaaccaggtcaacaacgccctcgtgttcccaggggtcttcaggggagccctcgacgtgagatcgcgggccataactgatgggatggctatagcggcggcggaggagatagctaggtatactgaggaggagataggaatcgaggaggataggatactcccccccataacagactggcaggtccactacagggttgcggccgccgtcgcatgggctgccagtagggagaaggttgccaggaagccgaggacctacgctgaggagcttgagaacgctagggctataatagagacgactaggaggaagtacggcgcccttctctcggcgggcctgatagagaggcttgtgtag

SEQ ID NO: 46525 - DNA, 1680 bp, Aeropyrum pernix
gtgaaagagttcttggcattgcccgagaagaccccatggaggccgggctatagtctcactatccacaagatctaccagtacgccctctacatgtggagcgacttggagatagtatcccgcaccactaaggggctggagagatacaccttctcagacgccgcgagaaggattgaaagcctagccaacgccctcagggcgctcggcgtgtccgggctcgacagggtagcaactatggactggaacacccactggcactatgagacctacttcgcggcccccatgatgggggctgttctccaccctctcaacgtgaggctagcccccaacgagatagcctacataatgaaccacgctgaggataaggttctgatcgtgcacagcgacttcctgaagctcgcggaggccatactcccccacgcacccagcgtggagcacgtggtaatagtggacgccgagtcccacccggacaggatagcaggcaggaggctacacaactatgaggacctcataaaggagcacggcgggaggttcgagtggcccgagctcgacgagaacaggccggctgcgatgggctacaccagcgggaccacggggctgccgaagggcgtgtaccacagccataggatgatagtggtccacgctctcagcggggccctagccctagccactaggggtaggaggagggttacaggggatgacacccttctccacatagtccccatgttccacgtgctagcgtggggactcccctacatggcgacgctcaccgggatgaagcaggtgttcccgggcaggctagaccccaaggtcctcctagaccttatagtgggcgagaaggttacagtcactgcgggcgtacccaccatactctacatgctgctctcccacccggagagcggtaagtacgacctctcaggactcctcttcgtcaacggggggcaggcgctccccaaagggctggcggacgctgctaggaagaggggcatagaagttatcgtgggctacggcatgacggagacagcgccaatattgactctagcaaacgtgccccaaaagtacatggacaggagcgaggagctatccctcacaaccggctggccagtccccctggtggagctgatggtggccgacccggagaccctggagcccgtgccgaaggacgggaagaccatgggagagatagtggtgaggacgccttgggtcaccccagagtactacaaggaccctgagaagacggagaaggcttggaggggaggctggttccacaccggagacatagccgtctggaccccggagggctacatacagatcgtggacagggacaaggacattataaagagcgggggagagtggataagcagcttgaggctcgagagcctcataagccagcatccgggtgtggcgcaggtggcggtgataggtgctaggcatccgaagtggggcgagaggcccgtcgccatcatagtcccgaagcccggatggcaggacaagctgactacagaggaggttagggagtggctcgccaagaacttcgtagagaagggcgaaataccgaagtggtggcttccagacaagattgtgcttgtggacgaccttccgaagaccagcgtgggtaagataaacaagaggagcctgagggagaagttcgcaaacatactagagcaggagccgcagcagtaa

SEQ ID NO: 46526 - DNA, 1401 bp, Aeropyrum pernix
gtggttcgcgtggctctaggcgtgagggagtataggaatatttctgagattaagggccccctcctggttgttgagggcgtgtcgagggtagcctacgatgagatagtcgaggttgagacggccgcgggcgagaagaggaggggtagagtactcgaggtgggtatgggctacgccgtggtccaggttttcgagggcaccaccgggataagcccgacgggcactgtggtaaggttcatggggaggcctctcgagatacctgtgacggaggatatgctgggcaggataatgaacggcctcggcgagcctatcgacggggggccgaagatagatgctgatgagaggagggacgtcaacggcgcccccttaaacccggctgagagggcctaccccgaggacttcatacagactggcgtaagcgctatagatggtatgaatactctggttagggggcagaagcttcccatattcagcggtgcggggctacctcacaacaggctggcggcccagattgccaggcaggccacggtgaggggtgaagaggaggagttcgccgtagtcttctcggcaataggcataaagtacgatgacttcctgttcttcaagaagttcttcgaggagacgggagcccttgggagggtcgccatgttcgtcaacctcgctgacgagccggcgatgataaggctgataacacccagggctgccctaacactggcagagtacctggcctacgagagggacatgcacgtgctagtcattataacagacatgaccaactacgcagaggctcttagggagataagcgctgcgagggaggaggtgccgggtaggcagggctacccaggctacctctacagcgacttggcaagcatatacgagagggcgggcagggtcaaggggaagaaggggagcataacccagatgcccatactgactatgcccaacgacgacataacccaccccataccagacctcaccggctatataaccgaggggcagatagtgctgagcagggagctccacaacaggggcatctacccgccgataaacgtcctcatgagcctctccaggctcatgaaggagggtataggccccgggaagaccagggaggaccacgccgaggtaagcaaccagctctacgcctcgtacagcaggggtgtagagctgaggagcctcacggcggtggttggcgaggagagcctcagcgagcgtgacaggcggtacctgaagttcgcggacctcttcgaacagaggttcctcaagcagggtgagagggagaacaggagtatcgaggagactcttgacatagcctgggagatactctcggtgctgccggaggaggagctggtcaacataaaggaggagactataaagaagtaccacccgaagtacagggcgggctag

SEQ ID NO: 46527 - DNA, 1797 bp, Aeropyrum pernix
gtgttggctgttaaggggtctatagttaggatctcgggccccttggtcgtggccgaggggatgagcggcgctcagatgtatgagatggtctatgttggcgaggacaggcttataggcgagataacgaggattaggggcgacagggctttcatacaggtctacgagtccaccagcggcctcaagcctggggagcctgttgtgggcacaggcgcccccctgagcgtggagctgggtcccggcctcctaggcacaatatacgacggcgtccagaggcccctccccataatcgccgagaaggtggccgaggtagaccctaggaggaggatgttcgtagagagggggatacaggcgccccccctgcccagggataggaagttccacttcaagccggagccgctgaaggagggtgataaggtagaggggggcgacgccctggggagggtgccggagactagcctgatagagcatgttgtcatggtgccccccgggataagggggaggcttaagtggctcgccagcgagggcgactatagtgttgaggacacgatagcggtggtcgagagggacggtagggatgtggagattaggatgcaccagaggtggcctgtccgtatacccaggcccttcaaggagaagctggagccccagctccccctgataactggggtcaggattatagacacgttcttccccatggcgaagggtggcacgggcgccgtgcccggggggttcggaacggggaagacggtgaccctccactcgctggcccagtggagcgaggctagggtggtcatatacataggctgcggcgagcggggcaacgagatgaccgaggtcctcgagaggttcccccagtataaggacccctggaccgggaagccgctgatggacaggactgtcctcatagccaacactagcaacatgccggtagccgctagggaggcgagcatctacgtcggcataacgatagcagagtactacagggacatgggctacgacgtcctcctcgtcgccgactccaccagcaggtgggcggaggcgctaagggagatcgctgggcgtctcgaggagatgcccgccgaggagggctaccccagctacctcgcctccaggctggccgagttctacgagagggcgggcagggtcaaggccctaggctccccggagaggagcggtagcgtgaccgtggtcggcgctgtaagcccgccgggcggtgactttagcgagccggtcacaagccacactacaaggttcatcagggtgttctgggctctcgacacgaagctcgcctacagcaggcactatccggctataaactggctcatgagctacagcgcctatgtagacctcgtgacgcagtggtggcatgagaacgtggataagaggtggagggagtatagggacgaggctatggacattttgctgagggagagcgagctccaggagatagtcaggctggttggtactgagggtttggacgagaaggataagatggtgctggagacggccaggctaatcaaggacgggttcctgaagcagaacgccttcgaccccatagacgccttcgcaacgcctcagaagcagttcaggctgctgaagatgattatggacatacacaggaagagcctagagctgattgagaagggcgtgacgacccagcagatactccaggccctcggcaggctttatatagacatagtgaaggcgaagttcaccatacccaacgaccagctggagaagatagacgagattagggatagggcgttgaaggcgctggatgagcttgtgtcgggctag

SEQ ID NO: 46528 - DNA, 750 bp, Aeropyrum pernix
gtgcaggaggtccacgactacggagcctaccttatactcgacgagtatgggggtgtaagggctttcctcccctggagcgagatagccagcagggcggtgaggaatatacacgctgtcctcaagccccgccagaaggttgttgtgaaggtcattagggtctacaagaagaggggccaggtggatgtcagcctgaagagggttatggatagtgagaagaagaggaagatgatgttctacaagaggtacctcaaggcggccaccctcgtcgagcttatagctgagaagcttgggaagagcgtggacgaggcctacagggaggtcctctggaagctagaggacgcctacggcgacccgatgaaggggctggaggcggctgtcctgcagggtagagaggctctggagaaggctggagtgcccgaagagtggatagagccccttctcgagactgcgaagactcacgtgagggttaaaactgtcaagataacattctacctcactctcaggagcatggctggcgacggcgtcgagagggtgaggaaagtcctcgaggcagccaagtcgcagatagagagcttcaaagactcgaaagtagtagccaggatatacaccgtcggcgcccccaagtacagagtggagctgcagggctacaactacaagacgctggagaaggccctggagaagatggttgaagcagccaggaagaccgcttccaaactgggcgtagaattctccttcgagagagaagactag

SEQ ID NO: 46529 - DNA, 702 bp, Aeropyrum pernix
atggtcgcctctatcgagaagattatagaggagggcgtgttcgtcgctaccggggaggggctgtctctgagggccctcgacactagccacgtagccatggtcgacctctactacccgaacaccgcgttcatcgagtacgatatcggcggcgagtctgtggagtttggtgtgtccttcgacctactctccaaggtgctgaggagggctaggaaggaggacgagctggtgctggaggtggaggggagcaggctggctgtgaagcttaagagcaggggggagaggacgttcaggataccgcaggtcgtcatgacctacgagaagctgcccgagcctaaggtgtcgttcaccgtcagggctaggatgctcggctccaccttcagggaggcggtgagggatttggagcctcacagcgagaccctcaccctcagggcactcgaggacgccctgcttctggtcggcagcagcgagatggccacggttgagatagagctctcacaatcccgaggctcgctcctagactatgaggcggagtcgcaggatagggctagctacagtatagaatatttcagcgagatgcttagcgccgcgcaggcggcggacgctgttgtagtgagcttctctgaggacgctcctgtgagggttgacatggagtacctgggcggtggtaggctgacgttctatgtatcgccgaagatcgagtag

SEQ ID NO: 46530 - DNA, 315 bp, Aeropyrum pernix
atgtaccccaagagggatggggccaggtatctcctggtgtgcaagagctgcggctacagcgaggaggcttctcgggaggaccaccaggcctacaggatgagggtgactgtcgagaaggggcctagggataagattgttgttatagacgacgagactcctgtcggcgcccaggtcctcaagggcagcgtgacctgccccaagtgcggccacgacgaggtgtacttctggatgatgcagactaggagcgctgacgagcctatgactaggttctacaggtgtaagaggtgcaggtacacttggagagagtacgcgtag

SEQ ID NO: 46531 - DNA, 1359 bp, Aeropyrum pernix
gtggctgttgatgcaccccggatagttgtggagcccccgggccctagggctagggaggtcctcgagagggacgagagggttataatgcagtctttcactcgctggtaccccctggttgttaaacgtggctacggggctgtggtggaggatgttgacggcaacaggtatatagacttcaacgctggtatagcagtgttgaacgtgggccacaatcaccctagggttgttgaggcggttaaacgccagctggagaggttcctgcactatagcctgacggacttctactatgaggaggccgtctccgccgcggagaggcttgccagatccgtccccataagcggcggggccaagacgttcttcaccaacagcggggccgagagcatcgaggcctccataaaggttgtaagggcgttcttcagggggacgaggccctacataataagcttcctcgggggcttccacgggaggacctacggggccatgagcgcctcagccagcaagccggtccacagggccaggttctaccccctcgtcccgggcttcatccacgccccatacccagacccataccgctgccccttccccggcctcgagggtgaagcgtgtggcgaggcggctgtaagctatatagaggactatatattctcgaagctggtcgacccgggagaggttgccgcattcctcttcgagcccatccagggcgagggcggctacgtcgtcccgcccgacagcttcctaccctcgctccagaagctggctaggaagcatgggatactgctcatcgcggacgaggttcagacgggcttcgcgaggacgggcaggatgttcgccgtggagcactggggtgtggagccagatgtcatggccctagccaaagccatgggaggggggctgccgctgggggctgcggtggggaggagcgaggtgatgagcctcccccgcggtagccacgccaacactttcggcggcaaccccgtcgccctcgccgccttcaacgcggtgatggacgttatagagggcgagaggctgtgggagaggtcgcagaggctgggcgagaaggcgctgaagatactgggggaggctgccgaggagctgagtatagtgggccatgtgaggggtaaggggctaatgataggcgttgagctggtcagggacgagaacaccagggagccccacaaggaggccctcgcctgggtgctggataggtctttcaagaggggtcttctagtgataggcgcgggcgtctcagccgtgaggatagcgcccccgctcaccatcgaggaggagctcttcgaccggggtctggagatactggtggaggtcctcagggaggccgaccgccgcttctcccaggtctag

SEQ ID NO: 46532 - DNA, 1422 bp, Aeropyrum pernix
gtggctcgtatagctgaggagcttgagaagattttcggcccggagaaggtggtctcagacccccacatagtgaggctctactcgagggagcctagcggcctggagggccgggcggaggctgtcgtcttccccgagtcagcccaggacgtgtctaggctggtgaggtacgcctacagtagggaggtttacatctacccccagggctcctccacggacctggcggggggcgccttccccgagaggccgggagtagtagtgtctatggagaggatgcggcgtgtgcgggaggtcagcgtgctagactctgtagctgtagtggagcctggggtcaggctttgggacttgaacgtcgagctctctaaataccgctacatgttcccgatagacccgggtagcgttaaagtcgccactgtgggcggcgccataaacactggagcgggggggatgaggggggcgcgctacgggacgatgagggactgggtcttggggctcgagatagtgctgccagacgaggagggcactatactcagggtgggctgtagaacactcaagtgtagacagggctacgacctggctaggcttatagtggggagcgaggggaccctggcgatagtaactgaggctatacttaagatcacgcccatgccggagaacgttgtcgtggtcctggcattcttccccaccctgagacagctggtggacgcggtcatagaggtaaagtcgagggccatcgacactctactgatggagttcatggacgtcgactcggcgagactcgccgccgaaaccctgggcgcagcgatcaggccagacggccacatgctgctggtcggcgtccctgttaacagggaagcttccaccagggttttggaggagatggtgtcaatagcaaaggcagcgggcgccgcttctgtctatacagccaagagtatggaggaggcggaggagaagaagcttctggagataaggaggagcctctttgcaacccaggctctactcacacagaagcagtttaaagggaggaaggtcatgatgctcatggaggacatagcggtacccccctcaaagctgctcgacgcggttgagaggctaaaggagcttgaggcaaagtacggattcaaaaccgttctaggagggcacataggcgacggcaacctacacccgacgataagctatccggtggacgacgagaaggccaaggaggccgcgctaaagtggtattacgacgtgatgaggatggccatagagctgggaggcacagtaagcgcggagcacggcataggcgtccttaagaaggaggcgctgaggcttgagctggaaagaatgggctctgttaaggctctggaaataatggctggcataaagagggtgttcgaccctaagggcatacttaaccccgggaaggttgtagcggctgagtga

SEQ ID NO: 46533 - DNA, 1377 bp, Aeropyrum pernix
atgagggggcctgtcaagatagtcgccacggtagggccatcatcatcctctgcctccatactagcacagatgctcagcctaggagttgatgtggctaggataaacgccagccacgggggtgtagagcagtggaatagcatgctggagtcgcttaggagggctgaggaggctgtcgggaagagggtcggagtggctgtcgacctagagggccctagggttaggactggtaacagcgagcctgttaagctggagaagggtgatctcgttacactaggcttcatggagggcgacgtgccggttgacgccagacagtttttcgaaacaatagacgagggcgatatagtgcttctcgacgacgggaagataatcctccaggtggagtctgtggaggggttccgggttaaagccagggttctagagggtggagtgctagggcctaggaagggcgtggttgttagaggtaaggagcccgatctcccgccactctcggctaaggataggagggcgctcgagttcttcgctgacaagggggtcagccacgtctatgtgagcttcgcccgcagtgctgaacatgttgagaaggttcgtaccgtggtgagaaggctcggactgaggcaggccaggattttcgccaagatagaggggcctagcggcgtgtctaggataggagagattgctgaggccagcgatggcgtgataatagctagaggagacctcgggatgcactacagcctagaggagctcccggagattcaggagcttatagtatgggaggctaggaagaggtacaagactgttgtgctagccacggagttcctgtcaagcatgatcgagaagccggtccccactagaagcgaggtagtcgatatataccaggcggtgcttcagacggcggacgcgctcatgctgacgggtgagactgccataggcaagtaccccgtcaagtctgtacagtggatggcaaagatatcctcccgagcctacaaaaagctggcgactagccccccggagaggcccaggcccacgtcgaccccctacaagctagcattggggcttgtagagctggcggagagcctcgactcccctctagtcgtctacagtaagaccggcaggttcgccgagaggcttgcaagcttcaagccgctcaaaaccttctacgtgggggtgcccagccgtgaggtggagagggttgtcagacacctctggggggctgagcccatagttgtgggcgattatccctacgaagcgggcctcgccaagacctatgagaagcttcgtagagagaacattatacacggtgatgaaaccgtggttgaggcggcctggagcagcgagaggggaatatacataatcagagttaggaacctggagttctag

SEQ ID NO: 46534 - DNA, 684 bp, Aeropyrum pernix
atggccttgggcatagtcgtcggcgtggatgaggctggcaggggaagcttagtcggggatctcgttgtggcgggcttcgcggttgaagaggcgaggttgggcgagctgcagagcctaggtgttagggatagtaagcagctcagccctgcggcgagagtggagctctaccgggagatctctggtgtaggcttcttcacagtggaggctattaggccttgggagatagacggggagaacataaacattttggtcacgaaggctgtggaggagatagtgtccaggatagtatcatatctcggagtccacccctcccttgtggtggtggacaagtacggcgacgtccagggcctcaggctcgctctaacgaggctgggcatagagcccaggtctatattggtggaggagaaggcggactcgaggtatcccgtggtttctgcagcgagtatagtggccaaggtcgtcagggatgcaaggctccaggtcctgaggcgcatgtatggggtcaggggtagcggctaccccagcgaccctgagacccgggagtgggtgagggaggtgttcgcccggggtgaggcgcccagggttatcaggtacacttggtccacagtcaggaagctggggggcccctggaggagtaagaaagccgggaggaaccggagtctggacgagttcctgggaggttag

SEQ ID NO: 46535 - DNA, 678 bp, Aeropyrum pernix
atgggggctggttgcaaagtggcagaatggatagcaggcgggctggagggccccgctggcagaggacttgacgagagggttgtcaggagtggcactactactgtaggcctcatcgcatcagaccacgtcatcctcgctgccgataagagggctacggcaggattcttgatagctagcaggcgcgtaaagaaaatagtcatgctctcaaactacgtcgccatgacggtctcaggcctggtagcagacgcccagatactctcagacgtgctgagggaggagatcaggctgtacgagatgactaataaggtcaagccgagtgtaaggttcgtcgcgagcctcctgtccaacatactcttcagcagcaagttcttcccctacatagtacagcttatagtcggcggctacgacacccagccaagactctacactctagacctcttcggaagtataaccgaggacaagtataccgccacaggctccggctccccaatagcctacggagttctcgaggagagatacagggaggatctaagcgtagaggaagcaattaaggtagccaccaccgccatacgctccgcggtactaagagacgcggcctcaggagatggggctgacgtcgttgtgataggcccgcagggctacgaggagaagtttataccgtacaacagcctcgtatag

SEQ ID NO: 46536 - DNA, 1143 bp, Aeropyrum pernix
gtggcgtctagggatagcctgggcgaggtgttcagggtatccatattcggcgagagccatggccccggggtgggggccctggtcaccggcgtccctccggggctggaggttgacgaggcctacatcaacagggagcttgagaggaggaggcccgggggcccctacgccagcccgaggagggaggcggacagggtggagatactgagcggagtcttcaggggcaggaccacaggggcccccatactcctcttcataaggaacgtcgacgtcaagcccgggttctacgaggagttcaggtacaagccgaggcccggccacgcagactacgtggcctacgagcgctacctaggccaccaggactaccgcggcggcggcatattcagcgggaggaggaccgccgcccttgtggccgcaggggctattgccaagcttgtgctggccaggtacggggtcagggtctacgcctacgtcaagtctataggcggcgtggaggccagggtggagccgagggatagcgaggagttcaggagggccatagacagggaccccctgaagtgccctgacccggaggcctcggagaggatgagaaggctcgtggaggaggcccggagggagggggacagcctggggagcgtggtggaggccgtggccttcaacgtacccccgggcctcggggacccgccgctgggaggggtcgacgccctcctggcaagggctgttatggcgatacccgcggccaaggctgtcgagttcggggagggcttcgccctcgccttcatgagggggagcgaggcccacgacagcccccgcgccgtgggggggaggatagtgcacgagactaacaggagcggcggcatagttggggggctgaccaacggcatgcccatagtgttcagggtcgccttcaaacccccctcgagcataccgaagcccaggaggactgtggacctgaggagcctcggcgaggcgtgggtctctggcaaggggaggcacgacccggtcatagggcctagggcggcgcccgtcgtggaggcggtcaccgccatagtcctggcagacctcctcctacttagggaggctctcctgccggagtgggttgaggacctcaggccgtggaccaggggtgaggctggtggggattga

SEQ ID NO: 46537 - DNA, 1284 bp, Aeropyrum pernix
atggtgtggctgagggctccagacagagtggttgtccacccctcaaccgtggagggcagggtcgaggcgccgccatcgaagagctacacccacaggatgctcttcctggcgcttctagcccgcggcaggagcgtggtaaggaggcccctggtttccaacgacaccctagcaaccctgaacgccgtagccctcctcggcgggaagccccggctggggaggggtgtggccgaggttgaggggggagaggttaggggtggtgccgtggtgtacgccgcgggcagtggtacgacgattaggatagccatgggtgtggctgcccacagcgccgaggccacgctgctatacggcgacgagagcctcaacaggaggcccgtccaccccctctcagaggccctgaggagcatgggggcccgggtatgcgacactggcggcaacccccccgtcaaggtctccggccccctaaggcgggctagcgtggaggttgacgcggctatcagcagccagttcgccacgagcctgctcatagccggctcccgcctcggcgagttcgagctctccgccgccaggctgtctagcagggggtacgtggacataacgctggagagcctctccatgttcggggtgagggtggagagggaggggtacaggctcttccgcctcaggggcactccgaagcctgtcgacgccgcggtccccggcgactacagctccgcctccttcatgctcgccgcgggcgccatagcggggagggtcgaggtggaggggctgaggcctgtcgaccctcagcctgacaggaggatagtggagctgctcaggagcatgggtgctagggtccgcgtggagggtggtgtcgtggcggtggagtcgacgggccctctggagcctgttgatgtagacctggacggctcccccgacctagccccggttgcggcggtcctagccgcctacgcccggggggtgagcaggctaagggggctagagaggctgaagtataaggagagcgacaggctctcagccatagcctggaacctagcgaggctgggtgtggaggcgagggtcagaggcgggatcctcgagatccgggggggcggtgttgaggggggagttgcgaggtcctggggagaccacaggatagccatggcaatggccgttgcaggcctgggggctagaaggcctgtggctgtggagggcttctccagggtgcccgactcctaccccggcttcctggaggacctcgcgaggcttggagcgcgtgttgaggcggtgaagggaggtggcgtctag

SEQ ID NO: 46538 - DNA, 678 bp, Aeropyrum pernix
atggcgggggagctgcacggcttcaacgtcaccaaacccctgaagagggaggccctctcgctggcctcaaccctagacagccacgccagggccataggggcggttaacactatggtggctggcgaggaggggtgggaggggttcaacaccgactggaagggcttcctagactccctcaagctctacacagcatcacccccggacaccgccctcgtcataggcgcggggggcgcggggagggcggcggcctatgccctggcaacctggggggcggggagggtcctgatagcgagcaggacaggcctcacagccaggagggcggcccaggatcttgccggcctgggggccgaggtggagcccgtacccccgggtgggcttgaggatgctgcggcagcctcggacgtcgtcgtcaacgccacccccctgggctgggacggcgtctccacacccgtagagagggggttcagggaggggtgtatagcggtggacatggtgtacaggcccctcgccacacccttcctcaggcgggcggcggccagcggctgcacccccgtggacggcctctggatgctggcgatccaggccgctgagaacatagcggtctggctagggctggaggccagcccggttgagctgaggacctacgccctcgaggccatgcgtgggggtcgaggctaa

SEQ ID NO: 46539 - DNA, 1077 bp, Aeropyrum pernix
gtggcacaggctgctgtagagaggagggtgttcaggctctcggttgatgaggagacggtggtggccgcgggtgtgggcgccctctccgaggccccccgcgccgccggggggacagcctatatagtgcatgaggaggccctctccgccgaggcagcaaggctggccaggatactggaggcccggggggtagaggtcctgggcgccgtggcggggggcggagagcgggtgaagagtctagactgggttacgaggctctgggacctcatgctccaggccggggtggagaggtcgacaaccgtctacataataggcgggggcgccctcctggacgccgcaggcttcgccgcgtcaacactcatgagaggcctatccacggttaacataccctccacgacactcgcagccttcgacgcggccgccgggggcaagaccggggtcaacctgagggggaagaacatggtgggcacgttccacaatcccaggatggtcctggtggagcctggcatagtggctgggcagccggatgagggctatagggacggcttcgccgagcttgttaagcacgtggccctctcgggcgacagggagcccgccgccagcctcctcccccaagccctcgccaggcggcccgccccgctggccaggctggccttctggagcctgggatacaagatgcaggtggtcgctggagacccgagggagaggggtttgaggaggatactaaacctgggccacaccataggccacgccctcgaggcggcctcaagctacacccttagccacggcaggtccgtctccataggcctggctggggagcttgagctcagcaggaggctggcaggcctcccccgcggtgaggctgaggatgtcctcgacatgctgtccacggcaggcctccccctagagccccctcccggcctggctggggaggccgcggggcttgtgggcctagacaagaagagggaggggggcagcatagtcatgccccttctggagaggctcgggaggcccaggctctccagggttccggtggagacggtctcccggctaatggtggagctgtggggcggggggtga

SEQ ID NO: 46540 - DNA, 831 bp, Aeropyrum pernix
gtgtggaggtggctcccagtggccggtttcaagggtgtaaagctagccctcaagagtgaggagcgcagggagaccgttgttgaggtggagggtgtaaggataggtggtgggagcaaggctgtgatagcggggccgtgtagcgtcgagtcgtgggagcaggtgagggaggcggcgctggccgtgaaggaggccggcgcccacatgctgaggggcggagccttcaagcctaggacgagcccgtacagcttccagggcctgggtttggaggggctcaagcttctgaggagggctggagacgaggctgggctcccggttgtgactgaggtcctcgacccccggcacgtggagactgtgtcccgctatgccgacatgctgcagataggggctaggaatatgcagaacttccccctgctgagggaggtgggcaggtccggcaagcctgtcctcctcaagaggggtttcggcaacactgttgaggagctgctggccgcggcggagtacatactcctcgagggcaactggcaggtcgtgctggtggagcggggtataaggactttcgagccctccaccaggttcaccctagacgtcgccgctgtggcggttctgaaggaggcgacacacctgcctgtcatagtggacccgagccaccctgcgggcaggaggagcctcgtacccgcactagccaaggccgggctggcagcaggggcggacgggctgatagtggaggtccaccccaaccctgaggaggctctgagcgacgccaaacagcagttgacgcccggggagttcgccaggctgatgggtgagcttaggtggcacaggctgctgtag

SEQ ID NO: 46541 - DNA, 1200 bp, Aeropyrum pernix
atgcagatagagtgggcggagaggcatatgcccgtgctgatgaggctccgcagcagcatgggcggcgataaacctcttagtggggttagggttgccgcgtgcctccacgtcaccaaggagactgctgtgctggttgagaccttgaggaagtggggtgccgaggtttacctggcccccagcaaccccctctccacccaggacgaggttgcagcggccctggcggaggctggtataggggtcttcgcctggaggggtatgacgcctgaggagtataagtgggccctatccactgtggccgggagggagccggatattgttatcgacgatggcgccgacctccacgtcctcctgcacgaggagatgaggagtgtgggggagaaggtgtggggcggcaccgaggagaccaccaccggcgttataaggcttagagccctagagagggaggggaggctcctatacccggtcatagctgttaacgacgccctaaccaagttcatgttcgacaacaggtacggtacggggcagagcactgtggacggggttctcagggctactaacatacttatagcgggcaagaccgtcgtcgtggcaggctacggctgggtcgggaggggtatagcggcgaggttcaggggtatgggggctaaggtggtcgtgacagaggtcgacccggtgagggctctggaggccgctatggacgggttcacagtaaccaccatggatgaggccgcctccctcggggacgtgttcataacagccaccggcaacataaacgtgatagacgctaggcacatggagaagatgaaggacggggctatactggccaacgccggccacttcaacgtggagataaacgtcgccgctctcgaggagatgagcgtctcgaagaggagggtgaggagataccttgacgagtacaggctccccgacgggaggcgcctctacctcataggtgaggggaggctggtcaacctggtggctgctgagggccacccgagcgaggttatggacatgagcttctccaaccaggccctagcagtgctgaagatagcgggggagagggggaggcttgagaagagggtgcacagggttgagaggatccaggacgagatggtggctaggctgaagctagagaccatgggcgtgaggatagatagcctgacggaggagcagaagctatacctgcagaagtggaaatag

SEQ ID NO: 46542 - DNA, 2538 bp, Aeropyrum pernix
gtgagaataagtgtcctctttaaatactttattcatttacctccgggtttaaccccttttatatggtgtttgtgtgtggagaggaggcttatcctctggcttgacgagatttctaaggacctcctccccctcgtgggcggcaaggccgccggtcttggggagatgatcaaggcgggcatacccgtcccccccggttttgtagtcacgagtgaggcttacaggaggtttgttttcgagacgggaatagcaggttttataaagcatattctggaggagaccatagtcagcggaaggcccgaggagtatgagaaggctagcgagctcatcaggagcaagttcgtcaggacccccatgccaccatatctcaggagggccatagtcgatgcctacaggaagctgggcaccctggttggggtggaggagccgagggtagctgtcaggagcagcgccacagtcgaggacctccctgaggccagcttcgcgggccagcaggagacgtacctgaatgtcaagggtgaggaggaggttgtggagaaggttaagacggcttgggccagcctgtggacggccagggcgctgagctacagggacagccttaacatagaccatgagacggctttgatggccgtcgtagtccagaagatggtgagcagccgcagcagcggggtgatgttcacgatacaccccgtcaccggtgaggaggacaagatcgttatcgagtcgatatgggggctaggggagtacattgtcggggggaaggtcacccctgacaggtttgtagtcagcaagtcggacctcgagatcctggaggtgaggatatccaggaaggataaggcattgttctacgatcccgatctcaacgagaacgtcgagataaagataccggagagcggggaggagctggaggacctcaggaggaagcaccccgcggtggctgaggttgtcgagaagtatggtataaggccggacgcaccctccctctccgagaaggaggttaaggagctggccaggcttgccataaaggttgagaaccacttcgcaaggccgatggacatagagtgggctatagacttcgagctcagcccgcccgagaacatcctactactccaggcaaggccggagacggtgtggtcgaggaagaaggaggaggcggaggcgaagccccctgaggaggaggccgtgccggagggtgaggtcctcgtcaggggggttcccgccagccccggcgtggcctccggcagggtcaaggttgccctgaccgtcgaggaggctgccaagaagatggagaagggcgacgttctcgtgacaaagatgaccgaccccgactgggtcccctacatgaagatggccagcgccatagtgacggacgaggggggcatgacggcccacgccgcaatagtggccagggagctaggcatacccgcggtcgttgggacgggcgacgcaaccaagaagctgaaggacggcatgctggtgacggtggacggcagcaggggtgtggtctacgccggggcagtcaagactgaggaggccagggaggaggaggccaggccggagctgggtgccgctgttgccgaggtgctctccgaggtctaccctgtgaccgccacgaagatctacatgaacctgggccacccggaggagattgacaggtataagcacctgccgttcgagggcataggcctcatgaggatagagttcataatctcgagctggataggctaccacccgatgtacctcatagagcagggcaggggcgtctacttcatagacaagctcgccgagggcgttgcgaaggtcgccagcgccatataccccaggcctgtcgtggtgaggttcagcgacttcaagaccaacgagtacaggaggctgaagggcggggagaagtacgagacactggacgagaggaacccgatgatagggtggaggggcgtctccaggtacatacaccccaactacgagcccgccttcaggcttgaggttagggctataaagaaggtcagggaggagtggggactgaagaacgtctgggtcatgttccccttcgtgaggacgacctgggagctggagagggcgctgaagataatggaggaggagggcctctctaggggcagggactttaaggtgtggataatggttgaggtgccgagcacagtcttcctggcggacgagttcgcaaagatggtcgacggcttcagcataggcagcaacgacctaacccagctcgtgctcggcgtggacagggacagcgggttcctggcgaagatgggctacttcgacgagagggaccccgccgttctaaggtcgatagagattcttatagagaaggctcacagccagggggcgactgtcagtatatgcggccagggccccagcgtctacccggagctggtagagttcctggtgaggaggggcatcgactcgataagcgtcaaccccgacgccgtggtgagggtgagaaggcaggttgccagcatagagaggaggataatgctggagaggctggaggagctgggctccaggctctccaggctctag

SEQ ID NO: 46543 - DNA, 942 bp, Aeropyrum pernix
atggtgggacagcccttgataacaatacttggcgctggcaaggtcggaatggccacagcggtcatgcttatgatgaggggttacgacgacctcctactcatagccaggacccctgggaagccccagggcgaggcgctcgacctggcccacgccgccgccgagctcggagtcgacataaggatcagtgggagcaacagctacgaggacatgagggggagcgacatagttctggttaccgcaggtataggcaggaagcccggcatgactagggagcagctcctcgaggcaaacgccaacaccatggccgacctggccgagaagatcaaggcctacgctaaggacgccatagtggttataaccactaaccctgtcgacgcgatgacctacgtaatgtacaagaagaccgggttcccgagggagagggttatagggttcagcggcatactcgactccgccaggatggcctactacatctcccagaagcttggagtcagcttcaaaagcgtcaacgccatagtgctaggtatgcacggccagaagatgttcccggtgcccaggctatccagcgtgggcggcgtcccgctggagcacctcatgtccaaggaggagatagaggaggttgtctcagagacggtgaacgcgggggcgaagataaccgagctaagggggtacagcagcaactacggccccgcggcagggctagtgctcacggttgaggcgataaagagggactccaagaggatatacccctacagcctctacctccagggcgagtacgggtacaacgacatagtggctgaagtgcccgcggtcataggcaagagcggtatagagaggataatagagctgccgttaaccgaggatgagaagagaaagttcgacgaggcagtgcaggctgtgaagaagctagtcgaaacactacccccacagctcagagagtaa

SEQ ID NO: 46544 - DNA, 1218 bp, Aeropyrum pernix
gtgctcacccccttggcgggaggttataacaggagggtagacctcataaccggcagcccgacgcggaagatagatgccgtgagggagaggctggcccgggagggcagggacgtcatactgctctccacgggccagcccggcttcctcccacccacgttccttagggagaggctggcccaagccctcctcgacgaggggtttaagaggctttactcctacaccccgacccccgggtacgccgacgttagggaggcgatagccgaggacctcgcagcactaggcggccctaggatggagcccgacgacatacttgtcaccgcgggcgggcaggaggctatgttcgcaaccctctccacaatactggagccgggggacaaggttatattgatggacccgacctacttcggctacagacccatagtcgagtacctgggagggagggtggagtgggtcagggcacccccctccctggggttccagcccgacgaggagaggcttaaggaggcgttcaccagggacgtcaaggcagttgtgcttgtctcgcctgacaaccccacaggaaggctactctccacagagtctgcgaagcttgtcgccgacctcgcggtggacacgggggcgtggatagtctatgacgaggcctacaagacgctggttttcgagggcgagcacgtctacctctacaaactcgcaccggacaacactatatccataaacactttcagcaaagacccggggttccccggctggaggctgggctacctctacgggcccggatggatagtcgggaagattaggctagtgtcggaggagctggtgtactgcccccccagcatagcgcaggtggcggccaaaatatacctggaggatagggaggggaggctcaggcacctggagtacgccagggagttcctgaagacgaggatggaggccatggcgggtgctctagaggagatgctgccggaggcagtgttcgcgaggcccggcggctccatgttcataacagtagacctctcaagctacctctcgaaagcctctataacgtctgaggacctctctgtaaagctcctagacgaggagtcggtggccacggtgccaggccgctacttcggccccagcggcgacacaatgctcaggctgagcttcgccaccgaaaccccggagaggataagggagggtatagggaggctggctaggctgctggagaggctggcttga

SEQ ID NO: 46545 - DNA, 1308 bp, Aeropyrum pernix
gtgcaggttatggcttcccctccttgcactaccgaggagctctcgcctcccccagggggttctctagtcgagtatagcggcggcagccttagggtccccgataaccctgttgttgcgttcataaggggcgacggcgtgggccccgaggttgttgagagcgctctaaaggttgtggacgccgccgtgaagaaggtttacggggggtctaggaggatagtctggtgggagctcctggctggccatctcgcccgggagaagtgcggcgagctgcttcccaaggcgacgctggagggtataaggcttgccagggtcgcgctcaaggggcccttggagactcccgtgggcacgggctatagaagccttaacgtggctatacgccaggcgctagacctctacgctaacataaggcctgtgaggtactacggccagccagccccccacaagtatgcggatagggttgacatggtgatattcagggagaacacggaggacgtgtacgccggtatagagtggcctcatgacagccctgaggctgcgaggattaggaggttcctcgcagaggagttcgggatatcgataagggaggacgccggcataggggttaagccgataagcaggtttgcaactaggcgtcttatggagagggctctcgagtgggccctcaggaacggcaacacagtagtcactataatgcacaagggcaacataatgaagtacactgaaggggctttcatgaggtgggcctatgaggtggcgctggagaagtttagggagcatgtggttacggagcaggaggtccaggagaagtatgggggggttaggcccgagggcaagatacttgttaacgacaggatagccgacaacatgctgcagcagattataaccaggccctgggactaccaggtcatagtggcgccaaacctcaacggcgactacataagcgacgctgcgagcgccctcgtcggaggcataggcatggccgcggggatgaacatgggcgacggcatagctgtcgccgagccggttcacggcaccgcgccgaagtacgcgggcaaggacctgataaacccctccgcggagatactgagcgcctcactactgataggagagttcatgggctggagggaggtgaagagcatagtagagtatgccattaggaaggcggtgcagagcaagaaggtcacccaggacctggccaggcacatgcccggggtccagccgctgaggacaagcgagtacacggagacgctgatagcatacatagacgaggcggacctgaacgaggtcctcgccgggaagaggggctag

SEQ ID NO: 46546 - DNA, 1662 bp, Aeropyrum pernix
atgactattgtttggacaccggttaaagggtggttcctcgtggctttatggaggatagagaagcctaagaacgagcctttcctggagtttaggcctgggactaaggagagggagcttctaaagaagaagctcgaggaggttaagagtaagaccgtcgagatccccctgataatcggggggaaagaggtcaagactggtgagaccgtcgagatacgcgcgccccacgataaggatgccgtgctggctgtagcccaccttgctggggaggaggagataagggatgccatagagaaggccctggacgcttggacaaagtggtccgagatggagtggtaccacagggcctcagtcttcctgaaggctgcagacctgctggcggggccctacaggcttgaggccgatgctgtcataatgcttaaccactcgaagacgccgtgggaggcggagatagacctggcagaactcgtggacttctggaggtttggggcctactatgctagattcatcttcgaacagcagcctgagcaggctcccggcgagctaaacagggtcgagtggcggcctctagagggcttcgtattcgcagttcccccgttcaacttcttcagcataggaggtaacctgcccaccgcccccgcgctcgtggggaacgtgtcgatatggaagccttccagatgggttatatactccaactacataataatgaggatcctgatggaggctgggctacctccgggcgtggtaaacttcgttcccttcaacaccaagtactcgagcatagtgctctcccacccagacttcgcaggcctccacttcacagggagctactcaactttcgtcaggctctggaagatgatagcgcagaacctggacaagtacaggaacttccccaggatagtgggcgagacgggcggtaaagacttcattgtggtccacccgagcgcagacataaccgaggcagtggttgctacgataagaggagccttcgagtaccaggggcagaagtgcagcgctgcctccaggctattcgtacccaagagcatgtggcccaggttctgggaggccatgaaggcggagctggataaggttaaggtcgggccggttgacgacttcacagtattcatgggcgccataataagcgaggagcagtttaggaagatagtctcctacatagagtatgctaagcagcatcccgaggagtaccagataatctacggtggcaagtatgatgacagtaagggctacttcatatggcctactgtcgtgctcaccaacaacccgaagggcaagctgatgacagaagagatcttcggccctgtgctcacggtctacgtgtatgacgacgacaagtatgatgagatactgtgggttgtggacaaggcagctccctacggactaacagggtccgtgttcgcgaaggatagggaggccatactcaaggcggagaaggcgcttaggtatgcagcaggcaacttctacataaacgacaagccgacaggatccatagtggctagacagcccttcggaggcgccagatggtcgggcaccaacgacaaggcaggctggttcacaaacctcctaaggtggctgaacccgagatcgataaaggagaccctagtgccgccgaaagagtggagaagaccctatatgggagaggactag

SEQ ID NO: 46547 - DNA, 1674 bp, Aeropyrum pernix
gtggttgagatggctgcgacgggatatcctgtgctgatactcaaggagggcacccagaggacctacggaagggaggctctcagggctaacatactcgccgcaagggtactggctgagatgctcaaaagcagcctaggacccagaggcctcgacaaaatgcttgtcgacgctttcggtgacataaccgtgaccaacgatggagccactatagtgaaggagatggagatacagcaccccgccgccaagctgctggtggaggtggctaaggcccaggacgctgaggtgggtgacggcaccacgagcgtcgtcgtcctcgccggcgccctgctagagaaggccgagaagcttctagacgagaacctacacccaaccataatcatagagggatacaccaaagccatggaggaggccctcaggcttgttgacgaggccgccgtcccagtggaggttgaggatgacagtgttctgaggaggattgcggagaccacgctagccagcaagttcgtgggcaccggccccgagagggataagataatcagcatggttatcgacgctataaggactgtggcggagaaaaggcccgacggcggctacgaggttgacctagactatgtcaagattgagaagaagaagggcggtagcctgctggacagcaagctggtcaggggtatagttctcgacaaggaggtcgtacacccagcgatgcctaagagggtcgagaacgcgaagatactagtcctagacgctccgctggaggtccagaagcccgagctaaccaccaagataagggtgaccgacatagagaagcttgagagcttcctcgaggaggagactaggatgctgagggatatggtggagaagatcgccgccaccggcgctaacgtggtgataacccagaagggtatcgacgaggtggcacagcacttcctggcgaagaagggtatactggctgtaaggagggtcaagaggagcgacatagagaaggtggccaaggcgactggcgcgaagatagtgactagcctgagagacctgaagcccgagtacctcggctacgccgagctggttgaggagaggaaggttggagaggataagatggtgttcatagagggcgccaagaacccgaagagcgtgaccatactgctcaggggcgccaacgacatgctgcttgacgaggccgagaggaacatcaaagacgctctccacggcctgaggaacatactgagggagcccaagatagtgggcggcggaggcgccgtcgaggtagagctggccctcaagctcaaggagttcgccaggactgtgggcggcaagcagcagctggctatagaggcttatgctgaggccctcgagaccatacccaccgtgctcgccgagagcgctggcatggacgccctcgaggctctcctaaagctgaggagcctgcacagccagggctataagtttgccggtgttaacgtgcttgagggcaagatagaggaggacatgaccaagataaacgtctacgagccagtgctcgtcaagaagcaagtgataaagagcgccagcgaggcggccataagcatactgaagattgacgacgtgatagcagcagccccgcccaagaagaaggagaagaagggcaagaccggcgaggaggaggaagaggagggcggcggcagcaagttcgagttctag

SEQ ID NO: 46548 - DNA, 783 bp, Aeropyrum pernix
gtggacctcggtatccagggtaaactggcggtggtcacggctggcagcagcggcttgggctttgcctcggccctagagctagccaggaacggtgccagacttctcctcttcagcaggaacagggagaagctcgaggccgcagcatccaggatagcgtctctcgtcagtggcgcccaggttgatatagtggctggagatatcagggagcccggcgatatagacaggctcttcgagaaggcccgggatctcggaggcgccgatatactcgtatacagcaccggaggacctaggccgggcaggtttatggagctgggtgtggaggattgggacgagtcctacaggcttctggccaggagtgctgtgtgggtcggccgccgggctgcagagcagatggttgagaaggggtgggggaggatggtttacatagggagcgtcacactcctaaggccctggcaagacctggccttgagcaacataatgaggctgcctgtgataggcgttgtgaggacactagcccttgagctagccccccacggtgtaacggtgaacgcagtgctgcccagcctcatactaactgatagggttaggagcctggccgaggagagggccaggaggagcggcataactgtggaggaggctctaaagtctatggcgtccaggatacctatggggagggtgggcaaacctgaggagctggccagcgtggtggcgttcctagcctccgaaaaggcttcattcatcacaggagccgtcataccggtcgacgggggagcacacatctag

SEQ ID NO: 46549 - DNA, 1203 bp, Aeropyrum pernix
gtgcatagtttgggaagagccgttgctattgtaggcactggccactcgaaattcggtgtcaggaacgacgttaacattgcggagctcgcatgggaggccatgagggaggcagcctccgaggcgggcatagagcttagggatgtagaccaggttgtcgtcggcaacgctggcgggtggagcagcgagtacctctcaagcatagtcctcctcgagtatgccgggataagcgggaagcctgtttacagggtcgaggctgcctgcgccaccgggagcgctgcgataaaggctgctcacgacgctatcgcggcgggggaggctgacctggtcctggttgttggtgttgagaagatgaacgagagcccgacgccaatagtggttgagatgatagggagggccgggaactatttctgggagttcgagaacttcggcctaactttcccaggctactacgccctctatgccacagcatatatgagcgagttcggcgctactgaagaggacctctgcagggtggcggttaagaaccaccaccacgccagcatgaaccccaaggcccacttcccccgggctataaccctggagcagtgcctccagtccaggtatgtagcatggccgctgaagctatacgacagcagccccataacagacggggccgccgctgttgtcatggctagcgaggacctcgccaggaagcttacagacagcccggtgtggatacactcgataggaatggccagcgacactagcaacctgagcaagaggcccgacttcctcgtacacagggctagcaggctggctgcggagagggctttcaagaagctggggatagagattgaggggtcctacaagcacttcgacttcgccaacgtgcacgacgcattcactatagccgagatactggcctacgaggccatgggcttcgcaaagctgggagagggctacaagctggttagggaggagcagacgtacgtaggagggctaataccggtgaacctggacggcgggctgaaggccaagggccacccgataggggctaccggtgtcagcatggcagtcgagcacgtgaggcagctccagggaagggttgagaagggcaggcaggccgagataaaacgcggcaggagcctggcacacaacgtcggcggcaccggccactacgccttcgtaacagtatacggcctagacaagcccaggagtcgctag

SEQ ID NO: 46550 - DNA, 978 bp, Aeropyrum pernix
gtggaggccctcaggggtgttagcttcagcttccccgagtcatccataacagctgtcctgggcccaagcggctgcggtaagactactatgctgaaggttatagcggggctcctgaagcctagaaggggccgggtgttcttcgggggtgtcgactatactggcctgccgcctgagaggaggagcgtgggcttcgttttccaggacctcgccctcttcccccatatgacagtctacgacaacgtcgccttcggcctcagggctagggggtttagcgggggcgaggttaggaggcaggttgagtgggcgcttgaaaccgtcggcctcacaccgccccgggagttcatggggaggagggttacaggcctcagcggggggcagcagcagcgggtggcgctcgcgagggccatcgcctacgagccgcccgtcctactcctggacgagcccctctcccacctagactttaagatcaggcagcggctcctcgccgagctgaagaggctgcagaggaagctgggttcaaccatgatatacgtgacccacgaccagtgggaggccatggagctggcggacacgctggttataatgagggatggtaggattgtgcagcatggtacgcccagcgaggtctacacgaggcctgccaacgtctacgtagccacgttcttcggcgacgccaacatcatccccaaagagcttctcaccccaggcagcgggggggagtgggccattatggtcaggcccgaggaccttgagatagttagaaacgggtccccagtcccccagggctggccgaggctggaggctgttgtggaggacctcgtgttccaggggcccctgataagggtcgagctcaggtggagggggggaaggttgagggctgtggtgccgaggaggacggcgtccagcctaccccggccaggtgaagccgtctcggtgacctggagtcctgataggggcgtggatgttgcgctcgagtag

SEQ ID NO: 46551 - DNA, 918 bp, Aeropyrum pernix
atggccttgttcgaccccaaggtggccacactagcgcctcccaagagggtcaggttcgtcattagaaagtatgatcccgagagcgggaggagctggtggcaggagcacgaggttgagacgtacaggggtatgacggttctagacgctctgctgaagatcaaggaggagcaggaccacagcctcaccctcaggtacagctgccgcatggcggtgtgtggtagctgcggcatgaccattaacggcacgcccaggctggcgtgccagacccaggtggcccaggtggctagagaggacgcgcctgtggtcagggttgagcctctctacaacttcaaggtggtcaaggatcttctgaccgatttcaccgagttcttcgagaagcacaggcgcgtaaagccctaccttataaggagggatgtggatgagcaggagaacccgacactcgagtacaagctgctccccgaggagtacgagcagttctaccagtacagcctctgcatagcctgcggcctatgcgtggccgcctgccccatattcgccagcgacaccaagttcctcggcccccaggccctctcccaggcttacaggttcgtggtggatcccagggacgaggggtatgtggagaggcttgagatcgtagactctatagacggcgtcttcggctgccacttcgcagccagctgcagcgccgtgtgccccaaggaggtggacccggcgggcgctatacagaggctgaggagcctcctactcaagtacaggctaggcctgtacaagaagaggataaacggcgtggtaccaccaatggaggctaagaaggagagggtccccctgccgccggaggcgcagcccctggacggcgtagacgtggagaagcttgaggagacgccccccgagatacccgttgaaaagctggtcgcctag

SEQ ID NO: 46552 - DNA, 1722 bp, Aeropyrum pernix
gtggtcgttgtcggaacgggtatagcaggtctgagggcggcggtggagattaagaggaggtatggcgacaagctggatgtaggcctggttagcaagatacacctcatgcgtagccacagcataagcgctgagggcggcactgccgctgttatatacaaggaggagggggatagctacgccctccacgcttgggacactataaaggggagcgacttcctggccgaccaggacgctgtgtggatattcgtcaagctaatgcccgaggaggttaggctgctcgagcattgggggatgccctggagtaggaggcctgatggaaggcttgctgtgagggctttcggcgggcacagcgtcaagagaacgcttttcgccggtgataagaccggcttctacgagatgcacaccctctacaacaagctgctacagtatgacgggtgggagaggtatgacgagtggtatgccaccaacatcgtggtggaggacggggagtttaggggggtcttcgctataaacccgagggacggcgacatatacctgttcaaggcgaaggcgggcataatagcgacaggaggggctgggaggctctacaacttcgccacatacgcccacaccgtaacgggagacggttggggcatggccctgagggcgggcctccccctgaaggaccccgagttcttccagttccaccccaccggcctgatcccgagcggcatactgataacggagggcgccaggggcgagggaggctatctcctcaacaacaggggggagaggtttatgcttaggaaggagtgcgcccccaagatggccgagatagcgcccagagacatagtgtctaggtgcatcataagggagatactggagggcagggggttcaaggacgacgtctcagggctggagtacgtgcttctcgacctgaggcacctgggggaggagaagataaacgagcggctacccgcagtcagggagatagctataaggtacgctggcatagaccctgtcgaggagcctctccccgtcaggccggtcgcccactacaccatgggcggcataaggacggacagctactacagggtgctggacgcggagggcaggtgggttagaggcctgttcgcggcaggcgaggttgcagcggcaagcatacacggcgccaacaggctgggaagcaacagcaccgccgagtgccttacctccggtaggatagcggggatgctagcggcagagtatgccctcaaggctgaggcgcggggcgtggagcctgagaggtttgagaaggaggaggcctgggtttacggcctcgtgaagagggagtcggggacgccgagctacgcgattaagagggagctgagggacaccatgggcaagtacttctacgttataagggatgaggagggtatgaggaggggtctcctcacaatactgaagctgaggaagatgttcagagaggatgtctacgtcgaggacaagggcaggatatacaatacagacctaatagcggccctggagactgcgaacatgctagacgccgcccttgcagtggcaaaggccgccttgaacagggcggaaagcaggggggcccactacagggtcgactatcccaagagggacgacgagaactggctgaagcacaccctagtcaccgccagcggggaggacgacgtgaggatagactacgagccggtcaggataaccacttggaagcctgtcgagaggaaatactag

SEQ ID NO: 46553 - DNA, 444 bp, Aeropyrum pernix
gtgcctcctggggtgggcgggcaagttattgaggttgaggtggctggcgtcaggttcctcctacgcaaggacctcaggtacacggagagcgacgagtgggccaggctggaggacggggtagccactgtaggtataacggacttcgcgcagaaggagctgaaggacattgttggcgtggagctccctgagaaggggaggaaggttaagaagggggaggcggtggcgacggtcgagtccataaaggctactgcagacatctacgcccccctctctggcgagatagtcgacgtcaacgagaagctcctagaccagccggagctgataaacgacgacccctacggtgagggatggatattcaagatcaaagtcgaggatccaggcgagttcgaaagcctcctcacgcctgagcagtatgttgagagcgtcaggaagaggaaggagtaa

SEQ ID NO: 46554 - DNA, 528 bp, Aeropyrum pernix
gtggcccggcccggccatagcggccgggtaacacccggactcatttcgaacccggaagttaagccggccgcgttggaggctccagtggggtccgagaggccctgcaggggcctccaagccggggccgggccactacaacggccggtgcctactatgtccccagccacctccagcctcatagtctacaccctcctacatcttatccccccgggcaaggtgaccacctactcctccctagccagggcctcagggctgagcccgagagccgtggggagaatacttgccaggaatcctagccccatagccgtcccctgccacagggtcgtgaggagcgacggcagcataggaggctactccatgggcgggcccagggttaaggctgccctcctgaagctggagggggtgaggctataccgctccggaggatcgtggcgagtgcacccggaggatatcgtagacttgtccagcatcctcctagaccctccggagggcagtgcagaagctttatcaaccgtaaaggctgattaa

SEQ ID NO: 46555 - DNA, 1155 bp, Aeropyrum pernix
gtgagggcggttccctatcttgagggtagcgctaagaaatacgctctggctgctgttgatgcggagaagaggggggactacgaggcggctatcgtaaacctcaacaaggcgatcgaatacctcaccgagatagtcaggaactatccggactaccctctagcccacatctaccggaggctcatagcccagtaccgcaggaaggttaaggacctcgagaagaaggcgaggatgatacccgcctccggggacgaggtctatgtcgacacccaggagaaggatggcggcggtgaagacgaggcccccgagttcgtgttgaaggagaagcccagcgtcaccttcgacgatattgccggtctcgaggaggctaagaaggctataagagaggccatagtcttcccggtcaagaggcccgacctattccccctaggctggcccaggggtatactactctacggccccccggggactgggaagactatgctggcgtccgctgtagcgaacgagatagacggtgagttcctctacgtcgacgcggcaaacataatgagcaagtggctgggggagggtgaaaagaacgttaagaaactcttcaactacgcccgcaacaaggccaaggaggggaagcccgttgttatattcatagacgaggttgacgccctcctgggagtccacggctccgaggtgggtggcgaggttagggttaggaaccagttcctcaaggagatggacggcatacaggacaagggcagcaggctgcacgtctacgtaatagcggcgactaacaagccctggaagctcgacgaaccattcatacggaggttccagaagaggatctacgtccccctgcccagcagggagacaaggaagaggatgcttgaaatgtacaccaggaagctcaggctagccggcgacgttgacctagacaggctggcggagatgctagaggggtataccgggagcgacatagccgacatagtaagggaggcctatatggcgacggtgagggagctcttcgagaaggggaaggtggatggggagcccaggcccataaccatgagtgatttccaggagatactccgcaggaggaggccgagcgtcgaccacaggctcctgaagacgtacgaggagtggacggagaggttcgccgcagtctag

SEQ ID NO: 46556 - DNA, 561 bp, Aeropyrum pernix
atgcctggcggagatgattttcgaggcgatagcagggtcgtcgtgatctcggggcccccgggctcgggcaaatcaacctacgctaagaggctggccgaggacctgggcctctcatactacagtacaggcaccatattccgctctatagccagggagagggggctgagcctggcggagatgagtaggctcgctgaggaggatccgaggatagatctggagatagataggaggaccctggatgtggcgtcccggggcggcgtggttatagacagccacctcgccgcctggctcctcagggacaaagcgcagtatctcgtcctggtgaaggcgccggtgtgggttagggttaggcgcatagcaaggcgcgacggcgtccccctcaggagggcgcttgccgagactgtggagagggagtggagccagaggctgaggttcaagaggtactacggcatagacgtctcagacaccaccatattccacctgacggtcgacacgagcatgtacagcgtcgaggatacctacaggctcatcctcgagggggctaggaggaggggcctctga

SEQ ID NO: 46557 - DNA, 771 bp, Aeropyrum pernix
gtggcaggggctgttttagacccctccacaccccctcctacaaccgggacgtcttggaggtggcctgggttaagggatgccgatccctacagggaggctaggctcaggatggtggagcagcttaggaggagcgggctggtgaccagcaggagggtgctcgaggccatggccagggttccccgccacctcttcgtgcccccggagtacagggggatggcgtatgaggacaggcccctccccataggccacggccagacgataagcgcccccggggtggtggggaggatgctccagctcctcgacccccagcccggggagaaggtcctagacgtgggggcgggcagcggctaccagtccgccctcctcgcagagctcgtaacccccgggggcagggtctacgcggtggagaggatacccgagctggccgagtacgccagggagaacctggagaagacgggctaccggggggtggtggaggttgtcgtgggggacgggagcaaaggcctcccacaacacgccccataccacaggataaaagtggccgccgcagcacccaaaccccccaaacccctggtggaacagctagcccccggcgggagaatggtcatacccataggaacaccagatctccaaatcctaacaatcatagagaaaacccccgacggcagagtgagggagaggagggacatagaggtcctcttcgtacccctaataggggaacacggatacagagaagactggcggaaacaatactggcaatggtggcgatga

SEQ ID NO: 46558 - DNA, 885 bp, Aeropyrum pernix
atggtaacccccctcaggggcggctccgttgacaagaacgccgcctcctggctcgcctccaggctgtccgagagcggtgtagacggggtcttcgtcccgggcaccacgggcgagtggtacctcctcgacccccacgagagggctgaggcgttcttcgcagtagcctctagcgccatagcggggctcaggctcgtggcgggcgtctcgggctacaggcctgaggagtcctacaggctcgccgaggaggcggcgggccacggggcccacgcggtgatggccgtgccccccatctacttcaggccctcgacagacttcctgagggagttctacggcgagatcaagaggagggccggagggctgccaacatacatctacattttccccgagaggatgggctacaccctagcagtcgagcaggtggagagcctggtggaggcgggtgtggttgacgggatcaaggcgactgtgaccgacgcagcctacatagcaggcctagccgccgttaaggagaggaaccccgagttcgaggtcctcgccggcggcctggagatgctggtgcacacctcgctctccgggggcgacggcgttgtggacgcctactccaacgtagcccccaagctggccgtcgagctggcggagagcctagagaaggggagcgttgagagggtagcggggctccaggggagggtgctcaagctctcgcgaatactagggaagaggagcctccccgccgtcctcaaggcagtgctccacgtgctgggcgcccccatcacgggggaggtcaggaagcccctcaaacccctgacccagccagaggctaacgccacggccaacgccctctgcaccagctacagggactatcttctccccggtctagaatgctaa

SEQ ID NO: 46559 - DNA, 1218 bp, Aeropyrum pernix
gtgtcaatgttgggtctaacgctaattagcctcacgcctcaacagctccgcttggagtttccgtcgtgtgggtgcggcgcgttgaagctgtacgagtttgaggctaaggagattctgcggatgtacggtgtcgagactcccccctctgttctggtgatgccgggcgacgatgtggcggccaagattagggaggcgggtttggagccgccgcttgttgtgaagagccaggtactcgtcgccggcagggggaaggccgggggtattaagctggttgagagtgttgaagacgctgtcagggttgcaggggagctttggcgtaagcctataaaggggatactcccgggggccctgcttgtggagaaggctgtcccccacgatgccgagctgtacacctcgataattatagacaggagtgagaggaggcccgtcatcctggccagcaggttcggggggatggatatagaggagattgccagggagaagcccgagagcattgtgaggcactatgtagaccccttcctggggctgaggggctatgaggccaggatggtggggaaggccataggcctctcgggcaggctgctaaacagctacgcatccttcctccaggtcttgtacagggtgttcacagccctggaggcggagctcgtcgagagcaacccactggccatcgtcggcgacaaggtggtccccctcgacgccaggataatcgtggacgacaacagcctgttcaggcacagagagctcgtggagaggaggagggttgagcagaggggcgagtacaccgagtgggaggtcaaggctaggcagcagggactcccattcgtcgagctggagggcgacataggcatcataggcaacggagccggactcacaatggccaccatggaccttgtataccacttcggcgggaggcccgcgaacttcctcgacatagggggcggcgccagggcggagctggttaagaaggccgtctccttcctcctagagttccccaaggcggagaagatcttcataaacgtgttcggcggcataacaaggggcgacgaggtcgcccgcgggatagtggcggcggtcagggagtccggctccagcaagcccctagtggtgaggctcagcggcaccagggaggaggagggtaggaggatactcgaggaggctgggatctacgcctataccgacccggtggaggctgtaaagaaggttgtatccctctag

SEQ ID NO: 46560 - DNA, 894 bp, Aeropyrum pernix
gtggggtggtgtgtgatggcggttctggtggatagcgagacgagggttctcgtccagggcataacaggcagggagggctccttccacgccaaggccatgcttgagtacggcaccaaagtggttgccggcgtgacccccgggaagggtggcagcgaggtccacggcgtcccggtgtacgatagtgtgaaggaggctctggccgagcacccggagataaacacgagcatagtattcgtcccagcacccttcgcgccggacgcagtctacgaggcggtggacgcggggataaggcttgtggtggtgataaccgagggcattccagtccacgacaccatgaggttcgtgaactacgccaggcagaagggggccaccatcatagggccgaactgccccggagccataaccccgggccaggccaaggtgggcatcatgccgggccacattttcaaggagggcggtgtggccgtggtcagcaggagcgggaccctgacctacgagataagctacatgctgacaaggcaggggataggccagtccacggttatagggataggcggcgaccccatagtagggctgagcttcacagaggccctcaagctcttccaggaggacccgcagacggaggccctcgtgctcataggcgagataggcggcgacatggaggagagggctgcggagatgataaagaagggggagttcaccaagcccgtgatagcctacatagcagggaggaccgccccgccggagaagaggatgggccacgccggggcgataataatgatgggcacggggacctacgagggcaaggttaaggcgcttagggaggccggcgtggaggtggcggagacgcccttcgaggtgccggagctggttaggaaggctctgaggaggtag

SEQ ID NO: 46561 - DNA, 1860 bp, Aeropyrum pernix
gtggggtgtctggttttggcttctagctctgggggtgttggaggcggtgacatgcctttcaagcccgtggctgaggccttcgcctccatggagaggataacctctaggacgcagctcaccctcctcctcacaaggctcttcaagtccacgcccccgggggcgatcggtattgtggtgtacctgatccaggggaagctggggcccgactggaaggggctgccggagctgggtgtcggggagaagctgcttgtaaaggccatagccctggcttacaaggccactgaggagagggttgagaggctctacaagtctgtaggcgacctggggagtgtggccgagaggctgtcgcgggagtaccgctcccgggctgccagggccgtcaccctggaggcgttcatggcgggagggggggaggcgctgactgtgaggagggtttacaacacgctgtacaggatagccatggcgcagggtgaggggagcagggacatcaagcttaggctgctggccggcctcctggcggacgccgagcccgtggaggcgaagtatattgtgaggtttgtggaggggaggctgagggtgggtgttggggacgcgaccgtcctcgacgccctcgccatggccttcggcggcggggcccacgcgaggcccgttatagagagggcctacaacctcagggccgacctaggctacatagcggaggtcgtggccagggagggtgttgatgcgctgaggggtgtgaagccccaggtcggcgttcctataaggccgatgctggccgagagggggagggacccggctgagatactcaggaaggtggggggcagggctgtcgtcgagtataagtacgatggggagagggcgcagatacacaagaaggacggggaggtctacatctactcgaggaggcttgagaacataaccaggatgttccccgacgtggttgagatggcgaggaagggcctcaaagccggggaggctatagtcgagggggagatagtggccgtagacccagacaactatgagatacagcccttccaggtcctcatgcagaggaagaggaagcacgacatacacagggtcatgagggaggtgcccgtcgccgtcttcctcttcgacgccctctacgtggacggcgaggacctcacaagcaaacccctccccgagaggcgcaggaggctcaaggagatagttgtggagacgcccctctggaggctggcggagtccatcgagaccagcgaccccgaggagctgtggaccttcttcctgaaggccatagaggagggggccgagggcgtcatggtcaaggccgtccacagggactcagtctacaccgcgggcgtaagggggtggctgtgggtcaagctgaagagggattacaagagcgagatgatggacacggtggacctcgtagtggtgggcgccttctacggcagggggaagaggggcgggaagctcagcagcctgctcatggccgcctacgacccagacagggacgtgttccccaccgtctgcaaggtggccacagggttcacggacgaggagctggacaggatgaacgagatgctgaagaagcacatcatacccaggaagcacccgagggtagagtcgaggatagagcctgacgtgtgggtggagcccgccctcgtggcggagatactgggcgccgagctcaccctctcaccaatgcacacctgctgcctcaacactgtgaggccgggggtggggataagcataaggttccccaggttcataaggtggagggacgacaagagtccggaggacgcgacaacaacccacgagctgctcgagatgtacaagaggcagttgaggagggttgaagagccggcggagcaggtgtag

SEQ ID NO: 46562 - DNA, 1815 bp, Aeropyrum pernix
gtgatagactacgactcgtgcaagcccaagaagtgtagctacgagtgtatagcagtgtgccccgtcaacaagagcggcaggggcgtggctatagacgctgatatggcgagcagggggaagcctgttatctacgaggacgcctgcataggctgcgccctctgcgtcaaggcctgccccttcgacgcgatatacattgtcaacctccccatggagctggaggaggaggccgtccacaggtacggggtgaacgggttcaagctcttccgcctccccatacccagggagggccaggtagtcgggctcctggggaggaacggcacggggaagacgactgccctgaggatactggcgggggagctcaagccaaacctcggaagggtcgagggtggtgagccggagtgggacgagatactgaagaggttccgcggcagcgagctgcagacctacttcaggaagctggtcgacgggaagctacgggtagcccacaagatccagtacgtagagctcgtcccgaggaggctgaagggtagggttagggacctgctgaagagggccgacgagaggggggtcgccctggagctggcggagcaggtggggcttgacaaggttttcgacagggacgtcaggcagctgagcggcggggagctccagaagatgctcatagtggccgtcctgagcagggacgcaaacgtctacatcttcgacgagcccagcagctacctcgatataagagagaggatgaggatggccaggctcatagcgggggccgcgaggccgggagcctacgtcatggtggtcgagcacgacctagccgtcctagactacgtcagcgacctagtccacatactctacggcgagcccggggcctacggcatagtgtcgaagccctactccacgagggaggggatcaacgtcttcctccagggctacctacccgcggagaacatcaggctaagaaaggagccgatactcttcaggaagccggccccagaggcccaacccgcagccccgggaggggggaggcaggcttccaggaggaggatagtggggtggaccggcctcagggtagccctcgacgggttcaccctaacctccggcgagggggccctctacggcggcgaggtcataggggtcgccgggccgaacgggatagggaagaccactttcgtgagaaccctcgcaggagccctcaagccggtggagggcgctgtctacccgtacgtcgaggacctcagggtcagctacaagccccagtacataagccccgagagcctccccgacgccacggtagagcaggtcctcaaagccgcaaaccccgccatcctagccccaggctcctggctgaacctggagctggttaagaggatgaggctggacaagctgctggagaggagggttagaaccctcagcgggggagagctgcagaaggtggccgtggcggccgccctagccagggaggcggacgtctacctgctggacgagcccagcgcctacctggacgtggaggagagggtgggggtggcgcgggctataaggaggattgtggagaccagggaggccgccgccctggtcgtggagcacgacctaatgatactggactacgtgagcgacaggataatgctggtcacaggcgagcccggggtgaggggccacgtagacgaccccaggcccgtgaaggagggcatgaacctcctcctccaaaacctgggagtcaccgtgaggaaggacgagcagacggggaggcccaggctcaacaaggaggggagctacctcgacaggatgcagagggccaggaagctctactacgcagtgtag

SEQ ID NO: 46563 - DNA, 1422 bp, Aeropyrum pernix
gtggaacgcttaaataagccttcggccccccggtattcccggctccgagagtgggtggtgggttgtgcgccaaacgatctagtcgtcgtcaagttcgggggtagcgtgctcaacggctccccggggtttctggcggcgggccgcctcgtcctgggcctcctggagtccggcctcgagcctgtggttgtcgtctccgctgtcaagggtgttaccgacgccctcctctcctccttcgagaggcgggatcccggcgtcgggggtgcggtggggaagacctacctctcgatagccagggagctgggcctgccccccgagtccgtgagggacgtcagccttgcttcggctgaggtctcgaagctcctctgggcggccgaggtcctgggccagtggacgccgagggtcagggatctcgtggtctcctatggtgagaggcttagcgcggccctcatggcggggctgctgaggcgcctgggcgtcgaggctaggtggctcggcggcggcgaggcgggtatagtgacggatggcgagttcggggatgcgacgcccctctacggctatacggagggcgttatcagggagaggcttgagcccatgctggaggagggcgttgtccccgtggtcgccggcttcaccggcgccactagggagggggataccaccctgctgggcaggggcggtagcgacctcaccgcgaccctcctcgcctcagccctcggggccgggagggttgtgctctacaccgacgtccccgggatactcagcggcgaccctcgtgtcgtgggggagccccgcagggttggctatatgagctatgaggaggcctgggaggtggccaggctgggcctcaggaagttccaccccaggactttcgagcccctcatagccggggggctgggggtggaggtggtggtctccgacctcaggggcaggagcaccaggataggcccgggtaggggcgggcccccgctgaaggtggtctccctctcccgtggagtggccaggctcgttgtcagggggcctagcatggccggcaagagggggttcctctcgaggctcgcaggcctcctagcgggtaggggcgtgaacatactggccataaggcagcctccctccgagactgctatagagcttgtggtggatgagcgggacctccccgcggctgtggaggagcttggggcccgctcgggcgcggctggtgtcaggctggaggtggagagggggttcgatgtagtgagcatcgtgggctggggcgccgtcgaggcccttcccgaggccctctcggcggcggagaagacggggggcaggctgctcagcacgggggagctcagccctagcatctccatactggcgcgggggaggacctcgccggagctggccaggcttctccacaggagggtggttgagagttgggtgacagggtga

SEQ ID NO: 46564 - DNA, 1050 bp, Aeropyrum pernix
gtgagggccgcggtactgggggcctccggcctggtgggccaggtcttcctaaggctcctcgagggccacccctacttcgaggtcgcggcggtggcctccagccccggtaaggccggtttggatgccgccgaagccatagactggatcctccccggcgggcctcccggctatctggagggcatgaggatgtcgaggcccgagccgggggcgctgagggctgagggcgtcgagctagtcttctcagccctcccctcccaggcggccgcggagctggagcccgcccttgccagggagggcttcgaggttttctccaactcgagcaacatgaggctcgaccccgacatacccctggtcaacggagaggtgaaccccggccacctggcgctcgccaaggctcagagggagaggggctggaggggtgtcgtggtgaagaaccccaactgcaccacagccatactaacactagccctcaagcccatagtggacgcggcgggcctaagggaggttcacgtggcgaccatgcaggccatctccggcgccgggaggcggggtgtgccgggctacgggatagtggacaacataatcccccacataccgggggaggaggggaaggttgaggccgagtcgcgcaagatcctcggcagcctccggggcgggaggctcgagcccgccgccttcagtgtggccgctaccaccaccagggtccccgtgctggagggacacctcgaggtggtctacctcaagaccgcccgccccatggagcccggggaggctgtggaggccctggagtcctacaggggcatcccccaggagctggggctccccacagcccccccgaagcccctcagggtgctccgcggcgaggacaggccccagccccggctagacagggctgcgggcggggggatgacggtctctgtggggagggttgaggcgaaggaggggggctggctgaggatggtggttctgggccacaacctggttaggggggctgcgggggccgctctgctggcggccgagctctggctacggcggggggagtggctgtga

SEQ ID NO: 46565 - DNA, 1233 bp, Aeropyrum pernix
gtggaggctggcagtatcgttctggggcttgtggggaagaccaacgtcgggaagtccacgttcttcgccgccgccacagaggtgccggttaagattgagaacaggcccttcgtcacgatagagcctaacgtgggggttgggtatgcgaggaagaggtgcgcccacgtggagctggggctcccccggtgcgacccggtcaacagcctctgcatagaggggtggaggttcatacccgtcaagctcctcgacgtggccggcctcgtccccggggcccacagggggagggggctgggcaacaggttcctcgacgacgttaggaaggccgacgccctcctcctcgtggttgacgcgagcggctccacagaccccgagggtgttcctgtgaagcctgggagttacgacccggtggaggaggttgggctgatgctgggggagatatacgagtggatgctccagaacctggccagggactgggagaggttcgccaggagggtggacaccgccgggaacgtggacctcgtcaccgccctgagccagaggctctcgggcttcgagataccccggggggtcgtggcgggggttctggaggagacggggctgggggagaagaggctctccagctggagcagggaggacctcaggctattcgtcaagctagtcctggagagggggaagccggcggttatattggctaacaaggtcgacgtgcccggggctgaggagaacgtggagaggctggggagcagctacccggggataccggttgtgccggcaagcgccctggcggagctcatgctcaggaggctggcgagggaggggagggtccgctacatcccgggcgaccccgacttcaccgtcaaagaccccggggggctcgggggtaaggcgttgaaggcgctggagctcgtcagggagagggttatgaagaggtggggcgggacgggcgtggtccaggccataaacacggcggtgttcgacgtgctagacatgatagccgtctacccggtggaggaccccaacaggtacacagacagggaggggaggatactccccgacgtgatactggtgaagaggggctcaacacccagggacctggcctacaggatacacaccgacctaggcaaaaccttcctctacgcggtgaacgcgaagacgaagcagagggtgggggagggctacaggctccaggacggggatgttgtgaagatagtggccgccgccggcaagaggtag

SEQ ID NO: 46566 - DNA, 1092 bp, Aeropyrum pernix
atgaggattctatggataaaccaccgagacccgaagcatccccaggcgggtggtgcggaggttaggctttacgagatagcccgtagacttgtgaagatgggccacgaggtcatggtgctatgcgagaaagtaagcagactgccaggcgaagaggttctagaaggtattaggattaagcgtagcggtggtagagcctcgatacacctcctagcaccactctacgtcaggaaacacggtcatgaatacgatgttatcgtagacgatatcgcccacgctgttccgtggtactcgccactggtaacgaaaacacccgtggtagcgcagatacaccacgtacaccaggacgtcgtctatatagagctgccaaaaccgcttgcatggatagtcagcagagccgagaaaaccatcgccaaaatctataggcgcttcatagccgtttcacaatcaacaaaaaaagagcttgcgaagaggctcggtatagaccccgatagaatagccgtcgtacccaacggtgtagacctcgagaagtatagaccaggatcaaaagacccaagaccaacaatactgtgggcaggaagaataaagatgtacaagaaccttgaccacctcctcaaagcatacagaatagtcaagcaggagatcccagacgcacagctaataatcatagggaccggagatcaagagcagaagatgagggagctagccaagaagctagagccaagggatgtccacttccttgggaaaatgtccgagcaagagaagatcatgtggatgcagagagcatggataatagtttcaacaagcatgatagaggggtggggaataaccataacagaagcagcagcatgcaaaataccagcaatagcatacaacgtgccaggactaagagattccgtgaaacacatggaaacgggaatattagtagagccgggaaacatagagcagctagcgaaagcaatagcatggttgttaacagacaatagcctgagaaacaagctgtcggagaacgcgtacaactatgcacagagcttcagctgggataacacagcaataactttcttaaatatattggaagatattacgaggatctag

SEQ ID NO: 46567 - DNA, 561 bp, Aeropyrum pernix
gtgcaagccttgaccacctacaagtgcatagaaaagggtatagttgtctggctaaccggcctccccggtagcggcaagacaacaatagcaacccgcctggcagatctcctccaaaaagaaggatacagggtcgaggtgctggacggagactgggccaggactacagtcagcgagggagcgggcttcactagagaggagaggcttagacacctcaagcggatagcgtggatagcacgtctcctagcaagaaatggagttatagtcatctgcagcttcgtttccccctacaagcaggcacggaacatggtgaggaggatagtggaggaggagggcatacccttcctcgagatatacgtcaaggcaagcctcgaggaagtaataaggagagatcccaagggcctttacaagaaagccctcaagggagagctggaaaacttcactggcataacagatccttacgaaccccctgaaaaccctcagctcgtgctagacacagagtcaaacactatagaacacaacgtttcttatttatacagcctcgtcaaagcagttatcgaatag

SEQ ID NO: 46568 - DNA, 1170 bp, Aeropyrum pernix
atggggtgctcggtcgggttggtttctaggcctcatggagggaggctggtaaggagggttttaagcggtaggaggagggagattttcgagtcacagtatagggagatgcctaggcttgaggtgcctctggagagggctatcgacgctgaggacctcgcccggggggttttcagccctctcgagggctttatggtcgaggacgactacctgagtgttctgagccgtatgaggctatctaacgatctgccatggaccatacctatagtgcttgacgccaatagggagtgggttttaaacgagggtgtttcagcgggggacgatatcatactcacctatcatgggctcccgattgcggtattgacgcttgaggacatatactcctgggataaggggcttcacgccgagaaggtcttcaaaacacgtgacccaaaccatcctggagtggaggcgacctacaagaggggcgacatactactgggaggcaggctggagctcatccaaggtcctcccaaccccctggagaggtacacactctggcctgtcgagactagggtcctcttcaaggagaaggggtggaggacggtagcagcattccagacaagaaacgtacctcacttgggccacgagtatgttcagaaggctgctttgactttcgtggacgggctgctggtgcaccctctggctgggtggaagaagaggggagactatagggacgaggtcataataagggcttacgaggcgctgataacacactactacccccggggtgtcgtcgtcctctccgtcctgcggatgaacatgaactacgcaggcccccgggaggcggtgcaccacgccatagttaggaagaacttcggcgccacacacttcatcgtgggccgcgaccatgcgggggtcgggagctactacggcccctacgaggcgtgggagatcttccgagagttccccgacctaggtataacaccactcttcgtacgggaggcctactactgtaggaggtgcggtggcatggttaatgagaaggtctgcccccatggggacgagtatagggtgaggataagcgggacaagattgagggagatgctgggcaggggcgagaggccgcctgagtatatgatgagacctgaggttgccgacgcgataatatcccatcccgatccgttcatataa

SEQ ID NO: 46569 - DNA, 1878 bp, Aeropyrum pernix
atgggcaggctggtggcaggagtcttgtgcggcatcataggcctggcgttcgccgagggcaacagcgtggcgggggcgctggtcagggggctcaagaggctcgagtacaggggctacgacagcatgggggtcgcggttatagagccaccggggaggcttgtggtgaggaaggcggcggggaagataggcgaagtcgtcaggaggactggggtgctgagcctcaggggcagggttggcataggccacacccggtgggcgacccacggcccgcccaacgacgtgaacgcccacccccacaccgactgtgggggcagggttgcggttgtgcataacggggtgataaggaactacgcctccctccggcgggagctggaggcgagggggcataggcttgtgagcgagactgataccgagcttgtggcccaccttatcgaggagtatctggggcgaggctacagcttcctggaggccctctccctgctgggcagagtgttaagggggagctacgccctcgccctcctccacctgggggagccggataaggtctatttcctcaggtataagagccccctggtagtcgggctgggtgagggggtaaacgctgtcgccagcgacataacggcggtgctggatgtcgccagggacgtgatagtgctcgaggacggggagttcggctggatatcccccgagggtgtggccatctacaggccgaggggtgacggggggttcgagcccctcccgccgggggctttggaggagagggttaagagggttgagtggacccccgagtccgcgtcgaaggccggctacccccactttatgctgaaggagatttacgagcagccccgggccctggcggagactttcgaggggattatagaggatccggcgctcttgagggccgccgggctggtggcgggggctgggaggctgctgatagtgggggctgggaccagcttccacgccggcctagtgggccactactacctctcccgcctggcaggcatactgggccaccccgtggtggcctccgagcacaaggtctacaccccaggggttgatggcgagaccgttgtggtggcggtgagccagagcggggagacctacgacaccttggaggctgtgagggagtggaggggccggggcgcaagggttataggggtcaccaacgtggttggcagcgccctggacagggaggccgacgtgaccctctacctccgggccgggcccgagataggggtggcggcgaccaagaccttcctagctcagaccatactcctccaaaccctctccatagcggcggctggggaggcgggtaggctcacctccggggagacaagggagctcaccggcgtcctggagggggcgcccgatgctgcgaggagggctattctggcgtcggagggcgccgccagggaggctgcgtcgctgctgaaaggggcgggcagcatgtacatcataggccgggggctgggtggcaggctggctatggaggctgctttgaaggtgaaggaggtgtcctacatacacgcggaagcctacccggcgggggagagcaagcacggccccatagccctggtggagcccgggttcaaggtttacgtggtggcgacgagcgactcacccgaggttatgggtaacgcgatagagatgaaggcccggggcgccagtgtaactgtggtggcgcccagcgacctgcagctcgatacaccagagggcatcgaggtcctcaaaatgccccccacagggggtgagacgctgctcgacccctactccctaaccccctacttccagctcctagcctaccacctggcggtggcgaggggctacgaccccgacaagccgaggaacctggctaagacggtcacagtagagtaa

SEQ ID NO: 46570 - DNA, 1155 bp, Aeropyrum pernix
gtgaggggcttcaccaccaaggccgtccacgcgggggaggacccccgggagaccctccacggcgacgtcgtccaccctatacacctctccgtcacgtattggaagaggagtgtggctgaggccgaggagggctacgtgtactcgaggacctccaaccccaccagggacgcccttgagaagaagctggccgccctcgagaacgccaggtacgccctggccttctcctccggcctggcggccgaggccaccgtcatactcgccctgctgagggagggagaccatatagtggcgttcgacgacctctacggcggcaccaagaggctcttccagagggtgatggcccggttcgggattaaggtcacctacgtggacgcccgcgaccccgggaacatcgagaaggccctgacacccgccaccaggatgatatggctcgagacccccaccaacccgctgctgaagctgaccgacatcagggccgcggcggagatagcgtcccgggcgggggcttacctggtggtagacaacaccttcgccaccccatacttccagaggcccctggagctgggggcggatatagtggtgcacagcgccactaaatacctctcaggccactcagacctcctcgcgggggccgtgatggtcaacagcagcgaggtctacgagaagctcaagtaccaccagaacgccgtcggcgccgtcccaccacccctcgactcctacctcctcatgagatccctcaaaaccctagccctcaggatggagtggcaccagcacaacgccatgaagatagccgaacacctagagagccacccgaaggtggaccgggtaatctaccccggcctctcaacacacccccagcacagcctggcgaagaggcagatgacaggctacagcggcatgctctccttcgagctcaaggggggcgccggggcggcggtcaggttcgtagagagcctcaggatcatagccctcgccgagagcctaggaggggtagaatccctagtggagataccctcgctcatgacacacgcctcaatacctagggaggagaggctcaagaaagggataacagacggcctagtaagactctcagtaggcatagaggacctcgaagacctcatagaagacatagaacaagccctcaagaaaacatag

SEQ ID NO: 46571 - DNA, 999 bp, Aeropyrum pernix
atggcaggggaagacgcgttgagggctgccgtcctatatgggccgggtgatgtaagggttgaggacctcccgccccccgagcagcctgagggctgggcgctggttaggagcagggccgtggggatatgcggtacggataaggccttctacaggggcacctacccgctgttcaagaagcccctggtgcccgggcatgaggtttcgggtgaggttgtggaggggcctgaggacctcgttggctctagggtcgtgagcgagattaacttcgcctgcctccgctgcgaggtatgcagggaggggctctacacccactgcccccgcaagaagaccctaggaatagacttcgacgggggcatggcggagtacttcaccgcacccccatgggccctccacccccacaacatgccccacgagaaggcgttcgccgccgagcccctcgccgctgtgctaaacgcgctccaacaagcgccccccaggcccggctgggcggtggcggtgctgggcacgggcttcatggcccacctcaccgcccagacactcaccgcctacggcttcaaacccgccatagtcgccaggccagacagccccaaagccgtgttcttcaggaggctcgggcttgaggtcctcacgccggaggaggctgtgaaggcggcctcagagactccaggcggcctagggttccacatggtgttcgagaccacaggcagcaaccaggggctgagcatagccacagccctcgccagaccccggggcgtagtgcacgtgaagagtaccccaggaggggaggcggtcttcagccagaccctagccgtggtgaaggagatcaggctcatcggcacacgctgcggcagccacagggagttcaaggaggccctccgcctactcgagtctggagaagttgagccccaggtaacaaagttcagaagcctggaggaggctccagaggccttcgaagcatcgctggacagggagagcatgaagattgtagtcaccatatag

SEQ ID NO: 46572 - DNA, 921 bp, Aeropyrum pernix
gtggcgggtattggtggtgaggacctcgcggttgttgttgagggtgttgtgaagatatacgagtctaggggcgagaggattgtagccctcagggaggtcagcctctccgtggcgaggggcgaggtcctcgctataatggggccgtcaggctctggcaagactaccctgctgaacataatagccggtgtagacaggccgaacgcgggaagggttattgtggatggttttgaagtctccagcgccggcggggaggagcttaggaggttccggctcgagagggtgggctacgttttccagcagcacaaccttataccaaccctcacggcgctggagaacatactcctccccatggccctggccgggaaggccaacaggctccgcggccaggagctgctcaggagagtcgggctaggggggaaggagcgcaggtacccggaggagctgagcgggggcgagcagcagaggcttgccgttgccgtggcgctcgccaacgaccctcccataatagtggctgacgagcctacgggcgagcttgacatcgcgacaggcgagaggatagttaggatactcctggaggaggcgcacagccgggggaagacagtggtactgaccacccacgacccccgggtggcgaggatggcggacagggtggcggtgatcgaggacggcaggctacggggggtctacagcccctcaaggatagccggggccacaggcttcggagaggttgaggcggagaaggctgttgaggctgtgatgaggaggatcctggatgacgcggaacgccgtctaagggaggctgaagacaggttcaggaggggggaggtcggcatagacgctctagtggagacatacactcgggtgaaagcgctgagggaggcggtgcgggaagagctatcaagactaggaatcacgggctag

SEQ ID NO: 46573 - DNA, 762 bp, Aeropyrum pernix
gtggaatgcggtttgggcggtgcaggccagccggcggtggaggcggagggggtttggaagcgcctggggggcaggtgggttttgaaggatgtcagcctcacagtcccccggggctcggtatacggggtagtggggcctaacggggccgggaagaccactctcttcagaactctcctaggcctctacagggctgacaggggtagggtggcgcttctgggcgagcctgtcgagagggcgggcggcagcctgttccggagggtcgcctacctccccgaggatggcgagccctacaggaacatgacgggccatgagttcctgaggctctacgcatccatctacggcgttgaggacctcgaggggtacctcgaggaggcctcccgcctctcaggcctcggaggtagactgggggagagggtgaggtcctacagcaaggggatgaggaggaggcttctcgtggccgcgatgctcgccctcaaaccatccctcgcagtgctggacgagcccactgcagggctagacccggtctatagcgtggggattaggaggctcctgaaggagtatagcgagaggcacggcgtgacggtgctcctgtccagccataacatgtacgaggtggagagcgtgtgcagcgagataacaatgatatccagtgggaggatagtctactccggcagccctggagaagctgtcaggaggacgggcgcctctagcctcgaggaggcctacgtagccctcgtgacaggagggggtggtgaatcgtga

SEQ ID NO: 46574 - DNA, 3783 bp, Aeropyrum pernix
gtgctcgcggccgccggcctgctgtcgagcctcggcccgctggcttccgctctctccagcaacagatatctcaccacaatcgagaccccccgcctcggctaccccgaggacctcaggggctgggagaagttctacagggacatgtgggcctatgataaggtggcgaggagcacccacggagtcaactgtactgggagctgcagctggatggtttacgtcaaggacggtatagtagcttacgagctccaggctggcgactaccctgacatagggcccagctaccccaactacgagcccaggggctgtcccaggggtgcaagcacctcctggtacctctacagccccttgagggtgaagtacccctacgtcaggaagcctctcctggagctttggagggaggctaggagcagctacagcgatcctgtggaggcctgggctggtatagtcgaggatcctgataagaggagcaggtatgtgagggcgaggggtcttggaggctgggtcagggccgactgggacaccgttctggagataatagcctcggccctcgtgtacacaatcaagaagtacgggcccgaccggatattcggcttcacccccatacccgcaatgagccccgtcagctacgccagcggcgccaggttcatagagctaataggaggctccatgggcagcttctacgactggtacgccgatcttccgccggcgagcccccaggtttggggtgagcagacggacgtcccggagagcgctgactggttcaacgcagcctacattataaacttcggcaccaacataccgatgaccaggactccggacgcccagttcttcacggaggttaggtacaagggcacgaagatcgtggtggtgagcccagacttcagcgagcacaccaggttcgccgacgtctgggtccccattaaggaaggcaccgacggggccttcgccatctctatggcgcacgttatactgagggagtactacgtggagaggcaggtagacttcttcatagactatgtcaagaggtttacagacctgcccttcctgatcgtgctggagccctatgaaggcggctacaggcccggcaagttcctgaggctctccgacctacaccccgaggagtactacagcgagggctacagcggcgagcctaacaaggagtggaagctcctcgtgtacgactcgaacacaggcaggccgaggcttgtgaacgggagcataggctaccggtgggacggcagcggcaagtggaacctcaagctcgaagacccgatcaccggggagcctgtggacccgaagctctccttaatagacgatagcgacgaggtggtgatggtaaagttcccggtgttcggggcctccttcggcgagaagggcatagtggagaggggtgtgccggcgaagagggtgaagctcgccgacggcagcgaggcccttgtggccacggtgttcgacctcctggcggcctatctgggcgttgacaggggcctccccggcgactatccggcgggatacgatgataagaagcccttcaccccggcttggcaggaggacataaccggtgtgagcagggagctcgccataagactcgccagggagtgggctgacacggcggtgaagacccggggcagggtcatggtcatgctgggcccgggcgtcaaccactggttccacagcgacctccactacagggccatactgaccctagtcaagctgactggagcggaaggcaggaacgggggaggatgggcccactacgtcggccaggagaagatcaggacgatagcgggctgggccaagctggccttcgccctggactgggtcttgccgccgaggcaccagaacagcccgagcttctactacgtccacacggaccagtggaggtatgacaggctgaccacggactactatgaggggccctggagcgacgtgagggagaagatgaagtgtagccacccgatggactgcaacataaaggccgccaggctgggctggctacccttctacccccagtttaacaggagcacgctggacctagcggcggaggctaggaggcttgggaaggatcccgtgcagcacgtggtagaccttctgaagagcggccagctgaagctggcgatagaggacccggacgcccctgagaactggattagggtcatgttcgtctggagggctaacctcctcggcagcagcggcaagggccacgagtacttcctgaagcacctgctggggagcccgatggcccagcctatgagcgaggaggtggacaggagcctcatcaaggaggttgtatggagggccgcccccgaggggaagctggacctcctggtggcaatagacttcaggatggccaccaccccgatatacgccgacatagtgctccccgccgcgacatggtatgagaagtacgatctgagcatgacagacctccacacgttcctacaccccttcacccccgcagtggacccgctttgggagagcaagagcgactgggacatattcaaagagctggcgaggaagttcagcgagatagcggccaaccacttcccagacgaggtcgaggacatcgtagccaggcccctctggcacgacacgcccatggagatagcccagccctacggtgtcgagaaggactggaggtatggcgagacggagccggtgccgggcaagacgatgtgggaccttaaggtggttaagagggactacaggaacgtgtacaagatgttcataagcctggggccgaaggccaggaaggccggcgtcaagggagtaagctacgacaccagcgacatctacgagatgctgaaggaggacctgggcgtagtgtactgggagaagtgtcccgacggctgtccaagcgtagagagcgacaagaacgcagccgaggctatactagccctgagccctgaggccaacggcctggtgggtgagaggagcttcgccagcctcgaggccaaggctggcgtgccgctaaaggacctggcgaagagtagggagtggtataagttcgacgaccttgtaggccagcctaggaggtcccacacgagcccgatgtggagcggtatagaggacttcaacagggcctacgcacccttcaccataaacacggagaagctggtcccctggaggaccctcaccggtaggcagcacttctacctcgaccacgactggttcatagccctcggagagatgctgcctacctacaagcctcccgttgaccctgttaggctcggctacctgaagaacgctgcggcgaggcttgggatcacgaggatgaacggctacaggatcgaggagggcggcaggaggtatctcttgctgaggtacctcacgccccacggtaagtggaacatacacagcgagttctgggacaacctgaagatgctgaccctgttcaggggaggccaggtggtgtggctgaacgacgaggacgcgaggtgggccgggatagaggacaacgactgggtggagatagtaaacgacaacggagtcatagtggcgagggtcgccaccagcccgaggatacccaagggggtcgccataatgtaccacgcccaggagaggcatatctacgtcaggccgagcaagctaaccggcaagaagggagggatccacaacagcgtcaccagggcagaccttaaggtcaacctcatggtgggaggctacgcgcagctgagctacttcttcaactactacggcccgacgggtgtcgacagggacaccatggttatagtatacctacacgacaagctaggcgccaaggcaccccagcctggagcctag

SEQ ID NO: 46575 - DNA, 1401 bp, Aeropyrum pernix
atggagatggttagggctcagctctccatggtgatggtgctggataagtgtataggctgccacacgtgcagcctaacctgtaagaacgtttggaccaacagggagggccaggagtacgcatggtggaacaacgtagagacgaggcccggcgtaggctacccgaagacctgggagaaccaggagaagtatggcggcggctgggtgctgaggaacgggaagctgaggctcaggctggagaccggcaggttcaagacgcctggcagggaagactactacgagcccttcacatacaactacgagaacctgttctccgaggagctgtctgaccagcagccccacgcggacccgataagcatgtacagcggcgagaagatcgacgtgcagtggggccccaacttcgacgacgacctcgccggaggcgacctgacgatacccgccgaccccaactggtcggggatagataaggctatatacaaggagtttaagaacgtgttcatgttctacctgccgaggatatgcaaccactgcctcaacccaagctgcctcgccgcctgccccaggaagagcgtctacaagaggcctgaggacggtatagtcctgatagaccagactaggtgcagaggatacaggcagtgcgtccaggcatgcccctacaagaaggtctactacaactggaagacgggtaagagcgagaaatgtatattctgcttcccaaggatagagacgggccagccgcccgtctgtgcactgacctgcgtcggcaagataaggtatgtgggggtagttctatacgacgaggaaagggttctcgaggctgccaaggctccggaggaccagctcgtcgccctgcagagggacataatcctagaccccttcgacccacaggtggtgaaggccgctagagagtctggagtcccggacaactttatagaggcggctaggaagagccccatatactatatgttcaagaagtgggagatagcgctgcctctacaccccgagttcaggacgctgcccatggtgttctacgtgccgccgctcaaccccgtggtgacggtgctagacaggaacggcaagtacagcgcggactacgacagcatactaccgactatagacaagctcaggatacccataaggtacctcgcaaacatgttcgctgccggaaacgaggaggaggttaggaaagccctcaagaggctcctagcgataagagagttcttcaggcagatagaggttgagggtaagagcaggagcgaggctgcgtgggtgctggaggagaacggcctcacagtggaggacgccgacatgatgttcaggtggctagccctcagcagagacaggtacgtgatacccaccgccaagaaggagctccgaatcaggctgccgagcaagggcaggtag

SEQ ID NO: 46576 - DNA, 549 bp, Aeropyrum pernix
gtgggagtagaaatgaggctgacgctgaaaactctaagcataatattcagctaccccagcgaggacctcgaggagcttgtcaggaacagggaggttgttaagcctcttctcataggggaggacggtgaggcggctgccctcataatggagttcctagagaagctggatctggagagggctgacgaggagtatgtagccgtgttcgagatgccgccgaaatgcagcatctacgcccacacctacctgctgaagggcaaggaggatatggtgggccagctcctgctggaggttaagagccactataaggctaagcagcttgacatgcctgtggatagggagatccccacctacctcccggcgatgctggagtacctggctctggtttatgatgaggaccctaaggccgcccgcaggttcgcgaagaagtatcttcagccgtgggtcggcgagctcgcgtcgtgtctagagaagaataggagcctatggagcctccccgcgaaggctctaaaaagggttgtagataagattgccgagggccggggcccctag

SEQ ID NO: 46577 - DNA, 1956 bp, Aeropyrum pernix
gtggaggcacgtagcgtggagaggcggcgggagaagccttgggagggggaggtatacgagtccaccttcccatggctcctcgagtggcgcgccaggacacagcctgggagggtggccttcaggtggaagaggtatgggatctggaggaggtatacctggcgtgactactacttgagggtggcctacgcggctcttgccctggagaaccttggcctcgggccgggcgatacaggggctttcataacgttcaaccggccctcatgggtgatatacgaggtcggagtccagctcctgggaggcagggccatgggcatatatcgggacagcctgagcgacgaggtaggctacctcctcgacagtggcgatgccaagttcgtgcttgtagagggtcaggagcagctcgacagggttctagactcaggtgtagatgttgacaagataattgttgacgaggcgaaaggacttcaccaatacagggggatggtcggctctaagttagtgaccttcggggacgtgatgaggctcgggaggaagctctactcggacggaggcgatcagcaggttaagaagctgatgggcgagctggagccagacatggtttgcggcctcttcaccacgagcggcaccacaggccttccgaagctcgccatgatatccttcaagaacatgcttgcaatggcccaccagctaaacaccgtcgacccggtgagggaggattgggagtacgtctccttcctaccaacagcatggataggggagcagatgatgagtataccctaccacatgataggcgggttcaaagtcaacttcccagagacgccgcacacactttggagggatttcagggagatcgccccccacttcatgttctccccgccgagggtatgggagaggattgcaaaagacattatggccagggttgacgatgccgaccctatcaagagggccgccttcaggctggcctataagatagggtatgaggccgctaggaggaggctcgtgaaagggcgcagcaggccgccgaccctctggagggccctatactacctggcctactggctagctctaagggccgttctggacaaggccgggctgaagaggatagtcagggcgtatactggcggtgcgatgataggggaggactacgtcatattctaccactcactcggtgtgaaccttaagcagatttacggccagaccgaggtggcggggattgcggtcgtccatcccgacgacgatgttaggcccgacactgttggcaagcctctacccctcaccgaggtgaagatagctgaggacggtgaaatactgatgaggagcccggctatgatgaagggctactacaagaacgaggaggccacggcgaagactatagtggacgggtggctgaggacgggcgatgtgggtgtgcttaccgaagacggccacctaaaggttctggatagggctaaggagatcataatcctctccgacggcaccaaggttgcaccccaggtcatacagaataagctgaagttcagcccctacataggggaggcggctatagtgggctccgggaaaccttatctagccgccctcgtcaacatagacttcgaaatagtgtctagatgggctgagagacggaggataccattcacaagctactcagacctttctcagaagcccgaggtcctccagctccttaagagggagatagagaaggtgaacaggaggctccccgagaaggagaggatacggaggttcgtcagcctcttcaaggagttccaccccgacgacgaggagatgacgaggactaggaagctcaggaggatggttatagagtcgaggtacgcgggcctgatagaggctatctacagtggcgacgaggagtacgagctcacggtcactatgaagcttgaggacgggaggagggtccaggtgaccaggagggtcaagataatagatgttgaggggtga

SEQ ID NO: 46578 - DNA, 1590 bp, Aeropyrum pernix
gtgaaatatttgactcatgccgtggcaacccgagtatggtgtgaagcctcgcccgctaaaccctgggaggagctgtggcctccccaggcgcccagggatgtggaggcccttagagagaggttcacccccatacacgaagagatattcaagaggtcctcacgggagggctgcgccctcatacagggggagacgggctactgctacacctggaagagcctagcgtccttcatagaaaggattggaggctggctccaatccaaaggtgtcagccatggagcccaggtggcagtagcctctgagaaccttatagaggctatagccttctctctcgcagtcctagcctctggcgcccggctcgtcctaatcgaccctctcaccgttggcgaggacctcgagtggcagctggaggggcgtagggggctggagactctcgcggccagcaggggcttcctcgagaggaatagggaggctgtgtcgcgaattgacaatataagtactgttatagaactctcgagcaacccccagccgctcgaggtaggaggggttgaggtcctcggcctcaacgaggtcttatccagcactgcagcgctagaggatgatgtggagcctgacgacgactccttctcaatatactacgcagggatagctgggagaaccatgcaggcaatccacagccacctcggactctggatggggtctaaagtgtttgccgccaccgcgggtatagacagggagactgtaagtctgctggcgacgcccttcacccacgtcctcggccttcaagcttcactcgtggcccccctaatccaggggggtacagtagtggctctgcagaggtggaaccccaggctggcggcgaggctcgtgtcatctctaaggataaactatctggctggcgtccccctgatgtttcagcagctgctggatctgggtgccaccagtggactgaggctggcgatatccgcgggtgccccgctgcctcccgagctgcagaggaggttcgggagggagaccggtattcccctgctccaggcttatggcatgagcgagagcctcatcctaaccttccaaacacccaagatagcggagatcgagggcacgattggagttccactgcctggagtcgaggtttccctcctgggcgacgacggcctcctcagcccgccgccgggtgtgggggagctcgtggtccaggcaccatgggttatgaagggttacgagtttgaggaggagaactccaaggctttcatcgatgggtggctgaggacgggtgatgtaatcgagattaccgataggggagtcatgttcttcaggggcgtgaggaaaaggataattaaatataagggttatgcaatactagccagggatctagaggtcatactagagtcgcaccccgacgtgctggaggcgagagtgtggggtgagcccgccggcgatgtcgggcagataccggtagcaagcgtcgtcctaagagccggctccagcgtgacgcccgaggatctcatggagtacgtgaaccagagagtctccttctacaagaagataaggcgtgtagaggtagaggggtacaggtatagccctgccccctag

SEQ ID NO: 46579 - DNA, 1983 bp, Aeropyrum pernix
gtgcaggagggtttggaaaagaagatatggtatccgccccgcgatatagtggaccagagtaatgtaaagcttttcatggataagcacggtttcaagagctatgaggagcttgtcaggaggagcagtgaggacctcaaatggttctggggtaacctgcctgaatggctcggggtagagtggttcagagagcctaaagccgtggtggacctgagcagaggtgtggagtgggcccagtggtaccggggaggcctcctcaacgcggcgtacaacgtcgtagaccgtatagtcaagatggggtacgggcatagggaggccttcacttgggtaggcgaggatggggaggttaggaggtacacgtacctacagctgaaggacgaggttgacaggatggccaagctcctctcccaggactatgggctgggagtcggcgatgtggttgcgatctacgcccccatgatgcctgagagcatagcggccatgcttgcggccatgaaggttggggctgtggcttcaccgatattctccggcttcgccccgccagccgttgctgagaggctcaagctgggggaggcgagggtgctcgttaccgtagacgggtatctgaggagggggaggaggatagccctaaaggagcaggccgaccaggccgtgaagcttgcgggcggggcggtcgagcacgtcattgtggtcaggaggctcgggatagacgtcccatgggttgagggcagggatgagtggtatgacagggccatagcgggtaaggctggctctgcggagcccgaggagctagacccggagcatccagccctcctcctcttcacaagcggcacaaccgggaggcccaagggcgctgtgataagccatgcaggcgccatactccagcccgggaaggagcactacttcaacctcgacatacacccagcctggaggggcggggaggacaggctatggtggataactgatataggctggatgatggggccatggcaggtcctcggctcccagctcctgggcgccagccaccttatggcggagggggccatagactatccttataagtcgagggtttggaggctaatacaggagcacagggtaacccacttcggctttgcggcaacagtggccaggatgctcagggcagtggcgagcgacacggtggaggattacgacctatcaagcattagggccttcggaaacacgggggagcctatagaccatgccacctggatgtgggtcatggagaagttgggaggctggaggaggcccctgataaatctcagcggcgggacagaggtgttcggctgcatactcctcccgagccccgttgtccccctcaagccgacgaccctctgggggcccgctctgggtgttgatgctgacgttttcgacgatgagggtaggcctgtgaggggcgagccgggatacttggttgttaagaagcccttccccagcatgaccagggggctgtggaaagaccctgagaggtatataaagacgtactggtcccgcttcccgggtgtatggtaccacggcgactacgccctagtcgacgaggacgggttctggtacatactggggagggcggacgacgtgataaaagtggcggggaagaggattggcagcgccgagcttgagagcgtgctcacacagctacccgaagtggcggaggcggcatgcataggggtgccccacccgataaagggcgaggtcatagcctgcttcctggtgcccaagggcggttatgacgcggaggagctggcctcgaaggccaggaaggccgtggtggataggttcggcaagcccttcgccccggagcacgtggttatagtgagcgagctcccaaagacgaggagcggcaagataactaggagggtgctcagggatctagcccgcggtgtggagccgaaggagctgagtgttctggagaatcctgaggccgtcgaaaagcttagggacattataaagaggataggagggggctag

SEQ ID NO: 46580 - DNA, 759 bp, Aeropyrum pernix
gtgcttggcggtagccgggggcttggtttccacgcggcccgcgcgctagccagcctcggctgcaacctggtgatcgtcgccaggggccgggaggctctcgagaagagtgctaaggaaatctcggaaggtttcggtgttgatgtagagcctctagttggcgatctaaggaagaagggtcatgtggagaacgcagttatacacgctgtccagacttttgggagggtggatgccgtagtagccgcctacggaaacatatcccgggagcctctaaccctccgtgaagcggagtgggaggactggattgaggctgcggcactatacctggcatcaacatccagccttttcaaagcactggcctcctataacacagcgaaggccaccgtgatacttctctcgagctttaccgtagccgagcctatggaccctctcatagtttcggacgccgtcagagccggattatcgaggctggtaaaatcggctgcgaggctttatcccgataggataagacccatactacttatcctaggaagtttcaagacgcctggggctatgaggacgttggagaggatagccaggtctcgaggggaaagcttagagaacgtctggaggagggaggttgagatgctgagccccctagccagatctggaggtctcgacgagtttgaggaggttataaggatgcttgtcaggagcccggattacatgcacggagccacggtagtattcgacggggcgtctgggagggtttcatggccctag

SEQ ID NO: 46581 - DNA, 2181 bp, Aeropyrum pernix
gtggccaactctagtgttgagctgagggtgagtgaggcctatcccagggatgttgggaggaagatagtccgtatagaccgtcagacagctgctaggctcggggttgaggtcggtgacttcgttaaagtatcaaagggtgataggagtgtggtagcggttgtctggcctttgaggccggacgacgagggtagaggcataataaggatggacggatatctcagggcagccctaggagtgacggtgggggatacagtcactgttgagaaggctgagaaggttgagccagcatcgaaggttgttctcgcgcctacagagcctattaggtttgggagagactttgtggagtacgttaaggagtttctcctgaggaagcctattagcaggggggagaccataatcgtacctgttctcgaaggccttcccctggtcgtcgtctccacccagccagcccacttcgtctatgtgacggaggctaccgaggttgagatcagggagaagcctgttagggaagagatagagaggctgaggggtgttcccaaggtaacgtgggaggatataggcgatctcgaggaggctaaggagaggattagggagatagtggagctccctatgaagcaccccgagatattcaaacacctgggcatcgagcctccgaagggtattctgctgtatggcccgccgggcaccggtaagacgctgctggccaaggcgttggcgaacgagattggagcctactttatctccatcaacgggccggagattatgagcaagtattacggcgagagcgagcagcggctcagggagatctttaaggaggcggaggagaacgcccccagcattatcttcatcgacgagattgacgcgatagccccgaagagggaggaggttacaggggaggttgagaagagggttgtggcacagcttctcacactcatggatggattgaaggagagggggagggttatagtcataggcgcgacgaacaggcctgacgccatagacccggctctgaggaggcctggaaggttcgacagggagattgagatacggcctcccgataagagggctagagccgagattctgaaggttcacacccggaacatgcctctcgcagaggacgtggaccttgacaagctagccgagatgacccatggctacacaggagcggatctcgccgctctggcgaaggaggcggccatggcggctttgagaaggttcatacgggaggggaagatcaattttgaggccaaggagattccggcaaccgtcctcaaggagctgaaggtgacgatgaaagacttcatggaggctatgaagatgataaggcctacgcttataagggagatctacgtcgaggttcccgaggttaggtggagtgatataggcggcctcgaggaggctaaacaggctcttcgagaagctgttgagtggcctctgaagcaccccgagatatttgagaagatgggtattaggcctcctaggggtgttctcttgttcgggcctccgggtactggtaagacgcttctggccaaggctgtggctactgagagtggggcgaacttcatagcggtgaggggcccggagatactcagcaagtgggtaggagaaagcgaaagagctattcggaagatctttgagagggccaggcaggcagccccagccgtagtgttcttcgacgagatagacgccatagcccctgcgaggggagctaggttcgacaccagcggtgttacggacagaattgtaaaccaaatgctggctgagatggacgggatacagccgctctcaaacgtcgttgtcataggggcgacgaacaggcctgacatactggaccctgcactactgaggccaggaaggttcgacaggcttatctacgtgccaccaccggataaggaggctaggaaggagatattcaagatacacacaaaaaaggtgccactcggagaagatgttgacctcgagaagctcgcggagatgacggagggctacacaggagccgatatagaggcggtggttagagaggcagttatggcaaaacttagggagaagctagaggtcggtaaagtcgaaatgagacacttcctagaggcgctaaagaaagtgccacccagtcttaccaaggaggatatactccggtatgaaaggctcgcaaaggagctgaagaagctgacgctgggatga

SEQ ID NO: 46582 - DNA, 1272 bp, Aeropyrum pernix
gtggaggtcttggccttgcagcccacggaccctcttgaggaggctcgcgcgcagctcaggagagctgtagaccttctgggctacgatgactatgtttatgaagttctcgcaaacccggacagagttctacaggtaagggtcactattaagatggatgacggtactgtcaagacgttcctcggctggaggagccagcacaatagcgcgctaggcccctacaaaggcggtgttaggtaccaccccaacgttactatgaatgaggtgatagcccttagcatgtggatgacgtggaagaacagcctcgccggcctgccttatgggggaggtaaggggggtgttagggttaaccctaagatactctcccccagggagcttgaactcctgtctaggaagtatttcgagagtataagtgatatagttggggtggaccaggacattcccgcgcccgacgtctacacggatccccaggtcatgtcttggttcctagacgagtataatagggtgaagaggggccagttcttcggcgttgtcactggcaagccagtcgagctcggcggcctcaacgctagaatagtgtccacgggctacggggtggcagtgtcgacaagagtcgccgcagaaaagtttctaggaggcctcgagggaagaacagtcgcggtccagggctacgggaacgtgggatactatgccgccaagttcctagcagagatgggtgctaagatcgttgcagtaagcgacagccgaggcggcatttacgaccctgagggcatagacccggaggaggctttgaaggtgaagaggagcacgggcacggtggctaactatcagcggggcaagaagatctcgacaatggagatactagagctgcccgttgacattctagtcccggccgccatagaggaggtcattaccgacgagaatgcggataggattaaggcgaagattatatcggagggagccaacggccccactaccactgcggccgagaaaatacttgtaaagaagggcgtcttagtgctcccggacatactggcaaacgctggcggtgttataatgagtcatatagagtgggtgaacaacaggatgggcgggtggatcacggacgaggaagctctgaagaagctcgagcagaagatggttgagaacacgaagacggtaataacatactgggagaagaacctcaagccggaggagaacagcctcagggacgctgcctacatgatagctgtggaaagggtgtttagagccatgaagctaaggggctggatctaa

SEQ ID NO: 46583 - DNA, 1284 bp, Aeropyrum pernix
atggatgagggtggtgtagctgtattgaatctagtagtgaagccgagccagattggaggcgagattattgctccctcgtcgaaaggccatactatagccgcgctgtttgcatccctcttggcgggagggcgctcgaaaatttccgaacccctctactcgagggatgttgatacagcaatatacgctgtcagaaggtttggaggtttagtgcagaagggggagcgggatctgattgtagattcgccgcctaggccttggtggcctagggtggtaaactgtaggaggtcctcaaccgtccttagacattcgatagtaactgcggccctcgcacccggtatctccctcgtctatggcgactctcacactaattccacaccagtgagcgaactagcaggtgcattaaaaaagattggggctgaagtggtaaccaccaacggtagaccgccagtagccgtgaagggtccgcttgccagaggctgctgcgagggtgagaccgtgggagctagcgatggcgaatccctagctgcacttctcctggcctcgcccctcctaggattcgccataaagagggctgggactcattcgtggcaccatgttgccgttgcgcttcatgtgctacgggggttcggtgccaaaataagctttgatggtggaatctactatcctgataaaccctacggtccaggcgcttacgccgtcccgggggattatgtaaacgcggcacccctactcttggccggggccatagcaggtaggatcacggtccggaggctagaccccgaggatcctcagggcgagaaggttttcctaaacatactcgctcaggcgggtgccaagctcaaggcgggagagagtagtgtggaagtggtaggaacagggagtcttgaggggttcgaagctgacgtgtctgagacgccgagcctagcacctgttcttgcggtgctcgccgcctatgccaagggtaggagtgttataaaaggcatatcccacttgcggctcaaggagggcggaaacctgaagccgctcatgtccaaccttaggcggctcaaagtaaaggctaagccacgctgcggaggcgactgcctcgaggtgtatggtgaaggctatgttgagggtggcacggcgaagggctacggggacccgagaatgacaatggcattcgcggtggcgggacttgcctcacgcaagggtgtgagagtaacaggggcttcccgctatagagactattacccgggcttcgttgaggacctgaggagcgttggggctgtaatagaggctgattaa

SEQ ID NO: 46584 - DNA, 777 bp, Aeropyrum pernix
atggcattccctatgccgccgcatcagactgcatatgatcgtgccgccactatattctctcccgagggcgatctataccaggttaggtacgccttcgaggctgtcaagaaggggtggacaagcctcggcattaagactaatgagggcgttgttatagcggctgagaagaggttcataggccccctcgtcgatattgacgatatagacaagatatacaagatagacgaccacataggtgtggccttcgcgggcatgggtggagacgggaggatattgatagactatgcccgtgtgttcactgttagacaccgcctactctacggcgagcccccgccagtcgagctcgtcgccaaggttgttgctgacgttaaacaggcgtacacccagcacggcggcgtaaggcccttcggcgttgccctcatattcgctggcgtaaacccggatggcacaacaaaagtctacaggacagaccctggaggccagtacttcagcttcaaagccatagctatagggagcggcgagcaggtggccaatgagatgttcgagaagcactataggagcgacatgagcctcgaagaagctaccaagctagccctaaagatactttacgctataataaggaagacggttgaggataaagagaaggcgatagcaacgctgcccgaccaagtagaactcgcctacataacagtcaaagaaaggatgttcacaaagatgactaaagaacaggtcaaagagattgtggacagcatgagggaggagctactacaactctaa

SEQ ID NO: 46585 - DNA, 2508 bp, Aeropyrum pernix
gtgacgctagtcaaggagaagctctcgataaaggggatgcactgtgccacctgcggccttactgttgagaaggccctgagaagccttccaggcgtggtagaggcctcggcagatcccgtaactggagaggcagttatagcgtatgagccgggctccgtaaggctttccgacgttgttaaagcgatcaggtctgtgggctatgatgttgtgctcgctgaggccgtgataagggttccctcaatgagtagtatcgacgacgagagagttgtcgaggagactctcctcaagatgaagggtgtggccgaggtctatgcttcccacacaaacaaaaccgtggtcgtcaggtacaatcctcacgccaccaaaccggaggaagtgctggaggctctgcggaaggcgggatacaaggctgagatggctgagggaaagagtcttgtggaggcggaggcagaagaggagagacgcttactcctggacggtctaatcagcattacagccagcatagtctactacattctactggctcttgagaggcttgctggggtggaagccgctggggcggttctgccctactatggagccgtggtcttcgccatcgtactcctaggccctgggagaaggtttctagtcggtgcctacaggagcttgaagaacggcacacccggtatggacgccctggtcagcctcggcacactatcgatctacttctatagcctcgctgcaaccctaaacataataaggggagagctctactacgaggggataggcctaataataggctttgtcctaatcggaaggtacatagagtcgaaggttaagaagggaactggcaaggctgtcgagaacctagcaaagctcaagccgcagaaagctagagttctaaggggtaggagggaggttgaggtcgatgttagcgaggtcaagccaggagacctcgtggttgtaagacagggtgagaggattcctgtagacggctacgtcgtccaggggaaggcctatgtcgacgagagcgtgtttacaggggagcccatccctgttgagaagaagccgggggatcttgttctagccggctcaatggtatcttcaggctggctccacatatcagcaaccagaacctcgggtgacacggctatagacaggatagccaggctcatagcctacagccaggctggcaagatggatatacagaggcttgctgacagggtttcaggaatgttcttctgggctgtcctctgtattgcttcgctaacgtttacggcatggctcttcctgggcgggcttgagacagctataataagggctgccagcgttttcctaatatcatgtccatgcgccctggggctggcaacgcccacagccagctcagcaggggtcggagtggctgccagggccggaatacttgttaggaacgtggtggcgttcgagaggctagcgaaggcgtctatagtggttttcgacaagacagggacgttgaccctgggcatgccgagggttgcggctgtggaggctgtagacggctacagcgagaaggaaatacttgaactggcggcttcagcggagaagtggagcgagcaccccctggccagggctattatagacgcctatatggaggtggcaggcagggggcctgaggatcctgataacgcagaggtattccctggtatgggtgtctacgcagaggtgggaggccgctcggtggttgttggtaacaggaagattatggacgggttcgaggtagatatcaagactctggaaaagattgcagaggagtggcagtcaagaggggcaacaacggttttcgtcgcaatcgatggaaagcccgctggggttatagccatcagagacgagcctagaccggaagccagggagacggtagattggctggagaagcttggcctgaaagtgatgatgctcacaggcgattcagaaggcacagcccgggctatagcgagggagctggacatagaggagtacagggccggggtcagccctgagggcaaggcagaggtgataagggagctccagaaaaagggtcatgtagttgtaatggtgggcgacggggtcaacgacgcgccaagcctagccagggctgacgtgggaatagctgttgcaaacgctaccgacgtcagcgtcgaggctggtgacatagtcctcataaaaggcgaccttcgacgtgtccccctagcagtggtaatatcgagaaagacatacaacactattaaattcaacctcttctgggcgttcatatacaacgtcaccttgatacccgtagcggcaggagcctttgcctgggcaggaataacacttaggccagagctagcagcagcggcaatggcgctaagcagcataacagtaacgagcataagctataggcttagcaaatggaaaccaagattaccgggcgattacgaaacttatgataacaaagaggagaaggaggagtcaaaagaagagttcgagaggataacgcgagaggagaaggctctagccgccgggagacaacagtag

SEQ ID NO: 46586 - DNA, 1386 bp, Aeropyrum pernix
gtgttacgaagcgaatacgacataatcgttatagggggtggtgctgcaggcttctcagcagttgtagcggcggccgaaggaggcgccagcgtgttactggtaagcgagggacccttaggcggcacctgcgtgaacttcgggtgtgtaccctcaaagcacgtcctctacaacctctcaacagcccgtaaggcagggttgaagataagcctctcggaggcccttgagggtgctaggaaggtctcggagacactacgtaaagagaagtacgagtcgctcctagacagcctgggagtggactatctcagggggagggctaggttcaaggctccagggattgttgaggctgacggacgggaggtcaggtacaggaaggctgctataatcgcggtaggcgccaggacctggagaccccccataccaggcctcaaggaggctgagaaggctggcaggatcctggataacgagaggctttttggagaggggcctccccccgacatggagagtgtggctgtgataggcgggagggcacagggtgtcgaagccgcccagatattcgcccgtagcggcctcaagactgttctactccagaggagcggcagactcctgccaagagacgagccggaggcgggagtctacatgaagagggtccttgaaggtgatggtgtcgaagtgaggacctctgcaaggccactgagggttgagagcgttaggggggctgtgaggatagattacgaaaccccccaggggcccgcctccgtagaggcgagctatatctacctggctactggtaggaagccggttttagacggtctcggcctcgagaacgtgggtgtcagggtcagtagcgacggctttatagtagttaacgagaagctgatggcatctccgggcgtctacgccgcaggtgactgtattggagggatccagctcgagccagttgctgccagggagggttacgtggcagccctcaacgctcttggaggcaacgttgagatggactacacagttatacctagagcggtgttcaccgatccggagttcgccagcgtagggttgacggagagggagctcgcaagaaagcttggagtatgcgcctgtaggacagtggatataacacagatacccagggccaggataatgggttatgagacgggattcgtcaagatggttgtagaccctaggacgaagaaggtagccggggttcatatgatggcgcctcaagcagccgaagccatacacgaggccgccttcatactgaaggctggtatgacggtagacgacgttatagacacaatacacatcttcccatccatatccgaggggataaaatacgctgcactggcattctacagggacgtctccaagatgccctgctgcctcctataa

SEQ ID NO: 46587 - DNA, 870 bp, Aeropyrum pernix
gtgggaggggctgaggagtcctcccctgagaccttagcttacggggggcgcagagctttggctagatatggagttgccgttgttaagatagggggctctatagcctccaggctcgagagggttgctgacgaaatagccgtcctagctcgagagggtttgaggctagtcgttgtacatggtgggggaaaggttgttgacgagtattcgagaaggatgggcgtggagccccgctatgtcctccacccctctggagtcaggagtcgttacacgagctgggaggagctggaggtttatgtaatggttatggccgggcttctggcaacaagcatatcatcagagctggcctcccgcggcctcaaggttctaagcctcacaggcctcgacggcctctcggtagaggctaggaggagggagaggatagtcatagtaaacgagaggggtaggccgcaggcaatccctggaggctacacaggaaagattgagagggttgacagcatgttcgtagggtcgatgctgcagcaggtagacgttatcctatattccccggtagcatacggccgcgaaggcgatagggtggtagctctaaacgttgacggcgaccagatggcagcatccctctccgcggctctcaaggctccgctagccctagtaacggatgtgccgggcgtgattttggatggaagagtggttgataggatcagggtgagcgaagcgagggagattgctgccaaggcgggtgttggcatgaacaggaagatacttatggcggccaaggccgtgtccgaaggatcaccctacgcggctataggggacccgcctatccaaagcctgattaacggggagaagggtacgctggtgactagaagttga

SEQ ID NO: 46588 - DNA, 1068 bp, Aeropyrum pernix
atggctcgtgcggttcgcgctggcatactaggagcctctggcatgactggtggtgaactcctcaggatacttgcttcccaccccggcgtagaggtggagtgggcgacgagcagggagtatgctggaaagcctgtccacacagctcaccctcacctgcggggcttctacactggccttaagtatacctctattgataagattgacattggagaggtcgatgttgtttttaacgctctccctcacggcgttggcgccagtattgttgcagaggcctacgaaaatggtgttagggttgtggatctgagcgccgactataggctaagggatcaatcgctatatcccaagctatacgggttcaagcatcccaggcccgatcttcttgaggaggctatatacgctcttccagagatctatggcgagaagctcaggggtgctaggctagcggcagtgccaggatgtaatgcaactgcggccatattagcagccgcacccctagtcgcctccaagattatagacatggatgtaggcattatagtcgacgttaaggcggcgagcagcgaggccggctccaagcccagccgccacagcatccaccccctacgagagggttctgcaagaccctacaccccctgggggcacaggcacgcggccgaggctgtccaggttctcagggacctggtaggacgcggcatacggttgagcctcgtgccgcacgctgtatcaatgacgaggggcgtcctagcaagcgcccacgccctgctccgggataatatcggtttctcggaggcggtgagggcttatgcatcattctacaaggactctcaaatagtgagagtcaagcccatggctccggggctgccagtcgaccctcctgatgtgaagaatgtgataggtagtatgtttgcggaggtagggttcgcagtagaggaggagtctggaaggataacggggttcgccgcaatagacaacctcgttagaggcgctgcggggcaggcagtctatgctatgaatgcaatgctaggatttgacgagtgggaggggctgaggagtcctcccctgagaccttag

SEQ ID NO: 46589 - DNA, 861 bp, Aeropyrum pernix
gtgagcctcaccgcgtcaatactctttttatacgatattgcaaggctcgacgagaagatgcttctcgaggagttgcggaagagagccagagtaagggttatccacacggcagccagagccctgccactgggagagcctccgagggaagccgaggaagccgatctggcagtggcccgcggggtcagcggtaggaggctcctctacagcgcgctggccgccgagagctgggggttggagacggtaaacagcagccatgcaataatggcgtcgcaagataaggtgtggagtcacatgctactgtccaggcggggagtacccactccacgctcttacaccatcctagacccccaagccgtcccctatgctgcggaggccatagggttccccgcggtattcaagcctgcccgaggaagctggggcaagcttgtttccctccttagggataaaagcgaggcttcactcctctccgaagccctcgagtatgttcagggggatttgaagcttgggctagtgcaggagtatgttgacaagccggggagggatatcaggtccttctgcataggcgacactgtgccagcagcgatttacaggtatggcagcggctttgctacaaacttggccgccggaggtagagcagcccctgcccccgtcacaggggatgtggaggacctaaccctgagagcttgtgaggcgttgggcgtcgaggtaggcggggttgacatagtagagtccacccgcgacggtggtctcctcgttctggaggttaacccatccacagagttcaagaacacggtgagggtgacaggggtcaacgttgcagcgctcatagcggattacgtagtgtctagggttaggcgctag

SEQ ID NO: 46590 - DNA, 1167 bp, Aeropyrum pernix
gtgaatgtggtgctcaagtttgtgaggttctacggctacaggggcctcaggatagttaagggtagcatgcagtatgtatgggacgattcgggtaggaagtatctcgactgccatgctggccatggagcagcgtttcttggccactccaaccccgctatcgtagaggcggtagtgaggcaggctcgagagctggtggcagcgtcttcaagcttctcaacacccagtcttgaagaggctctgacggagttctcacgcatagcacccccatgggcggaggagatagtgttcctaaacaccggcacagaggctgtcgaggctgccttgaaggctgcatggctagccacaggcaagcgggggattgtcgccctcaagaactccttccacgggaggactctggccagcctcagcgtcacgtggaatccacggtataggagaggggttccagtgcttgacacgagattcttaagtccatcaaccgaccctggagaggttgagaagctggtgccggaggatacggccgctataatcgtggagcccatccagggtgaggggggtttaacaaagatctatgcagagctggctaaggccctgagagaggctgctgacagggttggagccttactcatattcgacgaaatacagaccggtttcgggcgtacgggacgggtgtgggcgcacgagtctctaggcgtggagcctgacatcatgacggcgggcaagagcatagcgggggggctgccggccagcgcggtgctatcgagggagggtgtgctagcgacgctagccagcggccgccacgggtctacgcatgcagctaaccccctatctatggcagcagttgcggctgcctctagattcctgagagaggagggggttcctgataaggcccgggcagctggtgctctgctagagggtctcctcagggataggattgaaggcttgaggcttgtgaggggtgttagaggtgagggtcttatgcttggcgtggaactcaggctagaccccggccccgtcctccggtgtctccaggagtccgagcgtgttctagcccttaggtcgggtgccactgttgtgaggctcctaccgccctacagcatatcccgtgaggacgcggagatggtggtgtatggtctcgagcgatgcatatgtggagggtctggctgctaa

SEQ ID NO: 46591 - DNA, 1980 bp, Aeropyrum pernix
gtgggcgccgggaccatgggccacgggatagctgagctcgcagccatagcgggcttcaaagtctacctggccgacatcaacatagacatcctgaacaacgccctccagaggataaggtggagcctcgaaaagctcgccgagaaggggaggataagggagtctgtcgaaaccgtcatgtcgaggatcacccccatagtcagcgtgagggatggcgagtacagcgaggacctggcgaaggcgctttcggagtccgacttcatgatagaggcgataccggagaagctggagctgaagcagcagctcttcgccttcgccgacaagcacgcgaaggagacagcgatactggcctcaaacacgagcagcctccctataacagagatagccgcggcgactagcaggcccgagaaggttgtgggaatgcacttcttcaaccccccagtcctgatgcccctagttgaggttgtcaagggcgagaagaccagcgaggagacggtggctgcaacggtggatctagccaagaagatggggaagcagactgtggttgtgaagaaggatgtgccggggttcatagtaaacaggatactgggccggctgatggagtctgcctgccttctggtcgagaggggcgggtataccgtggtgcaggttgacgccacggccaagtacctactaggcctgccgatgggtgttttcgagctcgccgactacagcgggatagacgtgttctactatgtcttcgaggccatgagcaggagggggttcaggagcgctaagtgcagcatattcgaggagaagttcaaggcgggggagtacggagtcaaggcgggcaaggggatctacagctaccccgccccgaacaagtatgtgaagcctaacatacctagggaggaggctaaggtagacccactcctcctaatggctctgcccataaacgaggctgcatggctgcttagggaagatgtggcgactagggaggatatagacaaggcggtcaagctcggcctgggatggccaaaaggcgttttcgagtatgccgacgagttcgggcttgaccgggtcgttgaggccctcgagaggataaaaagggatttcggggtggaccacgccgagcctgacccgctcctcaagaagatggtggaggaggggaggatagggaggaaggctggcaagggcttctacgagtacggtgaggtcgaggagaagaagatggagaccctcctcgtgagggtggaaaagcccatagcctggatagtgctcaacaggcccgacaagctcaacgccatatcccccaagatgataatggagctgtctcaggccctagacgagcttgaggagaggagcgacgtcagggctgtgatactgacgggcgcgggtagggcattcagcgccggggccgacgttacagccttcgcccaggtaacccccatcgacatactcaggttctcaaggaagttccaagagcttaccctgaagatccagttctacactaagccagtgatagttgctatcaagggctacgcactcggaggcggcctggagctggcgatgtcaggcgacatacggatagccagcgaggacgcgatgctaggccagcccgagataaacctgggcttcataccaggcgcaggcgggactcagaggcttgcgaggctcgccggccccgccagggccaaagagctgataatgacgggcgacatgatacctgccagtgatgctgagaagatgggcatagtcaacagagtggtgcccccagagctgctcgagcaggaagcaagtagcctggccttaaagcttgcggagaagcctccaatagcacttgcagccgctaaatacgccatagacttcggcctagaaagcaacatatgggcagggctgcagctcgaggcatccctcttcagcgtcctcttcagcaccgaagacgtgatagaaggggtcacagcgttcctggagaagaggaagccaaagttcaagggaagatag

SEQ ID NO: 46592 - DNA, 1335 bp, Aeropyrum pernix
atgccgggagtgccctatagggtggactccgtcttggcagggaattctggccacactatcgacactctgctcctcaccttcgacgacgtagccatactacccggtctgagcacagtggagcctcacgacgtggagctctccagcagggtgagtaggagcatattcgtgagcacacccctcgtctccagccctatggataccgtgacggagtggagaatggccgccgcccttgcgaggcttggagccgtgggggtaatacacaggaacatgccgcgggaggagcaggcaaggcatgtaagcatggttaagagcgtttctccatcgccttggagcgaggtgcccaggattaggctgccagacgggctggagaactactccctgatcctggaggagcttgacgctggagcagccgtagttttcggcgacgacggtataaaggggtatctagtactcgaaaggcccgacgcccagctgtggctagagaaggcgaggtatctcagcctctacctgacgaggattaggcccttccccacgatagatggtgagggaaggctcgtggtgggagccgctgtcagccccttcgaccttgacagggcgaggcttcttgaaaagagtggcgcggactttctagtcatcgatgtggcccacctccacaacagaaacgctctctcaagcctttccaggctcgtgaaggaggtgtccatcgatgtcgtcgccgggaatctaggcaccagggaaggggttctggacactctagccagggccgaggaggtggctggcctgaggatgggtatatccagcggcagtatatgcagcacaggcgaggttgctggcgctgcagtacctaccctgactgcggttatgaacgcggtcttagccctagaggaactgggcctcgccgggaggatacccataatcgctgacgggggggtgaggaatgctggcgacgccgcgaaggcgataatagcgggggcctctgccgtcatggggggcaggctcttcgcgggagccgacgagagcccgggccccaggataagggttggcgacaagctttacaagccctaccgcggcatggcgagtagaggggctatggagaggaggttcgccgtagaccgttactcgaggcaggcaaaggcggttgaggagggtgtggaggggctagtgccttacacaggcccagttgtcaagacgctctacgagctggcggaggggctgaaggcggcgctcggctatgcaggtgcccaggacgtgacctcggcctggaaggccaagctagccagggtcacgccgacgggctccagggagattaggcctcacgacatactcctagggtga

SEQ ID NO: 46593 - DNA, 1041 bp, Aeropyrum pernix
gtgggaggtatacctgatataacaccctatccactcacatactctctggggggtgtaatcccgttgtccagcgttctggagatgctctgggtggagaagtacaggcccaggagcctggatgatatcgtcgaccagaagcatgtggtcgagaggttgaaacagtttgtaaagcagaggaacatgccacacctcctattcgcagggcccccgggcacgggtaagacgactgctgcccatgcactagcccacgatctcttcggcgagaattacaggcagtatatgctagagctgaatgctagcgacgagaggggtatcaatgttatcagggagaaggttaaggagtttgcccgtagcaggacgcccccggagattcccttcaagatcgtgctactagacgaggctgacaacatgacgagcgacgcccagcaggctctcaggaggcttatggagctttacagcagtgtcacaaggtttatactgatagcaaactatcccagcaagattatagacccgatacagagcaggtgcgcattcttcaggttccagcccctatccaagcaggacgttatcgagaggctgaggtatatagccgagaacgagggtgtagattacgaggaggaggctctggacgccatatacgagataagcgagggcgacatgaggaaggccattaacgtcctccaagccgccagctacctcggcaaggtgaccgtcgacgcggtgtacagggtagtgggtatggcgaagcccagagaggttagggagatgctcgccaccgccctgaaaggcgacttcaccgcggccagaagcctcctccggaagataatgatagagtatggaatgagcggcgaggatgttgcccggcagatacacagggagctattctccacagagcttaagatgcccgaggagcttagggttctcgcagcagactatctgggggaggtccactacaggcttgtggagggtagcgacgacgatatacagctctccgccttcctcgcgtggctgacaatgatgtcgagaaaactggaggtatag

SEQ ID NO: 46594 - DNA, 1017 bp, Aeropyrum pernix
atgctggggtctctagctgctgagaagcgttcagtcttccagacctcctgttgtgtaaggtataaagggtgtatgttaggggttggtcctactgtctggggggttgtgtggggtttgggctgtactgtggaggcacggggtttacggaagaggttcggcgggaggactgcagtggctggcgtctcgtttagtgtcggggatggtgagagggcttgtatcatgggtcctaacgggagcggtaagacgactctcctcaggatggtgtccggggtgctgaggccctccggggggagtgtgcgtgtctgcggctacgatgtgtggggcgacgggtggcgggaggccagggggcttataggattcgcccctcaggacccgcctatggctaggaggatgacgggcgccgagtatattacggtggttggcggcctcctgggccttagccccggagttgcaaggagggaggctaggagggttctcgagatgctcgggtttgaggatgtgcttgggagggttgtggctaggcttagcggcgggcagaggagggctctcggcatagccctggctctcgcgtcgaaccctgaggttgtcgtgctagacgagcctggtagcgggcttgacgtgagggccagggagtccctatgggcctcactcaggaaggccttcaaggggaggaccgtgttattcagcagccacgacccccaggaggctgaagcggagtcggacagggtactcataatgcacaggggtaggctagctgcatgggggaagcctagggagcttattcaacgatacgcacccaagcccagggttagagtgtgggcggatagggcgccggatgggctggagcccgtccacactggccccgggttctcggactaccttatagaggctccgggggacgtcgcgaggatagcctctgcatacagcggggcggggatacttgttgagaggatagaggtcctcaagcccagcctgagggaggttttcttcgcggtaacgggggaggagatggattga

SEQ ID NO: 46595 - DNA, 870 bp, Aeropyrum pernix
gtggagccccctgaaggctgggtccctgtcgaggttaggagtgttggcatgtgcggcagggatctcgttgtctggaagggagggttccccaaccttaagcccccgctggtgctgggccacgaggtcttcggcctccacgatgggaggccggtctcggtctatcccgccatagccgtcccggggtgcccggactgccctccctcgatactgggggagaacctaccgggggggtacgccgagagggtctacgtgccccgggagaacctcatacccctccccgacacggatttcaacaagtacgccgccgcgacgtgcggcgtggctacaatgatgcacgctgccagcgtcgccagcgtgaggccaggggagagggtgcttgtgaccggggcctccgggggtgtagcgctccacgggatacagtacctccagctccttggggctgaggttgtggcctacactaggagtagggagaaggccagggtgctcgaggaggagcttggcgtcgaggctgtgacaagcctagacttctacagggagcggggcagggttgatgtggtcatggagacggtgggggcgcccacgataaacgagagcatgagagccctccgcccacgcggccgcctagtcctaataggcaacataaccggggagccagtaacaataaagcgtccagcactgctcgtcatgagagagataacaatatcaggcacagcagcattcacacgcaaagaatgggaggcagccataaaaacaatagccaagggaggagtcaaacccttctacaaagcatacagactagaccagataaacaacgccctaaaagaagcactacaaggcgccagaatcggaagaatagtaataaacccctag

SEQ ID NO: 46596 - DNA, 2613 bp, Aeropyrum pernix
gtgataccctcagacttcaactcgctaccctactccatcagggttctcctagagaatgttgtcaggcactacgacggcttcgtggttagagatgaggatgtggaggctgtagcgaggtggagcgagtacgccgggcgtaaggacgtgccgttccaccccgtgagggttgtaatgcaggacttcacgggagttccagctgtggtcgacttagcggctatgagggatgctatgaagcagttcggaggcgacccgtccaaggtcaaccccctgatacccgtcgacctgatcatcgaccacagcatacaggtggactactatggcaccgccgaggcgttcaggctcaacttgaagagggagtatgaaagaaacagggagaggtatcagctgctgaagtgggctcagaaggccttctcgaacttcagggttgtcccgcccggaaaggggattatacatcaggtcaacctggagtatcttgcgagggtcgtgtggctttccaggaggaacgggaccctctacgcacacccagacagcctgttggggactgatagccacaccactatgataaacggtctgggagtcttcggctggggtgtgggtggtatagaggctgaggctgttatactcgggcagccatactacatgctcctccccgaggtcgtaggagtgaggctggtgggcgagctgagggagggcgtgaccaccacggaccttgttctctacattacggagaagctgaggaagaagaatgtggtcggcaagttcgtggagtacttcggggagggtgtgaagaagctaagcgtgcccgacagggccaccatagccaacatggcccccgagtacggcgccaccatgggcttcttccctgtagacgaggcaactctagagtatctcaggggtactgggaggccagagtggctggtccaacttgtcgagaggtataccaaggagacggggctttggtatagcctcgaggatccggagcccaggtatagcgatgttgtagagatagacctgtccgacgtggagccgagcataagcggcccaagccatccagaggacaggatacccctgagggaggctaaggagcgtgtaaggaagattataatggagtatctggagaagaagggcaggggacccgctatagtggagctcaagctcggtgacgaggaggtccatctgacggacggcagcgtcgtctacgccgctctaactagctgtaccaacaccagcaaccccagcgtcatgatagcggcagccctcctggccaggaatgctgtcaagaagggactcagaactcggccgtgggttaagaccagcaacgcccctggtagcagggttgtgcctgagtactggaaccggctcggcctaatgccatacctagaggccctggggttccatataacaggctacggctgcacagtctgcataggaaacagcggacccttgaggcccgagattgaggaggccataagagagcatgacctctgggttgcaacggtgctcagcggcaacagaaacttctctggcaggatacacccgctggccaggggcaacttcctggctagcccaccgctggttgtggcctatgccctggctggcagggtggatatagacttcgagaaggagcctgtgggctacgaccccaacggcaaccctgtatacctcagagacctatggcctagccagcgggaggtgagggaggcaatagagaaggctctagacccacagcttttcgtggagaagtataaagatatagacaagggggacaagttctgggaggagctgaaggcccctgagggcgagctttacagctgggacccgaagagcacgtacataagaaagcccccatacttcgacaacatgcccctagagccgcagcctccgagggacataaggggtgctagggttctagtctgggcgcctgacaggacaagcaccgaccatataagcccggccggaaggataagcccggactcgaaggcgggccagtacctgatagagcagggggtcccaccctcacagctaaacacctgcggctctagaagaggcaaccacgaggtcatgatgaggtgcaccttcgacaaccccagattcaggaacaagctggtgccagacagggagggaggctggacaatattctggcccaccggggaggtaatgcacgtgttcgacgccgccatgaagtatagagagatgggcgtaccgctcatagtgcttgccggcaagcagtacggcgtgggctccagcagggactgggcggcgaaagggcctgccctgctcggcgtgaaggcggttatagccgagagctacgagaggatacacaggagcaatctagtcggcatgggcgtgctaccgctagagttcatgcccggagagaacgcagagaagctagggctggacggtagtgaagagtacgatataataggtatcgaggagggcctcagccccgggaagatactgacggtgagggctaggaagagcgacggaagagtgatagagtttaaggtcaaggcaaggctggacacgcccatagaggtagagtactacaaacacggcggcatactccagtacgtcctgaggaagcttatcagagagcatggtagaggcaactga

SEQ ID NO: 46597 - DNA, 1017 bp, Aeropyrum pernix
atgggggctattattgtggacggcgcctctagaataacagctctcaaccccctcaccatatatctttcgggtggtcgtgtggagaccggttcgagggccagggacctttacctgctgaggcctcccgagcctgtcttcggcattcagaggagcagggaggaaagcctcttcagcgttataggggttccctacgactccacatcctccttcaggcctggccagaggttcgcccccagggagattaggcgggcttcaatcgagctagagtccaacggctactacgtcgagggagacatagaccgtgttcctatagccgacgagggtgatgtggcagcggtccccggcagcaccctgcttacgctcgagagggtcgcgagggttgttgaggacctggcccgtgagggtaaagtgcctgtggtgctgggtggcgagcacctagtaactctgggtgcgcttagagggcttgcagcagcaggcgttaaaccctgcgttgtcgtcctcgacgcccacttcgaccttaggaacgactatctaggggagaggtttagccacgcgacagtgtttagaagggtcctggaggagctgggcgtaaagctgctgtacataggggttagggcttacgaggcgggcgaggagaggctggcggtcgagtcggggcttatcgactatgttcctatgaggagaatggatatcgtgggcgtcgatggcgctgtattagctgcccgccgcttcaccggcgactgcgagaaaatctacataagcatagacatggatttctacgacccagcctacgctccaggcgttggaaaccccgagcccgggggggccagctccagggagggtttagcgctggcttcgcagctgggtgacaggagggtttgcgggattgatgtagttgaggtttcccctccctacgatccaggcggggccacctccctgctggcggctaagacccttcaggaactcttgatatccgtctggcaaagatggggagtcggtagaagcgcatctagttga

SEQ ID NO: 46598 - DNA, 1008 bp, Aeropyrum pernix
atggcgggtgagcccaggctcggcaggaccggcccgcgggtatcgagggttgggctgggcctctggcagttcggctcgccgatgtggggtgggaaggcgctatcggccgatgttctggctagaggcctatccatagccgtggaggaggggatcaacctcctcgacaccgctgaggtctacggcatgggctcttccgagaggatgcttggcgaggccctaaagaggcttaacgctagggaggacttcgtaatagtgagcaaggtcgcagggttcaggagtaccgcgggcgacatagtgaagggggcccgcggcatagcggggaggctcagctcggcgcccgacgtcatcctacaccactggccaccccccgtttactctaggctctgcagcgtagttcgcgggctggagcaggctgttaatgagggtctagccagctactacggcttctctaactacggcgaggacctcctgggcgacgccctatcctgcaccaggaggctcgagccagtggcggaccagatactatacaatctagcctacaggactccagagcagcggctcatacccctcctacaccagcacggaatgacccccatagcgtggagccccctcgcgaagggcgccctggcaggcttcaaaggcgagcccaccagggcccaggcgggtgaccccgtcttcagaactgccctagaagatactgggctgcaggaggtcctggagtccgtagcccggcgtctaggggcgtcgaaagcgtctgtagccctggcttgggtagcctacaagggtgccgtgcctatagtggggtggaggaggcctgagagggttagggaggcggccgcggccgccaggctaaagctgagcgaggaggatgtggcattgcttgacgaggcgagcaagcgctacgtaacattgtggggcagcagctatagccccccaggcctgcggaggatcaggctaattcccggggcgctgcagcggctcgccataaggttgtggggaggcatctag

SEQ ID NO: 46599 - DNA, 489 bp, Aeropyrum pernix
gtgattgtggtggagggcgagggactgcttgttaggaagataaggagcggggtggtgatagaccacattcccccaggcagggcgttcaccatgctcaaggcactgggccttctcccgcccaggggctataggtggaggatagcggtggttataaacgccgagagctcgaagctgggtagaaaggatatactaaagattgagggctacaagccccggcagagggacctggaggtcctcggtatcatagcacccggggcgaccttcaacgttatagaggactacaaggtagtcgagaaggttaagctaaagctgccggaggagtcacaaggggttctacggtgccccaaccccacctgcataacgaggaaggagagggagaaggctgtttcgaagatggtgctcgtctcccaagacccgccagcctaccggtgcgtctactgcggcaccacagttatgggcgacgagatacacgatctcatatccccgtag

SEQ ID NO: 46600 - DNA, 939 bp, Aeropyrum pernix
gtggctagccgggtggcggggaaccctttcaaagggcgcgatgtaatatccataaccgacttcacccgcggagacctagagctcctcttcaggcaggctgacgttatagagtctaaggccgggtccaagcctctggatggtaaggttgtggctctcgccttcttcgagcctagcacgaggactaggctgagcttcgagactgccgtgaaaaggcttggaggctccacgctcctcataagcggcgaggaggctataagcgtggccaagggggagaacctagccgacacgataactatgctggactcgtacgccgacgctatagtaatcaggcataggtacgagggcgcagccctctatgcagcggaggtggcggagaagcctgtaataaacggtggagacgggcgccagcaccaccccacccaggctatgctggacctctacacggtttacagcctattcggcacggttgacgggctaacatacggtgtgctcggcgatctccgctacggcagggccgccagcagcttcatcctcgggctctccctcttcaaccccaggcatgtatacctcataagcccgccgcagctgagggctaggagggaggtcctcgaggccctggagaagcggggcgtaccctacactgaggttgagaggctgcaggacgtgcttggagagctggatgtcctctacgtgacgaggatacagaaggagaggatacccgaccccagggagtacgaatccctcagggggagctatagggtaaccctcgacctgctggagtcgtttgcgaaggaatcgttgaaggtgctgcacccgctgccccgtgtggacgagatagatttctccgtcgacagcagcaggtatcaggcgtacttcactcaggctaggttgggtgtgagggtcaggatggccctcatgaacctggttatgagggggtga

SEQ ID NO: 46601 - DNA, 1404 bp, Aeropyrum pernix
gtggctggtttggagaggttcgacctcgtggttgtcggcggaggccccgggggatatccagcggctgtccgagctgcacaggaagggctgaacgtcgccctagtggagatggatagcctgggcggggagtgcaccaactatggttgcataccgacgaaagctcttctacaccccgcaggtcttgtagcctcgctagcgaggctcaagttcgtcaagggcagcgtggacgtggacttcaagggcctcatggagtgggttgatagtgttgttaagggtgtttcaaacggcgtttcaacgctgctcaagggttacggtgttgaggttgtaaagggcagggcgaagataaggcctggcgttgtcgaggttgacgggtcgggcagcatagggtattcaaagctggttctggccctcggcaccagccccgcctcaatacctggtctcgagcccgacggggaggttgtacacaacaacagaaccatactcggcctgaggaggaagccgggtagaatgctcatagttggcggtggatacattggggtagagtatgccacggccatggctaggctaggggtcgaggttaccatagtggagcttctcgacaggctacttcctaacatgcagagggatttctccagagtcgtggagaggaggctgagggctgagggcgtgaagatacacactaagagcaaggtcgaggctgtggagaggcgcgagcgctacgcggttgtcgaggtctccggggttggcaagatggagtacgatgctatactcgtggccgtggggaggaggcccaacacgggggacgtggggcttgagaagctgggggtgaagcttgacaaggccggctatatacaggtggatggtgccactctggagacgggggtaccgggggtgtatgccagcggcgacgtcaccgggccccccctcctagcccatagagcgttcctccaggcggtagtcgccgcggagagggctgcgggcgactcctccgccgccttcgacgccaaagcagtgcctgccgtagtgtatacagaccccgagctggctactgtagggttgacgcttgaggaggctagggcggcgggtgtggatgccgcggagactaggctccccctagctagccttcccagggtgggggcgatcgagggttgcagggagtgcttcgctaaggtggtctacgatagaagcagccgcgctatactcgggttccacgtggctgcgcctcacgcctcggagataatcgccgaggccgctctggccatagagatgggggctacgctggaggacctcgccctcacaatacacccacacccgagcgtttccgaggcgttgaaagaagtcgccgagctagcgcttgagaggcccattcactatatcctacgtaggggcggggcaaggcggtaa

SEQ ID NO: 46602 - DNA, 1239 bp, Aeropyrum pernix
gtgggtaggattgtccaggtaaagctaccggatattggagagggcatagccgagggggagattgtagagtggctagtagaggagggggcggttgtaaagcagttcagccctctagtcagggtgctgactgcgaaagcgacggtggaaataccatccccatacacgggtagggttgtgaggcttctagccaagccgggcgacgtggttagggttggggatcctataattgagattgaggttgaggagggagaggctcctaaggcgccagaggcggcggagaagccctctgcgacagtcgagcctcctaaggctgaggaggcggctgctcctcccccgcaagcagcccctgccattctagtcagagcaccgccaagggttaggaggctggcccggcagctcggcgtagacctagccagagtgaggggcacaggcccacggggtgctattacggaggatgacgtcaggagggcggctgcgatgctcgccacggcacccaagcctgaagcacccccgcctgtcgcagaggaggctgaggagaggatacctgtaaggggtatcaagaggtccatggcccagtctatgagcctgagcaagtcgaagatacctcacgcctatattgcagaggaggtcgacttcacagagctctctaagcttagggaggccctgaagagggatgccgaggagaagggggttaggctgacctacctccccttcgtgttcaaggctgtggcaaaggctatcaggaagtatcctctagtcaactccgagttcgacgaggagaagatggagatcgtcgttaagaaggctgtgaacatcgggttcgcggtcgacacgccacacggcctcgtagtccccgttgtaaagaacgttgagaaaaaggggttgttcgcgatagcgagggagatagccgatctcacggctaaggctagagagatgaggcttagccttgaggaagtgtcgggagcaaccttcactataaccaacgtaggcagcatcggcagcgtgataggcttccccgtgatatacccgcccaacgttgccatactaggcgtccacaggctggtcgagaggcctgtctacgttgacggagagctcaagccgaggaaaattgggtttgtgtcgctaagcttcgaccacagagccctggagggtgcctacgcgaccaggttccttatggaggttaagaggctgctcgagaaccccgccctcctcttcgccgaggactatgaattccggtag

SEQ ID NO: 46603 - DNA, 978 bp, Aeropyrum pernix
gtgcctgttatgaacatggtgcaggctcttaacactgctctcagggaggagatgaggcgggataagagtgttgttgtgcttggggaggacgttggcaggagggggggagtcttcctcgtaactgagggtctcatcgacgagttcggcgaggagagggttatagacactcccctcaccgagatgggtatcgtggcgttcgctatagggatggctatgtacggtcttaggccggttgcggagatacagtttatcgacttcatatacgaggcgttcgaccagatagtaaacaatgcggcctggtataggttcaggagcggtggcatgtataacgtgccccttgtaataagggggccctgctgcggcggcataagagggggaatgcaccacagccagagcaacgagccgtacttcatccacactccaggcctctacgtcgtcatgccatccacaccctacgatgcgaaggggctgcttaaatcgtctatacggagcgatgacgccgtcatatttctcgagcctaagagcatctacaggactatcagggaggaggttccggacaacgactacacaatccccctgggccaggctaggcttgtccaggaagggtcggacgtcaccctagtaacatggggcgctatggtgcatctggccaaggaggctgctgagctcctcagagagaagaggggctggagcatcgagataatcgatctcagaactctccagccatgggataaagatatggttgtgaagagtctcgagaagactggaaggctcgttatagtccacgaggctaggaagatactaggcccgggcgcggagatagccgcatacattagcgagaactacatagacttgctacgcggccccgttaagagggtggccagctacgacacaccataccccctagcccacgagaagctctacttgcctaacctcgctaagatatacagggcagtaacagaagttatgcagtggtga

SEQ ID NO: 46604 - DNA, 1296 bp, Aeropyrum pernix
gtggaaaccagtggcattgggtggcctaagtgtgtggcggtgttcataagactgtatttaggatggataaatagactacttgcaattactattaaagcgggccttaatatgagtaaaacaggccttattgatactcctttcaagcctgtcgagaaaaacgttgtggaggagtataagactctcctcgaagatgctctggggtttaagagggcagtcgacgaggagggcagggtagtcgacgaggaacttcttcccaaggtcagcgagggggagattgtagagatatacacctacatggtcagggcgagagttatcgacagttggcttctgaagctgcagaggatgggtaaggttgcgctacacgccccaaacaaggggcaggaggccgttgcagtgggcgccgcgaagcctttgaggagagatgactgggtgttccccagctatagagagctcggcgcctacctggtcaggggtatgagcgaggaggaaattctcgacagggctctggcgaacgctgacgaccctctgaagggaagcgacttcgccatattcggaaacaggaagtataacctggtgccagcccccgtccctgtgggcaaccagatccccatctcggtgggcgccgcgtacgcgatgaagtacctgggcagggatacggttaccctcacattcttcggcgacggcgccaccagcaggggcgacttccacgccgggctaaacttcgctggcgtgttcaaggttccagcggttttagtgatacagaacaaccagtgggctataagcgttcccagggcgagacagactgccgcaccctcactggctgttaagggtcttgcatatggggttccgggcgttaggatagatggcaacgatgtaatggtggtgtacaagattgtcagcgatgcggcggagaaggctaggagaggcggtggaccaaccttgatagaggctgtgacatacaggcttggcccacacacaacggccgacgacccctcaaggtacaggactagtgaggaagagagaattatggagaggtatgaacccctgaggaggatgaggaagttcatggagagcatgggtatattgaccgagaaggaggccctcagcatagaggaggagtggaatagcaaggttgaagagatagtgaggaaggtgctggcgaagcccccgctgccggagaacgtgttcttccagaacgtatacggggagaagccctggttcatccaggaggaggagcgggatctggaggagacgctcaaaactatggaggagctgggcctgagctataaggagtag

SEQ ID NO: 46605 - DNA, 1182 bp, Aeropyrum pernix
gtgcggctctgtatgtccacaagccaagccatatttccctgggaaggcgataatgtcagggctgtgagggagagtgtaagagagtttgccgagaagaaggttgcgcctaaagctagggagatcgacgccacaaacacagtccccgagagcctattgagagaaggggctgagatggggtttttcgcgctccgggtgcctgaagaatatggaggcccgggtcttagccttctcgaaagtgttgtggcgatcgaagaactctcaagggccagcagcggctacggcttgatagcggtggtcagcggctctatggtagtgcaccctatactgaagttcgccagcgaggaggtgaaagaaaagtatctatctaggctggctaagggcgccataggcgctttcgccctcaccgagccgtgctgcggaaccgacgtcgcctccctccacatgactaccgccaagagggagggcggagagtatgtggtgagcgggcagaaaatcttcatcaccaactccgcctacgcagacttcttcatagttgccgcacgcaccgggaagctagaggagaggcacaggggtatttccctcctgattgttgacaggagtgactgcgtcgaggtttccaagctggagatgatggggtacagggggagcgggacatctattgtatatttcaacgactgtagagtacccagtgaaaacctaatcggacaagaaggcggcgggttcaagctggtcatgcacaccctcaacgaggggcggatctcgaccagcgccagcggccttggagtcatgcaggctgccttcgacgctgcactgaaacacgcaggtgagagggagagcatgggcaggcctataatagagcatcagatggtctccagcatgatagcggagatgctggtcaggctagagacgagcaggctgctcgtctacactgcagcccacaagctcgacacaaacagtccagactacataaagtacgccagcctagccaagcttcacacagccacggctggtgtagatctggttagaatggccatgcaagtcctaggaggcataggctacagcagggagagcgatgtggagaggtactatagagatataaagatgatagagataggtgacggcaccaacgaggtccagagaatggtcctcaccaagttcctccaaggcaggataagaccctga

SEQ ID NO: 46606 - DNA, 1185 bp, Aeropyrum pernix
atgagccagcagccagagtgcagggtagagggtaactatataatcgttcctaagggcctggttaacgttatcgtcgacgagactagaataagcggcgttgaccccaagggcgaggcgactatatacaggggctacactatcgaggatatcggcgagcacgccagcttctacgaagcagcccacctaatactattcggcaggctcccctgcgacgaggagcttaaagagataaagtcgaagattgacaagtacaggggccagattccagagaaactgttcgacgctatgaagcacgtcccagtaacccacccaatgtactatggaatatatggcacagccctcctcggccagtactacgcgcctgagtggaggttcgacgaggacttcctgtacgaccatgcactcaggcttacagcacagctgcccgtaatctttacaacgggctggaaccttgctcaccacggcaccttcctcaggcctgatcccagcaaggaccatgcctgggacgtgctcagaatgatagtaatgagggagccgagcgatattgaggctagagccttcgagtcaaccctggtactctacatggaccacggattcaacgcctcaacattcaccacaagggtcataggcagcacgctcagcgacctatacagcgcagtagccggggggatagcggccctcaaaggccccctccacggaggcgccaacgagaaggccatggagatgttcctagacgctatgaagaaggctgaggagaagggcgtcccactatacgactacattgaggagtacattaaagagaagcttgccaggaaagagaagataatgggcttcggccacaggatctacaagctccacgaccccaggactgatgttgcggcaaagttcgtcgccaagctaaaagacggggagttctggatgaaggtactgaagaaggccgaggaggttatgtggagggagaagaagatacctgccaacatagacctctacactgcagtcctctactaccagctgggcatacctatacccatgtacacgcccatattcgccatgggcagagtcgtcggatggagcgcacactacatagaacaggtgctaaacaacaagctgataaggcccacggagaagtacgtcggcccaacaggcctcaagtaccagccaatagaggaaagatgcaggaaatag

SEQ ID NO: 46607 - DNA, 1014 bp, Aeropyrum pernix
gtgggtgtcagcgttttgaagtgggatagactgtttgaagcctcgtcgagatactcgatgctcatagaccactatataatggattttatgagcataactcctgacaggcttagcggggcatcgctacacctcattaaggccggcgggaagaggctcagacccctgataacactcttgacggcgaggatgctggggggtctagaggctgaggcccgtgcaatccctcttgcagcatctatagagacggcccacacgttttcgcttatacacgatgacatcatggatagggatgaggtgaggaggggcgtccccacaacccatgtagtctacggcgatgactgggctatactggctggcgacacgctgcacgcggcggccttcaagatgatagccgattctagggagtgggggatgagccatgaacaggcctaccgggccttcaaagttctttctgaggctgctatacagatatccaggggtcaggcgtacgacatgctcttcgaggagacctgggatgttgatgtagccgactacctcaacatggtcaggctcaagactggcgctctcatagaggcggcggcgcgcataggagccgtcgctgcgggggctggcagcgagattgagaagatgatgggtgaggtgggtatgaacgctggcatcgccttccagataagggatgacatactgggcgttataggtgatccaaaggttactggcaagcctgtttacaacgacttgaggagggggaagaagacgctgctggtgatatacgctgtcaagaaggcgggtcggagggagatcgtcgaccttattgggcccaaggcgagtgaggatgatttgaagagggcggcatcgataatagtggactcgggtgccctcgactacgcggagtccagggctaggttctatgttgaaagggctagggacatactatccagggtgccggcagttgacgcggagtcgaaggagcttctcaaccttcttctagactatattgtggagagggagaagtag

SEQ ID NO: 46608 - DNA, 759 bp, Aeropyrum pernix
gtggtggcggtggctagcccaggatcccgggctccctgtgggagcgctgtagtgaagctgggtggcggcctaataacgttcaaggacaagccgtacactatagaccgcgccatgctggagaggacggcatctcagctagcagcatattcgaagggtactggtaggttggccgctctagttcacgggggcgggagcttcggccacgccgccgtcgcagaggcaagggcccagggcggcctgacgccgagggcggctccccgcgtgcagctggcgatgctcaagctggctatggaggttgctgcatccctcctgaagtatggggtggaggtttccatccacccgccccacacgttctgcagcgggggcgaatgcgtgcttgagaccctgaagagggactataggcttggtctcacgccgatgacgttcggcgatgcagtcccggcggatggcggggttgagatagtcagtggcgacgacttggcactgtggcttgccgtcgagctcggcgtcgagtgcctcatatacgcaacccgcgttcccggggttgtgaagggcggtcgagtggtgcctgttatacgtggtctgggggagtttgaggacctggggagcggagacgctactggaggtatggcgaggaaggtgaaggctgcgctggaggcttcgaggaggggtgtctcgagggtcgttattgtagggggtgacatgcttttagaggccctacggggcgttaatgttgggaccagggttgatgcgcgttga

SEQ ID NO: 46609 - DNA, 1458 bp, Aeropyrum pernix
gtgtttaagaccttcgtcgccggcaactgggttttaacaagcaacctggcggtagtcaggagtccgatcgacgggagtataatagcgaaggtatccaggcttgacgcggccgctatagaggagggtgtagacgtagtatacaggctcgggaggaggaggatcagggacgtacccggggagaagaggctcaacatactctcaaggatagctgacctgctggagaagaatgcgggggattttgaagaggttctcacggtaaacgcgggtaagacgaggaagcaggctgctggcgaggtcgaggcaagcatagacaggctcaggaaagccgctctagacctcaggaagctccagggagagtacgtgcctggagactgggataggcataccctggagagcgagggcattgtcaggagagagccctacggcgtcgtgctagccataatccccttcaactaccccctcttcgacactgtcaacaagttcgtgtacagcactatacccggcaacgccttcatagtaaagccgcctagcgccgacccgctaccagtaataatgttcgctaggctggcgatagaagccggattccctcctgagtcgctgatgatagcaactctcagaggctctgaggccgagaaactcgtagcggacaggaggataagtgtgataagtctcacaggcagcagcgagaccggcgtcaaggtgatgaggtccgccgggatcaagcagctgattatggagcttggcgggggagaccccgccatagttctagccgacgccgacctcaagtcggcggcatccaagatagccacaggtataacaagctactcaggccagagatgcgacgctataaagctagtgcttgtagaggagccagtatacaacgagatgaagaaactacttgtagaggaactctctaagataaaggtaggcgatccgagaaacgactcgacaacaatgggccccctcatcgataaagaagctgttgacgccatggtggaggccatagaggaggctgtgtccagaggcgcaaagctgctctacggcggcgagagaataggcgacacctacataacccccgcactcgtagaggtcgaggataaaaacgtgctaagagagctaaagctctacaaagacgaggtgttcgccccggtagcggttataacaagcttctcaaccctcgacgaggcaatagagcttgcaaacggaaggcgctacgggctcgacgccgccatattcggggagagcatggctaggataaggaagctcataagattcctagaagtcggggccatctacataaacgagtaccccaggcacggtataggctactaccccttcggcgggaggaaagactcggggataggcagagagggtataggctacagcatagagtacgtgactgcgttgaaaactatagtctacaactacagaggacgcggaatatgggagtacctctaa

SEQ ID NO: 46610 - DNA, 2022 bp, Aeropyrum pernix
gtggttgctgagaagcctaaggcggctgctaagatagcctatgccctgtcagacggccggggtgtcctgaggtgtagcgagtacggagtaccctactggatagtccgcagggatggagccgccatagtagtcgctccctcagcgggccacctcttcggcccccacacagactctaggggcttccccgtgttcgacttcgagtggcgccctatcttcgagttcgacaggggagcggggtacctctccaagttctaccgcatgctttcaagaatactgcccggcgctagcctctacgttaacgcctgcgactacgacatcgagggcagcgttataggtttcaaaataatagaggccttcggagacgtaaacagggctaggaggatgaagttctcgacactagccccgcaggacattaggagggcctacgccaggatggaaaggctggatgtcgagatgatagaggcgggtatggctaggagcgagatggactggctctggggtatcaacgtgtcgagggccctcatggaagctgccaggagggcggcgggcaggagggtcatacttagcgccgggagggtgcagagccccactcttgtagaggcctacaggaggtggagggagataaacctccacgtccccaaggcttctgtcgcggtgaagataaccgccgagaagggtggaggcgttttcgacgccaggccgcacggctggaagccccaatccctcgagacagccagatctataaagagcgagctcaggaaaaacccctggctagccgtggaggaggttaggagtgagaggagcatcctgaggccccctcccgcgtttaacctgggcgacctgcagaaggaggctaataggatactgggtctgccgcccctcaggacgcaaagcatagctgaggagctctacctggaagccctcataagctatccacgcaccaacagccagaagctccctccctccataaactacagggccatactggacaagctggcccatggacctctaggcagggaggcgagggagcttctgaaggagacgggaggcgtgctgaggcctgtccagggatctaaagacgacccagcccacccggcgatacacccgacgggtgagaagcctagccagcgcctctctaaggagcatatggctgtttacgagctcatagttcggaggttcctggcagcgttcagcagggaagcaatagttagcaagtcgtcagtgctgctgagagacttccaggggagggtctggagggctgagggtctgagggttgaggacctcggctggctcaagtactaccactacagcacgccgggcgagaagcctatgccccctctagacaggggtgataaggctagggttgtcagggtcgatgtcagggtggagtggagccagacgccggtgaggctggacaaggcaagcctgctcagatggatggaaagtgtaaacataggtactgagggcacaagagctaggattattgagactctctacaagagaggctatcttgaggggtctaggaagtccgaagtgacacccctaggggaagcagtggccgtcataatccagaccctattcccagagctctccaagccggacctaaccaggaggttcgaatccatgatcgaagacatccgcagcggccgtagaaccaggcaggaggtcatagatatgtcgaagaaaacaatctcgaaactcctggagagcttcctagacaggctcgacaccgccgtcagggagataggcgtctccctaggcagcgtagaggtggaggccgcctgccacctatgcggtaggaaggctgtttcggcggtaagtggctacagactctgcagccaccatatggaggcgttcgataggcttagaaaggccctacctaatcttgcctcgacaatatcctcgacccctagggaggccctggaggccatagccaggggcaggtccagggcgggggcctgggtgagagatgtggcggccctggcgctgagagacgacgggctgtacaaagccctattgtga

SEQ ID NO: 46611 - DNA, 1356 bp, Aeropyrum pernix
gtgttgtgtgggtgtcgatttatggggaagtatgtggagagggctgtgagggtctttctgaatacaggcacgagatttcccgagaggatagtgtgggctataggcatggtgaagtactctgctgcgaaggctaacatggagctcggcctcctcgacgagaagagggcttcagctattatgcaggctgcacttgaggttgccgagggaaaacatagtgacaagatagtggttgacgtgttccagacgggcagtggaaccgggttgaacatgaacgttaacgaggtcatagctgagagggcttcggagatagcaggggtcgatgtacaccccaatgaccacgttaacatgagccagtcaagcaacgacgtcataccaaccgcgataaggttggccgctgcctctgcggtcctcagcgagctggtaccctcgctcgagactatcataaatagcctgggtagtgctgaggcgaagtatgcaagagtagtgaagccgggtcgcacgcacctccgtgacgctctccccgtaaccttcggccaggagatgggggctttcaaagacgcgttctcaaaggacctagccatggtcagggaagccctagaggccgtgctggaagtccctctaggcggcacagctgtgggcacggggattaacgcccacccggaataccctcgcagggctgtttctatactggcagaaaagactggtataccagtcaaacctgctgccagcaggtttagagctatgaggctggtcacagacctggccatgctaacagctgccgttagatccgtggccatagacctttggaggctgtcacaggacctgaggctcatgtacagcgggcccttcacagggatagcagaggttgagataccccaggaggtgccgggcagcagcatgatgcccggcaaggtgaaccccgtgactctagaggctgcgatgcaggctgccagctacgccatagccctggacagctcgctagtgcaagcttccctcctcggagagttcgagctaagcatgggcctcccccttgcgggctacgctgcggtaaggcaggccgagatagtggcggaggctcttaggaagacggccggtctcgtcatagggagggtagagccgagggtggagcgtatgagagagcttgctgagaggagtcaggctctgataactctagtggcgcctattatagggtatgagaaggcggctgaagtctccaggatgctgtacgagggtagaagcataagggaggctctgaaagctgtggggctcggcgacgaggctatagagaagctgctcgatcttgaaaaactagttaagcctggaataccaagtcttgaggtcgggcgtaaggattga

SEQ ID NO: 46612 - DNA, 1038 bp, Aeropyrum pernix
gtggcaggtgcgatgatagaggctcgcggactggtgaagcgctttgtcagcgggaggattaggaggagggtagtggaggcgcttaaaggagtatctttcagcgtttacgaaggtgagatctactctttcctcggacccaacggggctgggaagactacgacggtcaggatcctatccacgcttctagatccggatggaggtgaagctagggttgcgggtttcgatgtcgtgaaggagaggtgggaggtcaggaaaaggataggtgttatgctttcggtggagcgcggtttctattggaagcttaccggaagggagaacctctactatttcgggaggatctatggaatacctcaaggcgagctgaagagcaggataaaggaggttctagatctagtaggcctaaccgacttaggcggcgctgataagccgttcgaggagatgagcttgggcatgaaggccaggctggggctcgccagggtcctcttaaaggatcctgaggtcctcatattagacgagccaactttggggctggaccccgctagcgccaggactattagaggcgttattaggagtctggcctcggagggccgaactatatttataactacacataacatggttgaggctgagatgatcagcgacagagtgggcattataattggaggcagaatagctatggaagggactccggacgagcttaagaggagggttttcagctcgataaacctggagttcagggttaaggctagcggccatgccgctaaaaagttcttctatgatgttaagggcgagtatggcaacaggatagtaggaggcgtaacgttctcagacggtatactcacattcagggtctcggtaaaccgtgacgagcctgcagaacccataatcgaccgtataacacggctagcctaccagtacaggtttaagatactcgagataaaggctctcgagccttctctcgaggacgtgtttgttgctgtaagcgagagcggtgaagcgaggtcggggcgtgttaaagggagtatagcccagcggtga

SEQ ID NO: 46613 - DNA, 969 bp, Aeropyrum pernix
gtgcttgacctggagtggacggctctggggtggctgttgttggaggggccagagcagtgggttatagtgggggggtggggctccgcgtcggcagagttctcggaggggctctccaggaatatggggctaaaactcgtcaaacctgtgttcaaactgtttcccgacgaagaggagtatgtcaggatagaaggagatatcagtggttttacgggggccattgttgtgcagtctttcgagaggcccgcctccagaagcctagtctactcgctccttatagcagatgctctcaaggaggctggagtaggtaggatagtgcttatggctccttacatggggtacacaaggcaggaccgtgttttcctgcctggcgagcccgttagtgttagagcagtcatgagggcccttgcttcgtcggggtacaatgctctggcttctatagaagtccataaggagtacgttctagactactttgacggcagcacactcaacatattccccttcacctacatgcttaaggagacgggtatttcatgcggggacaataccattattgtcgccccggataaaggctctctcccccgtgttgagaggctcgcccgggagacagggtgtaggagctacggataccttgttaaggaaagggacaggattactggggaggtacggctagcgaagtctactgtcgatccccgtggcaagaacgctatagtggtggacgatataataagtaccggggggaccatagcccttgcatcccagtggcttctcgagaacggcgcaaacagtgttttcgtgcttgcagcacactatctaggcattggcaacgccgaggaaaaaatgatgaaagctggagtatcgagagtggtcaccgggaacaccctaccccgtaagccctcgaaaatagttacgtatgtagatctaacgggccttgcagcaggccagctgacaaagctggtgtcaaacctttga

SEQ ID NO: 46614 - DNA, 1314 bp, Aeropyrum pernix
atggctgagaagccgcatatgaacctagtggtaataggtcacgtagaccacggtaagagtacactggtaggccacctgctctacaggctcggctatatagaggagaagaagctgaaagagcttgaggagcaggctaagtctaggggcaaggagtccttcaagttcgcgtggatactggacaagatgaaggaggagcgtgagaggggtataacaatcgacctgacgtttatgaagttcgagactaagaagtacgtattcacaataatcgacgccccgggccacagagacttcgtgaagaacatgataacgggcgccagtcaggcagacgccgctatacttgtggtcagcgcaaggaagggtgagttcgaggctggaatgagcactgagggccagacgagagagcacctactcctcgccaggaccatgggtatagagcagataatagttgctgttaacaagatggacgcgcctgacgtgaactacgaccagaagaggtacgaattcgtagtgtccgttctcaagaagttcatgaaaggcctaggttaccaggtcgataagataccgttcataccggtgagcgcctggaaaggcgacaacctgatagagaggagccccaacatgccttggtataacgggccgactctagtagaggcgttggaccagctgcagcctccagcaaagcctgtcgacaagcccctcaggatacctgttcagaacgtctacagtatccccggggctggtacagttccggtaggcagagttgagacgggcgttctaagggttggagacaaggttgtcttcatgccgccgggcgtagtgggagaggttaggagcatagagatgcactaccagcagctgcagcaggccgagccgggtgacaacataggctttgccgttaggggtgtgagcaagagcgacataaagaggggcgacgtagccggacacctagacaagccgccgactgtggcggaggagttcgaggccaggatattcgtgatatggcatccaagcgcaataacggtgggctacacgcctgtgatacacgtccacacagccagcgtcagctctaggataatagagatcaaggctaagctcgacccgaagaccggccaggtggtggagcagaacccacagttcctcaaggcaggtgacgcagccatagtaaggttcaagccagtgaagccgcttgtcgtagagaagttcagcgagataccccagctagggaggttcgccatgagggacatgaacaggactgtgggcataggaatcgtgactgacgtaaagcccgctaaggtagacataaaggccaagtag

SEQ ID NO: 46615 - DNA, 3510 bp, Aeropyrum pernix
gtgtctaacaaggggggaggtcagcgtagcggagaaataggtgtggacgagctttggacggtgtataagtcgtttatcagggaaaccggccttgctaggcagcatctagactctttcaacaggcttgttacgcaggagatacagaagataatcgacagtattagggaggtcaggccgcagtggaggatctatgcgggtagaaggaggtataggcgtggaaggtttgaggagcacgagattcatcttcccgacgtgaagattgtatttgggaaggctaggtttaaggagcctatggcaagggaggtcatagagagtttcgacaggcgtgtcacacccttcgagtgccgtgtgagggggataacctactctgcacctctgatggtggagatgactatagtgcaggataacatgatagagaagacacgtgaggttaagatagccgacttcccggttatggtgaagagcgttctagaccctctatccaagtacgatgaggaaactgttatagagatgggtgaggaccccggagatcccggcggctacttcataataaacgggagcgaaaaagtcatagttgcccaggaggatctagcggtaaacaggattatagttaacaagagcacagcagctaccgccagaattacgcataccgctaaggcagtctcaacagttctaggacttaggaggcaagccatagtggataggatgagcgacggcacactcgaggccagtctaagcaggctgaggtataggataccccttgtggttctcctaagggccctagggttggaaaaggatatggagataatgcttgctgtcagcgctgatccggatgtgcagagggagatgttacccagccttgagaagggtagggctctcgcacccactaaagaggacgccctcaaatacctgggcaataggatagccccgggacagccgctggatgttaggataagaagggcagaggagttcctggacacgcagctgctgccccaccttggcaacaggcctgaggacaggataaagaaggcgtacttcctggctgagatggctaacagggttctacaactgtatctaggtaagaggggcgaggatgataaagacttcctcggcaataagaggctgaggctggcaggcgatcttatagcagagctattcagagaatccctagaggctctggcgaatactatggcccagaagctcgaggagcagctggccgagaggaggcaaataaggctggacttcctcgtcagaccaaccataataagtgacaggctcaagggcgccatagccactggcaactggggtcaggaccgtactggtataagccagcagttggataggacaaactggataagcctgctcagccatcttaggagggttatatcgcctctaagcagaggtcaggcccacttcgaggcgagagacctccacggctcccactgggggcgctactgccccttcgagactcctgagggcataaactgtggtcttgtgaagaaccttgcactttcagcctacatatctgtcggtgtggatgagtctgttgttgaggagatcctcgttaaggacctgggagtggcgcctctagagagaatcctggaagaggcgaaacaggcgggcgagccgccggagataatgttgaagggtaccaaggttttcataaatgggaggcctctcggctatcaccctaacggtgctgagcttgcgaggaagattagggagcttaggaggagtgacaagctcgaggttgagaggccttgggaggttagcgtatatcacctgagagagggcgagatagacgagctttacgtaaacaccgactccggcaggctcatgaggcctgttgtagtggttgagaacggggagcctaagcttaccagggaacatgtggagaagctgtcgagaggcgaaataacgttctgggatctcgttaaacagggagtagtggagatgctggaccccgaggaggagcagaacgcgttaatagctgagctgccctgggaggtcactaaggagcatacccacatggagctatgggtgccagcgatagttggtgtcgctgcagccaccattgggtacctggagcacaaccagagcccgaggaacacctaccaggctgctatggctaagcaggccctcggtgtctacgctctaaactataggataaggcttgacagccactcatacctgcttcagtacccgcaggtacctatagtccagactaggatgctggacataatgggctataacgagaggccggccgggcagaatatggtagtcgctataatgtcatacacgggatacaacattgaggacgcgctgatattcaacaagggatcgatagacatgggactggcgagggcctacttcttccgtgtatacactggaatagagaatgagtatcccggcggcgagagagacaggataaccctgccgaagcctgacgaggtttacgactataggggtgcagcggcatacgcgaagctagaggccgatggaatagtagcccccgaaaccgaggttgagggcggcgagatcctgataggcagggtaagcccgcccaggttcctcggcgaaggcagggttatatcgatggctaccgttaggaggcgtgacacaagcataccgatgaggctgggtgagaagggggttgttgatatggttgtcatatccacaacagtcgagaggaataagctagtgaaggtcagggttagaaacctgaggataccagagataggggacaagttcgccagcaggcacgggcagaagggggttataggcatgatattcccgaggtatgacatgccatacacggaggagggtatagagcccgacgttatacttaacccgcacgccataccctctaggatgactgtcggccagcttctagaggagatcgctggaaagctcggagctattaagggcagattcgtggatgccacccccttctttaaggaggatatagatggactgaggatagagctgttgaaggagggctacgatccgaacgcgagggaggttatgtacgacggtaggacagggcagattatagaggcaccgataacaatcggtgtcgcatactatcagagactttatcacatggttgcagacaagatccacgcaagggctactggaagggtgcatctattgactaggcagcctaccgagggtaaggcccgtcagggaggcctcaggttcggagagatggagagggactgtttggtgggccatggagcctccatgctgcttagggacaggatgctggacaacagcgacgcgtacgtgatgtacgtgtgtaacacttgtgggaatatagcgtggtttaacaggaggaagaaagtgctcgaatgccccatacatggagaggagggtgacatcaggcctgtcaaagtaccctacgcgttcaaactgctgctgcaggagataaccagtatgatgataaagccggaactcaaggtagccgacaagatatccgtcatcagaaaagtcgtcggcgactatacatga

SEQ ID NO: 46616 - DNA, 669 bp, Aeropyrum pernix
atgctaataacccttttaaaaggatttaaaggttgccaggtaggaggtgtggctgtggtgtctgaggaaataagctttgttaaagagatagacactggtgttgaaggccttcccaagcctgaagttaagattgagaatatagttgccacggttatcctggagaaccagctcgatctgaacctgattgagactaagatacaggatgtggactataacccagaccagtttccaggccttgtttacaggctggagagcccgagggttacagttctgatatttaagtccggtaagatggttattacaggtgctaaaagcataaaccagcttatacatgttgttaagaaactgttgaaagcgttcgccgaccagggtatacctataagcggtaagccccagatacagatacaaaatatagttgcgtcggcaaacctcaaggtctatatagatcttgaaaaggccgcactcgagttcgagaacagcctatatgagccggaacagttccccggccttatataccgcatggacgagcctagggttgtcatgctgatatttagcagcggtaagatggttatcacaggcgccaagatggagaacgaagtttatgatgctgttaagaaagttgccagaaagcttaaggaagcagacgccattataggaatcgcggagtga

SEQ ID NO: 46617 - DNA, 1266 bp, Aeropyrum pernix
atggggtcaagttcaggccaaaagcctaggaggttagaggacctggttgataagctggctagcggtagcctgagccactccaggcttgagaaggagctaggtaacgccaacgaggcggcgctcgtcaggaggctctacctcgagaggctaacgggtgccagtttatcgagcgtggcaagcaccatactagacttccaggagctctacgggaggaacattgagaaccctattggcgcagtccaggttccagtgggcgtagctggccctcttaggatcaatggcgactatgcccggggcgacttctatatacccctcgccaccacggagggggccctagtagccagcgtgaaccggggtgctaaggctataacattatctggaggagcaagagccaaggttataaaggacgggatgacccgagcccccctactctggactccaagcgtctatgaggcccacaggctggctatgtgggtggaggatagaattgaggacctcaggagtgttgtagccggggttactcggcacgggaggctgcagcacatctacccttacataataggcaacctggtgtggctcaggctctcgttctcgacgggggatgcgatgggcatgaacatggtgactatatcgagcgacaggatatgccgctacatagaggagaattatgatggcgatgctaagtgcatagcgctcagcggcaacatgtgcactgataagaagccggcggcgataaacaaaatactgggtaggggcaagtatgtagtcgccgaggcggttataaagggtgaagtcgtcaagaatgttctaaaaacaacgccgcaaaacatcaacctggttaacgtcacgaagaaccttcttggaagcgccgcagcggggagccactctttcaacgcacacttcgcaaacataatagcggcaatattcatagctacaggccaggatgcggcgcaggttgttgagagtagcatgggctatacgtggaccgaggtgaggggggaggacctctacataagcgtgactctccccagccttgaagtgggtactgtaggaggcggcacaagacttccgacacagagggaacttctggccctactgggcgttgctggcggggggaacccgccgggctcaaacgcgctgaagctcgccgagataatagcttctgcagtgctcgcgggggagctaaacctgctgtctgctatagcagctggccagctggcgagggcacacgaactcctcggcagaggcggcctaaagataagctaa

SEQ ID NO: 46618 - DNA, 1098 bp, Aeropyrum pernix
gtggtgtttagaatgcctgtagatagccttgtcggcaagacgcctgaatcgtcagcagggatacacgggtggggtgcatacgtacctgtatacaggattcccacgcgggaaatagctagagtctggggctggcctgaccatcagtggaaagcgttggacgtgtacgagaaggctgtaggaggggttgatgaggactccacgaccatgggggttgaagccgctagaaacgcgatagccagggctagggtggacccggccagtataggtgccgtattcttcggcagcgagtcgaagccctatgcagtcaagccgagcgccaccataatagcggaggctctgggtataacgcccgttacaatggccagcgacctggagtttgcctgcagggctgctagcgaggggatgagagcttctataggcctagttgcatccggcgttgtaggctacacactagtagtcggcagcgatactgcccaggccagccccggcgacgtgctagagtttagtgcctccagcggtgctgcagcgtttgttataggtccttcaaaaggcgccgccgcagttttcgagtccagcttcacatatgtgacagacactcccgacttctggaggagaggtctgaagccctatcccagccatggtgagggcttcactggggagccagcgtacttccaccatatagagagtgctgtaaaagggctttttgagaaaaccggattatcgccgggagacttcgactacgctatattccatcagcctaacggcaagttccctgttaaagttgctaaaaagctggggttcactatggagcaggtgaagcccggcctggtaacacccttcataggaaacacgtataacgcaagcgccctcctaggcctggttaaggttcttgatgtggccaagccgggtgacaggatactggttgcccccttcggcagcggagccggaagcgatgcttacagtcttatagttaccgatgctatagaagaagccaaaccgcttgcacagccgctagaatactatttgaagaggaggatcgagatagattatggcgtttacgccaagatcagaggcaaacttgttgtcagaaagctctag

SEQ ID NO: 46619 - DNA, 576 bp, Aeropyrum pernix
atgaaccgcgaagcacaaggcagccaggagggagtgagaattaggaaggccagagcccaggatatacctatagtcatggagataaacctggagagccttcccgagaactactggtacggattctataaatatatattagacaactggggcgaagcgtttcttgtcgcagaggttgggggggagattgttggctacgctatgagcagggtggagcagacatcagacccggtactcttggggatgaaggatgagcttgagggggataagagtgttatagacaagatcttggatgctataaggaaccagttaagcgaagagaggccggtggggcatctagtatccatagctgttaggccgggattccgggggcgcgggatagggtcaaaactgctaagtgctacagttcgtgtgatgaaaaatgtgtatagggtcgacgctatatttctcgaggtcagggtttcaaacatgccagccatcagactctacgaaaaattcggttttagaaaggtaaggagaattaaagggtactacagggacggtgaggatgcgtttgtcatggtgaaaaggctgttatga

SEQ ID NO: 46620 - DNA, 819 bp, Aeropyrum pernix
atgccgcttttccctatcgactacaacgacttcaaaccaatcggcaagacgaaggagcggctctcagcagttggcctgggcacctgggctatcagggattattcctcggcgctggaatcctatgtctacgcgatagagaggggtataaaccacatagacacggctgagatgtacggggctggcgaggccgagaggttcgtgggcaaggtgctaaggagtgttggcagggatagagtttatgttgtcaccaagctctatcccttcaggtttagagaccccgacgaggctgtgaaggctgcgcgggccagcgccgagaggatgggggttagctacgtagacataatccttatacactggccagacccacagacgcccattaaagaccaggttaaaagtctagaggccatagcagaggctggtctagcacgctatattggtgtgagcaacttctctaaggaacagcttgaggaggctcttaccgctactaaaaagcacgagatagtggttaaccaggttaagtacagcgtgctcgacaggcgcgccgaggagctaatccccctggccgtggagaagtctatactcctcgaggcttactcgcctctggagaggggtcatgtagccgaggttaggcttctggctaagataggtagacaatacggcaagacgcccgttcaggtggcacttaacttcatagtgtcgcgtccaaacttcatagcgataccgaaggccgagaggagggagcatgtcgacgagattctaggctcattggggtggaggctgaagcccgaggatatagagcttatagaggagaagctgtaa

SEQ ID NO: 46621 - DNA, 1200 bp, Aeropyrum pernix
gtgatgttttctttaggtggaccccgtttggttgactttgttttcccccgtaggatagtgtataatgagagcctccctagggctcttgagacgcttctaggggataagggtgttaaacatgtcctagtggttactgacggtaaagtcgcagctatgagctggtttaaagaagcggttgagcatgtagccagtctcggtgtagaagtgtgtatctttgacggtgttacccctgagccggagtttgatgtgggagacgctatagcatcggaggctaggaggtgccgggctgaggctatagtggctgtgggtggaggcagtgtaatagacgcggctaaggctgggtttgtgaagtttgtcaggcctgatgccgacctggagggcctagcgcccttcaactacctaggccttgaagactctggcatagtactggtagctgttcccacgacgagcggtactggcagcgacgccagctatggtatagtcctcacaaagcgggttaacggtggtagagagaagattgctgtgggcagctacgaggtagtaccctacgcctcaatactcgacccctcaataacacttggcatgccggaaagattgaccgtaggtacggctgttgacgcgctggctcacagtgtggaggctatagcctccacaaacgccaacccgctctccgacgctttagcggctaaggcggctgagatagtcttcaggaggctgccagaggttgtgaatgacccaggcaactatgatgctagggctgagatgcatatcgcagccacaatggctggtatggcgttcacaaactccggcctcggcctagcccacgcgatagcacaccccctcggcgcgaggcttggaacgcaccatggagccacagtgggtatggttctcccccatgtggtcaggttcaacgagtcaaggagtgactatgcgaggaggaagtattgggagctaaagctactgctcgagtccctacttggccttgaagaaagggggagcctagccgaccatatagaagaattatatgccagggtggggcagcccacgagggttagagagcttgcgggtattgagagggaaagatatcttaccttggccgacgaggttgcagaagccgccttcagagacccggaactggccttcaaccctgttatgccaactatggaagatgtaaaaacgctactgtacaatatgtattaa

SEQ ID NO: 46622 - DNA, 1209 bp, Aeropyrum pernix
atgagcgcctgcctaaccctctcccacctgggggcgactcttatcccgaactcctcccacagccactccgccaccgccccaggctcgacgccccgctcctccagcctctttacaagcctctccttcacaaccctctcactcggccccaacccttctcatcccagtactgttgaggaggcgctcggcccccttatccagagcattctctgccggggcaccaacataacctctagacggctacaactgcagttgtggtgggaagggttgagtctccaccggctcagggggaggcacctcctctggctggccgactatactggcgaggagattaggcatatggttgagctgaccctcgagatgaagcgccgctactacgccggggagagggtcatacctgtgcttagggggaggagcgtgggcctgctcttcgagaagcctagtacgaggaccaggataagccttgaggtggccgtcgcccagctaggggggcacacagtctacatgaccccgagtgagacgcagcttgggaggggtgagacggtggctgacaccgccagagtcctctctaggtatcttgacgccatagtggccagggtaaggagccacaaaaccctggaggagatggcgaggcacgcctccataccggttataaacggcctaagcgacctcactcaccccctgcaggctatagctgacatggccaccatactcgagaagaaagggaggctcgagggcgtgaagctggccttcgttggtgacggtgcagacaacgtgctgcacagcctcctcctcgcgggctccaagcttgggctccacataactgtggccacacccccccagataaggccggacgagaggatactatccatagccttaaaggccgccgaggagagcggagggtctgtagaaatcgttagcgacccctacgaggccgtccgtggggctgacgtcgtctatacagacgtgtgggtcagcatggggcaggagagcatggccgaggagaaggtgcagctgctgaagccttaccaggttaacgccaagcttatggaggcaacggggggcagagcgatattcatgcactgcctcccagctaagagggggcaggaggtgacggacgaggtcatagacggcccctggagcgccgtgtgggaccaggccgagaacaggctgcacgcccacaaggcagtgctctccctgctggtaccctag

SEQ ID NO: 46623 - DNA, 1230 bp, Aeropyrum pernix
atgacgttaagcagtgcggggggtagcaggagccacaggcataacggcgggcacagcgagagggacgttgagatcaggattctaaaggataaggtgcgcagcctgaccaaggagaagataagcctgcagaaggaactcgagtactataaaaacgagatcaccaagctcctctcgccaccctacatcgaggccgtggtactggaagtcatagacgataacagggttgtcgtgaagagcagcacaggccccaacctcatagttaacgttgcagcgggcgtcgacgccaggtccctgaagcccggggcgatagtggccctcaacaaccggggctccacaattgttgacgtgctgccgggcaggtacgaccccctggttaaggctatggaggttgaggagaggcctaaggtgttcttcaaggacgtcgggggcctcgaggagcagattagggagatatacgaggctgtggtgctgcctataaagaacccccacctctttagggagctcgggatagacccgcctaagggggttctactccacggccccccggggacggggaagaccctcctggctaaggccgtggcgggggagacagaggccacgttcataagggttgtgggcagcgagctcgtcaacaagttcatcggggagggcgccaggcttgtgagggagatattcaggcttgcgagggagaaggccccctcaatactattcatcgacgagatagacgccatcgcatccaagagggtcgacataggaaccagcggggacagggaggtgcagaggaccatgctccagcttctcgcggagctcgacggcttcgaccccctggacaacgtgaaggtcatagcagccactaacaggctagacctcatagacccagccgtcctcaggcccggcaggttcgacaggataatagaggtgcccctgccaagcctccgggggaggctggagatactgggcatccacacaaggaaggcgaagatggcgcccgacgtcgaccttgaggcgatagccaagctcacagaaggcttcagcggcgccgacctcaaggctgtggttgtagaggctggctacaacgccataagacggggatccagggtcataactatggacgacatgataaaggcggtggaaaaggttaaggcggccttggataagaggggcggcggagacccgttcataagagcccagcagaagagcggggacgacacgatagccaccgtgatatag

SEQ ID NO: 46624 - DNA, 1155 bp, Aeropyrum pernix
gtggagagatgtggagacgaatgggtgttgggctctggacgtcgacacttgggaggacttcaggagggctggagagctttgcgggggagagtgcacgggggaaggcctccgcctggagctctagatctgagtagcccctcaaaccccctgggccccccgcccagggtggacaacattatcctagaggctgttgaaaggggcgtccacacacgctatccagactacgagtatctgggttttagagaggccgtggcgggcttctataggatcgacctggagcgggttatacccttgaacggtgcagccgagatactgcccctggcggcagcagctctaaggccccggtctatagtggttgtcgagcctaacttcggcgaccacactatcctagccctctcagctggcataccgtgccactcggtccagctaagggaggctggagaccgcttctcactggagcctggcgcggtgtgtagcctgccccggagcgtggtagagggttctctcattgtgctgtccaatccaaacaaccccacaggctcggccgctgcgaggggtgatctcagggagcttgctgcctgcgccacattgaggggtgccctagctgtggtggtcgacgagtcttttgcagacctatccagggtcgagagtgtgctggggagtgtccccgaaggtgttatcgtcgccaggagcttgaccaagacgctcgcgcttcagggcctccgcataggcttcgcctacaccgatgatgcagcgctggcggcgaggctggatatggctaggcagccctggaacgtgaacagcattgcggcgttgcttgtggagaggctcttgggtgatatggcctccgaggtcaagggccatatagcgcgtgccatcgaggctattgaagggttgaagccgaggctatatagtgcagtctcggcgttaggggcgaagccgtactcctcgcaagcccccttcatactggtgaggcaccgccggaggaacccgctgtttgccagatgccttcttgaggccgccggagtctatattagggacgcgtcgtctttcagacacctcactccataccactcgagaatatctgtggctccaggtgtcgagaggctggagaggcttcaggaggcgatactggattgcctctcggggggttga

SEQ ID NO: 46625 - DNA, 1020 bp, Aeropyrum pernix
gtgtttgtaatgattatccagggccaggtcctggggggttatcccaggagcaggtatgtcaggagggctttaaggaggctggagcagggtgagatatcggctgtagagctgatgggggttctgaaccaggcctcctcagcagtcataggagcccaggtttcgcagggtttcccttatgttgtcgacgggatgctagactggcacgacatatttaggccgttcgcagaagcgtggaggaacgtaacccccacaggcctcctgaggtatttcgacaataacttcttctaccgcataccgcttttcacgggagagccggagccgactgatcctgtgctggcgcctagggttctctcctactcccaggttgctgagcctgcgaagctcaaggttgttgtgccggggcccgtgaccttcaccctaatgtcgaggaacgagtccggcatatcagacgaggagctggctgaagctatagctaaccttctggctgacgaggttgagaaggctgttaaggcgggagccggctttgtccaggtagacgagcctatcctctcagagccaaaggctactagggaccatgcactgctcgccgcagagctggcaggggtcatagcttcgaggtcagggagcgccgaaacaatgttatccgtatacttctaccctcccaagcccgaggtctacgaggcgctgctagaagctagggtggactacctaatggttgatctagtggcggcagggtcgaaggggttagaggttataactggtaagggtgcgggggaggggttggcactgggggttatagatgcgcgcagcatatatagtgaaagcctagagaaggtcgaggcgccagtcagaaggattgtggagagcgtgaagccggagaagattatactaacaacgtcgacgtggcttgatctcataccatacaggtacgccctcaggaagaccgcgctcctcggccgctacacatatgctctagcagaaaagcttggcgcccaaatagctgttgcggggggtgagtag

SEQ ID NO: 46626 - DNA, 1107 bp, Aeropyrum pernix
gtggaggagaagatacaagccttagaggagtttataagcgccgtgccgaagcacaagggaaccgagaacctactcctctgggccaggagaaggctggccgagcttagggaagagcttgaagagaagaggaagaggcgtgtaggcggtgggccgagcttcttcgtcgagaagagcggcgcaggccaggcagttctaataggccctcctaactcggggaagagcagcattctcgccgccctgactaacgcgaagcccgaggtagccgactaccccttcaccacgcgcatgccccgggcgggcatgctgccctacgaagatatacagtttcaaatagtcgacacgcccccgctgctgccggggagcggctcctcggttaacaatagagttttaggcctggctaggaacgccgacgccataatactggtgttctccctggacgaccctaacctggttgagactatagacgctgtggttagggaggttgaggataggggtatagtcatcaccaggaggcgagggttggcgaggatcatgaagtcccgggaggttactggcgttaggatagaggggcccgggcgtcttaccgatgctacggaggatgacgttaggaggctgctatcgcagtataggatatacaacgccatagtatatattgagggcgatgtgagccttgacgatgttgaatcggcagtatacattaacctcgtcaggaagcctgccctagccatactgaataaggcggacctgccgggggctcgggaagctgcggagccagctgtcaagaggctaggcgagataggcatcgacaccatagtagcctcagccctgaggggcgacggcctcggtgagatcgcccctaggctcttcaggatgcttgatatagtcagggtgtatactaagcagcctaacaaggagccggataaggaccccctcgtgctacaccggggctctaccgtgatggacgttgccaaacacattcacaaggacctggtgaggaggttcaagtacgccagggtgtggggtaagagtgttaagtaccccggccagagggtggggccggagcatgttgtggaagacggggatattgttgagatacatgtgaggtga

SEQ ID NO: 46627 - DNA, 1179 bp, Aeropyrum pernix
atgttgggcggcctcagaagggtggaagacctggacagcgatcctccccccagggggtccaggatagtcatggttatggacttccaccccagctctgtgggaggggtgcagtcgcacgttagagacttaacacgtcttctccaggatttcggctatgatgttgtcatagtgtccagagcgctgggaaagggtgatgtaaaggatctggaagccgagggccactacatagttaagcctctcttccccctggagataatcttcgtcccacccgatccttccgacctgaggagggagatcgaatcgctgaagcccgatgtggtccattcacaccacatctacactctaacaagccttctagccctcaaggcggcccgggatctaggcctgcccaggatagccacgaaccactccatattcctagcttacgataaggtcgcactttggaggatagcctctatagtattgcccactagatacctcctgcctaatgcgcaggctgtgataagtgttagcaccgcggcagacaagatggtggagggtatagtcggagatagcgtggaccgctatataatacctaacggtgtcgacgttgaaaggtttaagccttcgacgcctaaggcagactaccccctggtgctattcctcggcaggcttgtctggaggaagggggcgcacgttctagtgagggccttcaggcacgtcgtagacgagattagagacgccaagctctacataggcggtaagggggagttcgagcccataataaaactattgatagcacgctacggcctggaaaacaacgttaagatgctgggtgttgtgccggagtcggagaagccgagcctctactcgtcagcctgggtaactgcagtacctagcattgtaaacgagagcttcggcatagtggcactagaatccctctcctccgggaccccggtggtagcctccaggcagggaggccttaaagatgtggtcaagcacggcaagaccgggctactagtcaagccaggctcatcgaaggagctggcgaaagccctcataacactactccaggacagcgggcttagaaagaggatgagcgaggaggctaggaaaatcgtcctagagcgctacgactggagaaaagtggtgccccagatactaaaggtgtatggccactatatggaggcaagaggttga

SEQ ID NO: 46628 - DNA, 1170 bp, Aeropyrum pernix
gtgggctgggttacgagatgggttagagggggctggagaccctccaaggacccggttagagagccagtggtgccccccgtaaacgtgtcggcaatctatgtacaccccccgggcagcttcgagcgtgagtaccctagggtaggcgacctaaagtacgggcgggagaacaatcccactgttctggggttagaggaggcgctgacaagcctggaggaggctaggtggacactcgctttcaacagcggaatggcggcgctctcgacgctagtgctccacgaggtgtcacggggggctaaaaaggttcttcttgaaaggcttacatacgggtctacaaggagtcttctcgaaatgctgtcatcaataaccgggattgaagttaggcttgcaggacctccctgggaggatctcctcgatcttgtctgctgggctgatctaataatagttgagtcgatggccaacccgacgctgagggtaccgccgcttagcggtatctacagggaggctgggagttgtggtgtcagggttgtggtcgacaacacctttgcaacgcctattgcatacagaccgctggagaggggtgcacattattccctggaaagtctaaccaaatacatagccgggcataacgacgtcgtcggcggctccctctcaggccgtgtagaggaagatctagagcctctgtggaacatgaggaagatcctgggaactataatgcagcccatagacgcctatctagcatggcgcggtatgaagacgctcaaggctagattcgaagcccagtctagagcagcggtagaagtggcggaatggctggagagccatagaaaggttaagaaggtctattatccgggactctccagccatccagaccacgagctagcgaggagggagctgaacggtctctacggagccgtcgtaagcttcgagatagaaggcggcagggaggaggtgtttaaactgctttctaggctgaagctggtaacgccgagccccagcttcggaggagtggagacgataatatcctacccagccatatccagccacagcaacctagaccctctggagaggagtgagctaggcgtaactgacggtctcctgaggctaagcgtcggccttgaagatgtgtctgacattattgacgatctatcgcaagctctctcggcaatatag

SEQ ID NO: 46629 - DNA, 1668 bp, Aeropyrum pernix
atggttgaccgggtgatagagatggcgatccagcagcaacctatgacggagcctgtaggaatcccagttattatacttaaggagggcacccagaggtcttacggccgcgaggctctgagagcaaacataatggccgtcagggctatagctcagatcctgaaaacaacctatggtccaaaaggcatggataaaatgctggttgacagtctaggagacattaccataaccaacaacggtgccaccatactggacaagatggacgtggcgcatcccgccgcaaaaatgctggtccagataagcaagggccaggaggatgaggctggcgacggtaccaagacgactgtcatattcgcgggcgagctcctgaaagaggctgagaagcttcttgacataaacatccaccccacgataattgttgagggctacaaggaggccctcaggaaggcgagcgaggttatagagtccatagcggagccggtctcctatgacgatgtagagaagctaaagctaatagccaagacgagcctcaacagcaaggctgtagccgaggctagggactacttcgccgagctagctgtcgaggctgtaaggactgttgcggagaggagaggtgacaggtggtacgttgacctgaacaatattcagatagtgaagaagcatggcggcagcctgagggacaccaggctggtcaggggtatagttctcgacaaggaggtagtccaccccgacatgcctagaagggttgagaacgccaggatagcgctgctagacactccgctggagatagagaagcctgagatagacctggagataagcataaccagccctgagcagataaaggccctctacgagaagcaggagaggatactccaggagaagatcgagaagattgcagccactggcgctaacgtggtgataacccagaagggtatcgacgatgtggcacagcacttcctggcgaagaagggtatactggcggtgaggagggtcaagaggagcgacatagagaagatagctagggcgacgggcgccaggatagtgactgacatagaagatctcaggcccgaggacctaggctatgctgagctggttgaggagaggaaggttggagaggataagatggtgttcatagagggcgccaagaacccgaagagcgtgaccatactgctcaggggcggcttcgagaggcttgttgacgaggccgagagatccctccacgacgcgctcagcgtggtggccgacgccataatggacggcaagatagtcgctggcggcggcgctgtcgaggccgaggttgctaaggtgctatacgagtacgcatccaagctgccaggcaagacccagctagccgtagaggcgtttgctagggctgtagaggctctcccgcaggccctcgcccacaacgctggccacgacccgatagaggtcctagtaaagctgaggagcgcccatgagaagcctgagaacaagtggtacggagtcgatctggacactggtgagatagtggacatgtggagcaggggagtcctagagcctatgagggttaagctcaacgcgctgaaggccgccacagaggttgcctccctgatactgaggatcgacgacgtcatagctgctaggaaggaggaagaggagaaggaggagaagaggggcggagaggaggagtaa

SEQ ID NO: 46630 - DNA, 627 bp, Aeropyrum pernix
atgaggatagtagcccttgagggcatagacggctccggagtctccacacactccaggctgctccacgccaggcttgcgggcgcgggagtcaagtcctgcctctggaaggagcccacggaggggcctgtgggccggctgataagagggttcctgaggagtacagagggtgtggacagcgacttgatggccctgctattcgctgcagacaggctgtgggggctccggctaggcgtggtggagaggtgcggcggcagccccgaggtcctcgtcgtcgaccgttacaagtacagcagcctagcctaccagggcgtcggctcggggttggagtgggttgacgcggttaacaggaaggcgccggaggcggagatcctcgtctacatagatgtcccgaccgaggtggccctgaggaggataacggccagagagaggagggaggttttcgagacacccgagtttctagaacgcgttaaaagcatgtacgaggaggtcctgaggcttgccagagccaggggcgtgaaggttatacgggttgagggcgtcaggggaggggttgagagaggtatagaggatgtgcagggtgagatagcggagagggttttcgaggccctagggctggccagggcctag

SEQ ID NO: 46631 - DNA, 2355 bp, Aeropyrum pernix
atgagggggtcaacccccgttatcatactctgggggcggggggctgacgggtctagggttgtcgtgttctacggcgagttcagaccctacttctacgtgctgcccgacgggagcgtaggcctcgaccagctggcagctatgataaggaggctctcaaggccgtccagcccaatactctcggttgagagggttcgacgcaggtttataggcagggaggtggaggctctcaaggtaaccaccctcgtccccgcaagcgtcagggagtatagggaggctgtgcgtaggctggggggcgttagggatgtcctggaggccgatatacccttcgccctcaggttcatcatagactttaacctataccctatgagatggtatgtggccgaggttagggaggtcgcggtcccccacggctatagcgttgacagggcctacacgctctccggcgatataagggaggacgagacgaggatccaggaggaccccctgaagggcctcagggttatggctttcgacatagaggtctacagcaagatgaggacgccagaccccaagaaggacccggtaatcatgatagggttgcagcaggccggaggggagatcgagatcctggaggcggaggataggagtgacaagaaggttatagccggcttcgtcgagcgcgtgaagagtatcgaccctgacgtgatagtcggctataaccagaacaggttcgactggccatacctggttgagagggccagagttctcggcgtgaagcttgcggtcgggaggaggagcgtggaaccccagcccggcttgtacgggcactactccgtctctggcaggctcaacgtagacctcctagactttgcggaggagctccacgaggttaaggttaagactctcgaggaagtcgcggactacctaggggtcgtgaagataggggagagggttactctagagtggtggcagataggggagtactgggatgacccgtcaaagcgggagatactcaggaagtacctaagggacgatgtcagaagcaccatggggctggcagagaagttcctacccttcggggcggagctctcacaagtctcagggctccccctggaccaggttatggcggccagcgtaggcttcagactggagtggaggctcatacgggaggcggctaagctcggcgagctggtgcccaacagggttgagaggagcgagggcagatacgctggggccatagtactcaggcccaagccgggggttcacgaggatattgccgtcctggacttcgcaagcatgtacccgaatatcatggtaaagtataacgtcggccccgacactctggtcaggcctggggaggagtatggagaggaggaggtatacacggctccggaggtgggccacaagttcaggaagagccctcccggcttcttcaagaaaatacttgagaggttcctaagctggaggaggcagattaggagcgagatgaagaagcatccgcccgacagcccggagtacaagctcctcgacgagaggcagaaggcgataaagctcctggcaaacgccagctacggctacatgggctggccccatgccaggtggtactgtagagagtgtgcagaggcggttacagcgtggggtaggagcataataaggactgctataaggaaggctggcgagctagggctggaggttatatatggagacacggacagcctcttcgtcaagaacgatcctgagaaggtggaaaggctgataaggtttgtcgaggaggagcttgggttcgacattaaggtggacaaggtgtacaggcgtgtattcttcaccgaggccaagaagaggtatgtggggctgacggtggacggcaagatagatgtagtcggcttcgaagctgtcaggggcgactggagcgagctcgcgaaggagacgcagttcaaggtggcagagatagtcttaaagaccggtagcgtggacgaggctgtcgactacgtcaggaatataatagagaagcttaggaggggccaggtggacatgaggaaactggtcatttggaagactctgacacggcctccatcaatgtacgaggcgaggcagccccacgtgaccgcagcgctacttatggagagggctggcataaaggtcgagccaggggctaagatcggctacgtggtgaccaaggggtcaggccccctctatacgagggcgaagccttattttatggctagcaaggaggaggttgacgtggagtactatgtcgacaagcaggtggtgccagcggctctgcgcatactccagtacttcggagtaactgagaagaggctgaagggaggaggaaggcagagcacgctcctcgacttcatgaggcgggggaaataa

SEQ ID NO: 46632 - DNA, 942 bp, Aeropyrum pernix
atggttttacccgagcctggcgtgcagacgcacatagcggtgggcaacatcaacctagacataagcctctccgtcgacaggctgccgggccctgaggaggtagtgttcgccagggacgcgtggataggcgtgggcggcgcggcgacgaactacgccatagcagtagcccaactgggccagaaacccgtgcttgtggcggttgccgggagggagatggagaggctgggtgttgttgacacgcttaggagacggggtgtggacgtatccagggtgaagaccgttgataggccctcgggtgttgtcgttgtcatggttgtagccagcgactcgcacaggagtatggtgtcgatgaggggggccaacgaggagctcctcaagtatatcgaggaggagccccttgatggtgtctcgggcgaatgccacgttcacatggccagcgtgccaccccaggctctggacttcgcccccgggggttgcaccctcagctacgacccggggggcgaggctttcaagaggccgaaaagcctgtggagcaggctcccccgggttgactggatgttcataaacactcctgagcttaagggtatgagcggcagcggcgacctggccgcggcctataggcttctagagtcggggttgaagaggcttgtgttgaagcatggtagaggcggtgccacggtcgtggagaggggtttctgcgtaacgctggaccggacgccagtgctggagcccgttgacgtgaccggagcgggagacgccttcgacgctgctttcaacatcgcggtgaaggctggctggagcgttgaggaggctttaaggctggcagtggccgcaggctcggcaaaagtgcttaggaggggtagcagcaacatgcctacggccagcgaggtcctcgccatgctacccagggtagcctatccacgggattgcagcctaacctag

SEQ ID NO: 46633 - DNA, 1209 bp, Aeropyrum pernix
atggctaccgcaagggcaggggttctacgcagcccagtctatattgttgacggtgtaaggactaccataggcaagttcggcaggagcctcaaggacttcaaagcagtagacctggcagccctcacaatcagagagctcctagaacgggccggggttgaccccaactatatcgagctagcggtctacggccacgttataagggctggcacccacatgaacacggctaagcaggctgccctcaaggcaggtctcagaagcgacttggagggcttcaacgtcgacatggtgtgcgctagcggcatggcatccgttgtaaaggcgtcgctgcttatagatgcggggatgtacagcctagccctagccggcggcatggagagcatgagcaacgcccccttcatagccccaccgtctatacgctggggagtgaggctgctctaccaaggggctcttgagatgaaggatgcaatggtcagcgacgggctctacgacccgctaaaccagctggtcatggggcaggaggcggacgagacagcctgggagtatggggcccagcgggaggagctagactggatagcatacgagagtaacatgagagcggccagagcatgggagaggggtcacatgcagaagtacaccataccagtcaaggcaggcggcgctgtcgtgctagactacgacgagggtatcaggccggatacaacggtggaaagactctccaagctgccgcccgttttcacgccaaaaggcccccacacagcgggtaacagcagccagataagcgacggcgccgtgtccctccttgtagccggtgaggaagcggtaagggagatggggctcaagcccaaggcgaggatagtaggctgggggtacgctggcgtagaccccaggagattcccggtggccccagtccacgccgttagagccctgctgaaaaagctaggctggagggtggaggacgtggactactgggagaataacgaggcgttcgccgtaaacagtctaatcatgaacagggagctgggcgtgccttatgagaggctaaacgtcgtaggaggctccatagcagtcggccaccccctgggttcgacgggagccagacttatcctacagctagtctacacgctggaggagaacggggctaggaggggtgtagcctccatatgccacggcctgggcggcgcggcggccgtggctatagagagggtctag

SEQ ID NO: 46634 - DNA, 495 bp, Aeropyrum pernix
gtgaaaggcttggttgagcttggagagaaggcgccggacttcacccttcccaaccaggatttcgagcctgtgaacctctacgaggtgcttaagaggggtaggccagccgtcctcatattcttccccgcggcgttcagcccggtctgcactaaggagctgtgcaccttcagggacaagatggcgcagctagagaaggctaacgctgaggtcctcgccataagcgtggacagcccctggtgtctcaagaagtttaaggatgagaacaggctggccttcaacctgctctcagactataacagggaggtgataaagctttacaacgtataccacgaggacctaaagggtcttaagatggtggctaagagggccgtcttcattgttaagcccgacgggactgtagcttacaagtgggttactgacaaccccctcaacgagcctgactacgacgaggtggtgagggaggctaacaaaatagcgggggagctggtggcctga

SEQ ID NO: 46635 - DNA, 1185 bp, Aeropyrum pernix
gtgtcctgggcgaaaggctcgaggataagggactacagggggagggagtacatagactttcatatggcatttggcgctgtagctctcggccataatgacgatgacgtcgcagccagggttagcgaacagctgaacaggcttgttctccatggtgctggtgttagcgacgctgagatagaatttgctaaaatgctcatcagaaagtttccgatgtacgataaagtgctatttactaatagtggtagtgaagccgtaatgatggctatgagactggcgagagcatacacaggtagggatgttgtggtcaagttcgacggcaactaccacgggtggcacgactactcgatatacaacatcaaaaacccggcgtcaaaaggtaagaccgtggagtcgaaaggcgtcccctcagcaacagcctcgacagtagaggtcctcccctataacgatgtcgatgcactggaggactatgctgagagatttggcgacagggttgccgcctacatacttgagcctgtggcccatagtatgggcgttataccggcggaaaagggtttcgtggagaggttgagaaagctgtgcgatacccacggctcgctgctgatattcgacgagatcataaccttcataagggctagcgaccgggggatgcaggactacttcggcgtaagagcggatctgacaactgtaggaaaagccattgcaaacggcatgcctgttgcggcggttctcggtggtgacaatgttatggagctgctggctagaggggttgtgagcagcggaacatactccggccacccactatctatggctgctggagtggcaacacttgaaaaggcggaggatgtggggcttaccagagcgctacgtagtagggcggaggctctggcaggtattctcagggatatatctgaggacctcggcgtggaagctgctgtatcccagttcgggggctcggtaagcatatatttcggcatagacaggcggcccaagaatctcgaggaggctctgagagccaacggcgatgcctacagagtctttgcgagggagatgaggaggagaggcatactggtgactcctaacccgctgaagaggatgcacctcgcatactcccacagcgaggaggagctggaagccttccacagagcggcagaggaggcggtgagagtagctaaggagtacctataa

SEQ ID NO: 46636 - DNA, 1212 bp, Aeropyrum pernix
gtgcgtgaagatatggtcttccctttcagctcctcggaggattttagaatcgagctaacggaggagcatgagctgtttagaaagtcaattagggagtttgtagaatccaaagttatgccacgttggagagagatcgaggagactaacagaattcccgaggatatactcaaggaggcagccgacctcggcattttcggggtaggtatacctgaagagtacggcggccagggcggcggccatcttatgaccgccctgctgacggaggagatagctagagctgttcccgcactcggcgtaacaatcggtgtaaaccacctcttcgcagtccccatacttctcttcggtactgaagagcagaaaagaaagtatgtgacacctatagcccaggggaaggctaggggggcgcacgccaacacagagccgactggaggcagcgatgtggcgggtataaggacgactgcacgcaaggttaacgatcattacgtgataaacggtagaaaggtcttcataagcggtgccagggatgctgactaccttgtagtgtctgccaggactaacccgccgagggaggataagaggtggtgggggataagcgtgtttatagtcgagaaggacatgccaggcctaaagataggtcagcagtttaaagtgctcggtatgaggggcgagcagccctacgaggttatccttgaggatgttaaggtgccagccgagaaccttgttggaaaagaggacgagggattcaaggtaatagtgtccacatacgactacacgagaataggcatagctgctcaggctgtggggatagcccaagcctcgttcgagaaggctctaaactacgccctccagagggaggtgttcggccagccactcatacagttccagatgataatcgacaagctagccaacatgtacatgaagcttgaggccgcacgcctactcacatactgggcagccacactggctgacaaagggaagagggagttcatagtggccgctagccttgcaaaggccttcgccacagaagcggctgaatggatagcgaggcaggcgatacagatacacggaggctacggcgtagaccctgagactggtgtggaaagatacctgagggacgcaataataacgacaatatatgaaggcacaaacgagatacagagactgacaatagtaaggcagctggttagacaagctttcggcctaaaattctag

SEQ ID NO: 46637 - DNA, 756 bp, Aeropyrum pernix
gtgttcagactagtatacactgcctcgtctaagttcaagtatatagcccagaccctggctaagataaacgacgagggcgtcttcgagttctctctagacggtttgagggcgtggataatgagcccagacaagactagcctggctatattggagatgccttccctaagcttcgaggagtatatggttgaggaggagatgagggtagtcctcaggacagacgagctgaacaagatctctaaaagggctacgaggaacgacgacataatctttcagtggaatgcggaggagcaggccctcgaggtggagctgagggatagaaaactagggttctcgagaaaattccttgttcccgcaacttctgttggagccgaggagatgaggaggctcaagctagagcccacggtatccttcaccatactgaccgacgacttgaaagccatgatccaggatgtaaaggttgtaggagacttcgcggagttcgaggccagcgagggccaggtagtcgttaggagccaggcggaggagaaggagtatgagtgggtcatgaagcctggtgacgtgcttttgagcctagaggttgaggaggacgctaagtctatatattctaggcaggtgcttgagatcgccacgaagcccgtgggagctgcggagagcgtgaaagtctctttcgcaagcgactaccccatgaagatcgagtatactttcccgaacggcgagaggatggagctgtacatggcgcccagcctagctggctag

SEQ ID NO: 46638 - DNA, 1080 bp, Aeropyrum pernix
gtgagaatagagcaagacttctcgcagagcctaggggtggagcgtttgaaagctgccaggctccacgagtataacaagccgttgaggatagaggatgtcgactatccgaggctagaaggtagatttgacgttattgtaaggattgcaggcgctggcgtatgccatacggacctccaccttgtccagggaatgtggcatgagctattgcagcctaagctaccctacactttaggccatgagaacgtcgggtatattgaagaagttgccgaaggagtggaaggcttagagaagggggacccggtaattcttcacccggcggtcacagatggaacctgtctagcctgtagagctggtgaggatatgcactgcgagaacctagagttcccaggacttaatatcgatggtggatttgcagagttcatgaggacctcgcacaggtctgtgataaagctgcctaaggatattagcagggagaaacttgttgaaatggcccctctagcggacgctgggataacggcttatagggctgttaagaaggccgcccgaaccctctatcccggcgcatacgtcgctatagtgggcgtgggaggattaggtcatattgcagttcagctacttaaagttatgacacccgcgacggtgatagcactggacgttaaggaagaaaaactaaagctggccgagaggcttggagcggatcacgtggttgacgctagacgagaccctgtaaagcaggtcatggagcttaccagggggagaggagttaacgttgcaatggacttcgtaggctctcaggctacagtcgattatacaccatacctgctagggaggatggggaggcttatcatcgtaggctatgggggtgagcttagattccccacgatcagggtgatatcctctgaggtatcctttgaaggaagcctagtaggaaactatgtagagctccatgagctagtcacgttagcccttcagggtaaggtcagggtagaggttgatatccacaagctagatgaaataaacgatgtgcttgagaggctagagaaaggtgaagttctaggcagggcagtcctgataccctaa

SEQ ID NO: 46639 - DNA, 753 bp, Aeropyrum pernix
atgcccgggagcatacccctgatcggagagagattccctgaaatggaggttactacagaccacggtgtaatcaagctaccagaccactatgtgagccagggtaagtggttcgtgctgttcagccatccagcagatttcactcccgtctgcacgacagagttcgtcagctttgctaggagatacgaggacttccagaggcttggagtcgacctgataggtctcagcgttgacagtgtgttcagccacataaagtggaaggagtggattgagaggcacattggcgttaggataccgttcccgataatagcggatccgcagggaactgtggctaggaggctgggtctacttcacgccgagagcgccacacacacggttagaggggtattcatagtcgatgctaggggcgttatcaggactatgctctactaccccatggagcttggcagacttgtagacgagatactgaggatagttaaggccctgaagctaggcgacagcctgaagagggcagtacccgcagactggcccaacaacgagataattggtgagggactcatagttccgccgccaactacggaggaccaggcgagggcgaggatggagtcgggccagtaccgctgtctagactggtggttctgctgggacactccagcaagcagggacgacgtggaggaggctaggagatacctcagaagggccgctgagaagcccgctaagctgctctatgaggaagcccgaacacacctacactag

SEQ ID NO: 46640 - DNA, 1800 bp, Aeropyrum pernix
gtggtgcaggtaagccagatcactatatccatgcgtgtacataaaaattgctgcaagaaacataagatgattattaggtgggttgtttggaggaaatccgacataatgcagccgaggcttacctctctcgcccttggcttaagaagtatgacgagggagttcccgccgatatcgagatcccggataaacccctctactggatcctggaggagagcgcctcgaggttcccaagcaggactgcacttttattctatgggaggagggtcacttatagggagctgttggagtctgctctccaagttcgctgggtatctccgctcccgcggcgtcggtaagggggatgtcgtcgggctcttcctccccaactccccccagttcgccatagccttctacggagccctaattgcgggtgccattgtcagccctatgaatgtgctctacagcccccgggagatacgccatcagctctcggataataaggctagggttcttgtggcgctggacatgttcaaagacagggtgctggcaggtcttccgagcagtgttgaagaggtcctctggaccggcatacaggactatctccccgggctcaaggccctgctttacaagctgttcaagaagcctcctagccccccgaagggcggtatacacaagaagtttactgatgcccttaagcacgagcccatagactctaagcccgagataaacccgcacgaggatgtagccgccttaatgtacacaggcggcaccactggcacccctaaaggcgctatgctgacgcacaggaacctgctggcaaacgtcctacagatagacgcctggttcaagaggggtgtaaggggtaaagacgttttcgtgggagctcttccatggttccacatctacggccttactgcagtcctaaacagcggggtccaaaaggctgctacgataatcgtctatgcaaggccgaatatcgaggagataatgagggatattgagaggtataaggccacggtcttccacggggtgcccacactatacaggatgattataaaccaccccaaagttgagaagttcaacctaagaagcctagaggtgtgtataagcggcgccgagcctctccccaaggctgtagcagaaaggtttatggagattaccggggcaaagctgagggagggctacggcctgacagagaccagtcccgtgactcacgtgaaccccataatgggcgaggcccgctacggcagcataggcatcccggtaccatcaaccgtagcggcggttgccgatccagagtcccccgcaattctcgagcccgggcaggtgggggagctcgtggtatcgggccctcaggttatgaagggctactacaacaggcctgaggagaacgagaaggttttcttcgagtgctgcgggctgaggtggctgcgcacgggcgatatggcgcgcatggatgaggacggctatttctacatagttgacaggaagaaggacataatcaagtacaagggttacagcgtcttcccgagggagatagaagaggttctataccgccacgagtgcgtgagggaggctgcagtcattggagtcccacaccccgagtataacgaggtgccgaaggccttcgtcgccctaagggacgagtgtaagggcaaggtaaagcccgaggatataatagagttcgccaggaagcatcttgcaccgtacaaggtgcctaaggaggttgagataagggaggacctcccaaagagcggggtaggcaagatacttagaagagttctaagggaggaggagctgaaaaagagggggcaggcttga

SEQ ID NO: 46641 - DNA, 720 bp, Aeropyrum pernix
gtgctggcgctgattctagccggaggctatggtaagaggctaaggcccctcacagagcataagcccaagcccctgcttgaggtggctgggaagcctgtcctagtccaccagatagagtggctccgatactatggcgttgaggagttcgtcctcctcgtcggctacctgaaggagaggattatagaggagatgggttcgggggctaagttcggcgttaagataacgtacgtggtcgaggataagccgctgggcaccgccggggccctctggaacgctagacacataattgagaaggaaaacctcgtcctagtagtcaacggggacatagtcaccaacatagaccccgaccccctggtcaggcttgtaagggagagggaggctgtggccgggatagccgcggtacccctcaggagcccctacggtattctagagctcgacgatggcaatgtcacagggttcagggagaagcccttcatatacgactactggataaacggggggctctacgccgtcagcaaggagatagtgaagtatctcccccagcagggcgacattgagaagacgacattccctcagctggcctcggatggaaagttagtggcggctaggtatgaaataccgcctttctactggaggagcatagacactttcaaggatatagaggaggcgtctaaggagatagaggacatgggtgggctcgtgccgccccagaagggttga

SEQ ID NO: 46642 - DNA, 918 bp, Aeropyrum pernix
gtgagggtggcggcgagggggagtaggctcagcctcctgcaggtagagcaggccctggaagaactctccaggtacgcgggagtctcgatgcactgggaggtggtgagggtgaagagcgctggcgacgtgtggagcgacaggccgctggagtcaattggagtcgtgggggtgttcacgagggaggtcgacagggccgtggcgtcgggggctgcggacattgccgttcatagcctaaaggacatgccgaccagcggctacggcggccccctcaaaatagtctacatagccagcaggccgtccgccagagacgccctcatatcacgacaaggccctgggagggtcgaggaccttgagcccggttccaccttaggcacatccagcgcgaggagaagggctctctccctccactacaacccgaggatcagggtggagaacctcaggggcaacctagacacgaggctgaggaagcttagggagggcctctacgacgcaataattgcctcggaggcgggtctcataaggctaggcgtcgacgtagagtacacgcccctagacccgagctacttccccccagcgcccggccaggggttcgtggccgtcgtagccagggttggaagcaacgttgagaagatgctacgagatttggataagcccccgtggtggcatgtggcctgggcggagaggggtgtgcttgagggggcaagggccggctgtagaacccccgtagccgcatacgccgagccgctgggccggagcatggttagggtgacagccgccgccctctcgcccgacggatccagggcctactgggctagagccgaggggaggatcgaggaggctaggagaatcggcgtcagtcttggagaggagctgtcccgggttgtggagggctggcataagacaggaggtggctcttaa

SEQ ID NO: 46643 - DNA, 1299 bp, Aeropyrum pernix
gtggacgtgttggcatcgggcgagaagagtagaatgctcttcgagaggaccaaggagctattccctggaggcgtcaatagcccggttagggctgccgtcaagccctatcccttctacgtgaagaggggggaaggcgcttacttatacaccgtagacggcgccaggatcgttgacctggtgctagcctacggccccctcatactaggccataagcaccctagggttttagaggcggttgaggaggccctagcccgggggtggctgtacggggcgcccggcgaagccgaggtcctcctggcagagaagatactgggctatgttaagagggggggtatgataaggtttgtcaattcaggtacagaggccacaatgacggccataaggcttgctagagggtacactgggagagacctcatactgaagttcgacgggtgctaccacggtagccacgacgctgtgctcgttgcagctgggagcgcggctgcacactacggcgtccctaccagcgcgggggtccctgaggctgtcgccaggctaaccctcgtcaccccgtataacgatgtcgaggctctcgaacgcgtcttcgccgagtatggagacaggatagcgggagtcatagtagagcccgttatagctaatgctggggttatacctccccgcagggagttcctagcggccctccagaggctttccagagagagtggggcgcttctgatcctggatgaagtggtcacagggttcaggctcggtctcgaaggggctcaaggctacttcaacattgaaggcgacataattgttctgggcaagataataggcggcggcttcccggtcggcgctgtagcagggtctagggaggtgatgagcctcctaacaccccagggcaaggtgttcaacgcgggaacgttcaacgcgcaccccataaccatggctgccgggctggccacgctgaaggctctcgaggaggagccggtctacagtgtttcgagggaggcggcaaaggctctcgaggaggcggcatccgaggtcctcgacaggacgggcttaccctacactataaacagggtggagagcatgatgcagcttttcataggagtcgaggaggtttccaacgctgcccaggcgagaaaagctgataagaagttctacgtcaagctccacgaagagatgctcaggaggggcgtattcatagctccctcgaacctggaggcagtattcacaggcctcccacaccagggtgaggccctagagattgcggttgagggcctcaggagttcgctcaagacggtgctggggtcttga

SEQ ID NO: 46644 - DNA, 999 bp, Aeropyrum pernix
gtgagggctaggaggctcagactccacccgggagtgaggagcctggttgccgagaccaggctcgacccatctatgttcatactccccctcttcgtcgaggatgggctcaagactccgaaacccctcaggggtcttccaggacactttaaatacccacccgagtcccgggagcttgtagagctggtatcccgcgctctctaccttggggttaggagcttcctcgtcttcggaactcctagcatgaagagcttcgagggcgcggaagcctggagcccccgaggtcctgttcagagggccataaagttcgtaagggcggagctcgggtggaggccggtgataatggcggatgtctgcctctgcggctacacagaccacggccactgcggctatccgagggagacgcccaggggggttctaatagagaacgacaagtctatagaagcctacggcaagatatccgtgagcctagccgaagcgggggccgactttgtagccccctcagggatgatggacggccaggtagccgccatcaggagtgcgcttgacaacgccggctatacagaggttggtataatgagttacagcgcaaaatacgccagcggcttctacggccccttcagggatgtgatggactccgcgccccgattcggggataggaggagctaccagatggacccgaggaacaggtttgaggccgtcaaagaggttctactggacgctgccgaaggtgcggacatcgttatggtgaagcctgctctcagctacctcgacgtcataagcgaggttaagaggagcgtgccctggctacccctcgccgcctacaacgtcagcggagagtaccttatgctcaaagcggcagccgagaaagggctagtagactacgagaccgtcatgctggagatcctcacaagcatagcgagggcaggagccgacgccgtaataacgtaccacgccctcgaggctgccgaagccctcaagagcggcaagacgcccttctag

SEQ ID NO: 46645 - DNA, 1635 bp, Aeropyrum pernix
atgtcaatgctcctaggggaccatcctgagcttaggagtagggcgagggagatagcctccctggctgcaagggtcgtggagcaggtgaacagcatgcctgctggcgagcagaagaggctcctctcagaacagtatccggagctagcgaggtttgaagagcagcgcgagaaaggcgataaaggcctacccccgctgcccggggccgtggaaggcagggtcaagctgaggttcgcccccaacccagactttgtgatacacatgggcaacgctaggccggccatagtgaaccacgagtacgccaggatgtataaggggaggatggtgctgcggttcgaagacacagaccctaggacaaagactcccctacgggaggcgtacgacctcatccgccaggacctcaagtggcttggcgtttcctgggacgaggagtacatccagagcctcaggatggaggtcttctacagcgtagccagaagggctatagagcgggggtgcgcctacgtcgacaactgtgggagagagggtaaggagctgctctcgcgtggagagtattgtccgaccagggatcttggccccgaggataatctggagctgtttgagaagatgcttgaaggagagttttacgagggggaggctgttgtgaggatgaagacggacccgcgccaccccaaccccagcctgagggactgggtggccatgaggattatagacacggagaaacacccccaccccctcgtggggagcaggtacctggtgtggccgacctataacttcgccgtcagcgtcgacgaccacatgatggagataacccacgtgctcaggggtaaggagcaccagctgaacaccgagaagcagcttgccgtctacaggtgtatgggctggaggccgccgtacttcatccacttcggcaggctaaagctggaggggtttatactgagcaagagcaagataagaaagctcctcgaagagaggccaggagagttcatgggctacgacgacccccgcttcggcacgatagccgggctgaggaggaggggtgtgctggcggaggccataagacagataatactcgaggtgggggtcaagcccacggacgctacaataagctgggcaaacctggcggccgctaataggaagctgctggacgagcgggcggacaggataatgtatgtcgaagaccccgttgagatggaggtcgagctggcccaggtggagtgcagagccgcggagataccgttccacccgagccgcccccagaggaagaggaggataaccttgtgcacgggggacaaggttctcctcacaagggaggacgcagtagagggtaggcaactgaggctcatgggcctatcaaacttcaccgtcagccaaggcatattgagggaggtggatcccagcctcgagtatgcgaggagaatgaagctacctatagtacaatgggtgaagaagggcggagaagctagcgtagaggtactcgagcccgtcgagctggagctcaggaggcaccagggctacgctgaggacgctattaggggctatggggttgacagccgcctacagtttgtaaggtacggttttgtgagggtggacagcgtggaagacggggtctacagggtgatatacacacacaagtag

SEQ ID NO: 46646 - DNA, 1218 bp, Aeropyrum pernix
gtggacttctctctggggccggatctagagctgtttagggagagcctccggagggggctggagaagctgctgggcgggggtaggtgggccgagatagatgaggccggcgtcctccccgcagagacgattagggggctaggagccctcggcgtccttgctctcgtctgcccggaggagcttgggggtcagggtggaggctggctcgaggcggctatcgccgctgaggagataggctaccacgaccccagcatgtcgacagccgtgtacaccctgctaaacaacgcctggccgttcattctatcccgccatgggagccctgaggtggcggggggtatagttgagaaggttgctaagggtgaaatgttcttcgggatagcctcgaccgagccaggcggcgggagcgatgtggcgggtatcaagacccgcgccgagaggagcggggactactacagagtgtacggcgagaagatactgataagcggtgtaagggaggctctggagaccctcgactacgggggctggctgctgctagcgagaaccgggggtgagggccacaggggcctttccgccttcgccttcacaggcaaatgggatggcagcctggccagcggcctggagtacagcatactcgacacaatagggaggcacgggatatccacggggatactcaggctcgacggggcggaggtgcacgcctccaggatcgtcggaggcgagggccggggcttctacgtggcaatggagggcttccccctggcaaggatactggtggcggcggcgaacgttggcgccgcgaggtgggcgctggagagggccgtggagtggtccagggagaggaggctcttcggagggaggcccatagcctctttccagggtgtgagcttctcgatagcggaggctttcgcagggctggaggcggcgaggctcctagtctacagggcggcctggactgccgacaggtacgttcgaggcgaggctgcaagggaggagcttaacctgtacagcgcttcagcgaagctgaaggcggtggacaccgccttctccatattccaggagacgatgaagatagtcgggggcataagcttcacgaaggaggtcgacgtccacaggggcctgctcgggaccctatcctacctcgtgggggctgagggggcgcagaacataatgaagtacatcatagccagggacctgataggaagagagtatgtgaagctctag

SEQ ID NO: 46647 - DNA, 1263 bp, Aeropyrum pernix
atgcccgggtttagcgccttgagcggtggagacaagcgtcagcctgaggtcaacattggagtagtaggccacgtcgaccacggcaagaccacgctcgtacaggcgctcacgggagtctggactatgaggcacagcgaggagattaggcggggcatgaccattaagctggggtacgccgacggcgaggtgtgggagtgcgagggctgcgggttcccggagaggttcagcccagagcctgtgtgcgagtgtgacccccaggctagcgcctccctcaggaggagggtcagctatgtggacgcgcctggacacgagatactgatggccaccatgctaagcggggcagcccttatggacggcgccctcctggttgtggctgccaacgagccctgcccacagccccagaccaaggagcatctcgtggcgctcgagatcataggtatcaagaacatagtaatagtccagaacaaggtggacgtcgtctctagggagagggccaaggagagctaccaggagatcctgaacttcatcaaggggacgatagccgaggggagcccgatcatccctgtcagcgcgctcaagagggctaacatcgacgccgtgctggcagcgatagagaagttcatacccacgccgccgagagacctggataagccgccggtgatgtacatcagcaggagcttcgacgtcaacagacctggcacgccgcctgagaggcttgtcggcggggttgtcggggggagcataatccagggtgtcttcagggttggggacgagatagagataagcccgggtgtggccgtgcggaagccggggggcagggtggagtacgtcaggctccacaccacaatcactagcctaaggttcgggagtatagaggtggaggaggcgaggccggggggcctcgtggctataggcactcagctcgaccccagcgtgacaaaggccgacaacctggtcggcaacgtcgtgggcaagccgggagagctgccggagcccctgaccacgctgaggatagagcaccacctgcttgagaaggttgtgggtatgaaggaggaggctagggtggagcctataaggaggggggagatgctgatgctctctgtggggacggcgataaccctcggcgtcgtaaccagggcggggaaggacgagattgaggtgcagcttaggaggcctgtggtaacatggcccaaggcgagggtggccctgagcaggaggataatggggaggtggaggctcataggctgggggctcataaagtag

SEQ ID NO: 46648 - DNA, 1854 bp, Aeropyrum pernix
atggctggagataagggtggtggcgacggggagaggaggcttaggcagcctatagtggtggtgctgggccacgtcgaccacggcaagaccacgctgctggataagattaggaggactgcagtggccgcgaaggaggccgggggtattacacagcatattggggctagcatagttccggctgacgtcatcgagaagattgctgagccccttaagaaggttataccggtcaagctggttatacccggccttttattcatagacaccccgggccacgagctgttctcgaacctacgccgcagggggggcagcgtcgccgacttcgcaatactagtcgtggatataatggaggggttcaaaccccagacctacgaggctctggagctcctgaaggagaggagggttcccttcctcatagcggcgaacaagatagaccgcataccggggtggaagcccaacccggacgcccccttcatagaaaccatacgaagacaggacccgaaggttagggagatacttgaacagagggtgtacgagatcgttggtaagatgtatgaggcggggctgccggccgagcttttcacgaggatcaaggactttaggaggaagatagccatagtgcccgtctcagcgaggactggggagggcataccggagctgctggcggtgctcgccggcctgacccagacctacctgaaggagaggctgaggtacgctgagggccctgcaaagggtgtggtgctagaggttaaggagatgcaaggcttcggcacggtcgttgacgcggtgatatacgacggcgtcctgaagaaggaggacataatagtagtcggcgggagggagggccccatagtgactagggtgagggcgctcctcatgccagccccactccaggacatcaggagcagggaagccaggttcgtccaggttgaccgcgtctacgccgcggctggtgttaggatagccgctcccggcctggacgacgtgatcgccgggagcccgatctacgctgcggagagcgaggaggaggctaggaagctgatggaggcggtgcagagggagatagaggagctcaggttcaggacggagaatataggtgtggttgtcaaggccgacaccctggggactctcgaagcccttgttgaggccctcaggaggaggggagtccctgtcaggctggccgacataggccccgtgtcaaggtctgacgtgctcgacgctgccgtaaccaggaagatagacccgtacctgggggtcgtgctcgccttcaacgtgaaggtcctccctgaggcggaggaggaggcctcgagggctggggtcaagatctttagggagagcatgatatacaagctgatagaagactatgaggagtgggttaagaaggagaaggaggccgagaggctgaaggccctcaacagcctgataaggccgggcaagttcaggatactcccaggctacgtcttcaggaggagcgaccccgcgatagtgggtgtcgaggtcctcggcggagtgatcaggcctggctacccggtcatggatagccaggggagggagctcgggaggataatggctattaaggatagggatagaagcctcgaggaggccaggctgggggctgccgtggcggtctcgatacagggtaggatccttataggtaggcacgcaaacgagggcgatatactctacactaacgtgcccgcacagcacgcctataagatcctcaccgagttcaaggacctcgtgtcgaaggacgagctggacgtgctcagggagatcgccgagattaagaggagggctgccgaccacgagtacaacaaggtgcttctaaggctcaaaataaagcgtgttagccagtag

SEQ ID NO: 46649 - DNA, 426 bp, Aeropyrum pernix
gtggccgtccagaggaccctcctggtagtcaagcctgatggagtggagagagggcttataggagaggttgtgtccagggttgagaggaaggggctcaagatagtggccatgaagatgatgcgtctaacaagggagaaggctgaggagttctacagcgtacacagggacaagcccttcttcggcgagctggtggagttcataacgagcggtcctgttgttgcgatggttgtggagggggacgaggccgttagcgtggtgaggctgatgatagggtctaccgatgggaggaaggctgccccggggacgataaggggtgacttcagcctcgatattatgaaaaatatagtgcacgccagcgactcgccagagagctttgaaagggagttcagggtgctattcagcgagtcggagatagtggagtggtag

SEQ ID NO: 46650 - DNA, 1479 bp, Aeropyrum pernix
gtgagcgggttggcggggaacgttaggctcttcggcactgcggggataaggggaaggtacctcaggaaggtaacacccctactggcataccaggtggggctagctctggcgggctacgttggcagtggaggcagcatagtcgttgcccacgacgttagaaccactagccccctactggccagcatggcggcttcaggggttatggcggggggtgtcgacgcgatactggtgggacaagtacctttgccagcggcttcgtactcggtggtgaggagcggcagcaagtccggtataatggtgacagccagccataatcctccctgggataacggtataaagattgttgatagcaggggtatggagcttacgaggagtgaggaggaggagctagagtctattatagaagatggtgtcgaggggtttcttgccgactggaattcggtgggtatactgaggattgagaaggagatgctcaactactacatggaggatatagttgctaggaccgcggttgacggggagacgagcctgtccatggcggtcgactgcgcaaacggcgctgccagcggggtaacaccgattgtattaaggagcataggtgttaggagggtctacaccttcaactgccaccccgacggctacttccccggcaggcaccccgagccgaggccggacgtactggagccgtttataaagtcgtcttcaatactgggagtgcaggctttcatcgcccacgacggcgatgcggacaggaccgccctgggggttccagggtacggcttcgtgaagcaggacctcgtgatagctctccttagttggtggaagctgcgggagagaaaggggtctgtagtggtctctgtggacgtaggtattgaggttgaggaggttgtcgaagagctgggtggtaggatagtgaggagtaggctgggcaagatacacgagaagctgctccaggaggccaatgcagtcctagcagccgagccgtggaaactcatagacccagattggggtttgtgggtagatggcgtgtatcaggcggccctcctagcccacatatccctggccaccggaaagactccgagggagctgctggatatgctgccctactatccctcagccagggtctcatacgtcctaggtggggagaacgagagggacaggctctatgaagacgttgtagagaagctgtcccatagcctaacaggcaacgctgtaaggattctacctatcgatggggtgaggattgattacgaggataggtcgtggctgctgttcaggaagagcgggactgagcctaagcttagagtctacgcgcaggcacgagagaaagagaggttggtagaactactgtctagaatacatagtatggtgtctggtgaagcgtctagaacgggcatcaagcttgtttcgaaggaggagcacgtcagcctccctcctggcggggctcgcggcttccgaggccgtagcgctctattatag

SEQ ID NO: 46651 - DNA, 975 bp, Aeropyrum pernix
atgaggagggctgctagggcgtctgccccggggaaagttataatcgttggagaacacttcgtcgtcagaggctccctggcgatagtggcggccataggcagaaggctccgcgtcaccgtgagaagcgggggcaaggggattgtgcttgagagcagcatgctaggccgccacagcgccccgctaccaggccagggtgcagcggctaaggtaagccccgtcctcgagccgtacatagcagtgttgagaagtctggctgcaaggggctatagcgtagtgccccatacaatattggtggagagcggcataccccctagggcaggtctcggtagcagcgccgccagcatggtagcctatgctctatcatactcggccatgcatggtgaccccctctcggctgaggacctctacagtgttgctatggagggcgagaagatagcgcatggtaagccgagcggtgttgacgtaaccatagccgttagggggggagtcctggcttacaggaggggcgagaacccggtggatataaggccggggcttacaggtgtcactctgcttgttgccgacacgggtgtcgagaggcgtactagggatgttgtcgagcatgttctctccattgcggacgccttgggagaggcatcgacctacatatatagggcggcagacttgatagcgagagaagccctccatgcgatagaaaagggagacgccgagaggctaggtcttataatgaatgcagcccagggccttctctcatctcttggggcgtcgtcactagaaatagaaacactagtatatcggatgaggagtgccggggccctgggtgcaaagctaacgggagctggatgggggggctgtgtgatagggcttttcaaggagggtgaggtcgaacgggggctagagtctgtggtagagagttcaagccaggctttcaccgcgtcaatagcagaggagggtgctagactcgaggagttctag

SEQ ID NO: 46652 - DNA, 1299 bp, Aeropyrum pernix
gtgggcgttaatgattttgctattgagcgcgtttggggcttacaggtcctcgatagcaggggcaaccccactgtgaaggcgtatgtcaagcttgctggagggagcttgggctgggggatagcgcccagcggtgctagcagaggcgagagagaggcggtggagcttagagacggtgggggtaagtggaggggtaaaggagtttccagggcagtatctcttttaaacacagtagtagcacctaggctggagggggtcgacgccagaagacaagcccaaatagacaggctcctaatagaactagacggcaccccgaacaaatcgagactcggcgggaacacgaccaccgctctcagcatagccgtttcaagagctgcggcggctcaggcacgcctcgaactcttccagtatctaggcggcgccggggctaggagactcccaatacctcttctcaacgtcataaatggtggtgttcacgcggggaacgagctagactttcaggagtttatgataataccttatggttttgaaagcttcacagaagctatgagggctgcggtggagacatacggggagctcaagagcctgcttaaggacaggtatggtgcatctgcagtcaacgtcggcgacgaagggggtttcgcaccccctatgagaagcgccgaagaggccctcaagactctagtggatgcagtggagaaagcaggctaccagcccgggagcgagatagcccttggcattgacgcggctgcgagccagctctacagtaacgggcgctacagcgttgaagggaagagcctgtccagagaggagctcctaagcctctaccagcgcttggtagagcagtatccaatagtgtatcttgaagacccatttagcgaggacgactatgaaggtttcaaggccgccgtagacgccctctcgacagaaaccattatagtgggggacgatctcctagttaccaatccccagagggttaaggaggcttccgccctcaaagcagtcacaggcctcctagtaaaggtgaaccaggtggggactctcaccgaagctctcgaagccatccaggctgcgagggacagggggattgtccacatagtgagccacaggagcggagacactgaggacaccttcattgccgacctagccgtcgccacagaagctttgatgatcaaaacgggagccccagcccggggagagaggacctcgaaatacaacaggctcctagaaatagagaacatattaggctactcagccgaatatgcaggtccagaactacgcggcgtaatgggcaggcgctga

SEQ ID NO: 46653 - DNA, 2100 bp, Aeropyrum pernix
atgaaggagctgggtgtcgagcccggtgatgtagtcgagattgagggtaagaagaaaactgtcgccattgtaatgccagcctacccggaggacatgggtctcgacatcataagaatggatggtatactgaggaggaatgcagacgttaatattggagagaaggttattgttaggaagactagtgtgaggacggctacaaaggtgaagctagcccccgtcagctacacaatgactgtagacgaggggttcaagaggtatgtgaagaagaagctccagggagtgcctatcaccgagggcgacgtggttgttgtccccgttataggccaggctgtccagctgcaggtggttgacgctaggccgaagggtgcggtcatagtttctgaggagacgatagttgatgttcttgagaagccggtagcgcagagccgtgttccaaaggtcacctacgaggatatcggagggcttaaagaggtaatcgagaaggtcagggagatggtggagcttcctctgaggcatccagagatcttcaagaggcttggcatcgagcctccgaagggtattttactgtatggcccgccgggcactggtaagacgctgctggccaaggctgttgcgaacgaagccgacgcctacttcatctccatcaacgggccggagattatgagcaagtattacggcgagagcgagcagcggctcagggagatcttcgaagaggctaagaagaacgcccccagcattatcttcatcgacgagattgacgccatagccccgaagagggacgaagttgtcggggaggttgagaggagggttgtggcacagcttctagccctcatggacgggcttgaggctagaggtaacgtgatagtcattgcagcgactaacaggcctaacgccatagacccggctctgaggaggcctggaaggttcgacagggagatagaggtgcccttgccggataagcatggcaggctggaaatactgcagatacacaccaggcatatgcctctggcggaggacatggatcttgagaagctggccgagatgaccaaaggcttcaccggcgctgatctcgcagccctagcgagagaagcggccatgtacgccctccgaagatacctacccgagatagacctggaccaggagtccatacccgtggaggtcctcgaaaagatggtagttaccatggaggacttcctcaaagccctcagggagataacgcccagcggcttgagggagatacagattgaggttcccgaggttaggtggagtgatataggcggcctcgaggatgtgaagcaggagctgagagaggtagtggagtggcctctgaagcacccggaggcattcaccaggatgggtattaggcctcctaggggtgttctcttgttcgggcctccgggtactggtaagacgctgctggccaaggctgtggctactgagagtggggcgaacttcatagcggtgaggggcccggagatactcagcaaatgggtgggagaaagcgaaagagctattagagagatattcgcgaaggcaaggcaacacgcccccgccgtagtgttcttcgacgagatagacgccatagcccccgtcagaggcaccgacgtgggcacaagggttaccgagaggattgtcagccagctgctaaccgagatagatggggtctctgacctccacgacgtggtagtaatagccgccaccaacaggcccgacatggtcgacccagccctcatgaggccgggccggctcgagaagatgatatacgtaccacccccagacttcagctcgagactcgagatactgaggatacatacccggaaggtgcctctcgccgaggacgttgaccttgccgagatagctaggagaaccgagggctacacaggtgctgatatagaagctctagtcagggaagcgagtctagcggcgttgagggaggatataaacgcggcggaggtgtcgatgagacacttcgaagtggccctcaagaaggtgaagccgagcgtaacaccgcagatggtggagtactacaagagatggctggagaccgtcaagcagaggcaggaagaggttaagagggaggcccccaccattaccctgtaa

SEQ ID NO: 46654 - DNA, 732 bp, Aeropyrum pernix
gtgacaggtgggagcaggggtattggtagggctacggttctccgtttcgcccgtgaaggatggagtgtcgtgatcgcctacaagtcgagggctgatctggctgagaagactgctgaggaggctagaaggctggggtctccagaggcttacactgttagagtagatgttggcgatcctgatagtgtcactgagatgtctagtagggttggagagctcattccccatctcaacgtgcttgtaaatgccgcaggcgttctacagctaggcgggatagaagagacctctataagcgagtgggaggagaccctgagggttaatctaacgggagtgtaccttgtgacaaaactgctgctaccccttctaaggaaggccaaatgggcttccattgttaacgttgcaagtattgcaggggagacaggaaacgttgtggctggtgtagcgtactccgccagcaaagcaggggtcatcggtcttacgaagaggctggcagtccagcttgcaggctacggtatcagggtgaacgctgttgcacccagcttcgtcgagaccgacatgaccaggagtttcctcgacactcctgagaagagggagaggatagcaagtctccacccgctaaaaataatactcaagcctgaggacgttgcggaggccatactcttccttgcagacccacgtaggagcagggggatcactggccatgtgctgtcgataaacgcagggagacgcacctaa

SEQ ID NO: 46655 - DNA, 972 bp, Aeropyrum pernix
gtgggttacgcggtagaagcggaggctctagtgaaggagtacaggatgggcttgctcccatggagggctaggactatcagagccttagacggtgtcgatcttaaagtcggtagggggaccctcttctcgctgctgggccctaacggtgctggcaagacgactctcgttaagatactctccacactcctccttcccgactcgggctgggccagggtcgccgggttcgacgtcgttagggaggctaacaatgtgaggagcaggataggggttgtgctgggaggggagagggctctctactggaggctctcgggctgggataacctatggttcttcagccagctctacggcatacccccgagggaggctaagaggagagttaaggagcttctcgagattgttggcctcgaggagtgggctcacgtgagggttgaaaactactccaaggggatgaaacagaggctccatatagcgcgggggcttataaacgatccggaggtgcttctactagacgagcccactataggcctagaccccaaggccgccagggaggttagaagcattatacggaggatagttcgggaagggaggactgtcctgctgacgacgcactacatggtagaggcggaggagctgtcagacagggtggctataataagcaagggtaggatagtggctgagggcccgcctgaggacctcaagtcgctagtcggcggcgagagcgttattgaactgaaagtgatggggggagacagggttagtatgttgctggaaagactcggaggtagggtaattagcgtagtagagcgtgacggggccagagtttttagggtgcttgtctccgagcccgactcgttcatagaagctctgttggcagagctcacgcgcataaacgccagtatccgggggctagatgtgaggagcccgagcctcgaggacgtgtttataaagctagctgggggagaaggcgggtga

SEQ ID NO: 46656 - DNA, 3024 bp, Aeropyrum pernix
gtgatggtctacccgaggatggggagagtacctctacccccaaagggggcccagcactacacaactatgtgccagttctgcaacgtgggctgcggctacgatgtgtacgtatggcccgccggtgctgaggggtccccggagccaggtggacacggtatagagtataagatagtcgacgaggcttacgggaggaacctggtaaagcagcccgacttcacaaaggagcacacaggcctcagcgccgaggagggtgagccctggatatccgaggctatggtagtcaagacgataaggagaacctgggagaggggtagagggacaggaggctggagggaggtttacgtcgcgcaggttccgagccccgagtgccccataaactggggcaaccactcggtgagaggcggtacccaggcagagaggatatggagcccctggaacatcgctggggagaggaggctcactaagcccctggtcaggttcggtgggaggctagagcccgtttcctgggagtatgctatagaccttgttgcaagggttgtcaagggagttatcgacaagtgggggatagagaggccagggtggggtaaggaagggcacgcagtcttcgcccaccgtatggaccacggtggcggcggcggtggcggtatgatcttcaacacagtcgtcggcctgttcttcttctacggcgtgagaacagcattcgccagaatacataaccggcccttcttcgggcccgagaaccctgcggcaggcgatgcaggacccggcgccatgaatacctcctaccacgacctcaggcttgccgacacgataatactgtggggtaataatccctactccactgcgactgtcatgttcgtgaaacacgtcctcgacaatctaaggggcgccaccaaggctgagaagcagaggtggtttaaccccggagagcccgtgatagatagtaggataataattgttgatccgaggaggacggagactgttgaagcagctgaagctgccgcgggtaaggacagggtgttgcaccttcaggtgaagccgggcactgacatagtgctcgcgaacgcgatagccagagtcatttacgagagatacggtgatgttgtggaggagtttgtcaaccactatagatcagctgccggctgggggttcaaatgggatgaggagggcttccagaagtatgtttcggaggcgctacaggtcggcgaggagacgttggatgaggtcctcgccgaggccgagagcataacaggagtgccgagggacaagatagaactagccgccaaatggatagccgagaggaaggagggaggataccccaagagagtatggttaatgtacgagaaggggataatatggaaccagaactacagatccatctacagcctattcgacctatgcatgatagctggagcaacgagaggtctcccgggatgtggctgccagaggcagggagggcaccaggagggcttcgccagcccagcgcccccaccaccgccatggaccgatgagaggcatcacatagcttatccggacaagagcctctacgacgagtactataacacgaaatacccgagagccgacttctacatgccaacaactgatttcaggctggctaacggtgagggtaaggttctctgggtcattgacatggacaactacaggctcgcgcctaactcccagaggctcaaggcagtcgtgggagatagggcatggagggtaacaaggtatgtgttcgccgaagcctacgccaacgtgggagggaaagagtcggagcccaactacgaccccaatgctctggagccggtgataacgaccccgccgtcctccagggagtatgccgagaaggtgctccaggcccttgaagagactggaggcctcttcgtcatagtcgaggacatctacccgaccttcatggttgaagacgcccacgtagtactccctgcagcgttcaacaatggagagtggcccgacgtcagaatgggggttcacgagaggaggttcaggatagcagacgcctggctcgacccgccgggagaggctaagcccgactggtggatactcgcgaacgtagctaagaggatagtcgagctatacgaagaagagggtagaggtggcgacccagtcgcagagaggttcagaaaggcctttaagcctatatgggacgccatggaagccaacgctagggatccgacggttgaggttgagaacgagatcttcaaaacctacatagccaacgccgacgaagcctatgcaaggctgggagtccactgggaggtccagtactggacgccggagttcaagaagctcgacctgaacatactgaggaagctcaggaccatcggcaccgtactgccgataactaagctagacgtgaagccagacggcacaatcgaggtcagaggagtggtaaacatcatggagcccgccctaaacgacacctaccgggaggaagtggttgttgtgaagccagacggcaccatagtcaggaggatcgaagtcgtaccttccaacgagactgttagaagctacgtcccaggccacctaaaaccgtggccagcagtatgggataagtacccgccgtatgtggacgagctgataaggaagggctataagtactgggttgtcaacggtaggtacaacgctatatggcagacaggctatgcagaccccaacgtcgtagaaattatggctagacacccgatgaacatcgtccaggtcaacccggaggacgctgcgaaggaaggtcttgagaacggcgacatagttgtaatctataacgactatggttccacgacagccatggtatgggtaacgagggtggtagcgccgggcacgatattcctcataatggcccatccgaaagcggtaggtgcaaacgctgtaacgacgccaagcgttgacccggcagcacagaaccccgactacaagctcaccctagcaaatctgaggaagataggcagggctgacgagacgattataaagaaagttacgttcaaggacataagatttgccgttcgctag

SEQ ID NO: 46657 - DNA, 1194 bp, Aeropyrum pernix
gtggataaccctgcaaatcctttagacagggagttcctcacagagggggaggctgcccccggcctgcccgtcttctgcctggagaggtggcagagtaccctcgagaacagtgctaaatatctccttagcgagagcggtgtagagcctcctgcagcggagatgctcaccgagctgggagtagaccttgacgtccggagtgctgtgctcgggtacgggtggaccctcggcgagccggggcttagagagagtgtggcgagcgtatactacagggggcttgtggatagcgaacaagtgataataaccactggctccgccgaggcgaacttactctcggttatatccctagtagcccccggggacagggttttattcgacatgcccaattacatgcagatacacggtctcctcaggatgagaggggcaagaatactggaggcgtggcgtaagcgggagcaccgatggaagctagacccaggcctctacgcggaattgataaagagagagaagcccagggctgtcttcataaccaacccaaacaatcccaccggctctgtcgccggccccaaggctctgggcgagatagcggcggaagccgcgagaacaggctccatactagtgttcgacgagctgtacaggggcctagagcactctacagagccagcaccgacagtcctagaaccagccctagagcagggggcccacgcgatatcggtctcagggctatcgaaagtctacggcctcccaggactgaggataggatgggcagcagcaacctcgaggaggcttagggatagaatgtggatggtaaaagactacacaacaatctctccacccaagcccagcgagcacatagccgagcagatcctagagaaaggagtctggaaaaagctcgccgagaggggaaggaggatagtcctctccaacctggaaatcctcgaggacctcacgaccaggtttagaacggccaagctgtggcgtccggacgccggtgcctacgccctagtcgaaactaccgtgggtgacacgctgagcttcgcatacaagctctaccaaacccacagtatactagtgaaccctggagagtgcttcaaactaccgggcaccatcagactcgggttgggccatgaaaaccgggaatcttttaagaagtcagtggcactgacactaaacttcctagagagtttcgctgggtga

SEQ ID NO: 46658 - DNA, 1002 bp, Aeropyrum pernix
gtgaacgcgttggaaagcgaagctatggtagtggctgaggagcttgtgaaagattatggcggcttcagggcggttgacggagtgagctttaggatagccaggggagagctgttctccctcctaggccctaacggcgcaggcaagactaccactataaagatgctgagtaccctcctgaggccgacaagcggcgaggcttggatagctggctacagtatagtgagggagccgggaaatgttaggagggtcataggcctagtccctcaggacctgacagctgatgatgagatgagcggctgggacaacgtgtatatacaggcgaggctctacggcctgccatcgagcgaggcaagggagaggactagggaggtcctcgattatctcgaccttatggaggcggctcacaggagggtggctacatacagcggtggtatgaggagaaagcttgagatagcaatgagcctcgtccacagccctaaggtcctcttcctggacgagcccaccctgggcctcgacgtccactcgaggagaagcctgtggaggtatatcgaggacctcaaaaggagcgccgtgaccatactactaaccacacactacatggaggaggctgagatgctctcagacagggtggcgatcatagatagggggagaatcgttgccgagggcactccagaagagctgaaggctagagttaagggagagacagtctatatcgagctgaaggatccggaatacacagagcccctcgtactcgcactgaaagagaaactaggccttgaacccagcgttgtggagggcaaggttgcggttagggtagaccgggctgacactctgttgccagagcttgccagggctctaaacggctttcctgtgaaggccatcagcataaccagggcgacgctcgaagacgtcttcatagaactcacaggcagaaccctaggagggagcgaagagcccctggacccattcaggtacaggaggatgatcaggggggtgaggtga

SEQ ID NO: 46659 - DNA, 1266 bp, Aeropyrum pernix
gtgtttaggcgttacatagagattccggttctatacaagatagctgttgggttcgtactcgggataattgctggtatcgttatcgggggagtgatggtcgatctcaagcccttgggcgacctgtttataaggcttctgaagatgctagtggcccccatagtgttcttcagcctcgcagtaggtgccgcgagtatctcagccagcctcctgggcagggttggcgtcaagatattcgtctactacttgttcactacagctttcgccataactatcgggctcattgtggccaacataatccagcctggccgcgggctggagctggctggggaggcgaaggagatacaggtcaagcctccccctcccattagcgaggtcctcctaaacattgtgcccacgaacccattcaaggctctggccgagggtaacgtgctgcagataatcttcttcgccatagtcctgggagtggctgtagcgctgctgaggtcctcgcgggacgacaggctaaggagcggcggcgagactgtctacagggtgttcgacggtctcgccgagtccatgtacaagatcgttaggggcgtgctggagtacgctcccataggcgtcttcgccctgataggctatgtcgtggccacagccggcccaggcgtcctaggtcctctagccgttgtcgtgatcaccctctacataggcctagccatacacgtcctgggggtctactcgctgatactcaggctcttcggcttcagcccgttgaaattcttcaagggagcgctggaggcgatggcgacggccttcgtaacaaggagcagcagcggcaccctcccggtgacgatgaaggttgcggaggaggagctggcaatagacaggaggatattcagcttcacactccccctcggcgccacaataaacatggacggcacggccatgtaccaggcggtagcagcccttttcatagcaaacaccctcgggatagacctatccataggccagcagctctcgataatcctggcggcaacactagcatccataggcaccgccggcgtccccggggcgggattgataatgctagccatagtcctcgaggccctaggcctctctctcaccgaccccacagtagctctagcctatggcctcatagcgggtatagacgtcatcctagacatgggcaggacaatggtgaacgttacaggagacctcgtggggactactatagtggcgaaaaccgagaacgcggttgacactaaaaagggagtatggtcaaggtag

SEQ ID NO: 46660 - DNA, 657 bp, Aeropyrum pernix
atgtcgaggcttggcgtagagaatggggaccacgtcatactctatggggactacaacaactggttcgcggctttcgcctactgggtcttcaagatgtacgggcaccagagggtaagcctcctagacgggggtaggagtaagtggatagcccttgggaagccgatgtcaagacccgctaccagagagccgccgcgtgccgagagggagagtagatatagagtagttacggtcgacagcagataccgcgttttcttccttgacatccttcgtaagttgaacgatcccaacacggtgctagttgacgttaggagccccgaggagtaccggggagatattacggcaccgccagagtatcctgaggagcaggcccagaggggaggccacatacccggggccctaaacataccctggaaacaggcagtgagagatgacgggagcttcaaatcgcctgaggagctgaggagcctctacgaggatagaggtgtaacaccggataaggaggttatagtgtactgccgcataggcgagagagcctcacacacatggttcgttctcaaagagctgctgggctatcccaacgtcgcagtgtatgacgggtcttggagcgagtggggcaacatggtcagggctcccgttaagaagggggacgaaccctga

SEQ ID NO: 46661 - DNA, 1542 bp, Aeropyrum pernix
atgctagccgtgacaagaatcggggccatacacagcgtggtattctcggggttcagcagctgggccctcgccgacaggattgtcgacgccaaggcggatgtcctgataacggcggatggcttctataggagggggaggatagttgatctcaagaagaacgccgacgaggccgtgaagcttgccgccgacaatggtgtaaaggttaggaaggttatagtggtgaggagggctgggaacgaggttaggtggagcagcgagctgaacgtctggtaccacgacctcctgaaggaggtgcctgagaaggtctatgtaaagccggagccgaggaagtctgacgacgtgctcttcatactatacaccagcgggacgacgggaaagcctaagggtataatgcacagcgtaggcggttacatgacctacgtctacaacgtgttccgctggaactgggatccgaggcccgaggacgttttctggaccgccgcggatataggctggataacgggccacacctacatagtctacggcccgttgatgcacggcgagacccagatcatgtacgagggggctccagactatccgaaccctggtaggatctgggagatggtggagcgctacggagtaacggtcttctacactagccccacccttctcaggctgctcaggaagtatggggacgagtgggttgagggcagagacttctcccggctaaggctactgggtactgtgggggagccgattaaccccgaggtgtggaagtggtattacgagaagataggctggaagagggctcccatagtggatacgtggtggcagaccgagacgggggcggcaatgataagtcccgcgcccgggatagcgctggtccccctgaagccgggcagcgctacgctcccgctacctgggattgtggctgatgtcctgacaagtgacgggaggcaggcagggccgggtgagaagggctacctggttgtgagggagccgtggcccggcatgatgctgggtatatggggagatcctgataggtatgtgaggacctactggtccaggttcagcaagccggaggagggggtttggatctactatcccgcggactatgctgtgagggatcgcgacggctacttctggattctaggtagggctgacgaggtcctcaacgtggcgggacacaggattggaactatagagcttgaggacgccctcctcacacaccccgcggtgagcgaggcagccgtggtgggggcgcccgatcccgttaagggtgaggttcccgtggccttcgtcgtccttagggctggctacgagccgagcgataagctggagcgggagcttagggagacagtgagaaggctgataggccctatagcggagccgtcaaagatatacttcgtggagaagctcccgaagactaggagtggtaagataatgaggaggattatgataagcctgctacgaggccagcctgttggagacgtcaccacgcttgaggacccaagcgctgtagaggctgtaaggagagcccttgagagggagaaggctgggtag

SEQ ID NO: 46662 - DNA, 747 bp, Bacillus stearothermophilus
atgagcatggaacagaaaacagccattgtcaccggtggagcgaatgggatcggcaaggcgatcgctagagcattcgcaaaacagggagcgaacgtcgtgatcatcgaccgcgatattcaaaacggtgaagcgttcgccgcgcaattgcagtcggacgggttcaaggcgatctttgtggcagcggatgtgcggaaggtggacgatattgaacggtttgtacaagaagctgccggccgcttcggccgcattgactatttgatcaacaatgctggcgtctcacgctggaagtcgccgtatgagctgacggttgaggagtgggatgacgtgctgtcaacgaatttgcgcagcgctttttttgcttctcgagaagcagcgaaatatatgcgccgcaatgcaaaaggcggagcaatcgtcaacattgcctcgacaagggcgctcatgtccgagccgaattccgaggcgtacgctgcatcgaaaggcggccttgtcgctttgacccatgcgctggcggtgtcgtttgcggatgatcgcattcgcgtcaattgcatcagccccggttggattgaaacgggcgattatgggcaattgcgagacattgaccaccggcagcacccggccggccgcgtcggcaaaccggacgatatcgcccgcgcttgtctgtatttatgcgatgaggaaaacgattttatcaccggggtcaatttattcatcgacgggggaatgacaaggaaaatgatttatattgag

SEQ ID NO: 46663 - DNA, 837 bp, Bacillus stearothermophilus
accgaaaagcaggaaatgatgcggcaaatggtgcgcgagttcgccgcggcggagatcgccccatttgtcgagcgcatggaacaaggggagtttccgcgcccgattttagcgaaaatggccgaactcggcctaatgggcatcactgtcccggagcaatatggcggcgcgggtatggactttgtgtcgtacatcatcgccattcatgaaatttctaaagtgagcccgaccgtcggtgtcatcttatcagtgcacacgtcggtcggcacgaatccgatcttgtattttggcaccgaagagcagaaacaaaaatacgtgacaaagctcgcccgaggtgagtacttgggggcgttttgccttactgaaccgagcgccggctcggatgcgaaaagcttgaagacgaaagcggtgcgccgtggagatcgttatgtgctaaacggctcaaaaatattcatcaccaacggcggggaggcagatacgtacatcgtcttcgcccgcacgaatccggaagaagccggaagccgcggcatttccgcgttcattgtggaaaaagggacgccagggatgtcgattggcaaagatgagaagaagatggggctgcacgggtcgcggacggtgaccattacgtttgaagacgccgaagtgccggcggaaaacttgctcggtcaggaaggggaaggatttaaaatcgcgatggccaaccttgacgtcggtcggatcggcatcgctgcccaagcgctcggcatcgcggaggcggcagtcgaacatgccgtcgcctacgcgaaagagcgggtgcagtttggcaaaccgatcatcgagcagcaaggcgtcgctttccaa

SEQ ID NO: 46664 - DNA, 1302 bp, Bacillus stearothermophilus
ccgcgcgttgtcagaaccatgtccattcctaagatgaaacggtaaggcacccagattcgatggtttttaactgacaagttgtctaaaacagccggccatatcggcccgaacttaggggtcgtcgagctgacgatcgccctccaccgcgaattcgacagcccaaaagacaagctcatttgggatgtcggacaccagtcatacgtgcataaaattttgaccggatgcgccgctgcgttcgacacgctccgccaatacaaagggctgtccgggttcccaaaacggagcgaaagcgagcatcacgtgtggaaaacgggccatagctcgacgtcgctgtcgccggcgatgggaatggcgatcgcccgtgatttgaaagggacggatgaatacatcgtgccgatcatcggcgacggggcgctcaccggcggcatggcgcttgaggcgctcaaccatatcgggcatgagaaaacggatatgattgtcatcttaaacgacaatgaaatgtcgatcgccccgaacgtcggcgcgttgcacaacatcctcggtcggttgcgcaccgccggcaaataccagtgggtgaaagatgaactggagctgctgctcaagcgcataccagcggtcgggggcaagctggcggcgaccccgagcggctgaaagacagcttgaaatatttgcttgtctccggcgtgtttttcgaagagcttgggtttacgtatttaggcccggtcgacggccacgattttgaggatttgtttgagaacttgcgctatgcgaagaagatgaaaggccccgtgcttgtgcatgtcatcacgaagaaagggaaaggatacagtccggcggaaaacgacaaagtcggcacatggcacggcacagggccgtacaaaatcgaaaccggcgcttttgtcaaaacgaaagaggccggtccgtcatggagcgcgcttgtcagcgaaaccgtgcgccggctcgccagcaccgacccgcgcatcgtcgcgattacgccggcgatgccggtcggctcgaagctggaagggttcgcaagcgagttccccgatcggatgtttgatgttggcatcgccgagcagcatgcgacaacgcttgcagctggattggcgacacaagggatgaaaccgtttttggccatttattcgacatttttgcagcgcgcctatgaccaagtcgtccatgatgtatgccggcaaaacttaaatgtctttttcgccattgaccgtgctgggttggtcggggcggacggcgaaacgcaccaaggggtgtttgacatcgcctttttgcgccatgtgccgaact

SEQ ID NO: 46665 - DNA, 513 bp, Bacillus stearothermophilus
gcccgcgtcaaagaagagtttggctccattgatattttggtcaacaacgccgggacgctcgaccacgtttcgcaaatcataaagcaaaacgataagttttgggagcgcgatttgcgggtgaacctgaccggcacgtacaactgtacaaaagcggtatggccgtatatgaaagagcaaggatgggggcggatcatcaacatgtcgtccgtcgccggcacgcttggcggcttcggccaggcgagctattcggccacgaaaggagcggtgttgagctttacgaaaagcatggcgcttgagggggcgcgctacggcatcaccgtcaacgccatcgtgccgggcatcatcaatacagaagcgttccgcatgggcaatccgaaaatgaacgagcggatgatccagcgcacggcgttccgccgcccgggcgaaccggaagacgtcgccaacgccatcgtgttcctttgttccgataaagcgaagtacatcacggggattgggttgaatgtttcaggcggc

SEQ ID NO: 46666 - DNA, 444 bp, Bacillus stearothermophilus
ctcggcgacatttacatcgcctccgacggcgacgcgattgtcaaagtcgagctgtttccagaagaatggagcgcgttcgccggcgaacattcggttgtcaaaagctggtcgccgcttcttgaacgcgcgcttaggcagctggatgagtatttccacggtcgacgccaagtatttgacttgccgctgaagtggaagggaacagccttccaagaagaggtgtgggcggcgctttgccgcatcccataccgggagacggcgacatacgctgacatcgccgcgcaaatcggccgcccgaaagcggtgcgcgccgtcggccatgcaaaccgggcgaatgaactgtcgattctcgttccgtgccaccgtgttgtcggcaaaaacggcgctctcattggctatgccggaagccgcaccgatgtgaaggcgaagctgttggagcttgagcgc

SEQ ID NO: 46667 - DNA, 447 bp, Bacillus stearothermophilus
atggcagaacggacattcatcatggtgaaaccggacggggttcagcgcaatttgatcggcgagattgttgcccgttttgaaaaaaaaggcttccagcttgtcggcgcgaagctgatgcaagtgtcgcgcgaactcgccgagcaacattacgctgaacataaagagcgcccgtttttcggcgagcttgtcgactttatcacctcggggccagtgtttgcaatggtgtgggagggcgagaacgtgatcgccgccgcccggcaaatgatggggaaaacgaatccgcaggaggctgcccctggcacgatccgcggcgatttcggcttgacggtcggcaaaaacgtcatccacggctccgattcgccgcaaagcgccgaacgcgaaatcagcttgttctttaaagaagaagagctcgtcagctattcgaaacagatcaatgcatggctgtac

SEQ ID NO: 46668 - DNA, 507 bp, Bacillus stearothermophilus
cgcgccgtccgtgtgcgcaatgtcttgatcgggggagacgaaccgtgcatttgcgccccggtcgtgggagcggacgcggagcaagtgttagaggaaacaaggcaaatcagcgcgaaaaagccgcatctgattgaatggcgtgcggactttttccaggcgattcaggacgaacagcaagtggcggcaacggcgagagagatgcgggcgatcgccggagacatcccgattttgtttacggttcgttccgaactggagggcggccgaccgatttccttgacagaagaggaaaagctgcggttgtttgaaacagtgtgccaaagcggcgcgatcgatttgcttgattacgagcttgcccatgagccgtatgtccccgctgtccgtcagctgacccgccgctatggagtgcgtctcgttttgtcctatcataattttgattgtacgccatctaaggaagaacttgtcgccaaaatgcgccaagttgagcaacatggtgccgatatcgccaaa

SEQ ID NO: 46669 - DNA, 714 bp, Bacillus stearothermophilus
ggcattccgattccggttgaccttgacagcccgttttccatcgaccaaaacttgtggggacgaagcaacgagtgcggcattttggaagacccgtgggcggcgccgccggaagaggcgtatgagctgacggcttcgcttgagaacgcgccggatgtgccggatgtcatcgagatcggctttgaacaaggcgtgccggtgacgttaaacgggaaggcgtatccgcttgcgcaattgattttggagctgaacgcgttggccggcaagcatggcgtcggccgcatcgaccacgtcgaaaaccgccttgtcggcatcaagtcgcgcgaagtgtacgaatgccccggggcgatcacgctcattaaagcgcataaagagctggaagacttgacattggtgagagaagtcacccatttcaaaccgatcatcgaacaaaaaatcgccgaagtcatttacaacggtctttggttctcaccgctgaaagacgcgttggtcgcgtttttgaaagaaacgcagaaaaacgtcaccggcgttgtgcgcgtgaagctgtttaaaggccatgcgatcgtcgaagggcgcaaatcgccgttctcgctctatgatgaaaaattggcaacatacacgtccgaagatgaatttgaccatcaagcggcggtcggattcatttcgctgtacggcctgccgacgaaagtgcacagcatcgtgaacaagcaaaacaag

SEQ ID NO: 46670 - DNA, 1134 bp, Bacillus stearothermophilus
ccgctccccgttaagcgcgtgcaagagaatatttccacacgtccaccgcatggtcagatggacacattaggtgcccagtcagggctcatctgggcgtctcaggtgcatgaacctggcgtgcttccacagcatggggtgagtttgcttggcacaccgattgaagcgatccagcgcggggaataccgcgaagcgttccgcgcgttaatgcatgagcttggcgaaccggtgccggagagcgaaattgtcacaagcgttgaggaagcggtcgcgtttgccgaacaaatcggttttccgatcattattcgtcccgcgtatacgctcggcgggacgggcggcggcattgccgaaaacatggagcagtttctcgcgctcgtggagaaagggctggccgaaagcccgatccgccaatgtttgatcgaacggagcgtcgccggatttaaggaaattgaatatgaagtgatgcgcgaccaatcgaatacgtgcattaccgtttgcaatatggaaaacgtcgatccggtcggcattcatacaggagattcgatcgtcgttgcaccgtcgcagacgttgaccgatgaagagtaccaaatgcttcgttctttagcagtgaaaatcatttccgccttagggatcatcggcggttgcaacattcagttcgcccttgacccgaacagcaaacaatattacttaatcgaagtcaacccgcgcgtcagccgctcgtcagcgctcgcctcgaaagcgaccggctacccaatcgcccgcattgcggcgaagctggcggttggctatacgctcgcggaactcgtcaatccggtgacgaaaacgacgtacgccagcttcgagccggccttggactacgtcgtcgtcaagtttccgcgcttgccgtttgacaagttcccgcacgcggatcggaagctcggtacgcaaatgaaagcgaccggggaagtgatggcgatcgatcgcaatatggagcgggcgttccaaaaagcggtgcagtcgctcgaaggaaaaaacaacggactgtttttgccggagctttcggcgaaaacggatgacgagctgacccaactgcttgttgacaaaggcgaccgccgctttttcgccattttggaactgctccgccgcggggtgccggtc

SEQ ID NO: 46671 - DNA, 960 bp, Bacillus stearothermophilus
tttgaccagcaaaaaccgttggattttatcgccgttggccggctatgcatcgatttgaacgccaatgaaatccatcggccgatggaagaaacggtgacgtttacgaaatatgtcggtgggtctccggcgaacatcgccatcggcatggcgcggctcggcatgaaaacgggatttatcggccgggttgctgacgaccaaatgggtcgatttattgtccgatatttaaaaaacaatggaattgatacgtcccatgtcattaccgacaagtccggcagtgtgacaggcttggcgtttaccgagatcaagatcccgaccgactgcagcatcctaatgtatcgcgataatgtcgctgatttgaagctggaaccgaacgatattgacgaagactatattcggcgcgccaaatgcctgttgatttccgggacagctttagcgaaaagcccgtcaagagaagcggtgtttttagtgttggactacgcaagacgccatggaaccgtcgttgttttcgatttggattatcgcccttatacgtggcaatccaaagaggaaacggcgatctattacaacttggcggccgaaaaatgcgacgtgatcatcggcacgagggaagaatttgacatgacggagcagtttgacgaccggcggtgcgatgatgaacaaacagcgcgaaaatggtttgattacaacgcgaaaatcgttgtgattaagcatggcaaagacgggtctattgcttatacgaaaaccggagagacgtttgtcggcacgattttcccagcgaacattgtcaaaacatttggggccggcgactcgtatgccgcggggttcatctacggattaatgaacggctggccgattccaaaggcgatggaatacggggcagctgcggcttcgattgtcatctcgagccatagttgctccgatgcgatgccgacattggcgcaaatcgaacagttcatcgag

SEQ ID NO: 46672 - DNA, 1197 bp, Bacillus stearothermophilus
caccagcgcttaaagtcgctcctcgaacagctcgacggcacatactagaccgaaggcaaccgcatcttttatttggcaatggcgccggaatttttcggcaccgttacttcccgcttgcagtcggaaggattgacggaaacgcgcggctttaagcggctcgtcatcgaaaagccgttcgggcatgacttggcgagcgccgagaagctgaatgacgagattcgccgcgtcttttccgagcgggaaatctaccggatcgaccattatcttggcaaagaaatggtgcaaaacatcgaggtcatccgcttttcaaacgccattttcgagccgctttggaacaaccggttcatcgccaacattcaaatcacatcgagcgaaacgctcggcgtcgaagaccgcggccgctactacgaccattccggggcgctgcgcgacatggtgcaaaaccatatgctgcaaatggtcgctctgttggcaatggaaccgccgatcaaattaacgaccgatgacatccgccatgaaaaagtgaaagtgttgcgcgccttgcgcccgattgcgcacgatgaagtcgaccgctatttcgtgcgcggccaatacgggcgcggggtgatccacggcaaaaacgtgccggcgtatcgcgaggagccgaacgtcgatccggactcgaacacggaaacgttcgtcgctggaaaactcctgatcgacaacttccgttgggctggcgtgccgttttacattcgcaccggcaaacggatggcggaaaaatcgacgaaaatcgtcgtccaatttaaagatgtaccgatgaacttgtattaccggacgaatgagacgatcgccccgaacttgctcgtcatccacatccagccggacgaagggatcacccttcatttaaacggcaaaaaaaccggggaatcgacgaccataacagctccatttcaactcgactattgcaacaactgcatcgacgggatcaacacgccggaagcatacgaaaagctgctgtacgactgcatgcgcggcgatgcgacaaacttcacccattgggatgaggtagcagcgtcatggcaatttgtcgacccgatttctgaggtgtgggcgaacacaaaagcttccgactttccgaactacgcggctggctccatgggcccggcggccgcggacgagctgctcaaaaaagacggcttccactggtggccgatc

SEQ ID NO: 46673 - DNA, 555 bp, Bacillus stearothermophilus
gggcgggtgttgatcgatggcatcgatgtgcgcgagttttccgcggagcagttgcgcgcctatgttcgttttgttccgcaggaagtgctgttattttccggcacggtcgccgacaacctccgcttcggcaagatgaccgcgacgatggaagagatcgtgcaggcggctcgtgatgcgcaaattcatgaaacaatcactcggtttccggatggatacgacgcactgatcggtcaaaagggcgtcaatttatcaggcgggcaaaagcagcggctgtcgatcgcccgcgcgcttgtgggagagccgcgcattttgcttttggatgacagcacaagcgcgctcgatgcagagacggaagcaaagctgctcgcagcgttgcggcggtatgcgtgcacgacggtgatggtgacgcaaaaggtgagcgcggcgatggcggccgacacgattttccttttggaagacggccgcctgatcgcgcaaggaagccatgaacaactgctggcggcaagcgaactgtatcgacgcatcgtcgcgacgcaggaaggaaagaagggatcc

SEQ ID NO: 46674 - DNA, 840 bp, Bacillus stearothermophilus
atgaaagcgtatttgcatgtggcgagcggaaaaacgttcagcggggagctcgccgctccgcttgaagaaaaggtgagcggggagatcgtttttttcaccggcatgaccgggtatcaagaagtgttgaccgacccgtcgtataaaaaccaaatcatcgtttttacgtacccgctgatcggcaattatggcattaatgaagacgattttgaaagcaagcggccgcacgtcgaagcggtcgtcgtctacgaagcgagcggcacaggatttcattacggggcgaaatacagcttggcagaatacttgcagcattggaacattccgcttctcacgcacgtggacacgcgcgcccttgtgaaagaaatccgcaccgctgggacgatgatggcggaattaagtttgtcgcccattccagcagttgctgatgaggaagcggcttttccagtgcgcgcggtgtcaacgaaaacgatcgaatcatacggcgaagccgggccgcatttggtgctcatcgatttcggctataaaaagtcgattttgcagtcgctccttgcacgcggctgccgggtgacggtcgtgccgcatgatacggcgccggaagcgattgacgcgctgaaaccggacgggcttgtcctctcgaacggcccaggcgatccgaaacagttaagccatcagcttcccgctatccgtcagcttatcgaccggtatccgacgcttgcgatttgccttggccatcagcttgtcgccttatcgtacggggcggatacggaaaaactccgcttcgggcaccgcggtgccaatcagccggtgtgggacgcggtgaaacaaaacgtgatgatgacatcg

SEQ ID NO: 46675 - DNA, 1023 bp, Bacillus stearothermophilus
catgtcgctgtcgtcggagcaacgggggcagttgggcagcaaatggtgcggacgcttgaagaccggaacttcccggttggaaaattgactttgttgtcatcggagcggtcagccggcaaaaaaatgcgctttcgcagcgaggagatcgaagtgcaggcggcatcgcccgagcgctttaacggggtcgacatcgccttgttcagcgccggcggcgccgtatcgaaagcgctggcgccggaagcggtgcggcgcggggcgatcgtgatcgacaatacgagcgcgtttcggatggaggaaaacgtgccgcttgtcgttccggaagtgaacgaaagcgatttgacgtggcataacggcattatcgccaatccgaactgctcgacgattcaaatggtcgtggcgttggagccgattcgaaaagcgtttggcttagagcgcgtcatcgtctcgacgtaccaggccgtctccggggcgggagcgcaggccattgaagagctcaacgagcagacgaaagccgtgctcgaaggcaagccggttgaggcgaacattttgccagtgaaatcggaccggaagcattacccaattgcgttcaacgccattccgcaaatcgataagtttcaagacaatggattcacgtttgaagagatgaaaatgatcaatgaaacaaaaaaaatcatgcatatgcctgagctgaaagtggcggcgacgtgcgtgcgcattccggtggcgagcggccattcggaatcggtgtacatcgaaattgaacaagacggcgtcaccgcctctgacttgcaggcggtgctccgcgaagcgccgggcgtcgtgcttcatgatgatccgagcgaacagttgtatccgatgccggccaattgcgtcggtaagtacgacgtgtgtgtcggacgcatccgccgcgatttggacaaccgccgcggctttcatctatcgattgtacctgacaacttgctgaaatgtgcaccctccaactctgtgcagatctgacaaagtttgttgaagctcaggctcatt

SEQ ID NO: 46676 - DNA, 939 bp, Bacillus stearothermophilus
gtctggagcattccggtcacgctcgcggtaacagaagaaaaagcgaaagagctcgccgtcggcgataaggcgaaactcgtttatcgtggcgacgtctacggcgtcattgagattgctgacatttaccgcccggacaaaacgaaagaagcgaagctcgtttataaaacggatgaacttgctcacccaggcgtgcgcaaactgtttgaaaagccggatgtgtatgtcggcggggagattacgcttgtcaaacggaccgacaaaggccaattcgccgcgttttattttgatccagcggaaacgcggaaaaagtttgctgagtttggctggaacaccgttgtcggcttccaaacgcgcaatccggttcaccgcgcccatgaatacattcaaaaatgcgcgctcgagatcgttgatggcctgtttttaaacccactcgtcggcgaaacgaaatcggacgatattccggctgacatccggatggaaagctatcaagtgctgctggaaaactattacccgaaagaccgcgttttcctcggcgtcttccaagctgcgatgcgctatgccggtccgcgtgaagccattttccacgcgatggtgcgcaaaaatttcggctgcacgcacttcatcgtcggccgcgaccacgctggtgtcggcaattattacggtacgtatgatgcgcaaaaaatcttcttgaactttacggctgaagagcttggcattacgccgctctttttcgaacatagcttttactgcacgaaatgcgaagggatggcatcgacaaaaacgtgtccgcatgacgcgaaataccatgtcgtcctttccggcacgaaagttcgtgaaatgctgcgcaacggccaagtgccgccgagcacgttcagccgcccggaagtggccgccgtcttgatcaaagggctgcaagaacgcgaaacggtcgccccgtca

SEQ ID NO: 46677 - DNA, 1043 bp, Bacillus stearothermophilus
attgataaaatgaaatttatcgcgggagatgggttgcggggaccgatcaaagtgaccggttcgaaaaacagcgcggtcgctttgtttcctgaagcgattttggccgattcgccggtgacgatcgaggggttgccggacatttcccgacgtgcacattttaggaagcttgatcgaagaaatcggcggctcgttttcgtttgacggcaaagaggcggtcatcgacccaacgaatatggtgtccatgccgcttccgaatgggaaggtgaaaaagctgcgcgcctcctactatttgatgggggcgatgcttggccgcttcaaaaaagcggttgtcggcttgccgggcggatgtcatctcggtccgcgcccgattgaccagcatatcaaagggtttgaggcgctgggcgccaccgtaacgaacgagcagggcgccatttatttgcgcgcggaagaactgcgcggagcccgcatttttttggacgtcgtcagcgtcggcgcgacgatcaacatcatgctggcggcggtgcgcgccaaagggcggacgattatcgaaaatgcggcgaaagagccggaaatcatcgatgtagcgacattgctttcgaatatgggcgcgaaaatcaaaggagccggcaccgatgtgatccgcattgacggcgtcgaaacattatcgggttgccgccatgccatcatcccggatcggatcgaagccgggacgtacatgattgccgccgcggccaccaatggcgaagtcgtcgtcgacaacgtcatcccgcagcacgttgaatcgctgacggccaaattgcgcgaaatgggggtgcgcgtggagacgggggaagatcaaattctcgtctgcggcaccgacgttttgaaagcggttgacgtcaagacgctcgtctatccgggcttcccaactgatctgcagcagccgtttaccgcgctgctgacaaaagccaacggcacaagcgtcgtcaccgacacgatttacagcgcccgcttcaagcatgtcgatgaattgcggcgcatgaacgccaatgtaaaagtcgaag

SEQ ID NO: 46678 - DNA, 618 bp, Bacillus stearothermophilus
gatcggttggtgcaagcggcagacggcacggatttaaaattcggggcgcaaacgatgcactttgccgaccaaggggcgtacacgggcgaagtgagcccggtcatgctcaaagatctcggcgtcacgtacgtcatcctcggccattcggagcgccggcaaatgttcgcggaaacagatgagaccgtgaacaaaaaagtgttggccgccttcacccgcggcttgacgccgattgtttgctgcggcgaatcgcttgaggagcgggaagcggggcagacaaacgccgttgtcgcctcgcaagtggaaaaagcgctcgccggcttgacgccggatcaagtgaagcaagcggtcatcgcttacgagccgatttgggcgatcggcacgggtaaatcgtcgacgccggaagatgcgaacgacgtgtgcggccatatccgttcggtcgtttcgcgcttgtttggcccggaagcggcggaagcgatccgcatccaatacggcggcagcgtcaaaccggacaacatccgcgacttcttggcgcaagaacatatagacggcgccttagtcggcggggcgagcctcgagccggcttcattcttgcaattggtggaggcggggcgctatgag

SEQ ID NO: 46679 - DNA, 342 bp, Bacillus stearothermophilus
atgaacattttagagatcaaacaagtgaccaaaaaatttggtgacttcatcgctgtcgatcatatgtctcttacggctgccgaaggagaaatttttggcttcctcggagccaatggcgcgggaaaaagcacaaccatcaatatgattgctgggttgctgcgcccgaatgcaggagaaatcaagattctcggcaaggacatcgccaagcatcgccagtttgtcacacgacatatcggcgttgttccccaacagatcgccatctatgaaaatttgacggcgtatgagaatgtcgaatttcttgccggcttgtatggactgtgtggcgctgagttgcgccaaagg

SEQ ID NO: 46680 - DNA, 752 bp, Bacillus stearothermophilus
gccggctcagacgtcgcttctatccagacgacagccgtccgcgacggagatgactacattttaaacggacaaaaaacatggatttccctcgctgacatcgccgaccattttctcgtattcgcttatacggacaaatcgaaaaagcaccgcggcatttccgcctttatcgtcgaacggacgatgcccggcttttcgtcgcgccgattaaagggaaacttggcatccgctctggcaatacgggcgagctgttttttgacaacgtccgcgtctcgaaagaaaacttgctcggggaagaaggcgaaggattcaaaatcgccatgtcagcgcttgacaacggccgcttcaccgtcgccgccggcgcggtcggcctcattatggcatgtcttgaggcgagcgttaaatactgccacgaacgaaaaacattcggcaaagaaatcggccgccatcagctcgtccagcaaatgatcgcccgcatggaagctggtttgcaaatcagccgcctgctcgtttacaaagtcggctttctcaaaaacgaaggccggcgttgcacgagagaaacatcgctcgccaaatggatcgcctgcgactacgcgaaccaggcggccgacgatgccgtgcaaatccatggcgcctacggctattcgaacgaatacccggtcgagcgctacttgcgcaactcgaaagcgccggtcatttacgaaggaacgcgggaaattcatacgatcatgcaagccgaatatgtgctcggttac

SEQ ID NO: 46681 - DNA, 672 bp, Bacillus stearothermophilus
gcccatgccagcacagtcggcggcaaagtcgccatcaaccatccgttcggcaaaaatatgatcggcgctttccatcagccggaagcagttgtgtatgacacctcctttttgcgcacgctgcccgagcgcgagcttcggtccgggtttgccgaggtgatcaaacatgcgctgatccgcgaccgccgcttttacgactggctgcgcgcggaaatcaagacgctcgccgacttgcgcggcgagaaactcgcctattgcattgaaaagggcattgacattaaggcgtccgtcgtgcgtgaggatgaaaaagaaaccggggtgcgcgcccatttgaatttcggccatacgctcggccatgcgctggaaagcgagttaggctacggcgcgctcactcacggggaggcggttgcggttggcatgctgtttgccgtctttgtcagcgaacggttttacggccggtcgttcgctgagcatcgattggccgactggttcgccggatacggcttcccggtgtcgctgccgacaacggttcagacgcgccgcctgcttgagaagatgaaaggcgacaaaaaagcgtacgccggaacagtgcggatggtgcttctctgtgagatcggcgacgtggaagtggtggaactcgaagacgacaacctgctcacgtggctggacgagttt

SEQ ID NO: 46682 - DNA, 1119 bp, Bacillus stearothermophilus
cgccagctgcgccgggcagaggcttcaggcgctacggtcatcctgaacggaaagccgatgttgaatttagcgtccaataattatttagggttggcggatgataggcggctcatcgaagcgggctgcgaagcgatgcgggcctacggagccggagcgggcgcgtcgcggctcgtcgtcggcaatcatccgctctatgagcgggcggaagccgcgttgaaacagtggaaaaaagcagaggcggctcttattttcaacagcggctacacggccaacatcggcgtgctgacagctttaattggccgagatgatcttgtctttagcgatgagttgaaccatgcaagtttaattgatggcatccgcttgagcaaagccgcctgtttccgctatcgacatcatgacatcgatcagctggaatcattgttaaagcaatctccgcccgcgaagcggaaatggatcgtcaccgatgccgtcttcagcatggacggcgatatggcgccactcgaggagctggttgagttgaagcggcgttaccgtgccgttttgctcgttgacgaagcgcacagcggcggcgtattcggaccgaacggtgaagggctgcttcaccatttcgggcttgagaaggaagaggatgtgatcgccatcggcaccttcagcaaaggcgcttggcagcttcggagcgtatgtaacgggagagccgtggctggtcgactatttgatcaacagcgcccgcagcttgatttttacaaccgccttgccgccatcggtccttgccgccaatgaggctgccattcatattgtccaagctgagccaaagcggcgcgagcggctgcacgccctaagcgaaagattccgcaccaagctgaagcggcttgggtttgacacaggcggcagcgagacgccgatcgttcccgtgatcgtcggtccgaacgaccgggccgtggccatgagcgagcagctgcaagaagctggcatcgcggccgtcgccatccggccgccgaccgtccctgagggaacggcgcgcattcgcttttccatcaccgccgcgatgacggaagaagacattgatatggccgttgactgcatcgctttgcggggaagcagatcggattgatttcatac

SEQ ID NO: 46683 - DNA, 930 bp, Bacillus stearothermophilus
atcgagcttgacaacttgtgcaaaacgtatggggaccatcgggcggttgaccatttgtcgctttcgattcaaaaaggggaaatttttggcctccttggcccgaacggggcgggaaagacgacgacgattttgatgatgctcgggttcaccgaaccgacgtccggttcggtgagggtatgcgggatcgatccggtgcgaaacccgattgaggtgaaacggaaagtcgggtacttgccggatgatgtcggcttttaccatcacatgacaggcttggagaacttgttgtatacgggagcgttaaacggcattccccgcgccgaggcggaaaagatggcgtgggagctgctcgagaaggtgaatttgactgatgcggcccataaaaaagcggggaaatactcgcggggaatgagacagcggctcggcttgcatgatgtgttgatgaagtgcccggaagtgatcattttgaatgacctgacgttgggcatctaccatgagggagtgcgcgagctgcttcgcttgatccgcagtttgagccgccattaaggcatcaccgttctattgtcctcgcaccaattgcaccatgtgcagcaaatttgcgacttagtcggcttgttcgtgggcggccggttgttggccgaaggcaatatcgagcgcctggcgcaacagctgtttttgcaggatgcgtatgtcatccatgtggtcgcttcaccgcttgacgcttccttacggtccaaaatcgaggcgattccgggcgtcaacaaagtggagcaaacggaaaatggatgggatgtgtattgccaaacggatgtgagtgccgccatcagccagacgatcatcgaatcaggatcttcgctgttccatctcagccggcgagattttggacttgatgagatttatcaccgctattttgaagggagggatgtacatgaa

SEQ ID NO: 46684 - DNA, 711 bp, Bacillus stearothermophilus
atggagcataaagctccgcttgtcgaatttttaggccttacttttaatttatctgatatgttgatgattacgatcacgagcttgatcgttttcatcattgctgttgcggctactcgctcgcttcagctgcgcccgacggggatgcaaaactttatggagtgggtctttgactttgtcagaggcatcattaacagcacgatggattggcaaacgggcggccgctttttgacgctgggcgtcacgctcatcatgtatgtgtttgtggccaatatgcttggactgccgttttccgtccatgtcaacggtgaactttggtggaaatcgccgaccgcggatgcgaccgttacgttgacgctggcggtgatggtcgtcggcctcacccactactatggcgtcaaaatgaaaggggcgtccgactatttgcgcgattacacccgtccagtcgcctggttgttcccgcttaaaatcatcgaagagtttgccaacacgctgacgctcggtttgcgtcttttcgggaacatttacgccggggaaattttgcttggcttgctcgccagccttggcacgcattacggtgtgcttggcgctgttggcgcagccatcccgatgatggtgtggcaagcgttcagtatttttgttggaacgattcaggcgttcatttttaccacgttcaccatggtttatatggctcataaggtcagtcatgaccat

SEQ ID NO: 46685 - DNA, 717 bp, Bacillus stearothermophilus
atgaaaaaagtacgcaaagcgatcattccggcggccgggcttgggacgcggtttttgccggcgacgaaggcaatgccgaaggagatgcttccgatcgttgataagccgacgattcaatatattgtcgaagaagccatcgcctcaggcattgaggacatcatcatcgtcaccgggaaagggaagcgggcgattgaggatcattttgactacgcgtttgagctggaacagatgctcaagcaaaaagggaagctggatctgcttgagaaagtgaaagagccgtcgaaggttgacatccactacattcgccaaaaagagccgaaagggctggggcatgcggtttggtgcgcgcgcaatttcattggagacgagccgtttgcggtgttgttgggcgatgatatcgtccaggcggaaaagccttgtttaaaacagctcattgagcagtatgaacaaacgttcagcttggtgatcggcgtcaagcgcgtgccggaggaagaaacgcatcgctacgggatcatcgacccgctcgagcagcaaggccggcgctaccaagtgcgccgcttcgtggaaaaaccagttcctggcacagcgccgtcgaacttggcgatcgtcggccgatacatgttgaccccggaaatttttttgtttttacagaaacaagaagtctggtcaggcggggagatttttctcaccgatgcgatcgggcggttgtatgaaatt

SEQ ID NO: 46686 - DNA, 1150 bp, Bacillus stearothermophilus
ttgacagaaacctttaaaaatgtatttggtgggggtgaagaacgagttcgtatcttcttcgcccccggccgcgtcaatttgatcggtgagcatacggattacaacggcgggcatgtgctgccgtgcgcgctcgagatcggcacgtatgcgcttgtccggcaaacggatgagccgtttgtccgcctttactcccaaaacttcccggaaacgggagtgatcactgtctcttacgatgacttggcataccggagcgagcacggctgggcgaactacccgaaagggatcttggctgcgtttcaagcgctcagcccgctggagaccggattggacattttgtattatggaacgatcccgaacggggcaggactgtcgtcatccgcgtcgattgaactcgtgaccgcggtcatgctcaacgaactggtcaggcgcgggcttgaccaactagaacttgtgaaaatgagccaaaccgtagaaaataaatacgttggggtcaattgcggcattatggatcagtttggcggtcggcatggggaaacaagattgcgccattctattaaactgccagacgctagagtaccgctatttgccgctcgtgctcaacgattgttcgattgtcatcgcgaacacaaacaaaaagcgcggcctggcggactcggcgtacaacgagcggcgggcgacgtgcgaggcggctcttgcgaagctgcaaagcgtgcggaacatcgcctcgctcggcgagctgacaagcgcggaactggcccgttatgcacatcttctttccccgcttgaacaaaaacgggcccgccatgcggtgacggaaaacgagcggacgcttgaagccgcccgggcgcttgagcggggagacctgatccgctttggcgagttgatgaaacagtcgcatttgtcgctgcgcaatgattacgaagtgacaggcgttgaactcgacacgctcgttgaagcggcatggtcgcacgaaggaacggtcggggcgcgcatgactggagcaggattcggcggctgcacggtgaacattgtgaaaaaggcatgcgttcaagatttcattgaacgggtcggaaacgcgtatgccgaaaaaatcggttatgaagcaagcttttatgtcgttgaagttggtgacggggcgagagaactcacg

SEQ ID NO: 46687 - DNA, 942 bp, Bacillus stearothermophilus
gtgaaaatcgcgattgccggggcggggtatgttgggcttgtgaccgctgcctgcttggctgataaaggtcatgatgtcatatgcgtggatgtcaatgaggaaaaaattcggcgattgaatgaaggaatcgtccccatttatgaaccggggctcgaaccgctcatccaacggaacagcgcccgccttcgctttaccacaaacgatgcggaagcgtatcgatgggcggaagtgatcatggtcgcggtcggcaccccgccgctgccggatggttctgtgcagcttgacgccgtttggaaggcgctcggccgcattgcgatggcggtggagcgcgactgccttgtggccatcaaatcgaccgtgccagtcggtacgggagacgaagcggctcgctttttggaggaacacggacgcggcggggtgcgtatcgacattgtgtccaacccggagtttttgtcacaaggaacggcggtgcgcgatacgttgcaggcgccgcgcattgtgttaggcgtcgaatcggagagagctgagcggatgatgaaggacctctacgccccgtttgcgctcccgtacgtcgtcaccgaccgcaaaagcgcagagatgatcaagtacgccgccaatgtgtttttggcgctgaaaatttcctacatcaacgagatcgccaacgtatgcgagttggtaggcgccgacattcaggcggtggcggaaggaatcggcatggatccgcgcattggccgccgctttttgcgcgccggcgtcgggtatggaggctcatgcctgccgaaagatgcgagcgcgctttattctttggggggttcccaccgctattctctcaaaacgggatgggcgggaatggaccgttatgaaaaacaaaaatggaaactggtcgagaaagcgcgcgcccacctttgggtggtcaacgaaccaacactgggccggcttggc

SEQ ID NO: 46688 - DNA, 999 bp, Bacillus stearothermophilus
caattggaacagtgggacaagcagtacgtctggcatccatttacgcaaatgaagcagtatgccaaagaacgccccttgatcattgaacgcgggcaaggaagctatttgtacgatgtcgacggcaaccggtacttggacggctatgcgtcgctatgggtcaatgtccacggccataacgatccggagctgaatgcggcgcttcgcgagcaattggagaaaattgcccattcgacattgcttggttcggcgaatgtgccgtcgattttgttggccaaacggctgcttgaatattggccgcacatgtcaaaagtgttttattccgataccggggcggcggcggtggaaatcgcgctcaagatcgcctatcagtattggaaaaacatcgacccggtccaatatgcgaagaagaacaagtttgtctcgttgaaggaagcgtaccacggcgatacggtcggggcggtgagcgttggcggcatggaaacgttccaccgcatttttgcgccgcttttgtttgagcggatcgaagtgccgtcgccgtacgtgtaccgtatggacgaatacggaagcgagcaggagatcgtcggctattgtttgcgcgagcttgaacgggtgcttgaggagcagcacgatcaaatcgccgcggttgtcatcgagccgcttgtgcaaggagcggcggggatcatcgtccatccgcgcgggtttttaaaaggagtggaaaggctttgccgccggtatggggtgctcttcatttgcgacgaggtcgccgtcggctttggccgcaccggcaccatgttcgcttgtgagcaggaagaggtgcagcctgatcttgtctgccttgggaaagggatcacgggaggatatttgccgctcgcggccacactggtcacggaagagatttatgcggcatttctcggcgatgtggacgaagacaaaacgttttaccacggccatacgtacacgggaaaccagctcacttgttccgttgcgctgaaaaacatc

SEQ ID NO: 46689 - DNA, 309 bp, Bacillus stearothermophilus
gtggaggggcaaaccgtcatcccgctccgcgagcggaacatcattttgatcggctttatgggagcggggaaaacaacgatcgggcagctggttgcgaaaaagctgtaccgcgactttattgatgtcgacgcggaaatcgagcggcggcacgggatgacgattccggagatgttcgcgcaaaaaggggaagcgtactttcggcaggttgagcgccaactgatcgttgatttgtgcacaaatacaaggctgaaaattctttcgctcggcggcggcgcgtatttgcaggaagacgtgcggcgcgtctgtttg

SEQ ID NO: 46690 - DNA, 1230 bp, Bacillus stearothermophilus
atgacagcaacgaaacaaacggcgcaagtaacggcggtcgccgatggaacggtcgtcacgccgaagggatttcaagcggctggggtgcacgccgggctgcgctattcgaaaaacgatttaggggttattctatgcgacgtgcccgcttcggcggcggcggtgtatacgcaaagccatttccaggcggcgccgctcaaagtgacgcaggcgagcctcgctgtagaacaaaaattgcaggcgggcatcgtcaacagcgcatgcgcgaacgcctgcaccggcgagcaggggctcaaggacgcctatgaaatgcgcgagctgtgcgcgaaacagtttggcctggcgctgcaccatgtggctgtcgcttcaacgggcgtgatcggggaatatttgccgatggaaaaaattcgcgcgggcatcgaaaagcttgttccaggggcgacgatggcggatgctgaggcgtttcaaacggcgattttaacgacggatacggtgatgaagcgcgcctgttaccaaacgaccgtcgatgggaaaacggtcaccgtcggcggggcggcgaaaggatcggggatgatccatccgaacatggcgacgatgctcgcgttcattacgaccgatgccaatgtttcgtcgccggtgctgcacgcggcgctgcggtcgattacggacgtttcgtttaaccaaattacggtcgacggcgatacgtcgacaaatgatatggtcgtcgtgatggcaagcggtcttgctggaaatgatgagttgacgccggatcatccggactgggaaaacttttatgaggcgctgcggaaaacgtgcgaagatttggcgaagcaaatcgccaaagacggcgagggggcgacgaagctcattgaagtgcgcgtgcgcggcgcgaaaacggatgaggaagcgaaaaaaatcgccaagcaaatcgtcggctccaacttagtgaaaacggccgtttacggcgcggacgccaactgggggcggatcatcggcgcgatcggctattcggatgccgaagtgaacccggacaacgtcgatgtcgcgatcgggccgattgtgatgctgaaaggaagcgagccgcagccgttctcggaagaagaagcgacggcgtatttgcaacaagagacggtcgtcattgaagtggatttgcacttgggcgatggcttcggcgtcgcgtggggctgcgacttgacatacgattatgtgaaaattaacgccagctatcggacg

SEQ ID NO: 46691 - DNA, 666 bp, Bacillus stearothermophilus
caaaagccggtgtacgggctgaccgagtggaatcgggagccggtgcgcgagcccgtgctcctatccaacccgggctgttatccgacggcgacgctgcttggcttggcgccgcttgtcaaagaaggattgattaaggaagactcgatcatcgttgacgccaagtccggcgtatcgggcgcggggcggaaagcagggcttgggacgcatttttccgaagtgaacgaaaacgtgaaaatttataaagtgaacgtccatcagcacattccggaaattgagcaaacgctgcaaacgtggaatgaagcgatggagccgattacgttcagcacccatttgattccgatgacacggggcattatggcgacgatctatgcgaaggcgaaacaatcgatttcgccaaacgatttggtagatttatataaaacaagttatgaaggttcgccgtttgtccgcatccgtcaacttggacagtttccagcgacaaaagaagtgtacggctcaaattattgcgacatcggcttcgcatatgatgaacggacgggacgggtgacggtcgtgtcggtgatcgacaacttgatgaaaggcgctgccgggcaggcggtgcaaaacttcaatttgatgatgggctgggatgaggccgagggcctccaatccttgccgatctatccg

SEQ ID NO: 46692 - DNA, 1290 bp, Bacillus stearothermophilus
caaatcgcagtcgttggcgtcgactataaaaccgcccctgtagaaatccgcgaaaagctcgcgtttgcggaagcggaactcggtgcggcgatgaaacagctcgccaagcaaaaaagcgtgctcgaaaatgtgatcgtctcgacgtgcaaccggacggaagtttatgcagtggttgatcaactgcataccgggcgttactatatgaaagcatttttagccgaatggtttggcgtcaaagtggaagcgattgctccgtatttgcgtgtgcttgaaggagaggcggccataaagcatttgttccgcgtggcggccggccttgattcgatggtgcttggggaaacgcaaattttagggcaagtgaaagacagctatttgctcgctcaagaggtcgggacgagcggcacgattttcaatcatctgttcaagcaggcggtgacgtttgcgaagcgcgcccactcggaaacgggcatcggtgcgcacgctgtatcggtcagctatgcggcggttgagctggcgaagaagattttcggccgccttgccggcaagcacgtcttgattatcggggccggcaaaatggggacgctggcggcgcaaaacttgtacggcagcggcgtcgggaaggtgacggtcgtcaatcggacgcttgaaaaagcgaaacagcttgctaagcagtttgccggcgaagcgaagccgctcggcgaattgtcatgcgctttgctggaagcggatatcgtcatcagctcgacgggagccaaaggctatattttgacgaaggaaatggtggcgccgcttgagaaaatgcgcaaaggccgcccgctctttatggttgacatcgcggtgccgcgcgatttggatccggcgttggctgatttggaaacggtgtttttgtacgacattgacgatttgcaagatgtggtggcggccaacttggcggaacggcaaaaggcagcggctcgcattgaaatgatgatcgaagcggaacttatggcgttcagccaatggctgcagacgctcggcgtcgtgccagtcattgccgcattgcgcgaaaaggcgctggccatccaagcggaaacgatgaaaagtttggagcggaaactgccgcatttgtcggagcgcgactggaaagtgttgaataagcatacgaaaagcattattaaccagctgctccgcgatccgattttgcaggcgaaggaactcgctgccggcccgaatgccgaagaggcgcttttgctgtttatgaaaattttcaatatcgaagatgcggtgaaagccgagcggcatatgcagcag

SEQ ID NO: 46693 - DNA, 555 bp, Bacillus stearothermophilus
attgaggccgatttgtcggcaccggatggggtggaaaagctcgtttcgcaaatcgatcgcccggttgatgccatcgtttacaacagcggtgcaagctattacggattgttgaccgacatgaacgatgaattaatcgagcggatggtgcggcttcacatgacaagcccggcgttgctcatcaaaaggctgatcccatcaatggtggcgagaaagcgcggtcatattgtgttcatttcctcgatttggggattgtgcggcgcttcgtgcgaggcggtgtactcgatgacaaagggagggcagaacgcgtttgccaaggcgctcgccaaggagcttgccccaagcggcattcgcgtcaacgctgttgcaccgggggcgattgataccgatatgctgcgggtgtttcgtcctgaggagctggaagcgctcactgacgaaattccagccggccggctcggcaccccggatgaggtggcggaaacggtggcgtttttgctgtctgatgccgcttcgtatatcaccggccaagtcatttccgtcaacggcggctggtattgt

SEQ ID NO: 46694 - DNA, 660 bp, Bacillus stearothermophilus
atgacgcttttagaagtgaaggatctattcggaggctacacggcgcaaaacgtgcttgaagacatgacgtttgcggtctaccgccgcgaaatggtcgccttgatcggcctaaatggagccggcaaaagcaccaccatcaaacatattatcggcttgatggaaccgcgccgcggcgcgatttccattaacggctatcggcttgcggacgggccggaaacgtatcgaaggcagtttgcttatatcccggaaacgccggtgttgtatgaagaattgacgcttgaggaacatttgcgtctagcggcgatggcgtacgggttgagcgaagcagagtatgaacgccgccttccgccgctgcttcgcgagtttcgattggagcggcggctttcctcgtttccggctcatttttcgaaaggaatgaagcaaaaagtcatgattgtatgcgcctttttgcttgaaccgccgctttatatcatcgatgagccgtttctctggctcgatccgattgccattcacgccctgcttgagcgaatgaatgaacagaaagcgaatggggcggacattttgctgcccacacacattttggcgacggcagagcggtattgcgactaattcgttattttgcacaacgggcgccgcaaagccaaagggacgctcgatgac

SEQ ID NO: 46695 - DNA, 909 bp, Bacillus stearothermophilus
gaagtgccggcagtgcaaatcaaccgaatgtgcggatcggggcagcaggcgattcatttcgccgcccaggaaatccgctccggcgatatggatgtcacgatcgccgccggagtcgaaagcatgacgaaagtgccgattttaagcgatggcaacgagcagacgattccgccgtcgcttcatgaaaaatacgaattcatccaccagggcgtctcggctgagcggatcgccaaaaaatacggcctaacgcgcgaggagcttgacgcctacgcgtacgaaagccatcaacgcgccttggcggccttgcgcgaagggaagtttcgcgcggaaatcgtcccggtgaaagggcttgaccgcgacgggcgcgagatcctcgtcgcccttgacgaagggccgcgggccgatacatcgccggaagcgctcgccgcgctcaagccggtgtttcaagaagacggcctcatcaccgctggcaatgcgagccaaatgagcgacggggcggccgctgtgcttttgatggaacgggaggcggcgaggcggttcggactgaagccgaaagcgcgcattgtcgcgcaaacggtcgtcggctccgacccgacgtatatgctcgatggcgtcattccggcgacgaggcaagtgctgaaaaaagccagcctctcgatcgatgacatcgacctcattgaaatcaacgaagcgttcgccccggtcgtgctcgcctggcaaaaagaaatcggcgctccgcttgagaaggtgaatgtcaacggcggcgccattgcgcttggccatccgctcggcgccaccggtgcgaagctcatgacgtcgcttgttcatgaacttgaacggcgcggcggccgctatgggctattgacgatttgcatcggccacgggatggcgacagccacgatcatcgagcgg

SEQ ID NO: 46696 - DNA, 925 bp, Bacillus stearothermophilus
gcggcgagcgcgggaaaacaaaggactcctcaaaaaacattcgtggctgccccgtcagtgcgaaagtttgcccgcgagcagaacgtgtctttagaggaaatcactccaagcggaaagaacggaagaatattgaaaagcgatattgaagcagcattgtcggttcggcagcaaaaagcaacagatgaggctgctgccagtgttgagattttagagaagcaggaaagccgggaaaaagtgcgccgagtgccgctgacaggcatccgcaaggctatcgccaaagcgatggtgcggtcaacgcggaccattccgcaagtcacccattttggcgagcccgatgcgacccgtcttgttcaacatcgccgacggatccaaccgctagccgagcaacaaggggtaaaactgacctatttagcctatgtggtaaaagcgctggcagcgcgtgttgaaaaagtatccaatgctcaacgcttcgcttgatgaggaacgagaagaaatcgttattcacgaattcattcacattgggtttgcggttgacactgaccgtggattgctcgtcccggtgattcgtgatgcggatcaaaaatcgttgttccaaattgcgaaagaaattgaagaattgacggcgaaggcgagagcgggaacgattcaagcggtggagatgagcggagggacatgcacggtttcgaacatcggctcggccaatggttcgtggttcacgccgattattcattatccacagtcttgtcttttaggaatcgggaaagttgagaaaaaaccggtggtcgtcgatgattcgattgagattgcttctgtgatgccgctgtcccttacttacgatcaccgtcttattgatgggatgatggctcaacacgccttaaatgaatgtcaaacgtacttgtctgaaccggattggctgcttgttatg

SEQ ID NO: 46697 - DNA, 1441 bp, Bacillus stearothermophilus
aaatcgctcgtgttagcggaaaagccgagcgtcgctcgcgacatcgcccgcgtgctcggctgcaaagaaacgcataaaccatattttgaagggccgcgctacatcgtcacctgggcgctcggccatttagttgagctgaagatgccggaagactacgaccggaaatatgaaacatggcggctggaggacttgccgatcatcccaaagaaaatgggcttgaaagtcatccggcaaacgagccaccagtttcgcgccattgaacggttggcgaaacgaccggatgtgaaagatgtcatcatcgcgaccgacgcgggccgtgaaggggagcttgtggcgcgctggattttagagatgatcggttggacgaagccgatttggcggctatggatttcgtcgcaaaccgaccgcgccatccgcgacggcttccgccaactcaagcccggggcgcaatttgaccggctgtatcaatcggccgtctgccgcgccgaagccgactggctgatcgggttaaacgtctcgcgcgccttgacgacaaaatacaacgatccgctttcggccgggcgcgtgcagacgccaacgctcgcgatgatcatcgagcgcgaacgcgagatccaatcgttcgttcccgtgccatattggacgattcgggcgaagatcggttccatcacgcccgtatgggagcggcatggaggacatcgtctgtttgacctaagacgaagcgaagcagctgctcgcccgccttgacggtcagccggcgcgcgtcgtgtccgtcaagcggaaacgaaaaagcgagcccgccccgctgccgtatgatttaaccgagctgcagcgggacgcgaacaagcggtttggcttttcggcgaaaaagacgctctcggtgttgcagcggctgtatgaacaacacaaactcgtcacgtacccgcgcaccgattcgcgttatttgccaagcgatatggaagcgacgatgatcgagcggttgttggcgatgaaatccggttatgaggacgtcatcgctccgctccttgccaaaggcaaagccaaagcagccaagcgggtatttaacgatgacaaagtgaccgatcatcacgccatcgttccaacggatgaacggctcaaccttagcaggctgtcgactgatgagcgcaagctgtatgatctcatcgcccgtcgctttttggcgctgtttttcccgccgtatgaatccgaaacaacgacagctgtctttgacatcggcggcgaaatgtttgtcgccaaggagacggcgggtgtgaacttcggatttaaagcggctctcggcaaagaagaaacggatgccaaaccgacgttgtcacacctcgcagaaagtcagacgctcccatcggtgcaacttgagagggaacaatcgttcaccgaaccgcccgcccgttattcggaagctgatttgctcgcgcaaatggagaaa

SEQ ID NO: 46698 - DNA, 1083 bp, Bacillus stearothermophilus
ctcgtccgtccttcgtacgtgctcggcggccgggcgatggaaatcgtgtacaatcgcggcgagctgcttcattacatggaacacgccgtgcgcgtcaatccacagcacccagtgcttgtcgaccgctacatcactggcaaggaagtcgaagtcgatgccatcgccgacggcgagacggtcgtcatccccgggatcatggaacatatcgagcgggccggcgtccattccggcgactcgatcgccgtctacccgccccagacattaagcgcggaagtgatcgacaagatcgcggattacacgatccgactggcgcgcgggctgcatattgtcgggctgttgaacatccagtttgtcgtctcgggaagcgacgtctatgtcttggaagtgaacccgcgctcaagccgcacggtgccgtttttaagcaaaatcaccggcgtgccgatggcgaatctcgccacgaaagccattttaggggcgaagctcgccgagatgggctatgagacgggcgtctgcccggtgcgctccggcgtgtacgtgaaagtgccggtgttctcgtttgcgaaattgcgcaacgtcgacatttcgctcggcccggaaatgaagtcgaccggcgaagtgatcggcaaggacgtgacgtttgaaaaagcgctctataaggggcttgtcgcctcgggcatccatatccagccgcatggagcagtgctgttgacggtggccgacaaagataaagaagaagcggtcgacctggcgcgccgctttgccgacatcggctaccagctgttggcgacgaacggcacggcggaaacgttgaaagcggccggcattccggtgacggtcgtcaataaaatccactcggcgtcgccgaacattttggatgtcatccgccaagggaaggcgcaagtcgtcatcaatacgctgacgaaaggaaagcagccggaaagcgacggcttccgcatccgccgcgaagcggtcgaaaacggcatcccgtgcttgacgtcgctcgatacggcccgggcgatgctgcaagtgctcgaatcgatgacattttcaacgacggcgatgacggaagggctggtgcggtca

SEQ ID NO: 46699 - DNA, 843 bp, Bacillus stearothermophilus
tcgttttcgtttacgaaaatgcatggattgggtaatagttacatatacgtcgacttgttccgcgaaacattgcccgaggaggagctgccggcgatcgcccgcagcgtcgccgatgtccacacaggcatcggctccgatggcttgattctcatttgtccatcggagaaagcgccactcaaaatgcgcatttttaacagcgacggctcggaagggaaaaactgcggcaacggcttgcgctgcgtggcgaaatacgcgtacgagcacggcatcgtccgcgaccgcacctttttgattgaaacgctctccgggcttgtcgaagcccgtgttgctgtggcagatggcgaagtgacaagcgtgacggtcgatatgggcgagccgcgccttgagcgcagcgccattccgatggttggaccaaaagcggaacgagtcgtcgccgagccgtttgccatcgctgggggcgaatatgaaattacggcggtgtccatgggcaacccgcatgtgatcttttacgttgatgacatccaaaaagcgccggtgacgacgcttggcccgctcgtggaaaaggactcgcgctttccggaaggggtgaacgtcgagtttgtcgaagtggtgaacgagcgcgagcttcatttccgcgtctgggagcgcggctccggcgtgacgcaggcgtgcgggaccggagcgtgcgcggcggtcgtcgcttcggtgttaaacggcaaaacggtgcgcggggaggaaacggtcgtccatttggccggcggcgatttaacgatcgtatgggggcacgacgggcgcgtgcgcatgactggtccggcggagaccgtgtgcgccggcgtttattac

SEQ ID NO: 46700 - DNA, 1152 bp, Bacillus stearothermophilus
cgaaactgcgcattcgtctatagcgagcaatttcttcagtacaaatttcatgacgcccatccgttcaaccagctgcgggtcaaaatgacatacgacttgctttgcacgctcggcgcgctcgaagaccgccagatcgtcgccccgcgcatggcgaccgatgacgagctggcgctcattcacgaccgctcctacatcgaggcggtgaaagcggccgggcgcggcgaactgtcggaagcggcggcgcaaaactacggccttggcaccgaggatacgccgattttcccaaacatgcacgaagcgagcgctcttttggtcggcagcaccctcaccgccgtcgacgcggttctttccggagcggccgagcatgcgctcaaccttggcggcggtctgcaccacggcttccgcggcaaagcatccggcttttgcgtctacaacgacagcgcggtcgccattcaatacatccgggagaaatacggactgcgcgtgttgtacgtcgacacggacgcccaccacggcgacggggtgcaatgggcgttttacgacgatccgaacgtttgcacgttttccattcataaaacggggcgctatttgttcccagggaccggaaatgtcaacgagcgcggcttaggcgcgggctacggctattcgttcaacattcccgttgatgcgttcacggaagacgaatcatggatcgccgcctatacgaccgcgcttcggaaaatcgccgactttttccgcccggatgtcatcgtgacgcaaaacggcgtcgacgcccactattacgatccgctcacccatttgtcggtgacgatgaaaacgtaccgcgccattccgaagctcgcgcacgaaatcgcgcatgaatattgcggcggacgctggatcgccgtcggcggcggcggctatgacatctggcgcgtcgtgccgcgggcatgggcgctcctttggctcgagatgacgggacaagccgatgtgtccggcccgctgccggatgagtggcgcgaacgttggcaaccgctttcacccgtcgcgcttcctcttgagtgggacgacccggatgacttgtatcccccgatcccgcgcaaggcggagatcagcgaaaaaaatgcgcaaacggtggaaaaggcgttgtatttcattcgcagtcaacgccgg

SEQ ID NO: 46701 - DNA, 1065 bp, Bacillus stearothermophilus
tcgtttcaaccgactgaagaagaacaggcgttttttcaagtcgcccgcagccttgccgtcgagaaaattcggccggccgcgagagagtgtgagaaacgccggatcgtttcggctgacttgagtgaccgggtggatgagctcggcttgtcggcgctcgagctcccggaatcgtggggaggcttggaactgccgcttctgtcgcaagcgatcatttggcaagggctcagctatggcgatttaggcgtcattcaagggcttccgggggccggggaggcgtcttccctctttcgtctgtcttccgagcaccgcgtgtggcaccggtaccgggagatggcgaaaggaggatggccgactgtcgcctggatcgacgaagcggaacaaaaagaaccgctgaaagaagcgattcgcgtgcgccggcgcggcagcgggtacgttgtggacggagtgtcgtctccagtccgcttggcgtcgaaagccgactgggcggtcatcgccgctagggacgaagaagaagaaacggtattgctcgctttggatgagcgagtatgggagatcgaagaaggagacataaggcttgggctgctggctgccggcatcgctcgccttcggtttgcggaagtgtacgccggtccggaacaactcgttgcctgcggctcggaagcggatgcattgctcaaccgcgtgcgcgcccgaaaccaagtcatcgaagcggcgaaggaagtcggcttgatggaggcggcgcttgattacaccattgaatacaccgcgggaagaaaggcgttcgggcaagagatcgccaagtttcaaggcgtgtcgtttacgatcgcagagatggcgttcgaatgccgcggggcgaaatggcttgtatggcaagcggccgctgcagttgaccgaggggatgaacaggcgggcggctacgcctggagcgcgttgtcgcgagctcatcgctccctgcgctatgacaccgatcaggccgtgcaaatgctcggcgggcacggctatgagcaagaatatccggccgaaaaatggatgcgcgacgcccaggcgcaagtgatgctgtacggt

SEQ ID NO: 46702 - DNA, 708 bp, Bacillus stearothermophilus
atggggattacggcggaaaacttagcgaaaaaatagggcatcagccgtgaagaacaagacgcattcgccttgcgcagccagcagcgcatggcgcgcgccatgcaggaagggcgatttgacgagcaaattgtgcccattgccgtgccggtgaaaaaaggggagccgttcatcttcgatacggacgaacatccgcggccaaacacaaccatggaagcgctcgcaaaactgccgccggcgtttttggaaggcggaacggtgacggccgggaacagttccggattgaacgacggggcgtcggcgctcgtcatcatgtcgcgggaaaaagcagaggagcttggcttaaagccgcttgccgccatccgcgcccatgcggtcgccggagttgatccgaacatcatgggcattggcccggtgccggcgacaagaaaagtgcttgaaaaggcggggctgacgcttgatgagatggacatcattgaaatcaatgaagcgtttgccgcgcaagtgatcgcctgcgaccgtgagcttgagatggatcccgaaaaagtgaacataaacggcggcgccatcgcccatggccatccgctcggcgcgacgggggcgattttgatcacaaaagcggtgtatgaactgaagcgccgcggagggaaatacgcgctcattaccgcgtgcatcggcggcggtcaaggcattgcgaccatcattgagaga

SEQ ID NO: 46703 - DNA, 1134 bp, Bacillus stearothermophilus
gaccgcgaagggcagccgcgcctcattaagtacgaccggtttggaaacgacatttctgaagtgtgggtgaacgaaggatacgagcagacggcaaaacagacgtacgaaacggggattgtcggctatgtgcacaagccgattcccgagcttgggagaaaaggaaactatgtttattcatatgcccaagggtatgtcttatcccaagcagagcctgggttttactgcccggtgacgctgacgatggcgaccgcctatgtgctcgagcattttgccgatgaaaagctgaaggcgacgtatttgccccatgtcatctccaccggggaagtcgagttgtacgaaggggcgacgtttttaactgagcgccaaggagggtcggacgttggcgccaatgcggtgcgcgccgtgccgtgcggcgatcattataagttatacggggaaaaatattttgccagcaatgctgcccgctgcggcgtggcgctcgtattggcgcgcatcgacgggagcgggccggggacgaaagggctgagcttgttccttgtcccgtggcgcaaagaagatgggacgttaaacggcatctcgattcgccgcctgaaagacaagttaggcgtgcgcgccgtgccgtccgccgaagtcgtgtttgacggcgccaaggcgtatgtcgtcggcgatccggcgaaaggcttctattatatgatggaagtgctcaatctgtcgcgcgtctgcaatgcggttgcttccgtcggcatcatgaagcgggcgcttgaagaggcgaaacaatacgctgagcgacgcactgcctttggccatgtcttgacggattacccgatggtgcgcgagacgcttgccaatttgacggcgagacaggaagtggaaacgagcgcctgctttgacatgatcgccttgtttgaccgcgtcatggccgcgccgcatgaagcgagcgaggcggagaaagcatggctcaggctgctgattgcactccttaagatgcgcaccgccgaagaggcgatcgcgttcagccatgaggcgattgaactgcacggcggcaacgggtatatccaagattttgtcaccccgcgcctgcttcgtggaccccaagtgctggccctttgggagggaacggcgaacattttggcc

SEQ ID NO: 46704 - DNA, 1716 bp, Bacillus stearothermophilus
aaatttgcccgcgtggcgctcaagacacggcatattgactacaacggacgcttttgcatgtcggcagccgcagcggccatgaacgacgcattcggtcttgaccgcgggttgacgaatccactgtccgatattccgctcgctcagacgatcattttggctgggaccaatatcgccgaatgccagccgacgttgatgccgtatttttacgaagcgaagaaaaacggagcttttatcattgtggtggatccgcgggaaacgaaaacggcggcgttggccgatctgcacctgccgctcaagcccggaacggatgcggcattggccgtcggcataggaaaagtgttgcttgacgaaggatttatcgatgaaacatttgtgcgtgaacggacggttgggtttgccgaatggaaacagcacatagaagcggtgaagatggacgagatcgcccgggtgaccgacgtgccggccgagaagatccgcttggcggcacgaaagtacggggaggctgccgatgcgatcgtgctcacggcgcgcggccttgaacagcaagcggacggctatgcggcggtcagacactggatgaatgtcgtattggcgacagggaaaatcggccggcccggttcgggttttggatcgatcactgggcaaggaaacggacaaggcggccgcgagcatggacaaaaagccgatcagctgccgggttatcgaagcattgagcatctggaacaccgccggtatattgcgggcatatggggcatttcgccagatgagctgccgcgaaagggggtgtcagcgtatgaaatgatgcaaaaaatcgatgcgggtgagattaccgggctgttggtcatgggatcgaatcccgtcgtctccagcccgaacgcggcgtttgtggccaaagcgttgcaaaaactgaagtttcttgtcgttgcggatatgtttttgtcggaaacagccgagctggccgatctcgtgttgcctgtttcctcgtatttggaagatgaaggaacggtgacaaatgtcgaagggcgggtatgctttcggccggcggcgcgaaaacggccgggagaggtgaagcacgattggcaaattttatgcgcgatcgctcacaagcttggcaaaggccgttgcttttccttcacgtcagctgaagagattttcaacgaactgcggctggcgagccgcggcggcaaagcggactattatggtgtgacgtatgagcggctgcgccgcgaacgtgtctactggccttgccccgatccgcatcatcccgggactcctcgactgtttacggaacggtttgctcatccggacggcaaggcgcggtttgcggttttgccgttttggatggacaaagaggagacggatgaacgttatccgctttatttaacgacggggcgggtgcttgtccattatttaagtggaacgcagacgcggcgcagtccagcactggcggcgcggcagccggaggcgaccgtcgagatccacccgaggacggccaaacgatacgggatcggcccagggatgcttgtgcgcattgaaacgcggcgcggtgcggcggtcgtccgcagccgttacaatgatcaaattcgcgaggataccatttttgtcccattccactggagcggcctcgggcaaatcaacaacgttacgtccgatgagctcgatccgcattgtcggatgccggcgtttaagcggtgcgcagctcgggtgcggccggtt

SEQ ID NO: 46705 - DNA, 1125 bp, Bacillus stearothermophilus
aatgagctggggctggaagccgacggctttttggccgagcttgtcgatgacttgcagtcgaaaatcagcgcctatcgaagcgagccgcctcggttgtttgacgccattaaagcgagcggcgaagaccataacgcaaggctcatggcgctctatctgcaagattgcgggcttgaggcgagctacgtcagcccgcttgaagccggcattatcgtcaccgatgagccgggcaacgcccaagtgcttccggagtcgtatgacaaactgaagcagctgcgcgaacggcgcggcgttttggtcatcccaggatttttcggctattcccgatcgggccatatcgtcacgttcccgcgcggcgggtcggatattacgggctcgatcgtcgccgcgggcgtcaaagcggacgtgtacgaaaactttaccgacgtcgattcgatttattgcgtcaatccgtcgatcgtcgccgatgcccgcaagctgaaagaaatcacgtaccgcgagatgcgtgagctgtcgtattccggattttccgtctttcatgacgaggcgctcgagccggtctatcgcgccggcattcccgtttgcgtaaaaaacacaaacaacccggccgctccaggcacgtggatcgtcgccaagcgcaaccatatcgacgaaccggtcgccggcattgcgagcgacactggcttttgcagcatcaacatcagcaaatacttaatgaaccgtgagattggctttggccggcgcgtgctgcaaattttagaagacgaaggcatctcctacgaacatacgccgtccggcatcgacaacatgtcgatcattttgcgggcggatcagctcgcggacggaaaagagaagcgcatcctcgcccgcatccgcgaagagcttgccgtcgatgaggtgacgattgagtacggcttggcgctcattatggtcgtcggcgaaggaatggaaaagacgatcgggatggcggcgaaagccacgactgcgctcgctgacgccaacatcaacttggagatgatcaaccaaggttcgtccgaagtgagcatgatgttcggcgtcaaagaagaagtcgtcaacgaggcggttcgcgccttgtacaacgcctactttcaacaggcaaccgtaagt

SEQ ID NO: 46706 - DNA, 579 bp, Bacillus stearothermophilus
agggaagcgacgatcgcaagaacgacgaacgagacgagcattcagttatcgctttcgttggatggcgaagggaaggcggaactggaaacgggcgtgccgtttttaacccatatgctcgatttgttcgccaagcacggccagttcgatttgtacattgaggccaaaggcgacacgcatattgacgaccaccatacgacggaagacatcggcatttgcctcgggcaggcgatcaaggaagcgcttggcgacaaaaaaggaatcaagcggtacggcaacgcgtttgtgccgatggatgacgccttggcgcaagtggtgatcgacttgagcaatcgcccgcattttgagtttcgcggcgagtttccggcaacgaaagtcggcgcgtttgatgtcgagctcgtgcatgagtttttatggaaactggcgcttgaagcgcggatgaacttgcatgtcatcgtccattacgggcgcaatacgcaccatatgatcgaagcggtgtttaaggcgctcgggcgggcgttggatgaagcaacgatgatcgacccgcgcgtcaaaggcgttccgtcgacaaaagggatgctg

SEQ ID NO: 46707 - DNA, 822 bp, Bacillus stearothermophilus
cttgtttcccatgaatggctccttcgccatttgcacgacgaaaacacgcgcattcttgattgtcggttttggcttggcgatcctgcgaaaggagcggccgtttaccaggaagatcatattcccggtgccgtgtatatggatttggaacgcgacttgtcgggcccagtcggagagcacggcggccgccacccgcttccgtcggccgagcaagcggcggacgtgtttggccgggtcggcatcgatgaaacggtgaccgttgtcgcttacgacgaccaagacggggcgatggcggcgcgttgctggtggctgcttcgctatttcggccatgcccacgcatacgtattggacggcaattatcgtgaatggaagaagaaagggcatccggtgacgaacgtcgtccctgctgtggcgtcccgcccgtttcggccgcgtccggatcggtcatggctggcgacggttgaggatgtgcgcgccgccgtccgcgatcgctcggctgtgctcattgattcgcgtgaatggaagcgatatgccggcctggaagaaccgatcgaccgccgagccggccgcatcccaggagcggtgcaccggttttggaaagacggaatgacggaaggcggctactggaaaagcgctgtcgagcaggcggctcggtttgccgattttgaccgtgggcagccgttgatcgtttactgtggttccggcgtcaccgcctgcccgaacgtgttggcgctccacgaagctggttatcacaacgttcggctgtacgtcggcagtttcagcgactggatttcctatccggaccacccgattgaaacgggtgac

SEQ ID NO: 46708 - DNA, 546 bp, Bacillus stearothermophilus
gtgaccaagcaaaaagaaaaacgaggccgccgatggccatggtttgttgccgtttgtgttgtcgccacgcttcggttgttcgtgttcagcaattacatggtggaaggaaaatcgatgatgccgacgctagagagcggcaatttgctgatcgtcaataagctttcctacgacatcgggcctattcgccggttcgacattatcgtttttcacgccaacaaaaaggaagattacgtcaagcgggttatcggcctgcctggcgatcggatcgcgtacaaaaatgacatcttgtatgtcaacggaaaaaaagttgacgaaccgtatttgcgcccgtataagcaaaagctgcttgacggcaggctgaccggggattttacgcttgaggaggtgaccgggaaaacacgggtgcctcccggctgcattttcgttcttggcgacaaccggcttagcagctgggacagccgccattttgggtttgtcaaaatcaaccaaattgtcggcaaggtggactttcgctactggccgtttaaacagttcgcctttcagttt

SEQ ID NO: 46709 - DNA, 570 bp, Bacillus stearothermophilus
aacttgccgaataaaattacggtagcgcgcattatgctcatcccgtttttcttgatcgtgatgctcgttccgttcgggtggggaagcatccaaatcggcgggacagagcttccggttgcccatcttgccggcgcgctcattttcatcatcgcctcagcgacggactggatcgatggctactatgcccgcaaatacgggttggtgacgaatttaggaaaatttttagatccgcttgccgataaattgcttgtgtcggcggcgcttatcgtgcttgtcgagctcggggccgttccggcgtggatggtgattgtcatcatcagccgcgagtttgccgtcaccggcttgcggctcgtgcttgccggcgagggggaagtcgtcgctgccaacatgcttggcaaaatcaagacatggacgcaaattgtcgccatttccgctttattgttacataacttccctttctcgctcatttcgtttccgttcgctgaattggcgctgtgggtggcggtcattttcacgatttggtctggctgggattattttgcgaaaaacagacatgcgttttcccattcg

SEQ ID NO: 46710 - DNA, 1113 bp, Bacillus stearothermophilus
gagcaccatatgttccgcgcggcgtttcgcaagtttttggaaaaagaagcgtacccgcattataacgattgggagaagcgcggcatcattccgcgttcgttttgggcgaagatgggcgagaacggctttctttgcccgtgggtcgatgagaagtatgggggtctcaacgccgattttgcctactcggtcgtcatcaatgaagaactggaaaaagtcggatcgagcctcgtcggcatcggcctgcacaacgacatcgtcacgccgtatatcgcatcgtacggaaccgaggagcaaaaacaaaaatggctgccaaaatgcgtcaccggcgagctcatcacggcgatcgccatgaccgagccgggggcgggttcggatttggccaacatttcgacaacggcagtaaaagacggtgactactacatcgtcaacggacaaaaaacgtttatcacgaccggcattcatgccgacttgatcgtcgtcgcctgcaaaaccgacccgcaggcgaagccgccgcaccgcggcatcagcctgctcgtcgtggagcgggatacgccggggtttacgcgcggtcggaagctcgagaaagtcgggctgcacgcccaagataccgccgaactgtttttccaagatgcgaaagtgccggcatataatttgctcggcgaggaaggaaaaggtttttactatttgatggaaaagctccagcaggagcggctcgttgtcgccattgccgcacaaacggcggcggaagtgatgttttccttgacgaagcaatatgtcaaacagcgcacggcgttcggcaaacgggtgagcgagtttcagaccgtccagttccgccttgccgagatggcgacggaaatcgcccttggccgcacgtttgtcgaccgcgtcattgaagagcatatggcgggaaaacagatcgtcacggaagtgtcgatggcgaaatggtggattaccgagatggcaaaacgtgtcgcggccgaggcgatgcagctgcacggcggttatggttatatggaagaatatgagatcgcccggcgctatcgcgacattcccgtaagcgccatttacgctgggacgaatgagatgatgaaaacaatcatcgcccggcagcta

SEQ ID NO: 46711 - DNA, 1161 bp, Bacillus stearothermophilus
atgcaagagtttattttccgcaacccgacgaaactgattttcggaaaagggcagctcgaacggctcaaagaagaagtgccgcgctacggcaagaaagtgctgctcgtgtatggcggcggcagcatcaaacgaaacggactgtatgatgaagtgatgaagatattggggaacattggcgccgaggtcatcgaactgccaggcgtcgaaccgaacccgcgcgtctcgaccgtaagaaaaggggtggacatttgcaagcgggaaggcgtcgagtttttgctggcggttggcggcggcagcgtcatcgactgcacgaaagcgatcgccgccggggcgaaattcgatggcgatccgtgggactttatcacgaaaaaagcgcccgtcaccggcgccctgccgttcggcgtcgtcttgacgctggcggcgaccgggtcggagatgaattccggctcggtgatcacaaactgggagacgaaagaaaaatacggctggggcagcccgtttacgttcccgcaattttcgattttggatccgacgtatacgatgaccgttccgaaagaccatacggtgtatggcatcgttgatatgatgtcgcatgtgtttgagcaatatttccaccatacgccgaacacgccattgcaagaccggatgtgcgaagcggtgttgaaaaccgtgatcgaaacggcgcccaaactgatcaacgatttggaaaactacgagctgcgcgagacgatcatgtactcgggcacgatcgccttaaacggcttcttgcaaatgggcgtccgcggcgactgggcgacgcacaatattgagcatgccgtttccgccgtgtatgacatcccgcatgccgggggattggcgattttgttcccgaactggatgaagcatgtgctcgatgaaaacgtcagccgtttcgcccagctcgcggtgcgtgtgttcgatgtcgatccggcgggcaaatccgagcgcgatgtggcgcttgaaggcatcgagcggctgcgtgagttctggtcgagcctcggggcgccgtcgcggcttgcggactatggcatcggcgaggaaaacttggagctgatggccgataaagcgatggcgtttggcgagttcggccgtttcaaaacattgaaccgcgatgatgtgctcgccattttgcgcgcttccctt

SEQ ID NO: 46712 - DNA, 729 bp, Bacillus stearothermophilus
atgaagccaatttcaattatcggggttccgatggatttagggcagacacgccgcggcgttgatgtggggccgagcgcaatgcgttatgcaggcgtcatcgaacgtctggaacgtcttcattacgatattgaagatttgggagatattccgattgggaaagcagagcggttgcacgagcaaggagattcacggttgcgcaatttgaaagcggttgcggaggcgaatgagaaactcgcggcggcggttgaccaagtcgttcagcgggggcgcttcccacttgtgctgggcggcgaccatagcatcgccattggcacgctcgccggggtggcgaaacattatgagcggcttggagtgatctggtatgacgcgcacggcgacgtcaacaccgaggaaacgtcgccgtctggaaacattcatggcatgccgctggcggcgagcctcgggtttggccatccggcgctgacgcaaatcggcggatacagccccaaaatcaagccggaacatgtcgtgttgatcggcgtccgttcccttgatgaaggggagaagaagtttattcgcgaaaaaggaatcaaaatttacacgatgcatgaggttgatcggctcggaatgacaagggtgatggaagaaacgatcgcctatttaaaagaacgaacggatggcgttcatttgtcgcttgacttggatggccttgacccaagcgacgcaccgggagtcggaacgcctgtcatt

SEQ ID NO: 46713 - DNA, 912 bp, Bacillus stearothermophilus
ccggccagcgtgccagcgttttcattaaaccggatgtgcggctcgagccagcaggcgattcatagcgcggcgcaggcgattttggccggcgacatcgacatcgccatcgccgccggggtcgaaagcatgacgcgcgttccgatgggaagcgacatggggcggttcagccgccagctgacaagtcggtacaacatcgtgccgcaagggatttctgcggagatgatcgcgaaaaaatggggattgtcgcgggaagaactggacgaattttcgctcgccagccatgaaaaagcggcggcggcaaccgaccgcgggatgtttgagcgggaaatcattccgcttgacgtgccgggagaagatggcgcggtgcgctttgcccgcgatgaagggattcggcgcgacacctcgctcgaaaagttagcggcgttaacgccgtcattccagccgaaaggcggcgtcatcaccgccggcaattccagtcaagtcagtgatggagcggccggcgtgctgctcatgtcggcagaaaaggcggcagcgcttggcttgcggcctagagcccgcatcgtcgcccgcgcggtcgtcggagaagatccggtcatgatgctcaccggcattattcccgcgacgagaagcgttttgcaaaaggccggtttgcgcctcgatcagatggatgcgatcgaggtcaatgaagcgttcgcttccgtcgtcaaggcgtgggagcgggagctcgagccggatatgacaaaggtcaatccgcgcggcggggcgatcgccctcggccatccgctcggcgcgagcggcgcccggctgatgacaacgctgctccatgagcttgaggacatggacgggacatacggattgcaagtgatgtgcatcggctttggcatggcaaccgccacgatcatcgagcggctg

SEQ ID NO: 46714 - DNA, 1359 bp, Bacillus stearothermophilus
atgaatgaacggattgaacgcgactcgctcggcgaggtgcgggtgccggccgataaatactggggggcgcagacggagcggagccggcaaaacttccgcatcggcaaagaaacgatgccgcttgaactcatttacgcctatgccgagttgaaaaaagcggcggccatcgtcaaccatcgagccgggaaactgagcgaagcgaagcagcgggcgattgtggccgcgtgcgaggaaattttggcgggccaatgggatgaccattttccgctcgtcgtctggcagacgggaagcgggacgcagacgaacatgaacgtcaatgaagtcgtggcgagacgggcgagcgagctgctggatgagggggaagggcgcattcacccgaacgatgatgtgaacatgtcgcaaagctcgaacgacacattcccaactgtgatgcatatcgcgatcttcacgaagatccaaacgcacctcctgccagcgcttgatggcttgatcgggacattcgcgaccaaagaacgccaatatgggaagacgatcaaaatcgggcgcacccacttgcaagacgcgacgccgctcacatttgggcaggagatttccggttggcgggcgatgcttgagaaaagcaaggcgatgatcatggaggcgagtgagaagctgcttgatttggcgatcggcggcacggcggttggcaccggaatcaatgcgccgccgggatttggcgagcaagtggccgagcagctaaaaacgcagacgggctatccgttccgttcttcaaccaataaattccatgcgctgacaagccatgatgagatcgtgtatgtccacggagcgttgaaagcgctcgccgccgatttgatgaaaatcgccaacgatatccgctggctggcgagcgggccgcgctccgggctcggggagatcacgattccagccaatgaacccggaagctcgatcatgccggggaaagtgaatccaacgcaaagcgaagcgatgacgatggtcgctgtgcaagtgttcggcaatgacgccacgatcggctttgcggcgagccaaggcaacttccaattaaatgtgttcaagccggtcatcgcctataacgccattcagtccgtgcagctgctcggcgatgtgatccgctcgtttgatgaacggtgcgcccaagggctggaggcgaacgaagcgaaaatgaaagaatacgtggaccgctcactcatgctcgtgacggcgttgagcccgcatatcggctacgaccgggcgggggaaatcgccaagctcgcccatctcgaaaggttgacgctcaaggaaacggcgatgaaaacctggtattgtacgggggagcaggacgaagaatgggggaaaccggaa

SEQ ID NO: 46715 - DNA, 1674 bp, Bacillus stearothermophilus
acggtcgtcttggcgcttggcgtgcagcggatgatcaaacggaacgccatcgtccgcaagcttccggcggtggaaacgctcggctgcgcttcggtcatttgttccgacaaaacggggacgatgacggaaaacatgatgaccgtcacgcaagtatgggcaggcgggcggacatttgcggtaagcggcgttggtcttgaaacggatggcgagttttctgaacgcggccggacggttgatccgaaccgcgttcccgagctcgctcgcctattgacaatgggggtgctttgcaatagttcggagttgaaagaggaaaacggccggcgttacgtcgacggcgatccgacggaaggagcgctgctggtcgcggcggccaaagctggattggcgaaaggaatgcttttgcgtgagtacacgatcgaacaggagtttccgtttgattccgagcggaaaatgatgacggtcatcattcgcgaccgaaacggccgtcggtttgtcgtgacgaaaggggcgcccgatgtgctgcttgagcgggcggaccgccttgaatggaacggccgcgagcagatgctgaccccggcgtggaaagaaacgatcgagaaggcgattcgccagatggcgtcttccgccttgcgcacgatcgccgtcgcgtatcggccgctttcggaaacggaacggatcgagtcggagaaggatgcggagacaaagcttcggttcctcggcgtcgccggcatgatcgatccgccgcggcctgaggtgaagcaagcagtggcgcgatgcaaagaggcggggatgaaaacggtgatgatcaccggcgaccatgtgttgacagccaccgccatcgccaaacagcttggcgtgctgccgcctggcggaaaagtgatggatggggcgacgctctcgaagctgtcggtcgatgagctcgaacgcgtagttgatgagatttacgtgtttgcccgcgtcgctccggagcataagttaaaaattgtcaacgccctcaagcgtcgcggccatattgttgccatgaccggcgacggggtgaacgatgcgcccgctctgaaagcagccgatattggcgtcgccatgggccggtcggggacagaggtggcgaaagaggcggcgtcgctcgttttgttggatgacaactttgcgacgattgaggccgcgatcgaagaggggcgcaacatttacgaaaacattcgcaagtttatccgctacttgctcgcctcgaacgtcggggaaattctcgtcatgttgtttgcgatgctgcttgccttgccgctgccgctcgtgccgattcaaattttatgggtcaatcttgtcactgacggtttgccagccatggcgctcgggctcgaccaaccagaagaaaacgtgatgaagcggccgccgcgccgtcccgatgaaggggtgttcgcccgcgggctcggctggaaaatcgtaagccgcggctttttgatcggcgttgttacgctggctgcgtttctgaccgcctatgaacggagcggcgaggatctcgtttacgcccagacggcggcatttgcgacgcttgtgttggcccaattgatccatgtgttcgactgccgttgcgaccattcggtttttgaccgcagtccgttcgggaacatataccttgtcgcggcggtgatcgtgtcgctgcttttgctcgttgtcgtc

SEQ ID NO: 46716 - DNA, 756 bp, Bacillus stearothermophilus
atggcagaaacgcagtttactcgttttccgtttcaaccgtttatcatcgaagcgatcaagacgcttcgtttttataaaccgacggaaattcaagagcgcatcattccgggggcgctgcgcggcgaaagcatggtcggccaatcgcaaactggaacgggaaaaacacatgcgtacttattgccgatcatggaaaaaatcaagccggaacgcgccgaagtgcaagccgtcatcacggcgccgacgcgcgagttagcgacgcaaatttaccacgaaacgctgaaaattacgaagttttgcccgaaagatcggatgatcgtcgcccgttgcttgatcggcgggacggataagcaaaaagcgctcgaaaagctcaacgtgcagccgcatattgtcatcggcacgccggggcgcatcaacgatttcatccgcgagcaggcgcttgatgtgcatacggcccacatccttgtcgtcgatgaagccgacttgatgctcgatatgggctttatcactgatgtcgaccaaatcgccgcccggatgccgaaagacttgcaaatgttcgtcttttcagcgacgattccggaaaagctgaagccgtttttgaaaaaatatatggaaaacccgacctttgtccacgtcaacccgaaacagacggcgaacgaaaacatcgaacatgtgctcatcccgctgcgcggacgcgagaaaacaaaacttcttcatgatgtgctcctcagctacaacccgtatttggccatcgtattt

SEQ ID NO: 46717 - DNA, 1326 bp, Bacillus stearothermophilus
acgtacgccgaatgggagagggaagtgaaccggtgggcgaacgcgtttttggaagcgggcgtccgcaaaggagaccgcgtttcgacggtgctgtacaatacgcttgagctcgcgaccgccttgtttgcctgcgccaaaatcggcgcggtgttcaatccgatcaactttcggctgagggcggaagaaatcgcctatattttgacggacgccgagccgaaaatcgtgctgtttgaacgggcggtggaaccggaacttgccgcgattcacagccgtttcccgcacgtgtcattttggtcgatcgaccgcgatccgccgccgtttgccaaaaacgctcacgagcaggccgcgcgggccctaggggaagcgccgcgtgttcatgtggatgagagcgatctttatgccattatgtatacaagcggcacaactgggcgtccaaaaggagtgatgcaccgtcaccgcgacatgatcgagcaaagcgtcatttgccatggcgtcatgcgcatccgcgagacggatcgcaggctggcggcagcgccgctgttccattgcgccgagctgcattgctgcttgctgccgcgcgtgcatgccggagcggcgagcgtcattttgcaccagtttgacgccaagctcgtgcttgaaacgatcgaacgggagcggattacgatcatgtttggagccccgacgatgtggaacatgatcttgcaggagaatgtaagcggttacgatttatcttcgcttcgcctcgggctatacggcgccgctccgatggctccagcgcttgtcaggcaatgccaagagcagctcggcatcgagctgattcaagcgtacggcatgacggaaatggggccggcggtgacgtttttgttggaagacgagcagctgaaaaaagccggttccgctgcccgcgcctgcctgaaccatgagatccgcgtcgtccgtgcgcgtgaagacggtccgtccgacccagacgatgtgctgccgccatatgaagtcggtgaaattgtgatgcgcgggccgtgcatgatggctggctactacaagcgcgaggaagcgacggaaaaagcgttgtacaaaggttggtatcattccggcgacctcggctaccttgatgaagacggctacttgtatgtcgccgaccgggtcgatgacatggtgatcagcggcggggaaaacgtctatccgcgcgaagtcgagaacgtgttgtacgagcatccgaaagtgcttgatgtcgctgtgctcggcgagccggatgagctgtggggcgaacaagtcgtcgccttcgtcgtcaaaaaagatgacctcctgaccgccgatgagctcgagcag

SEQ ID NO: 46718 - DNA, 1575 bp, Bacillus stearothermophilus
atgaggcgggaagacttgattgctcccgagcgctacaatttaacatcggaaatggaacggcatgcggccgccggcccggatcggatcgcgttgaaatgggagagcgagcaaggcgaaacgaaagagattacatacggccgcttgatggcgtgcgccaaccaaattggaaacgctttcttatcgcatgggctcgaaaaaggcgataaagtgctcgtcatgatgccgcgcctcattgaaacatacgaagtgtatataggggtgctcaaagccgggcttgtcgtcatcccaagctcggagatgctgcggacaaaggatttgcaatatcggctcgtccatagcgaagcgaaagcggttgtcgcttatgcgccgtatacggacgaatttgcgccgattgacggcatcgaacgtttgacgaagttcgtcatcggggaaccccgggacggatggattccgcttgaagacgccatggccaaagagagcgaaacgcttgaggcggcggatacctcgcgcgatgatatggcgtttttgtcgtacacatccggcacgaccggcaatccgaaaggggtcgtccattgccatggttgggcgtatgcccacttgcgcacggctgcgaaaaactggctgtgcattgaagaaggcgacctcgtttgggcgacggccggaccgggatggccaaaatggatttggagcccgtttttatcggtgctcggctcgggggcgaccggtttcgtctactacggccgctttgagccggaaaaatatttgcagctattggaaaaatacaacatcaatgtgctgtgctgcacgccgaccgagtatcgtttgatggcgaaagtgccggacatcggccgctatcatctatctcatttgcacagcgccgtgtccgccggagagccgctcaaccgcgaagtgatcgacacgtttgccaagcatttcggcgtcgaagtgcgcgacggctacggtcagacagaaaacacgctgcttgtcggcgtcatgaaaggaatgcccatcaagccgggttcgatggggaaaccgacgccaggcaaccgcgtcgaaattatcgatgaaaacggcgagccgtgcccgcccggacaagtcggcgacatcgccgtccatatcgagacgccggcgctgtttaagtattattacaaagatccggagcggacagcgatgcagttccgcggcgactactacattacgggagacaaagcgcgcaaagacgaagacggctatttctggtttgaaggccgcggggatgacatcatcatcagcgccggctatacgatcggcccgtttgaagtcgaagacgcgcttgtcaagcacccagccgtaaaagagtgcgccgtcgtcgccagtccggatgaagtgcgcggccatgttgtcaaagcgtttgtcgtgctgcgcgacggggtcgacaaagacgatccgtctctgattccggccctgcaagaacatgtgaaacagttgacggcgccgtacaaatacccgcgcaaaatcgagtttgtcgacgatttgccgaaaacggcgtccggaaaaatccgccgcgtcgagctgcgcgagcgggaagcccgcctt

SEQ ID NO: 46719 - DNA, 940 bp, Bacillus stearothermophilus
ttgaaaatcgttgttactggaggagccggatttattggcagccatctagccgcccggttaagcggactcggatatgacgtggctgcagtggattgttttcatccatattattctgctgaacggaaagagcggcagtttcagacgctcaccggcggtcgggtgccgcttgtccgcttggatttgcttgatggggagcgaacgaaaaggtggctggtcgagtttcgccccgatgtcgtctaccatttggcggcgctgccgggcgtgccgtattccctcgaggagccgctcgcgtatatcgattatgacatcaaagcgacggtcaatgtgttggcggcggcgggggaagcgggtgcggcgcacgtgctgtttgcctcatcgtcatcggtgtacggcgaccgaggcaatgtgccgctccgggaagagatggctgacggccgcgtcgtgtcgccgtatgcggcggcgaaatacggagcggaatcgttttgtcatgcctatgcccatttgtatggctaccaaatgacgattttccgctatttcaccgtttacgggccgtggggtcgtccggatatggcgatcggcacgtttttgccgccgattgctggcggtcgagcagattgtcgtgtatggcaaggggacggcgcgcgattatacgtacatcgatgatattgtggagggcatgatcgcagcacttcaccgcagcggcgggcgaagcgaagtgttcaacttgggcgccggggcgcccgtcaccatggagcagctgctcgctgagttgcggaagcactttcccgatatgaaaatcgtgcacgcgccggagcggaaaggcgatgtgaaagcgacatgggcggacatcacgaaggcggagcgggcgtttggttacaagccgaaggtggcgtttgccgaagggctcgcccgcacggtggcgtgggcgcgcgaatatgag

SEQ ID NO: 46720 - DNA, 759 bp, Bacillus stearothermophilus
ccccttgcgaaaattacggaagagcaggcgaaacggctcgaggagcggctgaacgaagggcaagatgaagtcgagtttcgcatgtatttatggctcaaacatattgaaccgttcattgaagatgccgtcaagcgcatgcatgatgacggcatcaaagaagcggatgggatcgtcctagcccctcattattccacattcagcattcgctcgtacaatgagcgggcgaaagcggcagcggaaaagctcggcggaccgaccatttacacgattgatcaatggtatgacgagccgaagtttttgcaatattgggcagaacaagtgcgggcgatttttgccgccatgccggaacgtgagcgggagcgagctgtgctgatcgtatccgcacatagtttgccggaaaaaattattcaagccggtgacccgtatccaacgcagctcgaagatacagcgaaacgaattgctgatcaagccggcgtcgcccactatgccgtcggctggcaaagcgccggtcagacgccggaaccatggcttgggccggacgtgcaagacttgacgcgccagctttacgaagagcgcggctatacgtcgttcgtttacgcgccggtcggttttgtcgccgaccatttggaagtgttgtatgacaacgacattgagtgcaaacaggtgacggaagagatcggcgcccgctattaccgaccggagatgcccaacacgaatccattgtttattgatgcattggcgtcggttgtgttaaagcgg

SEQ ID NO: 46721 - DNA, 762 bp, Bacillus stearothermophilus
atgcatgtgttggacttatttaaaatcgaggggaaaaccgccattgtcactggcggtgggcgcgggctcggcgagcaaattgccgtcggtcttgccgaagccggggcgaacgtcgtcgtttgttcgcggaaagtggaagcgtgcgagcaagtgaaagaaaagcttgaacagctcggcgtccgttcgctggcgctgcggtgcgatgtgacgaatccggaggaggtcaaacatgtcgtcgaaacgaccgtcaaagagtttggcggcatcgacattttagtcaacaacagcggagcgacgtggggagcgccggtcgaggaaatgccgcttgaggcatggcaaaaggtgatcaacgtcaacgttaccggcacgtttctcatgagccaggcggtcggcaaggtgatgatcgccaaacaaacaggcggttccatcatcaatatcgcttccgtcgctggccttggcggcacgcacccggacattttaaatacgatcggctacaacacgagcaaaggggcgggtattacgtttacgagggacctagcagccaaatgggggaagcacggcattcgcgtcaacgcggaggctccgggctttttgccgacgaaaatgtcaaaagtggctcttgaacgcgttgggaaaaaagtgctcgagcatacgccgctcggccgctttggcggcgaagatgacttgaaaggggccgtcttgtttctcgcttccccggcgtccgcctttgtcacgggcgcgctcctcgtcgttgacggcggc

SEQ ID NO: 46722 - DNA, 923 bp, Bacillus stearothermophilus
gtgttcaactgctatgcgccgataccggcatatggaagtgctcgtccgctatggcacataggagcaaaagaaaaaatggctgatcccgctcttgaacggggaaatacgctcctgcttttcgatgacggagccggatgtcgcgtcgagtgatgcgacgaacattcgcgcctccattcgtccgcgacggcgatgagtatgtcatcaccgggcggaaatggtggtcgtctggcgccggcgacccgcgctgcaaagtcgccatcgtaatgggaaaaacgaaccccgatgcgccaaaacatgagcaacagtcgatgatcatcgttccgctcgatacgccgggagtgaaaatcgaacggatgctgccggtgttcggctttgaccatgcgccgcacgggcatgccgaaattacgtatgaccatgtgcgcgtaccgaaagaaaacatcatttggggcgaaggaaaagggttcgccatcgctcaaggccggcttggcccgggacggatccaccattgcatgcgcctcatcggagcggcggagcgagcgcttgaactcatgtgccggcgcgtacagtcgcgggtggcgttcggcaagccgctcgctgaacacggcgttatccgcgagtggatcgctcagtcgcgcattgagatcgagcaggcgcgcttgctgacgctaaaggcggcgtacatgatggatacggtcggcaacaaagcggcgcgcaaagaaattgcgatgattaaagtggtggcgcccaatgtcgctttgaaggtcatcgaccgtgccattcaggcgtttggcgccgctggggtgagcaacgattttccgcttgccgccatgtgggcgaactcgcgcacgctccgtctggccgatgggccggacgaagtgcataaagagcaagtggccaagcttgaattgcggcaatatcaacaa

SEQ ID NO: 46723 - DNA, 843 bp, Bacillus stearothermophilus
gtggcagaaacgattgcggtcatcggcgccggggtgatgggaagcggcatcgcgcaaacggcggcgatggcgggaaaaacggtgtatttatatgacgtgtccgaagcggccttgcaaaatgggctcgcttcggcggaaaaaagcttgcgccgctttgtcaaaaccggcgggctgtccgagccggaagcgcgagcggcgcttgggcgcatccgctcgaccgtcgatttggccgaagcggtgcgcggggcggatgtcgtcatcgaagccgtgccggaaaacttggcgctgaaaaaagacgtgtttcagcagcttgatcaactggcgaagccggacgccattttggcgaccaacacatccgagctgagcgtcacggcgcttgccgccgcgaccaaccggccggagaacgtcatcggcatgcattggttcaatccggcgccagtgatgaagttgatcgaaattgtgaaaggtgagacgacttccgacgacacagtcgacgccatccgtcggctgtctgtggagcttggcaaagaaacggtcgtcgtgaaagaccggcaagggtttgtgacgacacgggcgcttgccgcccatatgattgaatgtatccgcatgtacgaagaaggagttgcttccgctgaggatatcgacaaagcggtgcggcttggcctcaattatccgatgggaccctttgagctcgccgacatggtcgggcttgatacgctcctgtttgtgagtgaaaacatgacggaagcatacggcgaccggttccgggcgccgcagcttttgcgcaagctcgttgaagccgggcatttagggcggaagacggggaaagggttttacacgtat

SEQ ID NO: 46724 - DNA, 924 bp, Bacillus stearothermophilus
atgacccatcttttcgcattaagtgaactgccgcttgatgaaatccaccgtttgctcgatgaagcggaagcgttccgcagcgggcgcatctggcgcccggcggcgccgatgtacgtcgccaacttgtttttcgaaccgagcacgcgcacgaaatgcagcttcgagatggcggaacggaagcttgggcttcatgtcattccatttgacccggaacgctcgagcgtgcaaaaaggggagacgctgtacgataccgtacggacgcttgaggcgatcggcgtcgatgcggttgtcatccgccatcacgaagatgcgtatttcgaagcgctccgccatgcggtcggcattccgatcatcaacgccggtgacggctgcgggcaccatccgacccagtcgctcttggatttattgacgatccgccaagagtttggcgccttcactggcttgacggtggcgatcatcggcgacatccgtcatagccgcgtcgcccgctccaatgcggaagtgttgacaaggctgggggcaaacgtcctgttttccggaccggcggagtggaaagatgaaacgaatccgtacgggacgtacgtcgaagtcgacgaggccatcgcccgcgccgatgtcgtgatgcttttgcgcatccaacatgaacgccatgcggaaacgatggggctgacaaaagaagagtaccatgcgcggtacgggctgacgcttgagcgggcgcggcggatgaaatcgggcgccatcatcttgcacccggcgccggtcaaccgcggggtcgaaatcgcaagcgaacttgtcgaagcgaaggcatcgcgcatttttaaacaaatggaaaacggcgtctacatgcggatggctgtcttaaaacgggcaatggaagggagaatggagcatgggcgtatggctgaaaaatggcatgtcgttcaa

SEQ ID NO: 46725 - DNA, 1568 bp, Bacillus stearothermophilus
  unsure (1)..(1568): unsure at all n locations
atgaatgcgccgctcttgctccatcactttttcgatagcgccgtggctctctatggggacaagacagccatgatttgttcggggcgaacggtgacgtatcgtgagcttggagaacgggtgtcgagactcgccaacgggctgcgggggcttggcgttcgcaaaggcgaccgcgtggcgtacttggcgcccaacacgctcgagatgctcgaagggttttacggtgtgtttgaagtgggaggggtgatggtgccgctgaatacgcggctgaaaccggatgattacgtttttattttgaatcacagcgaaacgaaagtgttgtttgtggatcaggagctgtatgggctgattgcaccagtcaaaaacaagcttgaaacggtcgaggagatcattgtccaccataaaacagaggcgacgattgatgaaaccgcttacgatgaatggctcgccgcccagtcgtcagcgccggttccgcgcccgatgatcgatgagaatgatgtatgcagcttgctatatacgagcgggacgacaggcaacccaaaaggagtcatgctgacgcatcggaacaactatttgcatgcgcttgtgacgatgcaccatttgcgtgtgtccgaccgcgatacgtatttgcatgtgttgccgatgttccacgtcaacggatggggggctccgttttattacaccgccaacggggcaacgcaaatcggtttgcgtaaagtcgatccgaaagtcatttttgatcttgtcaaggaacatcaggtgacggttatgcatatggctccgactgtgctcaatatgttgctgcaatattatgagcaatatcaaccagatgtcccggaaggcgtgcgggtcgtcatcgccggttctgcgccgccgccggcatttgtcgcacgcgttgaggaaaagctcggctgggagtttatccaggtgtacggcatgaccgaatcatctccgctcagcacgatttcgctcattcgtccgcagcttgacggactgcctgtggagcaaaagcagcggatcaaggcaaaagccggctatccgatgatcggctgtgaagtgaaagtggtcgatgaaaacggcgacgaagtgcctcataatggccgggcgatcggcgaggtgatcgtccgcagccatggcgtcatgaaaggatattggaaaaacgaagaagcaaccgccgcaacgatccgcgacggctggctgtataccggcgatatggcgaccgtcgatgaatacgggcatattgatatcgttgaccggaaaaaggatattattattagcggaggggaaaatatttcgtcgattgaagtcgaagcgtgcgctttatgaacaccctgctgtgcttgaggcagccgtcattgccgcgccgcacgaaaaatggggagaaacgccgcatgcgtttgtctntcttgcgaccaaggcacaatgtgatagacgatgagctgatcgtcttttctcttgagaaactggctcatttaaaagccatatacagcgttacgtgtttttatgagctgccgaaaacagcctgcggaaaaattcagaaagtacacttgcgccgccaatattgggatgca

SEQ ID NO: 46726 - DNA, 1233 bp, Bacillus stearothermophilus
aaagtcctcttgacgaacaaggaacagcgcgccaaactgccgccgcgggacaacatgccgacattggaacacatttttgtcattgacggaccgtctcatgatcaagaccagccattttgggaaacgctttcgaaagagtcgactgagcactcgatcgaagaaacgacggtcgacgatctgctcgcgattcagtatacgtccggctcgaccgggatgccaaaaggcgccatgtggccgcataacgtgctcatcaacatttatccgtatatgcgctatgcgattggcctgcgcgatgacgatgtctttttcggcggggcggatccgggctgggcgtacgggctgatcttttgcaccttcgcgccgatggcctttggcgtgccgatcgtcttttacgaagggccgtttaagccggagacgtgctattccttgatggaaaaataccgggtgaccaatttcgcgtacgccccgaccgcgtaccgggcgatggcggcggccggcgcggacgtcattcgccgctatcaactgaacgtgcgcgccatgagctcggccggcgagccgctcaatccggaagtcatccgctttttccaagagcacgtgggcgttacgatccatgaccattatggcttgtcggaaacgttgatgctgatcggaaacttcaacgccgccgagatggaaatccggcccggatcgatgggatggccgctgccgggctttgacgtggccctgctcgatgagaatggaaccccagtcgccgacggcgaagtcggacaaattgcctttaacaccgactcgatccccaacgtctttaaggggtattggaaagaccctgaaaaaaccgccgagcggctcgtcggcaagtggtttttgaccggcgatttggcgacaaaagacgaagacgggtatttctggttccaaggacgggcggacgacatcatctcgagcgccggctaccgcatcgggccgtttgaaatcgaaagctgcctccttgagcatccggctgtcgtcgaagcagccgccgtcgggaagccggatcccgtcaaaggggaaatcgtcaaagcgtttgtcgtgctcagagaaggctttgcgccgtcggacgagctggccgacgagctgtccttgttcgtcaaaacgcgcttatccaagcatgaatacccgcgcgaagtcgaatttgtcgccgaactgccgaaaacgccgagcggaaaaatccagcggttcatcctgcgcaatcaagaa

SEQ ID NO: 46727 - DNA, 1945 bp, Bacillus stearothermophilus
gagtcgacatggggcgaagcactcgacttggtcgcggaaaagctcggggcgatcaagcggcaatacggcggcaacgccatcggttttatttcatcgtcaaaaatttccaacggagaaaactatttaatgcaaaagctcgcacggcaagtatttgaaacgaacaacgtcgacaactgttcgcgctactgccagtcgccggcgacggacggcctgttccgcacggtcggcatgggcggcgattccggcacgattcatgacatcgcttcagccggccttgtcatcatcatcggcgccaacccagcggaagggcatccggtcatcgccacccgcgtcaaacgggcgcataaactgtttggccaaaaactcattgttgcggacttgcgccgaaatgaaatggccgagcgggctgacctgttcatccgcccgaaacaaggcaccgaccaagtatggctgatggccgtgacaaaatacatcatcgaccaaggctggcacgatgaggcgttcattcgcgagcgcgtccatttctttgaagagtttaaacaattgctggaaaaatatacacttgattatgccgaacaagtcaccggcgtcgccaaagccgacctcatccgcatcgccgagatgatccgcgaagcagacggcacgtgcgtcctctggggcatgggggtcacgcaaaacacgggcggcagcgatacatcggcggcgatttccaacttgcttttggcaaccggcaactacggtcgtccgggggcgggcgcgttcccattgcgcggccataacaacgtccaaggcgcctgcgacatgggttcgcttcctgtctggctgcctggctaccaacatgtcaccgatgatgaggcgcgagcgaagtttgaaaaagcgtacggcgtccgcatcgatgcgaaaccaggccttgacaacatccaaatgctcgaagcggccgagcgcggtgagctgaaagcgatgtatatcatcggcgaagatatggcgcttgtcgactgcaacgccaaccatgtgcaagagacgttggcgaagcttgtactttgttgtccatcaacacattttcttgtgagaaacggcgcaatttgctgatgtcatcttgccatcagcgccaagtttggaaaaggaaggaactttcacgaataccgagcgccgcatccaccggttttaccaagcgctggagcctcttggcgactccaagccagactggtggatcattcaagaaatcgcgaagcggcttggcgccgattggaattacgccggtccgaaagaaatcatggatgaaatcgccagcctcgctccactgtactcacaagcgcattacgaccggctcgagggctggaacagcctttgctggggcagccacgacggcgctgatacgccgctgttgtacaaagagcggttcaacttcccggacggcaaagcccgctttgcgttagccgattgggtcgaaccggtgcaatatccggaagagtacgatttgcttgtgaacaacggccgattgctcgaacatttccatgaaggaaacttgacgtacaaatccaaaggcatcgagcataaattcccagaagtgtttgtcgaagtatcccctgaactcgccaaagaacgcggcattgaagatggggcgctcgttcggctcatctcgccgtacggccgcgtcaaagtgcgcgtgctcgtcaccgatcgagtcagaggcaatgaactgttcttgccgatgcactccacagccaatgagagcgccattaacatgctgaccggcccgcaaaccgaccatcgcacgaacacgccggcttacaaacaagcccgcgtgcgcatggaagtcattgaacggtccggcaagacgccgctgccgcgcacaaatccgcgctttaaaaagcggcatccgcaaaacggcgtcgaggtggagcggaagtggcggcgaagcgactacgtgccgctcaccgaggaa

SEQ ID NO: 46728 - DNA, 984 bp, Bacillus stearothermophilus
atgatgtccgcatttcaagcgttcgttgtcaacaaaaccgaaacagaatttaccgccggtgtgcagacgatttccatggatgatttgccggaaggcgacgtccttgtccgtgtccattattcgagcgtcaactacaaagacggattggcgtccattccggacggcaaaattgtgaaaacgtatccgtttgtgccgggaattgatttggccggggtggttgtttcgtcgcaacatccgcgttttcgcgaaggagatgaggtgattgcgaccggctatgaaatcggcgtgacacatttcggaggctacagtgaatatgctcgcctgcacggcgaatggctcgtgccgctgccgaaagggttgacgttgaaagaagcgatggcgatcgggacggctgggttcacggcggcgctgtccatccaccggcttgaggagcacgggctgacgccggaacgcgggccggtgcttgtcacgggggcgacgggcggcgtcgggagtctggccgtgtcgatgctcgcgaagcgcggctacacggtggaggcgagcacaggcaaagcggcggagcacgattatttgcgcgtccttggcgccaaggaagtgttggcgcgcgaagacgtcatggccgagcgcatccgcccgcttgataagcagcgctgggcagcggcagtcgatccggtcggcggccggacgctggccacggtgttaagccgcatgcgctacggcggagcggtggcggtgagcggactgaccggaggagcggaagtgccgacgacggtccatccgtttattttgcgcggcgtcagtttgcttggcattgattccgtctattgtccaatggatttgcgtttgcgcatttgggaacggctcgctggcgacttaaaaccggatttggagcggattgctcaagagatttcgctcgctgaattgccgcaagcgcttaagcgcattttgcgcggcgaactgcgcggccggacggttgtacggctg

SEQ ID NO: 46729 - DNA, 1026 bp, Bacillus stearothermophilus
attcctttttatgattcttgatcaaaggggagaggaatcttgaaaaaattgatcaatgatccgcagcgcgtagtggatgatatgttggaaggatttgtggccgcccattctcggcgagtgagacgaattccggggacgaatgtgattgtccggaaggatgccccggtgaaagggaaagttgggattgtgagtggcggcggaagcggccatgagccggcacacgctgggtatgtcggaaagggaatgctggatgcagctgtttgcggagaagtgtttacgtcgccgacgccagaccaaattttggccgctattcaagccgtagatagtgggaatggggtattgctaatcatcaaaaattataccggtgatgtgatgaattttgaaatggcagccgaattggctgaggccgagggaatccgggtcgccaaagtgattgtgaatgacgacgtggcggtcgaagacagcacgtttacgacaggacgtcgtgggatagcgggaacggtgtttgtccataaaattgctggagcattggcagaacgcggagcttcgctcgaagaagtggaagcagcagcgaaaaaagccattcaaggcgtccgttccatgggggtggcgctcaacccttgcattgtgccggctgccggaacgccagggtttgcgttgggtgagaatgagatggaagtcggaatcggcattcatggggagccgggaattgagaaagtcactgttcagccagcagagaacattgcagacggattgcttgtccgcattgttgaagatatgaaactcaatcaaggagatcaagtggcggtcatgatcaatggactcggagctacgccattgatggagctgtatattgttcataaacgtgttgctgagtggctagcagaaaagcagattcacattcatgagacgtttgtcggggagtatatgacatcattggagatggcggggtgctccatatcgctgttgaagctcgatgacgagatgatcgacttgcttcgttcgccggctgacgcagcagccttt

SEQ ID NO: 46730 - DNA, 1128 bp, Bacillus stearothermophilus
atgaggcggaaaacaatgctcattcatggcggcattccgggggatccgcatactggagcggtttcggttccgatttatcaagtgagtacgtataagcaagaagaagttggaaagcataaagggtttgaatactcgcgcaccggcaacccgacgcgcgcggcgcttgagaagctgatcgccgatctcgagggcggcgaagccggctttgcgttcgcttccggtatggcggcaattacggccgtcatgatgttgtttcaaagcggcgaccatctggtgctcactgacgatgtctacggcggcacgtatcgcgtcatgacgaacgtgctgaatcggttcgggcttgaggcgacgttcgtcgatacgagcgatgtcgccaacatcgaggcgcacatccggccgaatacgaaagccatctatatcgaaacgccgacgaacccgctgttgaaaatcactgacttgcaagccgccgccgccattgcccgtgcgcatgggctgctattgatcgtcgataacacgttttccactccgtactttcagacgccgcttgagcttggcgccgatatcgtcattcatagcgcgacgaaatatttaggcggccatagcgacgtcgtcgctgggttggcggttgtccgcacgccggagcttgccgaacggctccattacgtgcaaaattcaaccggcggcgtgctcgggccgcaggattcatggttattgatgcgcgggatgaaaacgctcgccgtgcggatggaggaatatgaagaaaatgcgcgccaaatcgctgtttttttggctgaacacaagacggtcaagcgcgtccattaccccgggcttccggatcatccgaaccacgagctggcgaaaaaacaaatgcgcggatttggcggcatgatttcgtttgatgtcggcagcttggagtgcgccgaaaaagtgctgtcgcgcgtgcgctactttacgcttgccgaaagcttaggggcggtcgaaagtttaatttcgttgccagggaaaatgacgcacgcctcgatcccgaaggaacggcgcgaacagctcggcattaccgacggcctgatccgtttgtcggtcgggcttgaagatgtcaacgatctgcttgacgatttggcgcaggcgctt

SEQ ID NO: 46731 - DNA, 732 bp, Bacillus stearothermophilus
atcttagaagtaagtaatgtatctaaagtgttcaaatggaaagataaaacgatacgagcggtaaaccaagtctcttttcatttaacagaaaaagctattataggtattagtggtagaaatggatcgggaaagactacacttttaaagttaattgcgggtcttttaatccctgatgaaggtaatgtcatgttgtttggtcaacctcttaatgatcgcaatgctaaagaaaatgtttcaattctcctagaggggtctagatctttttattggaatttgagaggaagggaaaatttggagtatttttgtcaactaaataaaattagaaatatgaagaaagaaatagataatatgattgagttattaagattagatacatttattgataatttaactggctcatattcaagaggtatgcaacaaaaactttcacttgcaattgcactattaagtaagcctaaattgctaatattagatgaaccaactaatgggcttgattatgaatcaaaagtacaactaagcaaaattcttcaacaattagtatcagaacttggtattagcatcttaatagtttgtcatgaatccgtttttttacaatcgacagtgaatcatattcttattatggaaaagggggctattgtagaaagtctaaaaataaacaagacagactttaatttttatgattttgtatcattcgaattttcggggtcacgcgtgttgattaaccaataatat

SEQ ID NO: 46732 - DNA, 639 bp, Bacillus subtilis
atgagcggtttatttattacattcgaaggtcctgaaggtgcagggaaaacgactgttctgcaggagatcaaaaacatactgacagcagaaggccttcaggttatggcaactcgagagccaggcggaatagatattgcagaacaaattagagaggttattctgaatgagaacaatatattaatggacccaaaaacagaagctctcttatatgcggctgcaagacgccagcatttagttgaaaaagtaaaacctgctttagaacaggggtttatcgttctttgcgacagattcatagacagtcctcttgcgtatcaaggatatgcaagagggcttggaattgatgaggttctgtccattaatgaatttgccattggagatatgatgccccatgtaacggtttatttttcaattgatccggaagaaggactgaagcgtatttacgcaaacggctcacgggagaaaaacaggctcgatttagaaaaactggactttcatacaaaagtacaagaaggttatcaagagctgatgaagcgatttccggaaagatttcattcagttgatgccgggcaatccaaagacctcgtcgttcaggatgttctaaaggtgatcgatgaagcgttgaaaaaaattcaattgtga

SEQ ID NO: 46733 - DNA, 870 bp, Bacillus subtilis
atgcgtattttagaaaaagcgccagctaagatcaatctgtcacttgacgtcacccgaaaacgcccggatggctatcatgaagtcgaaatgatcatgacgacaattgatttagctgatcgaattgaattgacggagcttgcagaggatgaagtgagggtttcctcccacaaccgatttgtgcctgatgaccaaagaaacttagcttatcaggctgccaagctgatcaaggacagatacaacgtgaaaaagggagtttccatcatgattacgaaggtaattccggtggctgccggtcttgccggcggaagcagtgatgcggcggcgacactcagagggctgaacagactgtggaatttaaatctgtccgcggaaacgcttgctgagcttggagcggaaattggctctgacgtttcattttgtgtctatggcggaactgcattagcaacagggcgcggcgagaaaattaaacatatcagcacgcctccgcactgctgggtcattttagcgaagccgacaatcggtgtttcaactgctgaagtgtacagagcgctgaaactggatggtatagagcatcccgatgtacaaggcatgatcgaggcgatagaagaaaagagttttcagaagatgtgcagccggttaggcaatgtgcttgaatctgttacactcgatatgcatcctgaagttgcgatgatcaaaaaccagatgaaacgctttggtgcagatgccgtgttaatgagcgggagcggcccgacagtgtttggactggttcagtatgagtcgaaggtgcagagaatttataacgggttaagaggcttctgcgatcaagtttatgcggtgagaatgatcggcgaacagaacgctcttgattaa

SEQ ID NO: 46734 - DNA, 954 bp, Bacillus subtilis
atgtctaatcaatacggagataagaatttaaagattttttctttgaattcgaatccagagcttgcaaaagaaatcgcagatatagttggagttcaattagggaaatgttctgtcacaagatttagtgacggggaagtccaaattaatatcgaagaaagtattcgcggatgtgattgttacatcatccagtctacaagtgaccccgttaacgagcatattatggaactgctgattatggtagatgcgttaaaacgcgcttctgcaaaaacgattaacattgttattccttattacggttatgcgcgtcaagacagaaaagcaagatcccgtgagccaatcacagctaaacttttcgctaacctgcttgaaacagccggtgcgactcgtgtgattgcacttgacctgcatgcgccgcaaattcaaggattctttgatataccgattgaccacttaatgggtgttccgattttaggagaatattttgaaggcaaaaatcttgaagatatcgtcattgtttcaccagaccatggcggtgtgacacgtgcccgcaaactggctgaccgactaaaagcgccaattgcgattatcgataaacgccgtccgcgtccaaacgtggcggaagtcatgaatattgtaggtaacatcgaagggaagactgctatcctcatcgatgacattattgatactgcaggtacgattacacttgctgctaatgcgctcgttgaaaacggagcgaaagaagtatatgcatgctgtacacaccctgtactatcaggccctgcggttgaacggattaataattcaacaattaaagagcttgttgtgacaaacagcatcaagcttcctgaagaaaagaaaattgaacgctttaagcagctttcagtcggaccgcttctggccgaagcgattattcgcgttcatgagcagcaatcagtcagctatctgttcagctaa

SEQ ID NO: 46735 - DNA, 543 bp, Bacillus subtilis
atgatgaaacatgatatcgagaaagtactgatctcagaggaagagatacaaaagaaagtaaaagagttaggtgcagaattaacgagcgagtatcaagatacatttccgttggcaatcggtgtgttaaaaggagcacttccttttatggcggatcttatcaagcatattgatacatatttggaaatggatttcatggatgtatcaagctacggaaattctacggtttcttctggagaagtaaaaatcattaaagatttggatacatctgtagagggccgggacatcttaattattgaagatatcatcgacagtgggttaaccttaagttatctcgtagagctcttccgataccgtaaagcaaaatcaattaagattgttacccttttggataaaccgagcggaagaaaagcggacatcaaagcagactttgtcggttttgaagttcctgacgcgtttgtagtgggttacggacttgattatgctgagcgctatcgcaatctgccttatatcggagtgttaaaaccggcagtttatgaaagctga

SEQ ID NO: 46736 - DNA, 1914 bp, Bacillus subtilis
atgaatcgggtcttccgtaataccattttttatttacttattttattagtagtaatcggggttgtgagctacttccagacctcaaatccgaaaacagaaaatatgtcgtacagtacgttcatcaaaaacctggatgacgggaaagttgatagcgtatcggttcagcctgtcagaggtgtttatgaggtaaaagggcagctgaaaaactacgacaaagatcaatactttttgactcatgttcctgaaggaaagggagcagaccagatatttaacgctttgaaaaagacagacgtaaaggttgagcccgcgcaagaaacaagcggatgggtgacgttcctgacgaccatcatcccatttgtcattatctttattctgtttttcttcctgctcaatcaggctcaaggcggcggcagccgtgtcatgaactttggcaagagtaaagcgaagctgtatacagaggaaaagaaacgcgtcaaatttaaagacgttgcaggggctgacgaagaaaagcaagaacttgttgaagttgttgagtttctgaaagatccccgcaagtttgccgagctcggcgccagaataccgaaaggcgtgcttttagtcggacctccgggtaccggtaaaacattgcttgccaaggcttgtgcaggagaagccggcgtacctttcttcagcatcagcggatctgatttcgttgaaatgtttgtaggggtcggtgcttcccgtgtgcgtgacttgtttgaaaatgcgaaaaagaatgcgccttgtttgatcttcattgatgaaattgacgcagtcggacgccagcgtggcgctggtctcggcggtggacacgatgaacgtgaacagacgctaaaccaattgcttgttgaaatggacggattcagcgctaatgaaggaattatcatcattgctgcgacgaaccgtgcggacatcttggacccagccttacttcgtccgggacgttttgaccgtcaaatcacagtggaccgcccagatgtcattggccgtgaagctgtattgaaagtccatgcgagaaacaaaccgctggatgaaacggttaacctaaaatcaattgccatgagaacaccaggcttctcaggcgctgacttagaaaacctcttgaatgaagctgcgcttgtagcggctcgtcaaaacaagaaaaaaatcgatgcgcgtgatattgacgaagcgacggaccgtgtaattgccggacccgctaagaagagccgcgttatctccaagaaagaacgcaatatcgtggcttatcacgaaggcggacacaccgttatcggtctcgttttagatgaggcagatatggttcataaagtaacgattgttcctcggggccaggctggcggttatgctgttatgctgccaagagaagaccgttatttccaaacaaagccggagctgcttgataaaattgtcggcctcttgggcggacgtgttgctgaagagattatcttcggtgaagtcagcacaggggcgcacaatgacttccagcgtgcgacgaatattgcaagacgaatggttacagaattcggtatgtcagaaaaactgggaccgttgcaatttggacagtctcagggcggtcaggtattcttaggccgtgatttcaacaacgaacagaactacagtgatcaaatcgcttacgaaattgatcaggaaattcagcgcatcatcaaagaatgttatgagcgtgcgaaacaaatcctgactgaaaatcgtgacaagcttgaattgattgcccaaacgcttctgaaagttgaaacgcttgacgctgaacaaatcaaacaccttatcgatcatggaacattacctgagcgtaatttctcagatgatgaaaagaacgatgatgtgaaagtaaacattctgacaaaaacagaagaaaagaaagacgatacgaaagagtaa

SEQ ID NO: 46737 - DNA, 2433 bp, Bacillus subtilis
atgatgtttggaagatttacagaacgagctcaaaaagtactggcgctagcacaggaagaagcacttcggttaggtcataataacattggcactgagcatattttattaggactggtaagagaaggagagggcattgctgctaaagctcttcaagcgcttggactcggttcagaaaaaattcagaaagaagtagaaagtttgatcgggcgcgggcaggaaatgtctcaaacgattcattatactcctagagctaaaaaagtcattgagctttcaatggatgaggcaagaaaactcggtcattcttatgtgggaacagaacatattcttcttggtctgattcgtgaaggagaaggtgttgctgcgagagttctgaataatctcggtgtcagcttaaataaagcaagacagcaggtgctccagcttctaggaagtaatgaaacaggatcatcagcggcaggaacaaacagcaatgcgaatacgcctacgcttgacagcttggcaagagacttaactgctattgcgaaggaagacagccttgaccctgtaatcggcagaagcaaggagatccagcgtgtcattgaagtgttaagccgcagaacgaaaaacaaccctgttctcattggggaaccaggtgtaggtaaaacggctatcgcagaaggtttggcacagcaaattatcaataatgaagtacccgaaattttgcgtgataaacgtgtgatgacattagacatgggaacagttgttgccggcacaaaataccgcggagaatttgaggatcgcctgaagaaggtcatggatgaaattcgccaggcaggaaatatcattctattcatcgatgagctccatacattaatcggggcaggcggagcagaaggtgctattgatgcatctaatattttaaaaccttcacttgctcgtggcgaactccaatgtattggtgcaacgactcttgatgagtaccgtaaatatattgaaaaagatgcagcactggaacgccgttttcagccgattcaggttgatcagccatctgtagatgaaagtattcaaattttacaaggtctgcgtgacagatacgaagcccaccaccgcgtttctatcactgatgatgccattgaagctgcggttaagctttctgacagatatatttctgaccgcttccttccggataaagcaattgacttgatcgatgaagcgggttcaaaggtgagactgcgctcatttacaacgcctcctaacttaaaagagcttgagcagaagcttgatgaggttcgtaaagagaaggatgcggcagtgcaaagccaagagtttgaaaaagctgcttccttgcgtgatactgaacaacgcctgcgcgagcaagtagaggatacgaagaaatcatggaaagagaagcaagggcaggaaaactcagaggttactgtggatgatattgcgatggttgtatccagctggaccggtgtgcctgtatctaaaatcgcccaaactgaaactgataagcttctcaatatggaaaacattcttcactcccgtgtcatcggccaggatgaagcagttgtagcggttgcaaaagccgtcagacgtgcaagagcaggattgaaagatcctaaacgcccaatcggctcattcattttcttaggccctacaggtgtaggtaaaacagaacttgcacgagcacttgctgaatccatttttggcgatgaagaatccatgatcagaattgatatgtctgaatacatggaaaaacattcaacttcaagacttgttggttcacctccgggttatgtgggatatgatgaaggcggtcaattgacagagaaagtcagaagaaaaccttactctgtcgtgcttcttgatgagatcgagaaagcgcaccctgatgtcttcaatatccttctgcaagttcttgaagacggacgattgactgattctaaaggacgcacagtcgatttccgcaataccattctgatcatgacatcaaacgtcggagcaagtgagctaaaacgcaataaatatgtcggctttaacgttcaggatgaaactcaaaatcataaagacatgaaagataaagtgatgggtgaattaaaacgagcgttcagacctgagttcatcaaccgtattgatgaaatcattgtcttccattcacttgagaaaaaacatctcactgagattgtgtcattaatgtctgatcaattaacgaaacgcctgaaagaacaagatctttctatcgaattgacagatgctgcaaaagcgaaagtcgcggaagagggcgttgacctggaatacggtgcccgtccgttaagaagagcgatccaaaaacatgtcgaggatcgtttatctgaagaactcctcagaggaaatattcataaaggacagcatattgttcttgatgtagaagatggcgaatttgtcgtaaaaacgactgctaaaacgaattaa

SEQ ID NO: 46738 - DNA, 1452 bp, Bacillus subtilis
atgggaaacgaagtacgcgtccgttatgcaccgagtccaaccggacatttgcatattggaaatgccagaacggcgctttttaattatttatttgcccgcaatcaaggcggtaagtttatcattcgagttgaggatactgataaaaagcgcaatattgagggcggagaacaaagccagctgaattatctgaagtggctaggtattgactgggatgagagtgtggatgtcggaggagagtacggtccataccgtcagtcagagcgtaacgatatctataaagtgtactatgaagagcttcttgaaaaagggcttgcttataaatgttactgtacggaagaagagcttgaaaaagagcgtgaagaacagattgcccgcggagaaatgcctcgttattccggaaaacacagagacctgactcaggaagaacaggagaaatttatcgccgaaggcagaaaaccaagtattcgtttccgtgtgccggaaggaaaagtcatcgccttcaacgacatcgtaaaaggcgaaatttcttttgaatcagatggcatcggcgacttcgttattgtgaaaaaggacggaacgcctacttataacttcgcggtagctattgatgactacttaatgaaaatgacacacgtgctgcgcggtgaggatcatatttctaacacaccgaaacagattatgatctatcaagcattcgggtgggatattcctcagttcggacacatgacgctgattgtaaacgaaagccgtaaaaagctcagcaaacgtgatgaatccattattcaattcatcgagcagtacaaagagcttggctacctgccagaagcgctgttcaactttatcggcttgttaggctggtcaccggttggagaagaagagcttttcacaaaagagcagtttattgaaatttttgatgtaaatcgtttatctaaatcaccagctttgtttgatatgcataagctaaaatgggttaacaaccaatatgtgaagaagctggatcttgatcaggttgttgaactgacgcttccgcatttgcaaaaagccggcaaagttggcactgagctttctgctgaagaacaagaatgggttcgtaaactgatttccctgtatcatgagcaattaagctacggtgcggaaattgttgagctgactgatttgttctttacggatgagatcgagtataatcaagaagcgaaagctgttctggaagaagaacaggttcctgaagtgctcagcacattcgcagcgaagcttgaagagcttgaggagttcactccggataatatcaaagcatcgatcaaagcagtgcagaaagaaactggccataaagggaaaaaactgtttatgccgattcgtgttgctgtaacagggcaaactcacggtccggaactgccgcaatcaattgaattgatcggtaaagagactgcaattcagcgtttaaagaatatctaa

SEQ ID NO: 46739 - DNA, 3582 bp, Bacillus subtilis
ttgacaggtcaactagttcagtatggacgacaccgccagcgcagaagctatgctcgcattagcgaagtgttagaattaccaaatctcattgaaattcaaacctcttcttatcagtggtttcttgatgagggtcttagagagatgtttcaagacatatcaccaattgaggatttcactggtaacctctctcttgagttcattgattatagtttaggtgagcctaaatatcctgtagaggaatcaaaagaacgtgatgtgacttactcagctccgctaagagtgaaggttcgtttaattaacaaagaaactggagaggtaaaagaccaagatgtcttcatgggtgatttccctattatgacagatacaggtacttttatcattaacggtgcggaacgtgttatcgtttcccagcttgttcggtctccaagtgtatatttcagtggtaaagtagacaaaaacggtaaaaaaggttttaccgcaactgtcattccaaaccgtggcgcatggttagaatacgaaactgatgcgaaagatgttgtttatgtccgcattgatcgcacacgtaagttgccggttacggttcttttgcgtgctctcggcttcggctccgatcaagagattcttgatctcataggagaaaacgaatacctgcgaaatacgcttgataaagataacacagaaaacagcgacaaagcgttgctggaaatttacgagcgtctccgtcctggagagccgcctacagtagaaaatgcgaaaagcttgcttgattctcgtttctttgatccgaaacgatacgatcttgccaatgtaggacgctataaaattaataaaaaacttcatattaagaatcgcctcttcaatcagagacttgctgaaacgcttgttgatcctgaaacaggagaaatccttgctgaaaaaggccagattcttgatagaagaacgcttgataaagtactgccatacttagaaaacggaatcggttttagaaagctgtatccgaatggcggcgttgttgaagatgaagtgactcttcaatcaattaaaatctttgctccgactgatcaagaaggagaacaggttatcaatgtaatcggcaatgcttacatcgaagaagagattaaaaacatcacgcctgctgatattatttcttcaatcagctacttcttcaacctgctgcacggagtaggcgacacagatgatatcgatcatcttggaaaccgccgtttacgttctgtaggcgagcttctccagaaccaattccgtatcggtttaagccgtatggagcgtgtggttcgtgagagaatgtcaattcaagatacgaatacaattacgcctcagcagctgatcaatattcgtcctgttattgcgtccattaaagagttctttggaagctcacagctttctcaattcatggatcagacgaacccgcttgctgaattaacgcacaagcgtcgtctgtcagcattaggaccgggcggattgacacgtgagcgtgccggaatggaagtgcgtgacgttcactactcccactatggccgtatgtgtccgattgaaacgcctgagggcccgaacatcggtttgatcaactcactatcatcttatgcaaaagtaaaccgttttggctttattgaaacgccatatcgccgcgttgaccctgaaacagggaaggtaacgggcagaatcgattacttaactgctgatgaagaggataactatgttgtcgctcaagcgaatgctcgtcttgatgacgaaggcgcctttattgatgacagcatcgtagctcgtttccgcggggagaacaccgttgtttccagaaatcgtgtagactacatggatgtatcgcctaagcaggttgtatctgctgcgacagcatgtatcccgttcttagaaaacgatgactccaaccgtgccctcatgggagcgaacatgcagcgtcaggctgtgcctttgatgcagccggaagcgccatttgttggaactggtatggaatacgtatcaggaaaagactctggtgccgctgttatttgtaaacaccctggtatcgttgaacgcgtagaagccaaaaacgtttgggttcgccgttatgaagaagtagacggtcaaaaagtaaaaggaaacctggataaatacagcctgctgaaatttgtccgctctaaccaaggtacgtgctacaaccagcgtccgatcgtaagtgtcggcgatgaagtggtaaaaggagaaatccttgctgacggtccttctatggagcttggtgaacttgcacttggccgtaacgtaatggtcggcttcatgacgtgggatggctacaactatgaggatgccatcatcatgagtgaacgcctagtgaaggatgatgtttatacatctatccacattgaagaatacgaatcagaagcacgtgatacgaaacttggacctgaagaaatcactcgcgatattccaaacgtcggtgaagatgcgcttcgcaatcttgatgaccgcggaatcatccgtattggggcagaagtaaaagacggagatcttcttgttggtaaagtaacgcctaaaggcgtaactgaactgactgccgaagaacgccttcttcacgccatctttggcgagaaagcccgcgaggttcgtgatacttctcttcgtgtgcctcatggcggcggcggaattatccatgacgttaaagtcttcaaccgtgaagacggagacgaacttcctccaggtgttaaccagttagtacgcgtatatatcgttcagaaacgtaagatttctgaaggggataaaatggccggtcgtcacggtaacaaaggtgttatctctaagattcttcctgaagaggatatgccttaccttcctgacggcacaccaattgatatcatgcttaacccgctgggcgtaccatcacgtatgaacatcgggcaggtattggaacttcacatgggtatggccgctcgttaccttggcattcacattgcatctcctgtatttgacggagcgcgagaagaggatgtctgggaaacacttgaagaagccggcatgtctcgtgacgccaaaacagtgctttacgacggacgtactggagagccgtttgataaccgtgtatctgtcggtatcatgtacatgatcaaactggctcacatggttgacgataaacttcatgcacgctctacaggcccttactcacttgttacgcagcagcctcttggcggtaaagcgcaatttggcggacacggttttggtgagatggaggtttgggcacttgaagcttacggtgcggcttacactcttcaagaaattctgactgttaagtctgatgacgtggttggacgtgtgaaaacatacgaagccatcgttaaaggcgacaatgttcctgaaccaggtgttccggaatcattcaaagtattaatcaaagaacttcaaagcttaggtatggatgtcaaaatcctttctggtgatgaagaagaaatagaaatgagagatttagaagacgaagaagatgcgaaacaagctgacggcctggcattatcaggtgatgaagagccggaagaaacagcatctgcagacgttgaacgcgatgtagtaacaaaagaataa

SEQ ID NO: 46740 - DNA, 834 bp, Bacillus subtilis
atggcgattaaaaagtataaaccgtcctctaatggacgtcgtggcatgacaacttcagattttgctgaaatcacgactgacaagccggaaaaatccttgcttgctccccttcacaaaaaaggcggacgtaacaaccaaggtaaattgacggtacgtcaccaaggtggcggacataaacgccaataccgtgttatcgacttcaaacgcgataaagatggtatacctggacgcgttgctacagttgaatacgatccaaaccgttcagctaacatcgctctaatcaactatgcagacggagaaaaacgttacattcttgctcctaaaggaattcaagtaggtactgaaatcatgtcaggtcctgaagctgacattaaagtaggtaatgcacttccacttatcaacatccctgttggtacagttgtgcataacattgaattaaaacctggtaaaggcggacagcttgtacgttcagctggtacatctgctcaggttcttggtaaagaaggtaaatacgttcttgtacgtcttaactctggtgaagttcgcatgatcctttctgcttgccgtgcttctatcggtcaagtaggtaacgaacagcacgaacttatcaacattggtaaagctggacgttctcgctggaaaggcatccgtcctacagttcgtggttctgtaatgaaccctaacgatcacccacacggtggtggtgaaggacgtgcgccaatcggacgtaaatcaccaatgtctccatggggcaaaccaactcttgaattcaagactcgtaagcaaaagaacaaatccgataaatttatcgtacgtcgtcgtaaaaataaataa

SEQ ID NO: 46741 - DNA, 831 bp, Bacillus subtilis
atgaagaccccgtttgagcgcctagcactgtatgatatcaatgcatcgattaaagaaggaagctacgtagccgttatcgggcatacaggctctggcaagtccactcttctacagcacctaaatggtctcctgaagccgacgaagggacagatatcactaggcagcactgtcattcaggcagggaaaaagaataaagatctgaaaaaacttcgtaaaaaagtcggaatcgttttccaatttcctgagcatcaattattcgaagaaacagttcttaaagatatttcattcggaccgatgaactttggtgttaaaaaagaagatgctgaacaaaaagcgagagagatgctgcagcttgtaggtttatcagaagagcttttggacaggtcaccctttgaattaagcgggggacaaatgcgcagagttgcaattgccggcgtacttgcaatggaccctgaagtgcttgttctggatgaaccgactgcaggattggacccaagagggcgaaaagagattatggacatgttttatgagcttcatcaacgtgggaacttgacgacgatccttgtgacacacagcatggaggatgcagctgcatacgctgatgaaatgattgttatgcataaaggaacgatacaagcatcaggcagtccgcgtgatctgtttttaaagggtgaagagatggccggctgggggctggatcttcctgaaacaataaaattccaaagacaccttgaagctgcactgggtgtgagatttaatgagcctatgcttacaatcgaagatgccgctgccgaaatccgtgctctttttcagggagagaagactttatga

SEQ ID NO: 46742 - DNA, 1347 bp, Bacillus subtilis
atgggcaagtattttggaacagacggtgtaagaggtgtcgccaatagtgagcttacacctgagctggcctttaaagtcggacgtttcggcggttatgtgctgacaaaagacaaacaacgtccaaaagtgctgataggccgcgatacacgcatctccggccatatgctggagggagcccttgtcgccggacttttatccattggcgcagaagtcatgcgcctgggtgtcatttctacaccaggtgtatcttatttgacaaaagcgatggatgcagaggcgggcgtcatgatttccgcttctcataacccagtgcaggataacggcatcaaattctttgggggagatggatttaagctttctgatgaacaggaggctgaaattgagcgcctgatggacgaacctgaggataagctgccaagacctgtcggagcagaccttggacttgtaaacgattattttgaaggcggacaaaaatatctgcaattcttaaaacagacagctgatgaagatttcacaggcattcatgtggcattggactgtgccaatggcgcaacgtcatccttggcgacgcacctgtttgctgatttagatgcagatgtttctacaatggggacttccccgaacggattaaacattaatgacggcgtcggttcgactcatcccgaagcgctcagcgcgtttgtcaaagagaaaaacgcggatctcggtcttgcgttcgacggtgacggcgaccgcctgattgctgtcgatgaaaaaggaaatattgtagacggcgaccaaatcatgtacatatgctcaaaacatctgaaatcagagggccgtttaaaggatgatacagtggtttcaaccgtgatgagcaacctcggcttctataaggcgctcgaaaaagaaggcatcaaaagcgtgcagacagctgtcggcgaccgctacgtagtagaagcaatgaaaaaagacggctacaacgtcggcggagagcagtcaggacatcttattttccttgattacaacacgacaggggacggattattgtctgctattatgctgatgaacactttaaaagcaacaggcaagccgctgtcagagcttgcagctgaaatgcagaagttcccgcagctgttagtcaatgtgagagtgactgataaatataaagttgaagaaaatgaaaaagtaaaagcagttatttctgaagttgaaaaagaaatgaacggcgacggccggattttggtgcgcccttcaggaactgaaccgctcgtccgtgtcatggctgaagcgaagacgaaagagctgtgcgatgagtatgtcaatcgcattgttgaagtcgtccggtcagaaatgggattagagtaa

SEQ ID NO: 46743 - DNA, 1803 bp, Bacillus subtilis
atgtgtggaatcgtaggttatatcggtcagcttgatgcgaaggaaattttattaaaagggttagagaagcttgagtatcgcggttatgactctgctggtattgctgttgccaacgaacagggaatccatgtgttcaaagaaaaaggacgcattgcagatcttcgtgaagttgtggatgccaatgtagaagcgaaagccggaattgggcatactcgctgggcgacacacggcgaaccaagctatctgaacgctcacccgcatcaaagcgcactgggccgctttacacttgttcacaacggcgtgatcgagaactatgttcagctgaagcaagagtatttgcaagatgtagagctcaaaagtgacaccgatacagaagtagtcgttcaagtaatcgagcaattcgtcaatggaggacttgagacagaagaagcgttccgcaaaacacttacactgttaaaaggctcttatgcaattgctttattcgataacgacaacagagaaacgatttttgtagcgaaaaacaaaagccctctattagtaggtcttggagatacattcaacgtcgtagcatctgatgcgatggcgatgcttcaagtaaccaacgaatacgtagagctgatggataaagaaatggttatcgtcactgatgaccaagttgtcatcaaaaaccttgatggtgacgtgattacacgtgcgtcttatattgctgagcttgatgccagtgatatcgaaaaaggcacgtaccctcactacatgttgaaagaaacggatgagcagcctgttgttatgcgcaaaatcatccaaacgtatcaagatgaaaacggcaagctgtctgtgcctggcgatatcgctgccgctgtagcggaagcggaccgcatctatatcattggctgcggaacaagctaccatgcaggacttgtcggtaaacaatatattgaaatgtgggcaaacgtgccggttgaagtgcatgtagcgagtgaattctcctacaacatgccgcttctgtctaagaaaccgctcttcattttcctttctcaaagcggagaaacagcagacagccgcgcggtactcgttcaagtcaaagcgctcggacacaaagccctgacaatcacaaacgtacctggatcaacgctttctcgtgaagctgactatacattgctgcttcatgcaggccctgagatcgctgttgcgtcaacgaaagcatacactgcacaaatcgcagttctggcggttcttgcttctgtggctgctgacaaaaatggcatcaatatcggatttgacctcgtcaaagaactcggtatcgctgcaaacgcaatggaagctctatgcgaccagaaagacgaaatggaaatgatcgctcgtgaatacctgactgtatccagaaatgctttcttcatcggacgcggccttgactacttcgtatgtgtcgaaggcgcactgaagctgaaagagatttcttacatccaggcagaaggttttgccggcggtgagctaaagcacggaacgattgccttgatcgaacaaggaacaccagtattcgcactggcaactcaagagcatgtaaacctaagcatccgcggaaacgtcaaagaagttgctgctcgcggagcaaacacatgcatcatctcactgaaaggcctagacgatgcggatgacagattcgtattgccggaagtaaacccagcgcttgctccgttggtatctgttgttccattgcagctgatcgcttactatgctgcactgcatcgcggctgtgatgtggataaacctcgtaaccttgcgaagagtgttactgtggagtaa

SEQ ID NO: 46744 - DNA, 1389 bp, Bacillus subtilis
gtggcaaataaagaattaaagaggggcctgggcgcgcgccatattcagatgatcgccttgggcggtacaatcggtgttggcttgtttatgggttctgccagcacgatttcatggactggcccatctgtccttctggcttatgcaatatgcggaatttttatcttttttattatgcgtgcgatgggtgaaatgctgtatgtcgagccgagcacaggttcttttgcgacgttcggccatcaatatattcatccgatggcaggttatataacagcatggagcaactggttccagtggattatcgtcggcatgtcagaaattatcgctgtcggttcttatacgaagtattggttcccggatttgcctgcttggatacctggtatcgtggcaatggtgattcttggtgcggcgaatttaatttctgttaagtcgtttggggaatttgagttttggtttgcgatgattaaaatcgtgacgattatcttgatgattattgcgggaatcggaattattttcttcggttttggcaatggcggagatgcgatcggtttgtcgaacctgtggtctcacgggggcttctttgcaggaggtttctcaggtttcttctttgcactgtctcttgtcattgcagcctatcaaggagttgagctgatcgggattacagcgggtgaagcgaaggacccgcaaaacacgctaagaaatgcgattcaaagtattatctggcgtattttgattttctacattggcgctatttttgtgatcgtgacggtgtatccttgggatgagctcaactcactcggaagtccgtttgtgtctacgttctcgaaaattggaattacggcagcggccggcattattaactttgtcgtgattactgcggcaatgtccggctgtaacagcggtattttcagcgcgggccgcatgctgtatacactgggtgtcaatggacaagcaccgaaattctttaagaagatttcacgcaatggtgtgccgctgtatggcacaattgcggtgctgatcggtttggctgtcggcgttgtactgaactatatcgcgccgccgaagatctttgtctatgtatacagcgcaagcgtgctcccagggatgattccttggtttatcattttgatcagccatatcggattcagaaaagcgaagggtgctgcattagataaacatccattcaaaatgccgtttgctccttttacaaactatttgacgattgctttcttgctgatggttctggttggcatgtggtttaacgatgatactcgtatctccctgattgtaggcgtgattttcttagcgcttgtggtcattagttattatgtgtttgggattggcaaacgcacgcaggccaatttgacaaaaagcgaacaagcagctgaataa

SEQ ID NO: 46745 - DNA, 1620 bp, Bacillus subtilis
atgaatcaattgcatcgaagaatgggaacgttttccctcatgatggtcgggctcgggtcgatgatcggttcaggctggctgttcggggcttggcgtgcggctcaaatagcaggaccagctgctattatttcatgggttattggaatggtcgtcattttatttattgctctttcttatagtgaactaggttctatgttccctgaagcggggggaatggtcaaatacacgcaatattcacacggttcgtttatcggttttattgcgggctgggccaactggattgcgattgtgtccgtcattccggttgaagcggtggcctccgttcaatatatgagttcttggccttgggaatgggcgaaatggacaagcggtttggtgaagaatggaacgctgactggggaaggactagcgtttgcctctgtattgcttctcatttattttctgctgaactactggacagtcaatctattttcgaaagcgaattcattaattacgatttttaaaattattattccgggtcttacgattggagctttgctgtttgtcggattccacggagaaaactttactggcggtcaaagcattgcgccgaatggctgggcaagtgtgctgacggcggttgccacttccggtatcgtttttgcgtttaatggtttccaaagcccgattaatatggcgggtgaagcaaaaaatccggggaaatcaatcccgattgcggttgttggctctctttttgttgcgacagtgatttatgtcctgctgcagatcgccttcattggagctgtgaatccttctgatattgctcacggctggagccatctgaattttaattctccttttgctgatctggcgattgcgctgaatattaactggcttgttattgtgttatatgcagatgcatttgtatcaccgtctggaacggggattacgtatacggcgacaacgtcccgaatggtttacggaatggaaaaaaacaaatacatgccgagtatattcgggaagcttcatccgatttacggcgttccgcgacaagcaatgttctttaacttgattgtttcgttcatctttttgttcctgttcagaggatggggcgtattagcggaaattatttctgttgctacgttaatttcttatatcaccggcccgatcacagtgatgacattgagacggacggggaaagacctgtacaggcctcttcgtttaaaaggcttaaatgtgattgctccgcttggatttatctttgcgtcactggtgctgtattgggcgcgctggccgttaacaggacaggttctgtttattatcctgatcggtcttccgatttatttctattatcaggcgaaggcgaaatggaaagggtttggccggaactttaaagccggcgtctggatggtgttttatctgctggccatgatggttatttcttatttgggcagtgataaattcggcggcctgaatgtcattcattatggctgggatatggttctgattgcgatggtatcccttgtattctatgtgtgggcgctgaagagcggctaccagacagaatacttaaaggatgcgaaagagataaattctcagctgcttaatggacagtcagaagctgctgccggaaaagaataa

SEQ ID NO: 46746 - DNA, 1251 bp, Bacillus subtilis
atgaaaagactgcattatgcgtggatcatcgtctccgtcacctttttgatcttattggcggttcagggggtgcggctgtcgtttggtgcgtttgtggagccgtgggaacggcagttttcaatcgatagaagcaccatctcgctgatttcgacggtgagttttattgtttatggcatatcacagcctgtgatcggtcggcttgtggacaaatggggtgcccgggctgttttggcatggagtgcgttactgacaggagtcagcattttcttaacataccttgtgacttcgccttggcagctgtttttgctttacgggctgggtgtctcgcttggagtgggcggagcatcgaatgtggcggcaagtgtattggtcgtcaattggttcagcaaaaagcggggactagcctttgggatcatggaagcaggctttggcgcggggcaaatgcttctcgttcccggctcactcatgttgatccattggtttagctggaagctgacggttgtggtgttgggactgctgttaatcgtgattgtctttccggctgcgctgctgatgctgcggaacaatccttcagaaaagaatacagagccgataggcggactggctgcatcagaaaaagaaacagcacccaaaacaacagctctttcagtggccgggatgtttcgtatgaggcaattctggttcttgatttttccgtttttgatctgtggatttacgaccgtggggctgatggatacccatttgattccgttttctcatgatcatggcttttcaacgacagtcacgagtgctgctgtcagtctgctagcaggctttaatattgctgggatcttgctgtccggaattgtagcggaccggtggagcagccggaaaatcctgtgcattttatatgcggtgcgggcgctgtcgatcgtgattcttatttacagccacgagccctacttgcttttagcctttgcgattctgtttggattagtggactttgcaacggtagcaccgactcaaatgctcgccacccagtactttcaaaactactcgatcggcctcatgattggctggctgtcactcgcccatcagatcggatcggcactaggtgcgtatgtgcccggcgtcatctacacggtaacgggtgagtatacactggctttttatttgtcgattggaatgctcgtgcttgcgagcgtaatgaatgtgatgctgagggagccagctgcggttacgcgtgacagtgcggctgtggtagacaagtga

SEQ ID NO: 46747 - DNA, 1155 bp, Bacillus subtilis
atgtatcaatcaaagaaggttttattgttaggttcaggtgaattaggtaaagaggtagtgattgaagcccagcgtcttggggtacagacggtggcagttgacagttacgagcatgctccggcgatgcaggtcgcgcataacagttatgtcgttgatatgctggacccagagcagatcagaaccatcattgagaaagaaaatccggatttgattgtgcctgaggttgaggcgattgcgacggatgaattgctgaagcttgaagaggaaggatttcacgttatcccgaatgcccgtgcggccaagctgacgatggatcgggaaggcatcagacgacttgcggcggaaacgcttggacttgcgacagctggctatgaatttgcgaatacatatgatgaatttatacaagcggcagctcagatcggttttccttgtgtcgttaaaccattgatgagttcttctggaaaaggccaaagtgtgtgccgctctgaagcggatttagagagctgctgggagacggcgatggaaggcggacgggtgaaaaacggccgcgtgatcgttgaggagtttatccctttcgaatcagaaatcacactcttaaccgtacgtgcggttaacggtacggcattttgtgagccgatcggtcatgtgcaaaaggacggggattatatcgaatcgtggcagccgcatgatatgacagagcagcaaatagaagaagcgaagcatattgcgaaaacgatcacggatgagcttggcggatacggcctgtttggtgttgagctgttccttgcgaaagatagggtatatttcagtgaggtatctcctcgtccgcatgatacgggtcttgtcacgctggtgacgcaaaatttgtcagaatttgcgctgcatgtccgggcgattctcggctttccgattacagaaatcacacagctttctcctggcgccagcaggcccctcaaagcgccggaagaattagcggattacactgttgaaggattggaaaacgcactggcagtcccaaagactcaagtgcgcgtctttggaaagccgataacaaaagccggacgtcgtatggcagttgcgctttctgctgctgattcagttgaaacggcaagagagaatgcaaagaaagcgttggaccagctaattttaaaatag

SEQ ID NO: 46748 - DNA, 534 bp, Bacillus subtilis
gtgaattacatcccctgtatgattacgataggaaacttcatttgcggattgctggcgattcattccttgctatatcacaacattcattcagcagtgctttttatttttacaggcatgttccttgatttctttgacgggatggctgctcgtaagctgaatgccgtttctgatatggggagagaactggattcgtttgccgatctggttacgtttggggtggctccttctatgcttgcttacagtgtcgcgttgtataccctgccatttatcgggatcttatgcgcattgacgtacagcatttgcggaatgcttcgcctctctaaatttaacattgaacaaagcaagctcccgacgtttatcggtatgccgattccgtttgcgggcatgtgtctcgttattctaagcttcacctataacccgatccttctggcaatcggcacttgcggactctcatatttgatggtgagtaaaataaaattccctcattttaaaaaacatgcggcagaaaacctggagtctgggagatggaattag

SEQ ID NO: 46749 - DNA, 792 bp, Bacillus subtilis
atgtttaatacggctgtaaagattctgtatcgatcattgatagagctgacgaatcatcgtctgtcatcctatctgattaaaggattttgcgagtcgaaaatcagcaaaccggtcattccgcttttctcaaaacattttcggctgaattgggatgatgtggacggtacggctgctgattacggatcgctgtccgaattgttcattcgacaaataaatctggagcggcgccctgtgtcaaaagaggcgcatgcggtggtcagccctgttgacggtgtggttcagacggtaggaatcatcaacccgaatcaaacctttacggtgaagggaaaagattactcattcgctgagctgaccggctgtaaaagcgcagaccatcaatacaacggcggatatttcgtcgtgctgtatttaagcccgaggcattatcaccgtttccattctccgatcagctgcaggtatcaaaagctggccgagctcggaaatcgctcatacccggtaaatcaactaggcttaaaatacgggaaagatgtgctgtcgaaaaattatcggtttgtgtacgagctgaatagcggcagccgaaatgtcctgatgattcctgtcggcgcgatgaatattaattctatcgtgcagacgaatacccgtactgaattggagatcggcgaggagctgggatacttttcatttggctcaaccgtcattttggtttttgaaaaagacgcgttccagccgtccgcccatttagcagaaggccaagaagtccaagtcggagaactgataggttacgaagaataa

SEQ ID NO: 46750 - DNA, 1245 bp, Bacillus subtilis
ttgaaaaaattaatcgcgtttcaaattttaatcgctttggctgtcggcgcggtgatcggccacttttttcctgatttcgggatggcactgaggcctgtcggagatggatttatccgcctgattaaaatgattgttgtgccgattgtattttctaccattgtcattggagccgcaggaagcggaagcatgaaaaaaatgggcagtctcggcatcaagacgatcatttggttcgaagtgattacaacgttggtattagggcttggacttttattagcgaatgtcttaaaaccaggtgtcgggcttgacctctcccatttggcaaaaaaagatattcatgaactttccggctacacagacaaagttgttgatttcaagcaaatgatcctggatattatccctacaaacattattgatgtcatggccagaaatgatttgcttgccgttattttcttcgccattttatttggtgtcgccgcagctggtatcggcaaagcttctgaaccagtaatgaagttttttgaatctacagctcagattatgttcaagctcacgcaaatcgtcatggtcactgctcctatcggcgtgttagccctgatggctgcttctgtaggccaatatggcattgaactcctcctccctatgtttaagctggttggcaccgtattccttggcctgttcctgatcctctttgtcctctttccgcttgtcggtctcatctttcagattaagtatttcgaagtattgaaaatgatatgggatctgtttttaattgcattttccaccacaagcactgaaaccattctccctcagctgatggatagaatggagaaatacggctgtcccaaacgagtggtatcatttgtcgttccctccggcttgtcattgaactgtgacggctccagcttatatttatcggtttcttgtatctttctcgcacaggcctttcaagtagacatgacattgtcccagcagctgctcatgatgcttgtgcttgtgatgaccagtaaaggcattgcagctgtaccctcaggatcgcttgtagttcttctggcgactgccaatgctgtaggactgccggctgaaggcgttgccattatcgcgggtgttgaccgcgtcatggacatggcgagaacaggcgtgaacgtaccgggacatgcgatcgcctgtatcgtggtatcaaaatgggaaaaggccttccgccaaaaagaatgggtttccgcaaacagccaaactgaaagtatatag

SEQ ID NO: 46751 - DNA, 1413 bp, Bacillus subtilis
atgaactctgcccacaacaagaatgagacaacctttcagagaagtatgaaaagccggcacctctttatgctttccttgggaggtgtcatcggaaccgggctgtttttaagctcaggttataccattcagcaagcaggcccggccggaacgatactcgcctacttagtcggggccggcatcgtctatctggtcatgctatgcctcggtgagctgtcagtcgccatgcctgtgaccggcgcctttcacacctatgcagccaaatacatagggccgggcaccggatttacggtcgcttggctgtattggctgacatggaccgtggcattgggatcagaattcacagcagccggcctgttaatgcagcgctggttcccccatacatcggtttggatgtggagtgccgtctttgcgctgttcatcttcttgcttaacgcattttcggtcaagtttttcgctgaatcagaattttggttttccagcatcaaagtattagccattgtattatttattcttttaggcggctctgccatgttcggcatcatcccgatcaaaggcggagaagccgctccgatgctgtccaacttcacggcggaaggcgggctttttcccaatggatttgtcccgattttgatgacgatgctgtccgtcaattttgccttttcgggaacggaactaatcggaatcgcagccggtgaaagcgttgatcctgacaagacgataccaaaagcgataaaaacaacggtctggcgtctctcgctcttctttgtcggaacaatttttgtgctgtcagggctgattccgattcaagatgcaggtgtcatcaaaagcccgtttgtcgctgtctttgacagagtcggtgtaccatacgcagccgatatcatgaactttgttatcctgacagcgatcctgtcagcggctaattccggactctacgcttcttcccggatgctgtggtctttatcaaaagaaaaaacgcttcatccgacatttgcaaagctgacgtcaaaaggaaccccttttaacgcgctggtgttcagcatgatcggcggcattctgtcgttgctgtccagcgtatttgcgccagacactgtatacgttgtgctcgtgtcgatttccggttttgccgtcgttgtcgtgtggatgggaatcgctgcttctcaattcatgttcagaaaacgttatatcgaagcgggaaacaaggttactgatttgaaatacagaacccctttgtatccgttcgtgccgattgctgcgttcctgttatgcctggcttccgtcgttggcattgcctttgatccgaatcaaagaatcgcactctattgcggcgttccatttatggccatttgctatgcaatatattatgtaaaaaaccgcaaaagccagccggctgctgatatgactcattcaaaataa

SEQ ID NO: 46752 - DNA, 948 bp, Bacillus subtilis
atgaatcctatccaacacatattagatacatacccgcttattgtgctagacggcgccatggcgaccgagcttgaacgcaagggctgtaatttgaatgacagtctgtggtcggcaaaaatcctgatggaagagccggagctgattaaacaagttcatactgattattttgcggcaggcgccgattgtgcaatcaccgccagctatcagtctacatttgaaggctttgccgcacgcgggctgagcgaagcggaagcacgccggctcatcgagttgtccgtcagcatcgcagctgaagcacgtgatgaattttggtcgcttgaagagaaccgtttgaatcggccaaaaccgatcattgcggcttctataggcccttatggcgcttatcttgcagacgggtctgagtatcgcggcaactacgcaatatcagaagatgaactgattgaatttcatcgcccccggatgaaggcgctgattgaagccggagctgatgtattggcatgcgaaacgattccgtgtctgactgaagccaaagcgattgttcggctgttgaaggaatttcctgaaacgtatgcatggatcagcttcagtgctaaagacggcttgcatatcagtgacggaacacctgcagctgactgcgcatcgtggcttgatgaacaccgccaaattgcagcactcggcatcaactgcacgccgcttcagcatatcccttccttgatagaggagttaaaaaagaacacgtcaaaaccgatcattgtctacccgaattcaggtgagcaatatgatccggaaacaaaaacgtggaacggcgcagcatgcgcagaatcttacggggcgagcgcccgcacctggcatgaaaaaggagcgaggctgattggcggctgctgccggacaaaacccgaaaatattcaagaaattgcggcttgggcccgctctttaaaaacaacttga

SEQ ID NO: 46753 - DNA, 927 bp, Bacillus subtilis
atgagccgtatcagaaaagcacccgctggaattttaggttttccggttgctccttttaacacacaaggaacactggaggaagaagctctttttcaaaacattgagtttttgctgaatgagggcttggaagcgatatttatcgcttgcgggtctggtgaattccaatctctcagccagaaggaatatgagcaaatggtggaagtcgcagtctcggcagccggaggaaaggtgccggtctacacgggggtgggcggcaacctcagcacagcgcttgattgggcgcagctgtcggagaaaaaaggcgccgacggctacttgattctgcctccgtatttggtgcatggcgaacaggaggggctgtaccagtatgcgaaaacgattattgaaagcactgacttgaacgcgattctttatcagcgcgataacgcagttctctctgttgaacagatcaaacgtctgaccgaatgtgaacagcttgtcggtgtcaaagacggggtaggaaatatggatttgaatatcaatctcgtctatacgatcggcgaccgcttgggatggctcaacggaatgccgatggctgaagtgacgatgccggcttatctgccgatcgggttccactcttactcttcagcgatttcaaattatatcccgcatatttcgcgaatgttctatgatgcattgaaaaacggaaatgacgagcttgtgaaggaactctatcggcatgtgattctgccgatcaacgacattcgcaaacaacgaaaaggctacgccgtatccttgattaaagccggtatggaaatcatgggtttgaatgtaaggaatacagccagaccgcctgtcggcccggttgaaaaagatcattatcagcaattggaagcaattttgaagcagccggctgaccgttttccgaaaaaagccgcgacggtttga

SEQ ID NO: 46754 - DNA, 1467 bp, Bacillus subtilis
atgtctgtgatcacggaacaaaacacgtacctcaactttattaacggagagtgggttaagtctcaatcaggcgatatggtcaaagtcgaaaaccctgccgatgtgaatgatattgtcggatatgtacagaattcaacggctgaagatgtggaacgtgccgtcaccgccgccaatgaagccaaaacggcttggagaaagctgacgggtgccgagcgcggccaatacttatacaaaacagcggatatcatggagcagcgcttggaggaaatcgccgcctgtgcaacgcgtgaaatgggtaaaacattgccggaagcgaagggagaaacagcccgggggattgccattctgcgctattacgccggagagggcatgcgaaaaacgggtgacgtcattccgtctactgacaaagacgcgctcatgtttaccacccgtgttccgctcggtgtggtcggtgtgatttctccgtggaacttcccagtggcgattccgatttggaaaatggcgccggcattggtatacggcaataccgttgtcatcaaaccggcgacagaaacagctgtgacatgcgcgaagatcattgcctgctttgaggaagcggggctcccggcaggggtcatcaatttggtgacaggcccgggttctgttgtcgggcaggggcttgctgagcatgacggtgtaaacgccgttacgtttaccggttcaaatcaagtcggaaaaatcatcgggcaagccgctttagcgaggggagccaaatatcagcttgagatgggcggcaaaaaccctgtcatcgtagctgatgacgctgaccttgaagctgcggcagaagctgtcataacgggggccttccgttcaaccggccagaaatgcaccgcgacaagccgtgtcatcgtacaaagcggaatttacgagcgctttaaagaaaaactgctccagcgcaccaaagatattacaatcggagacagcttaaaagaggatgtctggatgggaccgatagccagcaagaatcagcttgataactgcctgtcatacattgagaaaggcaaacaggagggcgcttcccttttaataggaggagaaaagctggagaacggaaagtatcaaaacggctattatgttcagcctgccatctttgacaatgtgacatctgagatgacaattgcccaggaggaaattttcggtccggtgatcgccttgatcaaggtggactcgatagaggaggcgctgaacatcgccaatgatgtgaagttcggtttaagtgcatccatcttcacggaaaacatcggccgaatgctttctttcattgatgaaatcgatgccgggctggttcggatcaatgcagaaagcgcaggtgttgagctgcaggcgccttttggcggcatgaagcagtcgagctcccactcccgagaacagggtgaggcagcgaaggactttttcacagcgatcaaaactgtttttgtgaagccgtaa

SEQ ID NO: 46755 - DNA, 1368 bp, Bacillus subtilis
atgaaaaaagactttgcgagtgttactccggcgggcaaaaaaacgtccgtgcgctggttcatcgtgtttatgctgtttcttgtgacctctattaactacgcggatcgagcgacgctttccatcaccggagattccgtccagcacgatttgggattggactcggtcgccatgggatatgtcttttctgcctttggctgggcctatgtcatcggacagcttccgggcggctggctgctggaccgttttggttcaaagactatcattgcgttaagcatctttttctggtcgttttttacgttgctgcaaggggcgattggctttttctccgccggcacagcgattatcctgctgtttgcactgcgttttctggttggtttatcagaagcgccttcatttcccggaaacggcagagttgttgcctcatggtttccaagctccgagcgcgggacagcttcagccttttttaattcagcacaatacttcgcaatcgtcatttttcctcctttaatgggctggcttacccactctttcggctggcattccgttttcgttgtcatgggtattgcaggcattcttctggctgtcatctggctaaaaacggtgtatgaaccgaaaaaacatccgaaggttaatgaagctgagcttgcgtacatcgaacagggcggcgggctgatttccatggatgacagtaaaagcaaacaagaaacagaatcgaaatggccgtatatcaaacagctgttaacgaaccgcatgctgattggcgtgtacatcgcgcaatactgtattacgactctcacctatttctttctcacatggtttccggtatatttggttcaggcccgcggcatgtctattcttgaagctgggtttgtcgcttccctgccggcgctgtgcggatttgccggcggcgtgcttgggggcattgtgtcagacatcttactcaaaaaaggccgttcactgacctttgcaagaaaagtgccaatcattgccggcatgctgctgtcttgcagtatgattgtctgtaactacacagattcagcatggctcgtcgttgtcattatgtcgctcgcgtttttcggaaaaggcttcggcgcattgggttgggctgtcgtgtcggacacgtctccgaaagaatgtgcaggattaagcggcggtttgttcaacactttcgggaatattgcctcaattacaacaccgattattatcggatacattgtcaatgccactggatctttcaatggcgcgcttgtgtttgtcggcgctaacgcgattgcggcgatcctcagctatttgctgctggtcgggccgatcaaacgggtcgtgttaaagaaacaagaacaagaccccgatcaatcgttgcctgtctaa

SEQ ID NO: 46756 - DNA, 933 bp, Bacillus subtilis
atggatcaaacacgtacactcggcaaaacgaagctgaaggtgaagcggatcggattcggcgcgaatgcggtcggcgggcataatctatttccaaatctaaatgatgaaacagggaaggatttagtgcgcacggcattggatggcggcgtcaattttatcgataccgcctttatatatggattggggcgatctgaagaattaatcggcgaagtcgtacaggaacgcggcgtgcggaatgagctcatcatcgccaccaaaggagctcataaagaagtggacggcagcattgaattagacaatagccgggagtttcttcgcagcgaggtggagaagagcctgaagcggctgaaaacagattacattgatttgtattatgttcactttccggatggaaaaacacctctcgctgaagtggcgggcactttgaaagagctgaaggatgaggggaaaatcaaagcgatcggcgcttcgaacctcgattatcagcaattgcaggattttaatgctgacggctatttggaggtcttccaggccgaatattctctcatacagcgtgatgccgagaaagagcttcttccatactgtgaaaaacaaggcatctcctttattccttactttccgcttgcgtccggactgctgacaggaaaattcacgcaagacacagtctttgatgatttcagaaaggataaacctcaatttcagggtgaaacgtttatccacaatctcaaaaaagtagataagctgaaagcagtagcggaggaaaaacaagcggatacggcacatgtcgccttggcgtggctgttaacgagaccggcgattgatgccattattccaggagctaaacgaccggagcaattacaggataacctgaaaaccttgaacattgaactgaccgaagatgaagtgaatttcatcagcgacattttcaaataa

SEQ ID NO: 46757 - DNA, 777 bp, Bacillus subtilis
atgtacaaagatttaaccggaaaaacagcgattgtgacagggtcttcaaaaggaatcgggaaagccattgcggaacggttcggaaaggagaaaatgaatgttgttgtaaattaccacagcgacccgtctggagcagatgaaactctggaaatcattaagcagaacggagggaaagccgtctcagttgaggcggacgtgtcaaaagaagaggggattcaggcgctcttggacacagctttagagcatttcggcacgctcgatgtgatggtaaacaactccggttttaacggcgttgaggcgatgccgcatgagatgagtcttgaagattggcagagagtgattgatgtcaatgttaccggaacctttctgggagcgaaagcagcacttaaccacatgatgaaaaacaatatcaagggcaatgtgctgaatatctcaagtgttcatcagcagattccgcgccctgtaaacgttcagtattccacatccaaaggcggcatcaagatgatgacggaaacgctggcgctcaattatgcggataagggaatccgcgtcaatgcgatagcgcccggcaccattgccacagaatcaaatgttgatacgaaaaaggaagagagcaggcaaaaacaattgaaaaaaatcccgatgaaagccttcggaaagcctgaagaagtggcggcagcagcagcttggctcgtatctgaggaagcaagctatgtgaccggcgcaacacttttcgtcgacggcggaatgacactttatccatctcagcttgaatag

SEQ ID NO: 46758 - DNA, 1686 bp, Bacillus subtilis
atgaaaacagactggtggaaggatgcagtggtgtaccaaatttacccgagaagctttcaggacagcaatggagacggaattggggacttgcgggggattatttcccgtcttgactacataaaggagctcggggcagatgtgatttggatttgcccgatctatccttctccgaatgttgattacggctatgatgtgacaaaccataaggcgattatggattcttacggaacaatggacgattttcacgagctgctggaccaggtgcatcagcggggattaaagctggtgatggactttgtgttaaatcacacctcggtcgagcatccgtggtttaaagaagcggagctggacaaaaacagcaaataccgtagctattattattggcgtcccggcacaaagaacggcccgccgacggactggctctcaaactatggatgcccggtctggcaatacgaagagcacaccggagaatactatctccatatgaatgccgtcaaacaagctgatttaaactgggaaaatcccgaagttcgccaggcggtgtatgacatgatgaaattttggctcgataaaggggtcgacggtttgcgaattgatcagctccatctcatttctaagaaagaatatcttccttcgtatgaggactatatcaatcagcaggcagagccgaagccctttcagccaaatggcgaacgaatccatgactatttaaaagaaatcacagatgaagtgttttctcattatgatgtcatgtctgtcggagaggtcggcagtgtcacaccggaagaaggcctgaaatatacgggaacagataagcatgagctgaatatgatttttcactttcagcatatggagcttgatcagcagcccggaaaagaacattgggatttgaagccccttgagctttctgatttaaaatcggttttgacaaaatggcaaaagaagcttgaacatcaaggctggaatacattgttttggtgcaaccacgaccagccccggattgtgtccagattcggagacgatggggaataccgcaaagcatcagcgaaaatgctggcagccgtaatttattttatgaagggcacgccgtatatttatcagggagaagaaatcgggatgacaaacgcgccgttcacccggattgaagactacaaagatatccaaacgatcaatatgtatcataaacgggtgtttgaaaaaggctatgatccaaatgatgtgatgagatcgatcttagccaaaagccgggatcacgcccggaccccgatgcagtggaacagcggcaaaaatgccggatttactgacggcacgccttggctgaaggtcaatccgaacttcaccgcaatcaatgtggaggaagcgcagggagatcctgattctgtcttaaactattacaaaaagctgatcagcctgagaaagcagtacgctgacctcatgaaagggagctttgatcttttgcttccggacgatccgcagttgtttgtatacatgagagaaaacagtaaacaacagcttttgtcggtcaataatttttcaaaagagcaggctgtttttcagtggcctaagaactgcggcaaagctcaggcctcactgcttctcagcaattataacaacgatgatcttgatgacgaaatggtgttccggccttatgagagcagggtctatcttctggacaaaacaaactaa

SEQ ID NO: 46759 - DNA, 1203 bp, Bacillus subtilis
atgggaaaacaacagcctatatcccagcgtaaactgctgggcgtcgccggtttggggtggctgtttgatgcaatggatgtcggaatattatcgtttattatcgccgcgctccatgtagagtggaatctgtcgcccgaagaaatgaaatggatcggaagcgtcaattccatcggcatggctgcgggtgcgtttttgtttggtttgcttgctgatcgaatcggccgcaaaaaagtgttcatcatcacccttttatgcttttccatcggaagcggcatttccgcttttgtgacgagcttatcggcatttctaatccttcgtttcgtgattggtatgggacttggcggcgagcttccagtcgcttcaacactcgtttcggaagcggttgtgcctgaaaagcggggcagagtgattgtgcttttggaaagcttttgggccgtgggctggctcgcagcggccttgatttcttactttgtgataccaagcttcggctggcaggctgcccttctgttaactgcgctgactgctttttatgcgctgtacctgcggacgagtctacctgattcgccgaaatatgaatcgctttctgccaaaaagaggtcgatgtgggagaatgtaaaaagcgtctgggcaagacagtatatacggccgacggtgatgctgtcgatcgtttggttctgtgtggtgttttcttattacggcatgttcctatggctcccgagtgtcatgctgctgaaaggcttcagcatgattcaaagctttgaatatgtcctgctgatgacgcttgctcagctacctggctatttctctgccgcatggctgattgaaaaagcgggccggaagtggatactcgtcgtttacttgattggcacagcaggaagcgcctatttcttcggaacggcggattccttaagtcttctgcttacggctggagtgctgttatcgtttttcaatctcggtgcgtggggcgtgctgtatgcttataccccggagcaatacccgactgcgattcgagcaacaggttcaggaacgacagcagcgtttggaagaatcggcggcatcttcgggcctttgctcgtcggaaccctggcagcccgtcatatttcgttttcggtcatcttttcaatcttttgcattgcaatcttacttgcggttgcttgtattttgattatggggaaagaaacgaaacaaactgagctagaatag

SEQ ID NO: 46760 - DNA, 966 bp, Bacillus subtilis
atgatgaacaaacatgtaaataaagtagctttaatcggagcgggttttgttggaagcagttatgcatttgcgttaattaaccaagggatcacagatgagcttgtggtcattgatgtaaataaagaaaaagcaatgggcgatgtgatggatttaccccacggaaaggcgtttgggctacaaccggtcaaaacatcttacggaacatatgaagactgcaaggatgctgatattgtctgcatttgcgccggagcaaaccaaaaacctggtgagacacgccttgaattagtagaaaagaacttgaagattttcaaaggcatcgttagtgaagtcatggcgagcggatttgacggcattttcttagtcgcgacaaatccggttgatatcctgacttacgcaacatggaaattcagcggcctgccaaaagagcgggtgattggaagcggcacaacacttgattctgcgagattccgtttcatgctgagcgaatactttggcgcagcgcctcaaaacgtacacgcgcatattatcggagagcacggcgacacagagcttcctgtttggagccacgcgaatgtcggcggtgtgccggtcagtgaactcgttgagaaaaacgatgcgtacaaacaagaggagctggaccaaattgtagatgatgtgaaaaacgcagcttaccatatcattgagaaaaaaggcgcgacttattatggggttgcgatgagtcttgctcgcattacaaaagccattcttcataatgaaaacagcatattaactgtcagcacatatttggacgggcaatacggtgcagatgacgtgtacatcggtgtgccggctgtcgtgaatcgcggagggatcgcaggtatcactgagctgaacttaaatgagaaagaaaaagaacagttccttcacagcgccggcgtccttaaaaacattttaaaacctcattttgcagaacaaaaagtcaactaa

SEQ ID NO: 46761 - DNA, 561 bp, Bacillus subtilis
atgaacgctaaacgagccatcccagtaagagaaagaaatatcgtcctgatcggattcatgggtgtaggaaaaacaacaatcggccaattggtcgctaaaaaattatatagagattttattgatattgaccagcagatcgaaaaggatttcaatatgtcaattcctgagatatttgagaaaaagggagaagacttttcccggaaaacggagaaggaatatattttagacatctgccatcataaacgattcaaaatcgtatctctgggcgggggatcttttaaacaagaagaaatcagaaattgctgtctggaaaactgtctcgtgcttcatctggacctgtcatgggagaactggaagcagcgcgcggatttattgatcgaaagccgccctgtactgcataaccgttcaatggatgaaatggaacagctgtttaacgaaagaaaagtcatttatgacaagcacaattcaaaagtggcaacagacaacctttccccggaagaggttgccgattacattgttgagacattaaaaattggctgggatctttatcagccgatgtaa

SEQ ID NO: 46762 - DNA, 1548 bp, Bacillus subtilis
atgacaacaccttacaaacacgagccattcacaaatttccaagatcaaaactacgtggaagcgtttaaaaaagcgcttgcgacagtaagcgaatatttaggaaaagactatccgcttgtcattaacggcgagagagtggaaacggaagcgaaaatcgtttcaatcaacccagctgataaagaagaagtcgtcggccgagtgtcaaaagcgtctcaagagcacgctgagcaagcgattcaagcggctgcaaaagcatttgaagagtggagatacacgtctcctgaagagagagcggctgtcctgttccgcgctgctgccaaagtccgcagaagaaaacatgaattctcagctttgcttgtgaaagaagcaggaaagccttggaacgaggcggatgccgatacggctgaagcgattgacttcatggagtattatgcacgccaaatgatcgaactggcaaaaggcaaaccggtcaacagccgtgaaggcgagaaaaaccaatatgtatacacgccgactggagtgacagtcgttatcccgccttggaacttcttgtttgcgatcatggcaggcacaacagtggcgccgatcgttactggaaacacagtggttctgaaacctgcgagtgctacacctgttattgcagcaaaatttgttgaggtgcttgaagagtccggattgccaaaaggcgtagtcaactttgttccgggaagcggatcggaagtaggcgactatcttgttgaccatccgaaaacaagccttatcacatttacgggatcaagagaagttggtacgagaattttcgaacgcgcggcgaaggttcagccgggccagcagcatttaaagcgtgtcatcgctgaaatgggcggtaaagatacggttgttgttgatgaggatgcggacattgaattagcggctcaatcgatctttacttcagcattcggctttgcgggacaaaaatgctctgcaggttcacgtgcagtagttcatgaaaaagtgtatgatcaagtattagagcgtgtcattgaaattacggaatcaaaagtaacagctaaacctgacagtgcagatgtttatatgggacctgtcattgaccaaggttcttatgataaaattatgagctatattgagatcggaaaacaggaagggcgtttagtaagcggcggtactggtgatgattcgaaaggatacttcatcaaaccgacgatcttcgctgaccttgatccgaaagcaagactcatgcaggaagaaattttcggacctgtcgttgcattttgtaaagtgtcagactttgatgaagctttagaagtggcaaacaatactgaatatggtttgacaggcgcggttatcacaaacaaccgcaagcacatcgagcgtgcgaaacaggaattccatgtcggaaacctatacttcaaccgcaactgtacaggtgctatcgtcggctaccatccgtttggcggcttcaaaatgtcgggaacggattcaaaagcaggcgggccggattacttggctctgcatatgcaagcaaaaacaatcagtgaaatgttctaa

SEQ ID NO: 46763 - DNA, 2133 bp, Bacillus subtilis
ttgactgaacgactgcttagatatttccgtgataaacagcaagacgtccaatcagaaaaaacatatgacactcaatgcccgttttgcagcatgcagtgcaaaatgcagctcgtggaacaaaccatcgtcacgcgcaaaaagtacactgcgatcgggattgataatcctacgacacagggtcggctatgcatcaagggcatgaatgctcaccagcatgccttgaactcctcccgcatcacccggccgctgctgaagaaaaacggcgagtttatgcctgtttcctgggaagaagcactgaatcatatcaaagaccaagtgacaatgatccaaactgaacacggacatgacgccatggcggtatacggaagcgcctcgattacaaatgaagaggcgtatttgttagggaagttcgcacgagtaggcttacagacaaaatacatcgactacaacgggagactttgtatgtccgcagcagccaccgcagccaaccaaacattcggcgcggacagaggcttaacgaatcctttatcagacatcccccacacccgtgtgatcattctggccggcaccaatattgcggaatgccagcctacgattatgccgtattttgaaaaagcgaaagaaaacggagcttacttcattgccattgatcctcgtgaaacagcgacaacgaaaatcgccgatcttcatctgaaaatcaaacccggcacagacgccgcccttgccaacggtctcgtcaaaatcatcattgacgaacagcttataaacgaggatttcattcaatcacgaacaaatggattcgaagagctgaagcagcatactgactcgttggacctgaatgacatcgccgaacagacgagtgtctcgctggtggatataagaaaagctgctgtgaagtttgccaaggaaacgtccggcatgctgtttacagcccgcgggattgaacagcaaaccgatggaacagcggctgtgaaaggcttcttaaacatggtgctgatcacaggaaaaatcggcaaaccttactcgggctacggggcgatcaccggacaaggcaacgggcaaggcgccagagagcatggccaaaaagccgatcagcttccaggctaccgttctatcgaaaacgaagaacaccgggcgcatattgcgaaagtgtggggaatccatcaggatgatctcccgcgaaaaggtgtctcagcctatgaagtgatggaaaaaatcaatgacggcgacatcaaaggactgttcctcatgtgctccaaccctgctgtttccagtccaaatgcaaatctcgtgaaaaaggctttaagaagactgacattctttgtcgcaatcgatttgtttatttctgagactgcgaaatacgcagatgtgattttacctgcctcctcttacttagaagatgaaggcaccatgacaaatgtagaaggacgcgtgacattaagagaagcaagccggccatgccccggcgaagcaaagcatgattggcagatcatttgtgatctcgcatccgctctcggcaagggccgctacttttcttatacgtcagcggaggatattttcaatgaattgagagaagcgagccgaggcgggattgccgattattcaggcatctcatacggcaggctcagacgtgaaggcggcattcattggccgtgtccggaatctgatcatcccggaactgggcgcttgtttacagaatcatttgctcatccggatcaaaaagcggcattaagtgtgattccaaacgaaccacctgttccaaaagagaagccgacagccgattatccgctttatttaacgacaggcagagtcatgtctcactacttaacaggcgtccaaacaagaaaaagcgccgcccttgccgcgagacattttgaatcgtttatggagatccatccgcaaacagcagcgacctacaatatcgaggaccgtgtactggtaaaaatagaatcgccgcggggaagcatcaccgtccgcagcaaattatcagaacaaatcagaaaagataccgtttttgttcccatccattgggcagacgctcaaaatgtgaatgatttaatcggggaagccttagatccagcctgtaaaatgcccggttttaaggtatgcgccgtccgaatcatacctatttaa

SEQ ID NO: 46764 - DNA, 1434 bp, Bacillus subtilis
atgatccaccagcatccagaatcttttccgaaacattttttgtggggctctgcttctgcagcgtaccagattgaaggcgcttggaatgaagatggcaaaggcccttctgtttgggatgtgtttacgaaaataccgggcaaaacgtttaaaggaaccaatggcgagattgcggttgaccattatcaccgatttaaagaagatgtcgctctgatggctgagatggggttaaaagcatatcgattttccgtcagctggccacgggttttcccaaaaggaaaaggagagatcaatgaagcaggtctagcgttttacgatagtctgattgatgaattgctttctcatcacatcgagccggttctgactttatatcactgggatttgcctcaagcgcttatggacgaatacggcgggtttgaatccagaaacatcatagaggattttaatcactactgtattactctttataaacgttttggagacagggtgaaatattgggttacgttaaacgaacagaactacaattttaatcacggatttattacagccatgcatccgcctggagtgaaagacagaaaacgattttacgaagcaaaccatattgcgtttctggctaatgcaaaagccatcgaatcatttagagaatatgtgcctgaaggcaaaataggtcctagctttgcttattctccggcttaccctttatcaagtcatccagaggatatactggcatttgaaaacgccgaagaatttacgaacaattggtggcttgacatgtattgctggggaacctacccgcaaattccattccgctgcttggaaaaacagggatgggcgccgacaattgaagcaggagatatggacctgctcgccaaagggaagcctgattttgtaggtgtcaattattatcagacgatcacctatgaacgaaatccgcttgatggtgtgtcagaagggaaaatgaatacgacaggccaaaagggaaccaatcaggagacggggatacccggagtgttcaaaacgaaaaaaaatccgcatctgacaacgagcaactgggattggacaattgacccaattgggctgcgtatcggtcttcgccgaattacaagccgctatcagcttccagtgtttataacagagaacggtttgggtgaatttgataaagttgaggacggcactgtacaggatgattatcgaattgattatttgcgttcgcatcttgagcaatgcagacaagccatcagtgacggtgtcgatttaatcggctattgcagctggtcgtttactgatctgttaagctggctgaacggctaccaaaaaagatacggatttgtatatgtcaatcgtgatgaagaaagcacatccgatttaaaacgcttgaagaaaaaaagcttttattggtatcaagatgtcatcaagacaaacggagaaagtttataa

SEQ ID NO: 46765 - DNA, 1365 bp, Bacillus subtilis
atgaaggtcgttaaattcggaggcagctcacttgcttcaggcgcccagcttgacaaggtgtttcacatcgttacctcagatccggcacggaaagctgtagtcgtttcagctccgggaaaacactatgccgaggatacgaaagtgactgatctcttaatcgcatgtgcagaacaatatttggcaacaggcagcgcacctgaactggcggaagctgttgtggaacggtacgctctcatcgccaatgagcttcagctggggcaaagcattatcgaaaaaatcagagatgatctgtttacgcttttagaaggagacaaaagcaatcccgaacaataccttgacgcagtcaaggccagcggagaggataacaatgccaaactgatcgccgcttacttccgttataaaggcgtcaaagcggaatatgtaaacccgaaggatgccggcctctttgtgacaaatgaacccggcaacgcgcaagttcttcctgaatcctatcaaaacctctatcgtcttcgggaacgtgacggactcatcatttttcccggttttttcggattcagcaaggatggcgatgtgatcacattctcacggagcggttctgatattaccggttcgattcttgccaacggactacaagccgatttgtacgaaaactttacagacgtagacgctgtgtattctgtcaatccgtccttcgttgagaatccaaaggaaatcagcgagctgacatatagagagatgcgggagctgtcctacgcgggtttttcagtgtttcatgatgaagcgctcattccggcattcagagcggggattcctgttcagatcaaaaatacgaacaacccctcagccgaaggcacccgcgtcgtcagcaagcgggataacacaaacgggcctgtcgtcggcattgccagcgacaccggtttttgcagcatttatatcagcaagtatctcatgaacagagaaatcggttttggccgcagagcccttcaaatcctggaggagcatggtttgacgtatgagcatgttccatcgggaatcgatgacatgacaatcattttacggcaggggcaaatggatgccgccactgaacgcagcgtcatcaaacggatcgaagaggatttgcatgccgatgaagtcatcgtcgagcatcatctcgccctgattatggttgtaggggaagcgatgcgccacaatgtcggtacaacggcaagagccgccaaagcattatcagaggcacaggtgaatatcgaaatgatcaatcaggggtcttctgaagtgagcatgatgtttggcgtaaaagaagccgaagaaagaaaagccgttcaagcgttataccaggaatttttcgcgggcgtgctgatctcttaa

SEQ ID NO: 46766 - DNA, 1311 bp, Bacillus subtilis
atgagtcaaacaacagcaagcatcacaactgcacaatggcagcaaaaacgggatcaatttgtgtcaaaaggtgtgagcaacggcaaccgcagtctggcggtcaaaggagaaggggccgagctgtacgatctggatggccggagatttattgattttgcaggcgccatcggcacgttaaatgtcggacactcgcatccgaaggtggttgaggctgtgaagcggcaggcggaggagctgattcatcctggttttaatgtcatgatgtacccgacttatatcgaattagcagaaaaactgtgcggcatcgcgccgggcagccatgagaaaaaagcgatttttcttaactcaggggcagaagcggtcgaaaacgctgtgaaaatcgccagaaagtatacaaagcgccaaggcgttgtctcgtttacacgcgggtttcacgggcgcacgaatatgacgatgagcatgacaagcaaggtaaaaccttataaattcggtttcgggccttttgcgccagaggtttatcaagcgccgttcccttattattatcagaagccggccggcatgagtgatgaaagctatgacgatatggtcattcaagcattcaatgatttctttatcgcttcagtggcgcctgaaacggtggcgtgtgtcgtgatggagccagtgcagggagaaggcggatttattattccttcgaaacggttcgtacagcacgtcgcttcattctgcaaagaacacggcattgtttttgttgctgatgaaatccaaaccggctttgccagaactggcacttatttcgcaattgagcactttgatgtagtgcccgatctgatcacggtttctaaatcgcttgcggcaggcctgccattaagcggtgtgatcgggcgtgcggaaatgcttgatgcggcagcgccaggggagctgggcggcacgtatgccggcagcccgctcggctgcgcggcggctttggcagtcttggatattatcgaagaagaaggactgaatgagcgatctgaagaaattggcaaaatcattgaagacaaggcgtatgagtggaaacaagaattcccgttcatcggtgacatccgcagactcggggcgatggccgcaatcgaaatcgtcaaggatcctgacacgcgtgagcctgataagacaaaagcagcagcgatcgcggcctatgcgaatcaaaacggattacttttgctgacagcgggaattaacggtaatatcatccgctttttgacaccgctcgtcatctcagacagcctattaaatgaagggctcagcatcttggaggcgggcctgcgagcttaa

SEQ ID NO: 46767 - DNA, 1389 bp, Bacillus subtilis
atgccagatcaattaacggtctacaacccggctacgggcgaggagatcaaaacgattcctcagcaatcagccacagaggtagaagaagccattgaacgttcacatcaagcgtttaaaacgtggtctaaaacatcagcgaacgaaagaacgtctcttttgaaaaaatggtatgagctgattgttgaacataaagaagagcttgcagatttaattacaaaggaaaacggaaaaccataccaggaagcagtcggcgaggtactttacggcgcaggctatatcgaatggttcgcagaggaagcgaagcgtgtgtacggaagaacggtcccggccccgacaactggtaaacgaattgttgtcacacgccagccggtcggccccgttgctgctatcacgccctggaatttcccgaatgcgatgattacacgcaaagcggcgcctgctcttgccgccggctgtacatttatcatcaagccggcgccggacacaccgctgtctgcttatgaactagcgcgcctcgcatatgaagcgggcattccgaaggatgttcttcaggttgtgatcggcgatggagaagaaatcggaaatgtgttcacaagcagtccgaaaatccgcaaaatcacgttcacaggctcaacacctgtagggaaaatccttatgaaaaacagcgctgacaccgtaaagcacgtctcaatggagctcggcggacacgccccgctgatcgtagatgaagatgcggacattgaccttgccgttgaacaggcgatggcgtccaaataccgaaacgccggccaaacctgcgtatgtgccaaccgcctgatcgttcatgaatccattaaagatgaatttgctgcgaaactgagcgagcaagtgtctaagctgaaagtcggaaatggacttgaggaaggcgtcaatgtcggcccgattatcaacaaacgaggcttcgaaaaaatcgtcagccaaatagatgatgcggttgaaaaaggcgcgaaagtgattgctgggggcacatatgaccgaaacgatgacaaagggtgctactttgtgaatccgacagtgctcaccgatgtcgatacgtccatgaacatcatgcatgaggaaacattcggcccggtcgccccgatcgtcacgttttctgatattgatgaagcgattcagcttgccaacgatacaccgtatggcttggctgcttacttcttcacagaaaactaccgccgcggcatctatatttccgagaatctagagtatggcattatcggctggaatgacggcggaccgtcagcggttcaagcgccattcggcggaatgaaagaaagcggcatcggccgtgaaggcggttcagaaggtatcgagccgtaccttgaaacaaaatatttgtccatcggtttataa

SEQ ID NO: 46768 - DNA, 786 bp, Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggataaagctgatgacagaaacattagcgttggaatacgcgccgaagggcattcgcgtcaataatattgggccaggtgcgatcaacacgccaatcaatgctgaaaaattcgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacacaatatccttcattccaggcaggccgcggttaa

SEQ ID NO: 46769 - DNA, 903 bp, Bacillus subtilis
atgcagcgtattcaattggcggaggatcttcaattttcaagagtcatacacgggctttggcggctgaatgaatggaactattcagatgctgaacttctaagcctcattgaatggtgtatcgatcacggcatcacgacctttgatcatgcggatatttatggaggctatacgtgcgaaaagctgtttggaaacgcccttgccctttcgcctggattaagagaaaacatagagttggtcacaaaatgcggtatcgttcttgaatcgcctgaacggcccgctcacagatcgcatcattataacacaagcaaatcgcatattttggcatccgttgagcaatcgcttatgaaccttaggacggattatatcgatatgcttttgattcacagaccggacccgctcatggatccggagggggtagcagaggcgtttcaggccttgaaatgctctggcaaggtcaggtactttggcgtttcaaattttaaagatcaccagtatcggatgctggaatcatatttgcctgagaagctcgtaaccaaccagattgagctttccgcatacgaattagaaaatatgctcgacggcactttgaacctgtgccaggaaaaacggattccgccgatggcttggtcgcctctggcaggcggcaaagtattcactgaaaacacggataaagaccgacgtgtccgtacggcgcttgaatccgtccaaggggaaatcggcgccgcttcattggacgaggtgatgtacgcatggctgtatacgcatccggccggcatcatgccgattgtcggaagcggaaagcgcgagcggatttccgccgcgataaatgcgttgtcatacaagcttgaccaggatcaatggttccgcatttttacagccgtacagggttacgatattccataa

SEQ ID NO: 46770 - DNA, 1398 bp, Bacillus subtilis
atggaaacattacagcatctgattctgcatgacatgccgaatagcgaagaaatagaggctgtaaaaagcggagaccatacactgacatataaaggttaccgtaaacggattaatcagctggcgaatgccatgcttcaaaaaggaattcaaaagggcgaccgtgttgcattgctttgcaaaaacggccatcccgcctcaactgttatgttcgccgcacttgaaataggtgctgttgtcgtacctgtcagctggcagctgaaaccatatgaaatgacaggcattttaaaagcaagtgaaccaaaagcgatgttttacggagcggagtttaaagagatactggatgaagttcttcctgaattgtcctcactgtgtgtaacaatggaaacaggaacagcttacgaaacatctgctgaatttgaagcgctgtttgcaggtcctgatcatttgccagagacggaaatggtttcacctgatgatacagcacttctgatgtttacatctggaacaacgggaaacccgaaaagatgcatgattacacatggcggcatatacagatacgttaaaaaatccaacagctcaatagcacgtatgaagggccttcgttttctcgcgtgccatccgatttatcatacgagtgcgctcatttgcatcatgcttggaacgtttgcagaaacaacatttgtgtttacaaaggatcaagatcctgttcacatgctgaaggtcattgaagaagagaagattcagaccgtgatggctcttcctgtgttctacacgtatttgcttgaggcgtgggaaaagcaccaaactgacttatcttcgcttgttattttaatgacaggcggaacaaaagtgccgagcagcctaataagccgctatcttgatattggcattccgcttgcgcatggctatggaagtactgaggcttggggcatcagcacatggacgcctgatatgggaatggataaagcggcatctgcaggaaaacctgtggcaggtgttaaagtcaaagtggaagatcctctgaccggagaagaacttcctcaaggagaaatcggcgaaatcgttgttcatactccattcttatttaaaggctatgaagacaatcctgaagcaacagcgaaagtgctgcaaaatggatggtttagaaccggagattcaggatatgtagatgaagatggctttattttcatcacgggacgctacaaggatgtcattatttacggaggcgataacgtctatcctgatcaggttgaagaagttatccagcagatcccgggaatccttgaaacggctgtggtcggtattcctgacccgctttacggtgaaaaaccgaaagcttttatcgtgaaaaatggcggccagcgcatcacggaagaggatgtcatcgcatttttgtaa

SEQ ID NO: 46771 - DNA, 861 bp, Bacillus subtilis
atggcaaattatccaaaagaactgccggcacaaactcaaagtcgccagccgggaattgaaagcgaaatgaatccaagtccggtgtatgagtacgaggattataaaggagcagacaaattaaaaggaaaagtagctcttattacaggcggcgacagcgggatcggacgcgcggtttccgtcgcttacgcaaaggaaggcgcagacatcgccattgtgtataaggatgagcatgaagacgctgaggagacgaagaaacgtgttgaacaagaaggcgtaaaatgcctgctgattgctggtgacgtaggtgaagaggaattctgcaatgaagcggttgaaaaaacggtcaaggaactaggcggccttgacatccttgtcaacaatgcaggtgaacagcacccgaaggaaagcatcaaagatattacgagcgaacagcttcaccgcacattcaaaacaaatttttattctcaattttatttgactaaaaaagcaattgattacctgaaaccgggcagcgccatcatcaatacgacatccatcaacccgtacgtagggaacccgacactgattgattatacagcgacaaaaggggcgatcaatgcctttacaagaacaatggcgcaggcgcttgtcaaagacggcatccgtgtaaatgcagtcgcgccgggtccaatttggacgccactaatcccagctacgttccctgaagaaacagttgctcaatttgggcaagatacgccgatgggccgtcctggacagcctgttgagcacgtcggctgttatgtgcttctggcatcagatgagtcctcttacatgacaggtcagaccctgcatgtcaacggcggaaactttgtgacgacataa

SEQ ID NO: 46772 - DNA, 2184 bp, Bacillus subtilis
atgtcaaaaacagttgtattagctgaaaaaccttcagtcggccgggatttagcccgggtactgaagtgccataaaaaaggaaacggttatctcgaaggcgatcaatatattgtgacttgggctttaggccatttggtgacgcttgctgatccggaaggctacggaaaagaatttcaatcatggcgcctagaggatctgccgattatcccagaacccttgaagcttgtggtgataaaaaaaaccggaaagcagttcaatgcagtcaaatcccagcttacccgtaaagacgtcaatcagattgtcatcgcgactgacgcaggccgggaaggtgagcttgttgcgcgctggatcattgagaaagcgaatgtccgaaaaccaatcaagcggctgtggatttcatctgtgacggataaagcgatcaaggaaggttttcaaaagctgcgcagcggcaaagaatatgaaaacctgtaccattctgccgtcgccagagcggaagcggattggattgtggggatcaacgccacccgtgcacttaccacaaaattcaatgcccagctctcatgcgggcgtgtgcagactccgacgcttgccatgattgcaaagcgcgaggcagacattcaggcgtttacgcccgttccgtattacggcatacgtgctgcagtcgacggcatgacgctgacgtggcaggataagaaatcaaagcagacgagaacgttcaatcaagatgtaacaagccgtttgctaaaaaatctccaaggaaagcaagcggtcgtagctgagctgaaaaaaacagcgaaaaaaagctttgcgcctgcgctttatgatttaacggagctccagcgtgacgcccacaagcgcttcggtttttctgccaaagaaacgctttctgtcctgcagaagctatatgagcagcataagctcgtcacatatccgcggacggactctagatttttatccagtgacatcgtcccgacgttaaaagaccgtctggaaggcatggaagtaaaaccgtatgcccaatatgtcagccaaattaaaaaacgcggcattaaatctcataaaggatatgtcaatgacgcgaaggtgtcagaccaccacgcgattatcccgaccgaagagccgctcgttctcagcagtctgagtgataaagaacgaaagctgtatgacctgattgcgaaacgtttcctggctgtattaatgcctgcattcgaatatgaggaaacaaaggtcatcgcagaaatcggcggagaaacctttacggcgaaaggcaaaaccgtgcagtcgcaagggtggaaagccgtttatgatatggcggaagaggatgatgagcaggaggatgacagagatcagacacttcctgcgcttcaaaaaggcgacacacttgccgtccgcacgttaacggaaacaagcggccaaacgaagccgcctgcccgctttaatgaagggaccttgctgtcagcgatggaaaacccaagcgcgtttatgcagggagaagaaaaaggcctcgtcaaaacgcttggagaaacaggcggcctcggcacggtggcaacgcgtgccgacattattgaaaaactgttcaacagctttttaatcgagaaaaaaggccaagatatttttatcacatctaaaggaaaacagctcctgcagcttgttccggaggatctgaaatcaccggccttaacagcagaatgggagcaaaagctgtctgcgatcgcggccggcaaattgaaatcggctgtttttattaaagatatgaaggcttacgctcaccaaacggtaaaagaaatcaaaaacagcagccaaaccttccgacatgacaacattacgggaacggcatgtccggaatgcggcaaaatgatgctgaaagtaaacggcaaacgcgggacgatgctcgtgtgccaagatcgtgaatgcggaagcagaaaaacgattgcccgaaaaacaaacgcacgctgcccaaattgccataaaagaatggagcttcgcggccaaggcgagggccaaacctttgcgtgtgtgtgcggtcaccgtgaaaagctctctgtatttgaaaaacgaaaaaacaaagacaaagcgcgtgctaccaaacgggacgtatcctcttatatgaaaaaacaaaataaagatgagccgattaacaacgcgctggcagaacagctgaaaaaactcggtttggataaataa

SEQ ID NO: 46773 - DNA, 1725 bp, Bacillus subtilis
atggcacacaaaactgcaggacaagcaatgacagagctgcttgagcaatggggagttgatcatgtatacggcatccccggagacagtataaatgagtttatcgaagaattaagacacgaaagaaatcaactgaagttcattcaaacccgccacgaagaggtagcggcactggcagccgcggctgaagcaaaactcaccggcaagatcggagtctgtctgtcaatcgcagggccgggagcggtgcacttattaaatggtttatatgatgctaaagccgacggcgcccctgtgctggcgattgcaggacaggtttcttctggcgaagtcggacgggactatttccaggagattaagctggagcaaatgtttgaggacgtggccgtgttcaacagagaggtacatagcgcggaatcacttccggatctcttaaatcaggcgatcaggaccgcctacagcaaaaaaggcgttgcggtattgagcgtgtcagatgatttgtttgcggagaaaatcaaacgggagcccgtgtatacttcaccggtgtatattgaagggaacctagaaccgaaaaaagaacagctcgtcacctgcgcccaatatattaataacgctaagaaaccgattatcctggcagggcagggaatgaaaaaggcgaaacgggagctcttagaatttgcggacaaagccgccgctccgatcgttgttacactcccggcaaagggtgttgttcccgataagcacccacattttctcggcaacctcggtcagatcggaacaaagccggcttacgaggcaatggaggaatgtgatttattaatcatgctcggaacgtcattcccgtaccgtgattatttgcctgatgacacgccggcgatacagctcgattcagacccggcaaaaatcggaaaacggtatccggtgacagcgggccttgtctgtgattcggctctcggtttgcgcgaattgacagagtatattgaacgcaaggaagacagaagattcctgaatgcctgcacagaacatatgcagcattggtggaacgaaattgaaaaagatgagacagaggcaacaacaccgcttaaacctcagcaggtcgtggcccgtcttcaggaagcggcagccgatgatgcggtgctctctgtagatgtcggcactgtgacagtctggatggcgcgtcatttcaaaatgaacgcgaatcaggatttcatcgtttccagctggcttgcgacaatgggctgcggcctgccgggagcgattgcagcgagcttgtccgaaccggaacgccaggcgatcgccgtctgcggtgacgggggattttccatggtcatgcaggaccttccgaccgccgttaaatataagctcccgatcacagtcgttattttaaacaacgaaaatctcggcatgattgagtacgagcagcaggtcaaaggcaatatcgactatgtcacaaaacttcaaaatgtcgactatgccgcatttgcagaaagctgcggagcaaagggcatcaaagtgaccaaagcggaagagcttgcgccggcttttcatgaggcgctgcactctgaccaaccggtcgtagtggatgtcatgattggaaacgaaccgccgcttcctggcaaaatcacctacgggcaggcgaaaggctttagcaagtacatgctgaaaaacttcttcgaaaaccaaaaatttgaaatgccgtcactgaagaaaagtttgaaacggttattttaa

SEQ ID NO: 46774 - DNA, 1266 bp, Bacillus subtilis
atgaaactgtttaaaaatttaacagttcaggtcataaccgcggtcatcatcggggtcattgtcgggctggtctggccggatgtcggcaaagaaatgaaaccgcttggtgatacatttatcaacgctgttaaaatggtgatcgcaccaatcattttcttcacaatcgttctcgggattgcaaaaatgggcgatatgaagaaggttggaaaagtagggggaaaagcgtttatctatttcgaggttgtcaccaccctcgcactcattatcggtttatttgtcgtcaatattatgaagccgggtgcgggtcttgattacagcaagcttgaaaaaggagatgtatcacaatacacgcaaaatggcggtcagggaatcgactggattgaatttattacacacattgttccgtccaacatggttgatgccttcgcaaaaggggacattttgcaggtcttattcttttctattcttttcggagtgggtcttgcggcattaggcgaaaaaggaaaaagcgtcattgatttcttcgacaaggtttctcacgtttttttcaaaattatcggctacattatgcgtgccgcgccaatcggggcattcggggcgatggcgtatacaatcggacacttcgggctcgattccatcaaaccgctggcaagcttaatgatgtctgtttatattacgatgttcctgttcgtatttgttgctttaaatatcatctgcaagctttacggattcagcctgtggaattaccttcgcttcattaaggatgagcttttgatcgtgcttggcacaagctcttccgaatcggtgcttccgcgtatgatggataaaatggagcgctacggctgttccaaatccgttgtcgggcttgttattccgacgggctattcgtttaacctcgacggcacatccatctatttatcaatggcgactgtctttttggcacaggtgtttggagtagacctcagcatcggccagcaaattacgattatcctcgttctgatgctgacatcgaagggagcggcaggtgtgacgggaagcggatttatcgtccttgcctcaacgctgtcagcgctgcaggtcattccgctggaggggcttgcactcctgctcggggtcgaccgtttcatgagtgaaggaagagccattgtgaacctgatcggaaacggaatcgccacgatcattgttgccaaaagcgaaaatgaatttgatgaagcaaaaagcatagaggctgttgaaggcatgaaaaaaatgaaaacagcagtctga

SEQ ID NO: 46775 - DNA, 1146 bp, Bacillus subtilis
atgtcattatttatacaaaacgatcaacagcggcaatggatggagaaaatcggacggattgcggatgaatttcagcaaacagctgctgaagatgacgaacagggacgttttcctgcagagaaaatacaaaaactgcgtgatgctgggtatacagcattaacattgccggcatctcatggcggagggggcatttctgtttacgatatgctcttgtttcaagaacggcttgcacggggagatgctccgacggctcttagcatcggctggcatttgagcgtgatcggggagcttggagaaggcaacagctgggatgaagacgtatttgcatttgttgccaaggaagtccaaaacggagccgtcattaacagggcggcgactgaagcgaaaaccggaagcccgacaagaggagggcgtcccggtacacacgccgtcaaaaaggatggcaaatgggcagtgaacgggagaaaaacctttacgacgatgtcacaagctctggattattttttagtaaccgcatggattgaggacaaacaaacaacaggcgtgtttctcattcataaagatgatcccggcttgtcgattgaagaaacgtgggatatgatggcgatgcgggcgactgggagccatgaccttgtactgaacgaagtaatgcttgatgagaataagctggtggaactgcttcaagggcctcgtggagctaagccgaatggctggctgcttcacattcctgcgatttatcttggtgtggctcaagctgctcgtgactatgcagtgcaatttgcatctgagtattctccaaacagcttgaatggaccgatcaagaatgtcccggccgtacagcaaagaacaggcgaaatggagcttgaactgctcaatgccagacactttcttttccatatcgctcaattgtatgacgatccggtgcggcgtccacacttgaccagcgagctcggtgcggcgaaacatatcgtcacaaacgctgcgctgtctgttgttgataaagcgatgagaattgtcggggccaaaagcctggaacgaaccaacccgcttcagcgctattaccgtgatgtgcgcgccggtcttcacaacccgccgatggatgacgccgtgatacacaagctggcagctgaagcgtttgagtcataa

SEQ ID NO: 46776 - DNA, 1065 bp, Bacillus subtilis
gtgtacggaggaaagtcggcagaacataatgtttccctgcagacagctctggctgtaatcaaagcgctaaatactgagaagtttgatatacatccgatttatataacagaaaaaggcgaatgggttagaggcgcccgtttaactgaacctgtttcaaacgtgaaaatgcttcaatttgagcaaggaggcagtgctttttctccagctgccctgaaccaggagatgtttccgcaggaagcgtcacagcaaaatgaagccatcgacgtcgtattcccgctcctccacggaccgaacggagaagacggtacgatccagggaatgctcgagctgttgaacattccttatgtcggcaacggagtgcttgcttcctcagctggcatggataaagttgtcatgaaacatttatttgcgcaggttggccttgctcaggctaaatacgcagctttccttaagaaagactggactcgttctccgaaagaaagctgtgaggaggttgaacaggaattaggctacccttgcttcgtaaaaccggcgaacctcggctcaagtgtcggaatcagcaaatgccgaaaccgtgaagaactgcaaaaagcgtttgagcttgctttccaatatgaccgcaaagtcgtcgttgaagaaggaattaacggccgcgagatcgaaatcggcgttcttggaaatgatgatcctaaatgctctgttgtgggagaaatcgcaccgaagacagatttctacgattacaaagcgaaatatgaggatggagatactgatctgatgattccggcgattgtgactgatgaggaatacgcaacaatcagtgatatggcgatcaaagcgtttaaagcgatcgacggttcaggactcgtcagagcggactttttcctgacagctgacggcgaagttctgatcaatgaagtcaacacaatgcctggctttacacctttcagcatgttcccgttgctctggaaagaagccggagtggaatatgctgacctgattgaacagcttgtggagcttgcaaaagaacgccacgctgaaaaacaattgattaagcatacattctaa

SEQ ID NO: 46777 - DNA, 1536 bp, Bacillus subtilis
gtggtaaatcacgacattactgaaacagcaattagaaggagtttgaataatttgactataacgtttcaagattttaatttaagttctgatctcatgaaagcaattaatcgtatgggatttgaagaagcaacaccgattcaggcacaaacgataccgctcggactttcaaataaagacgtcattggacaagcgcaaacaggtacaggtaaaacagctgcgtttggtataccccttgttgaaaaaattaaccccgagtctcctaatattcaagcaatcgtaatcgcgccaacccgtgaattagccattcaagtatctgaagaattgtataaaatcggacaagataaacgtgcgaaggttcttcctatttacggcggacaggatattggacggcaaatccgggcgttaaagaagaatccgaatattattgtcggaacacctggacgtcttcttgaccacatcaaccgccgcaccattcgtttaaacaatgtaaataccgttgtaatggatgaagcggatgaaatgctgaacatgggattcattgacgatattgaatctatcctttcaaacgtgccaagcgagcatcagacacttctgttctctgccacaatgcctgcgccgatcaaacgcattgcagagcgcttcatgactgagccggaacacgtaaaagtaaaagcgaaagaaatgacggtttctaacattcagcagttctatttggaagtgcaagaacgtaaaaaattcgatacactgactcgccttcttgatattcagtctcctgagcttgcgatcgtattcggacgtacaaaacgccgtgtcgatgagctggctgaagctctgaaccttcgcggatatgcagctgaaggtattcacggtgacttaacgcaggcgaaacgtatggttgcgcttcgtaaatttaaagaaggcgcaatcgaagttctagtcgcaactgatgttgccgctcgcggacttgatatctcaggtgttacacacgtatacaacttcgacgtgcctcaagatcctgaaagctacgttcaccgtatcggaagaacgggccgtgcaggaaaaacaggtatggcgatgacgttcattacaccgcgtgagaaaagcatgcttcgcgcaattgaacaaacaacaaaacgcaaaatggaccgcatgaaggagcctacacttgatgaagcgttagaaggtcagcaacaggttactgttgaacgtcttcgcacaacaatcagtgaaaacaacctgaacttctacatgacagcggcagctgagctgcttgaagatcatgatgcagtaacagtggttgcggcggctatcaaaatggctacaaaagagccagacgacacaccggttcgcttaacagacgaagcgccgatggtcagcaaacgctacaagaaccagcgctcttctaaacgcagagacggtcaaggcggcggctaccgcggcggaaaagggaaaagcaacaaccgttcttcctatgacaaaaagcgttcaaacgatcgccgttcttcaggtgacagacgccagaaaaaatcttactaa

SEQ ID NO: 46778 - DNA, 1377 bp, Bacillus subtilis
gtgacagacgacatgacgaaagacaatataaatcagcaaacgttgcagagaggcttgaaaaacaggcatatccagctcatcgccatcggcggagccattgggacaggcttatttctcggctcgggcaaatcgattcattttgccggaccttcgattttatttgcttatatgatcacagggatcatttgctttttaattatgagatcgctgggtgaactgctgttatcaaacttgaactatcactcttttgtggattttgtacaagactacctaggcgatatggcagcttttatcaccggctggacatattggttctgctggatttccattgcgatggctgatctgacagcagtcgggctctacactcaatattggctcccgggtgtgccgcaatgggtgcctggcttaatcgctcttattattttactgattatgaatctggcgacagtcaagctttttggagaattagaattttggttcgctttgattaaagtcattgccattttggcgttaatcgtcattggccttgtgatgattttcaaaggcttttccacaagctcaggagtgtccagcttcacaaacctctggagccacggaggcctgttcccgaatggcatgcacgggtttatcctctcgttccagatggttgtgtttgcttttgtcggcattgagcttgtcgggcttacggccggtgaaacagaaaaccctgaaaaagtaatccctaaggcgatcaacaatattcctgtccgtgtgctgcttttttatatcggggctcttctcgtgattatgagcatctatccttgggatatcatcaatcccagcgaaagcccattcgtacaagtatttgtcgctgttggcatcgtcggggctgcaagtattatcaactttgttgtgttgacatccgctgcttcagcatgcaacagcgctgtattcagtacaagccgtatggtctattccctggcgaaagatcacaatgcgcctgagtcaatggcgaaactgactcagcgtaaagtgcctagaaatgctttattcttttcagctatcgtgattttaatcggtgttacgttaaactacatcatgccagaaggcgtattcaccctgatcacaagtatttcaaccgtatgctttatctacatttgggggattacggtcatctgccatatgaaataccgcaaaacaagacctgaattagcgaaaacaaacaagtttaagcttccgctttatccgtttacaaattacctgattcttgcgttcctggcgtttgttctggttgtgctggcactggcacaggatactcgtgtttccttatttgtcacaccggtttggtttattttgctgattgtgatttataaagtgagaaaagcgaagcatcaataa

SEQ ID NO: 46779 - DNA, 1398 bp, Bacillus subtilis
ttggcacatacagaacaatatcgttttccaaaggatttttggtggggatcatccgcttcagcaacacaaatggagggtgccgccgacagagacggaaaaggccagaatatatgggattattggtttgaaaaagaaccgcatcgtttttttgatcatgtcggacccgcagacacatcccaattttacgacaactataaagaagatatcaggctgatgaaggaacttggccacaactcgttccggatgtcgatttcctggtcacgtttaataccaaacggaacgggcgagatcaacgataaagccgcagatttctataacaatgtcattgatgagctgatcgctaacggaattgaaccttttgtcaatttgtttcatttcgatatgccgatggcgcttcaaaaaatcggcggctgggtcaacagagagacggttgacgcgtatgaaaactatgcaagaacttgcttccgtttgtttggcggccgggtgaaaaaatggttcacgcataatgaaccaatcgttcccgtagaaggcggatacctatatgattttcattatccaaacaaggtcgattttaaagaggccgtccaggttggatttcatacgatgctatcaagtgcccgcgccattcaggcttacagggagatgaagcaggacggaaaaatcggcatcatcttaaatttgaccccttcatacccgagaagcagccatccggcggatgtgaaagccggggaaatcgcagacgcgttttttaacagatcttttttagacccatctgtcaaaggcgaatttcccaaagagctggttgacattttgaagcatgaaggctttatgcctgattacaacgctgaagatctcgacatcatcaaaaagaacacggttgacctgttgggagtgaattattaccagccgagacgtgtgaaagcgaaagaacatcttccgaatcccgacgctccttttttgccggacaggtattttgatccctacgtcatgccgggccgcaaaatgaatccgcatcgcggctgggagatctatgaaaaaggcgtttatgatattttgatcaatttaaaagaaaactacggcaacatcgagtgttttatctctgaaaacggtatgggggttgaaggtgaagagcgattcagggatgaacaaggcatcattcaggatgattaccggattgaatttataaaagagcacctcaaatggattcaccgcgccatacaggaaggctcgaacgtaaaaggctatcacttatggacgttcatggacaactggtcttggacaaatgcctataaaaaccgatacggatttgtatcagtcaatcttgagaaagacggagaaagaaccgtcaaaaagagcggaaaatggttcaaagaggttgctgagcatagcggtttctag

SEQ ID NO: 46780 - DNA, 1089 bp, Bacillus subtilis
ttgtttaagaaacatacgatctctttgctcattatatttttacttgcgtctgctgttttagcaaaaccaattgaagcgcatactgtgtcgcctgtgaatcctaatgcccagcagacaacaaaaacagtgatgaactggcttgcgcacctgccgaaccgaacggaaaacagagtcctttccggagcgttcggaggttacagccatgacacattttctatggctgaggctgatagaatccgaagcgccaccgggcaatcgcctgctatttatggctgcgattatgccagaggatggcttgaaacagcaaatattgaagattcaatagatgtaagctgcaacggcgatttaatgtcgtattggaaaaatggcggaattccgcaaatcagtttgcacctggcgaaccctgcttttcagtcagggcattttaaaacaccgattacaaatgatcagtataaaaacatattagattcagcaacagcggaagggaagcggctaaatgccatgctcagcaaaattgctgacggacttcaagagttggagaaccaaggtgtgcctgttctgttcaggccgctgcatgaaatgaacggcgaatggttttggtggggactcacatcatataaccaaaaggataatgaaagaatctctctatataaacagctctacaagaaaatctatcattatatgaccgacacaagaggacttgatcatttgatttgggtttactctcccgacgccaaccgagattttaaaactgatttttacccgggcgcgtcttacgtggatattgtcggattagatgcgtattttcaagatgcctactcgatcaatggatacgatcagctaacagcgcttaataaaccatttgcttttacagaagtcggcccgcaaacagcaaacggcagcttcgattacagcctgttcatcaatgcaataaaacaaaaatatcctaaaaccatttactttctggcatggaatgatgaatggagcgcagcagtaaacaagggtgcttcagctttatatcatgacagctggacactcaacaagggagaaatatggaatggtgattctttaacgccaatcgttgagtga

SEQ ID NO: 46781 - DNA, 1635 bp, Bacillus subtilis
atggcaaaagaaattaagtttagtgaagaagctcgccgcgcaatgcttcgcggtgtcgatgcacttgctgatgctgttaaagtaactttaggaccaaaaggacgcaacgtggttctagagaaaaaattcggttctccgttaatcacaaatgacggtgtaacaatcgctaaagaaatcgagctagaagacgcgtttgaaaacatgggtgctaagcttgttgctgaagtagccagcaaaacaaacgacgttgccggtgacggtacaacaactgcaacagttcttgcgcaagcaatgatccgtgaaggccttaaaaacgtaacagcaggcgctaaccctgtaggcgtgcgtaaagggatggaacaagctgtagcggttgcgatcgaaaacttaaaagaaatttctaagccaatcgaaggcaaagagtctatcgctcaggttgctgcgatctctgctgctgatgaggaagtcggaagccttatcgctgaagcaatggagcgcgtaggaaacgacggcgttatcacaatcgaagagtctaaaggcttcacaactgagcttgaagttgttgaaggtatgcaattcgaccgcggatatgcgtctccttacatggtaactgactctgataagatggaagcggttcttgacaatccttacatcttaatcacagacaaaaaaatcacaaacattcaagaaatccttcctgtgcttgagcaggttgttcagcaaggcaaaccattgcttctgatcgctgaggatgttgaaggcgaagcacttgctacacttgttgtgaacaaacttcgcggcacattcaacgcagtggctgttaaagctcctggtttcggtgatcgccgtaaagcaatgcttgaagacatcgctgtccttactggcggagaagtcatcacagaagatcttggccttgacctgaaatctactcaaatcgctcaattgggacgcgcttctaaagttgtcgttactaaagaaaacacaacaatcgttgaaggcgctggcgaaacagacaaaatttctgcccgtgtgactcaaatccgcgctcaagtggaagaaacaacttctgaattcgacagagaaaaattacaagagcgtcttgctaaacttgctggcggcgtagctgtcatcaaagtcggcgctgcgactgaaactgagctgaaagagcgtaaacttcgcatcgaagacgccttgaactcaactcgcgcagctgttgaagaaggcatcgtatccggtggtggtacagcgcttgtaaacgtatataacaaagtcgctgcagttgaagctgaaggcgatgctcaaacaggtatcaacatcgtgcttcgcgcgcttgaagagccaatccgtcaaatcgcacacaacgctggccttgaaggatctgtcatcgttgagcgcctcaaaaacgaagaaatcggcgtaggcttcaacgctgcaactggcgaatgggtaaacatgatcgaaaaaggtatcgttgacccaacaaaagttacacgctcagctcttcaaaacgctgcgtctgtagctgcaatgttcttaacaacagaagctgttgtcgctgacaagccagaagaaaacggtggcggcgcaggaatgcctgatatgggcggcatgggcggtatgggtggaatgatgtaa

SEQ ID NO: 46782 - DNA, 1062 bp, Bacillus subtilis
atgactcacacagtacctcaaaacatgaaagcggctgttatgcacaacacaagagagatcaaaattgaaacattgcctgtgcctgatatcaatcatgatgaagtgttgattaaggtgatggctgtcggaatttgcggatctgatctgcattactatacaaatggccgaataggcaactatgttgtggaaaaaccatttatccttgggcatgaatgtgcgggtgaaattgccgctgtcggatcatctgtcgatcaattcaaggtgggagaccgcgtcgctgtagagccgggtgttacgtgcggacgctgtgaggcgtgcaaagaaggacgctataatctttgcccggatgtacagtttttggctacaccgccggtagacggtgcgtttgtccaatatattaaaatgcgtcaggactttgtttttttaatcccagactcactttcttatgaagaagctgctttgatcgagccgttttctgtcggtatccatgcggcggccagaacgaagctacagcccggatcaacgattgcgattatggggatgggccctgttgggttaatggctgttgccgcagctaaagcatttggggcaggcacaatcattgtcaccgacttagagccgctgcggttagaagctgcgaaaaaaatgggagcgactcacattattaatatacgtgaacaggatgcacttgaagagattaaaacgatcacgaatgatagaggcgttgatgttgcttgggaaacagcagggaatccagcggcattgcaatccgcactggcttctgtgcgccggggcggaaaattggcgattgtcggtttgccttcacagaacgagattccgctcaacgtgccgtttattgcggataatgagattgatatttacgggatcttccgttatgccaatacgtatccaaagggaatcgaatttcttgcttcaggcattgtggacacgaagcatctagtaacggaccaatattcgctggagcagacgcaagatgcgatggagcgggcgcttcaatttaagaatgaatgtttaaaagtgatggtgtatccaaatcgctga

SEQ ID NO: 46783 - DNA, 963 bp, Bacillus subtilis
atgcgtagtcattctgtagtttgtattggggaattgttgattgatttcttttgtaccgatgttgacgttgatttaatggaagggcgccaattcctgaaaagtgccggcggggcaccggcgaatgtgtcggcagcgattgccaagctgggcggagacgccgctttcagcggaaaagtaggaaaggatccgtttgggtattttctgaagcgaacattggacgctgtacatgtcgatacctctatgctggtgatggatgagaaagcgcctacaacgcttgcttttgtttcattaaaacaaaatggagagcgtgactttgtttttaatagaggcgcggacgctttgtttacgctggaggacattgaccaggaaaaactaaacgaagcgaaaatccttcatttcggctctgcgacggcactgttatcggatccgttttgctcagcctatttacggttgatgtcgattgcgaaagacaatggacagtttatttcgtttgaccctaactaccgtgaagatttatggaggggaagagtctcagagtttgtaagtgttgcgaaaaaagcgatcgctgtaagtgattttgtgaaagtcagtgacgaggaacttgagattatcagcggtgtgaaggatcatgaaaagggagttgcgatccttcatgagatcggagccaacattgtcgctgtgacacttgggaaaagcggaacgcttctttccaatggaaaagaccgtgaaatcattccaagcattccggtgacatcaattgactcaacaggggcgggagatgcttttgtcggtgcggctttatatcaattggcaaacacggatcagattcaatctgtagatgctgattttgtgaaactgcgtgagattgtggcgtttgccaataaggtcggagctcttgtgtgcactaaaattggagcgattgatgcactgccgagtttggatgagattggagtttctttgtaa

SEQ ID NO: 46784 - DNA, 1422 bp, Bacillus subtilis
atgaataaacaaggaaatcaaatgtcatttttacgtacaattattttagtctccactttcggcgggcttctttttggctatgataccggtgtgctcaatggagctttgccgtatatgggagagccggatcagcttaatctcaatgccttcacagaaggccttgtcaccagttcacttctttttggagcggcactgggtgctgtgtttggcggcaggatgtctgattttaacggccgccgcaaaaatattttgttcctcgctgttatattttttatttcaacgattgggtgtacgtttgcaccaaatgttacggtcatgattatttcccgttttgtgctcggtattgcggttgggggtgcatccgtaacggtgcctgcctatttagcagagatgtctcctgtggaaagcaggggacggatggtgacgcagaacgaattgatgattgtatcaggacagcttttggcctttgtttttaatgcgatccttggaacaacaatgggagacaactcccatgtgtggaggtttatgctggtcattgcgtcacttccagccttgttcctgtttttcggcatgatcagaatgcccgagagtccccgttggcttgtttctaaaggaagaaaagaagatgctttgcgtgtattgaaaaaaatcagggacgaaaaacgggcagcagctgagctgcaagaaattgaattcgctttcaaaaaagaagaccagcttgaaaaagcgacatttaaagatctttcagtcccatgggtgcgccgtattgtgtttattggattagggattgcgattgtacagcaaattacaggtgtgaattcgattatgtattatgggactgaaattctaagaaattccggtttccaaacggaagccgctttaatcggaaatattgcgaatggcgtgatttcggtattggcaacattcgtcggaatctggctgctgggaagagtggggcgccggccgatgctgatgacaggcttgatcggtacgacaacagcattattgctaatcgggatattctcacttgtacttgaaggatcaccggcacttccgtatgtagtcctgtcattaacggtcacatttcttgcttttcagcagggcgccatttcaccagtgacttggctgatgctatctgaaattttcccgcttcgccttcgcggactgggaatgggtgttacggtattctgtctgtggatggtgaattttgcagtcagtttcacgtttccgatattgctggcagctatcgggctgtccacaacgttctttatcttcgttggattaggaatttgctctgtcttgtttgtgaagaggtttttgccggaaacgaaagggctttcgcttgagcagctggaggaaaacttccgcgcttatgatcacagcggggcaaagaaggattctggggctgaagtgattggataa

SEQ ID NO: 46785 - DNA, 1041 bp, Bacillus subtilis
atgaaggcagcaagatggcataaccaaaaggatatccgtattgaacatatcgaagagccaaaaacggagccgggaaaagtaaagatcaaagtcaaatggtgcggcatctgcggaagtgatttacacgaatatctgggcggcccgatctttattccggttgacaaaccgcacccattaacaaatgaaacggcacctgtcacaatggggcatgaattctccggtgaagttgtcgaagtcggagaaggcgttgaaaattataaagttggagaccgcgttgtagtcgagccgatttttgctacacacggccaccaaggcgcctacaaccttgatgaacaaatgggattcctcggcttagccggcggaggcggcggtttctctgaatacgtctctgtggatgaagagcttttgttcaaacttcctgatgaattatcatatgaacaaggcgcgctcgttgaaccttctgcagttgctctatacgctgtccgctcaagcaaactcaaagcaggcgacaaagcggctgtattcggctgcggcccgatcggacttcttgtcattgaagcgctgaaggctgccggtgcaactgatatttacgctgttgagctttctcctgaacgccagcaaaaagctgaggagcttggcgcgatcatcgttgatccgtctaaaacagacgatgtagtcgctgagattgcagaacgtacaggaggcggtgttgacgtagcattcgaagtcactggtgtcccagtggtgttacgacaagccatccagtccactacaattgccggtgaaaccgtcatcgtcagcatttgggaaaaaggtgctgaaatccatccgaacgatatcgtaatcaaagaacgtacagtaaaaggaattatcggataccgcgacatcttcccggctgtattgtcattaatgaaagaaggctatttctcagccgacaaactcgtaacgaaaaaaatcgtactagatgatttgatcgaggaaggcttcggggctcttattaaagagaaaagccaagtcaaaatccttgttagacctaactaa

SEQ ID NO: 46786 - DNA, 1410 bp, Bacillus subtilis
atgaaccagtctcaatcaggattaaaaaaggaattaaagacccgccatatgacaatgatttcgattgccggtgtaatcggagccggcctatttgtaggcagcggtccagtgattcactcgaccggtccgggtgccgttgtttcttacgcgttagccggattattggtgatttttattatgagaatgctcggtgagatgtctgccgtaaacccgacgagcggatcgttttctcaatacgctcacgacgccatcggaccgtgggcaggatttacaatcggctggctgtactggtttttctgggtgatcgtcatagcgatcgaagccattgccggtgctggcattattcaatactggttccatgatattccgctgtggctgacaagtttgatcttgaccattgtgctcaccctgacaaacgtctactccgttaagtctttcggtgagtttgaatattggttctccctcattaaagttgtgactatcattgcttttctaatcgttggttttgcctttatttttggctttgcaccgggcagtgagccagtcggtttttcgaatcttacaggcaaaggcggatttttcccggagggcatcagctccgtattgctcggcattgtcgttgtcatcttctcttttatgggaactgaaatcgttgccattgcagcaggggaaacatccaacccgatcgaatctgtgacaaaagccaccagatccgttgtatggcgcatcatcgtcttttacgtgggctcaatcgccattgtcgtggcgctgttgccatggaattcagcaaatattttagaaagccctttcgtcgctgtacttgagcatataggagtgcccgcagccgcacagattatgaactttatcgtcctcacagccgtactctcttgcctgaattcaggtttgtataccacatccagaatgctgtattcacttgcagaaagaaatgaagcgccgcgccgttttatgaaattgagcaaaaaaggcgttcccgtacaagccattgtggccgggacatttttctcttatatcgcggtcgtaatgaactatttttcaccggataccgtctttttattcttagtcaactcatcaggcgcaatcgctttactcgtctatcttgtcatcgccgtttcccagctgaaaatgcggaaaaaactcgaaaaaacaaacccagaagcactgaagatcaaaatgtggctcttccctttcctaacctacttgaccatcatcgccatttgcggaattttagtgtccatggcgtttattgattccatgagagacgagctgctgctgacaggcgtcatcacgggaatcgttctgatttcttaccttgtgttcagaaaacgcaaggtgagcgagaaagcggctgccaacccagtcacacagcagcaacccgatatcctgccttaa

SEQ ID NO: 46787 - DNA, 1296 bp, Bacillus subtilis
atgatcgaacgttattcaagacctgaaatgtccgcgatttggacggatgaaaacagatttcaagcatggttagaggttgaaattcttgcctgtgaagcgtgggcggagcttggcgtcattccgaaagaagatgtaaaggttatgcgcgaaaacgcgtcatttgacatcaaccgcattttagaaatcgaaaaggacacgcgccatgacgttgtcgcttttacgcgcgctgtatccgaatcactgggcgaagaaagaaaatgggtgcattacggcttaacgtcaactgacgttgttgatacggctctttcctacttattaaaacaggcaaacgatattttgctcaaggatcttgagagatttgttgacattataaaagaaaaagcgaaagaacataaatacacagtcatgatggggcgcacacacggcgtacacgctgagcctacaacattcggcttaaaacttgcgctttggcatgaagaaatgaaacgtaatcttgagcgcttcaaacaagcgaaagcaggcatcgaggttggaaagatttccggtgctgtcggcacatatgcgaacattgatccatttgttgaacaatatgtctgtgagaagctcggattgaaagcagcaccgatttccactcaaacccttcagcgtgaccgccatgctgactatatggcaacacttgctttgatcgcgacaagcatcgagaaattcgctgtggaaatccgcggactgcaaaagagtgaaacacgtgaagtagaggaatttttcgcgaaagggcaaaagggttcatctgcaatgccgcataaacgaaatccgattggctctgaaaacatgacaggcatggcgcgcgtgatccgcggctacatgatgacagcttacgaaaatgttccattatggcatgagcgcgatatttctcattcttcagcagaacgaattattcttccggatgcgacaattgcgctgaactacatgctgaaccgcttctccaacatcgtgaagaacttaacggtcttcccggaaaacatgaagcgcaacatggaccgcactctcggccttatctattctcagcgtgtgctccttgctttgattgacacaggcctgactcgtgaagaagcctatgatacagttcagccgaaagcaatggaagcgtgggaaaaacaagtgccgttccgcgagcttgtggaagcggaagagaaaatcacgtcacgtctttctccagaaaaaattgctgactgctttgattacaattaccatctgaaaaatgttgatctgatctttgaacgtttaggtttagcatag

SEQ ID NO: 46788 - DNA, 2220 bp, Bacillus subtilis
ttgaattatattagcaatcaattactaagcggtttaaaccccgttcagcaggaagcagtcaaaacaacggacgggcctcttttgctgatggcgggagcgggtagcggaaagacgcgtgtcctgacccatagaattgcttatttaatggcagaaaagcatgtggcgccgtggaacattctggcgatcacatttacaaataaagcggcacgcgaaatgaaagaacgtgtggaaagcatcctcggacccggcgcggacgatatctggatctccacattccacagcatgtgcgtgcggatcttgcgcagagatatcgaccggattgggatcaaccgaaatttctccatccttgatacggctgaccagctttcagtgatcaaggggattttgaaggagcgcaatcttgatccgaagaagtttgacccgagaagcatcctcggcacgatcagcagtgcaaaaaacgaattgaccgaaccggaggaattctctaaagttgctggcggctactacgatcaggtggtcagcgatgtatatgctgattatcagaagaagctattgaaaaaccagtcgctcgatttcgacgatttaattatgacgacgattaaactgtttgacagagtgcctgaagtgcttgaattttatcagcgcaaattccagtacatccacgttgatgagtatcaggatacgaacagggcacaatacatgctcgttaagcagcttgccgagcgtttccagaacctttgcgttgtgggggattctgatcagtcaatctacagatggcgcggcgcggatatcaccaacattctttcatttgaaaaagattatccgaatgcaagcgtgattttgctagaacaaaactatcgttcaacgaaacggattttgcgcgcggctaacgaggtcattaaaaacaactctaaccgcaaaccgaaaaatttgtggacggaaaatgatgaaggcatcaagatttcctattatcgcggtgataatgagttcggtgaaggacagtttgtggccggcaaaattcatcagcttcacagcacaggcaagcggaagctgtcggatatcgccatattataccggacaaacgcgcagtcccgtgtgattgaggaaacgcttctcaaagcgggcttgaactataacattgtcggcggcacaaagttctatgacagaaaagaaattaaagacattcttgcgtacctgcgcctcgtatccaatccggatgacgatatcagtttcacgcgcattgtcaatgtgccgaagcgcggagtcggcgcgacatcacttgaaaaaatcgcttcgtatgcggccataaacggcttgtcctttttccaagcgattcagcaggttgattttatcggcgtcagtgccaaagcggcaaacgcgcttgacagctttagacagatgattgaaaacctgaccaatatgcaggattacttatccattacagagctgacagaagaaattcttgataagacggaatacagagaaatgctgaaggctgagaaatcgatcgaagcccaaagccgtttagaaaatatcgacgagttcctgtctgttacgaaaaactttgaacagaaaagtgaagacaagacactcgttgcgttcctgacagacttggcattgatcgcagatattgatcagctcgatcagaaggaggaagagtcaggcggcaaggatgcgatcaccctgatgacactgcacgccgcgaaaggactggagtttccggttgttttcttgatggggcttgaagaaggcgtcttcccgcatagccgttcactcatggaggaagcggaaatggaagaagaacgccgccttgcgtacgttgggattacaagggcggaacaggagctttatctgaccaatgctaaaatgcgcaccttgtttggccggacaaatatgaacccggaatctcgcttcattgctgaaataccggatgatttattggaaaacctaaatgagaaaaaagaaacaagagcgacgtctgcgagaaaaatgcagccgagacgcggccctgtttcacgcccggtatcctacgccagcaaaacaggcggcgacaccttgaactgggcagtcggagataaggcgggccataaaaaatggggaacaggaactgtcgtcagcgtgaaaggcgaaggagaagggacagagcttgatattgccttcccgagccctgtcggcgtgaaacgcctgttagcagcatttgctcctattgaaaagcagtaa

SEQ ID NO: 46789 - DNA, 1992 bp, Bacillus subtilis
atgagaaaactgtatcatggcgcttgctattatccggaattatgggatgaagagacgattcagcaggacattgacatcatgcgtgaagttggcgtaaatgttgtgcggatcggcgaatttgcctggtcagtcatggaacctgaagaaggaaaaattgacgtcggttttttcaaagaaatcatcgcccggctgtatgatagcgggatcgaaacgattatgtgcacgccgacgcctaccccgccgatttggttctcacatggccggcccgaacgcatgcatgccaatgaaaaaagagagatcatggggcatggctcccgtcagcatgcctgtacgaacaacccgtatttccgaaaaaaagccgccatcatcaccacagccatcgccaaggagcttggccggctcccggggctgatcggatggcagctagacaatgagtttaaatgccatgttgcagaatgcatgtgtgagacatgcttgcgcctatggcatgactggctcaaaaatcgctacggggtaattgagcgcttgaatgaagcttggggaaccgatgtgtggagcgagacctatcagacgtttgagcaagtcccgcagccgggaccggccccgtttctgcatcatgcctctctacgcactatgtatcagctgttttcgatggagatgatcgcttcgtttgcggatgaacaggccaaaatcatccgctgctattcagatgcgccgatcacgcataacggatcagtcatgttcagcgtggacaatgagcgaatgtttcagaatctcgattttgcctcctatgacacgtacgcttcgcaggaaaacgcctctgcctttttattgaactgtgatttatggagaaatctgaaacaagggcgcccgttttggattttggaaacgagtccgtcgtatgccgcctcgcttgaaagctccgcttacccgcacgcagacgggtatttgcaggccgaagccgtatcgtcctacgccttagggagccaggggttttgctactggctatggcgacagcagcgttcaggcagcgagatttcccacggttcggttctcagtgcctggggcgaacccaccatcggctatcaaaatgtgctggcggttgagcgggcaagaaaggaaatcgagcctattattctatcgactgaacccgttcaagccgaggcggcgatgacttactctgacagagcaaaagcatttattaaaactgagcctcaccggggactccggcatcgttcgcttgtgacgcatttttatgaacgtattctcaacacggggattcaccgtgaccttattccggaaggcgctccactggacggctatcgcttgctgtttacgccatttgtgccgtatttgtcttctgaatttatcaaaaaagcttcggcattcgctgaagcgggcggcatctggatcaccgggccgctgacaggaggacgcacatgcgagcataccattcataccgattgcggacttggcgaacttgagaaaacgtcagggatcaaaacactttttacctttccgatgaatgagaacgtgaatacaggaaaagcgtttggcatcacggcgccgctcggactgtggagcgcggtgtttgacacagagagcggaaacacccttggcacggttgaagcaggaccgggggcgggccatgcttttctgacggaacggaattacggcgaggggaaaattgtcatgctgggctcgcttccatccgggaaagaaggggatgcgatgctggaagcgctcgtcaggcattatgcggaggaagctgttatttccagccggtcggatgtgacacccggcacgatcgttgccccgcgtataggcgaaaacggccttgtgtggatcgttgtgaatatggatggaaaaggcgggagcgtgacattgccggaatcgggaacggatttgttgacgcaccgcttggaaaaggcggggagactggcggtcggaccgcatgaataccgtgtgattcaatttgacaatcacagctga

SEQ ID NO: 46790 - DNA, 1341 bp, Bacillus subtilis
gtgtttcatatcagtacattagatcagattaagattgcctatatcggcggggggtcccaaggctgggccagaagcctgatgagtgatttgtcgattgatgaacggatgtcaggcacggtggcgctctatgatcttgattttgaagccgctcagaaaaatgaagtgatcggcaatcacagcgggaacggcagatggagatatgaggctgtttctactttgaaaaaggcgttatcagccgcggatatcgtcattatttccattttgccgggatcactggatgatatggaagtcgatgtgcacttgcctgagcgctgcggtatttatcagtctgtaggtgatactgtcgggcctggagggatcatcaggggcttgcgtgctgtgccgatatttgcggaaattgcccgggcaataagagactacgcacctgaatcatgggtcattaattatacaaacccgatgtctgtctgtacaagagtgctgtataaagtgtttcccggcatcaaagcgattggctgctgccacgaggtattcgggacgcaaaagctattggcggaaatggtcacggaaaggctggggattgaggtgccgcggcgtgaggatatccgcgttaatgtgctcggcattaaccattttacatggatcacaaaagcctcttaccgccatattgacctgttgcctatattccgtgaattcagcgcgcactatggggaatcaggatatgagctggagggggaatgctggagggacagcgtcttttgttcggcacaccgtgttgcgtttgatttatttgaaacgtatggcgccatccctgctgcgggtgacaggcatctggcagagtttcttcccggcccatacctcaaacagcctgaagtatggaaatttcatctcacacctatatcattcagaaaacaagacagagctgagaaacgacaagaaacagaacggttgatcgtgcaacaacggggcgttgctgagaaagcttcgggagaagaaggcgtgaacatcatagcggctcttctcggattgggtgaactcgtcacaaatgtaaatatgccgaatcaaggccaggtcttaaaccttcctatacaagccattgtcgaaacaaacgcattcatcacaaggaaccgtgtccagccgattttgtccggagcgcttccgaaaggtgtggaaatgctggcggctaggcatatatccaatcaggaggcagtggcggacgcaggtttaacaaaggatactggcctcgcgtttcaagccttcctcaatgacccgcttgtccagattgaccgcagtgatgcagagcagcttttcaatgacatgctccaatgcatcatgcaaagctga

SEQ ID NO: 46791 - DNA, 765 bp, Bacillus subtilis
atgaaagcggtcattctctgcggcggaaaaggaacgagaatgagtgaagtcacgaatgacattcctaaaccgctcgccatgataggcggcaaaccgattctatggcatattatgaaaatttatcagtactacggagtaaacgagtttattctgcttttgggctataaaggagaaaaaatcaaggaatactttctcgactatgaatggaagcacaacagcctgacactcgacagctctacgggagaggtacagatgctggggcagcctgaaacgtggaaaattacgtttttggagactggggtagatacgctgacagccggaagaatcttgcaggcgaaagactatatcggtgatgaaacatttctgctcacctatggagacgggctggccaatatcaatcttttccatctcatcagctatcatcagacaaaaggtgctgccgcgactgtcaccggcattgacaaagtctcgcagtttggcaccttgacagttgaggatggcatggcgaaaacattttctgagaagacatcaagtgatggaatcatcaacggcggattcttcgttcttagtccaaaggttttcgattatttgccgaaggacgggaacacgatgttcgaagatgaaccgctgaagaaccttgccaaagatggggagcttgctgtgtaccgccattacggattttggacggccatcgatacgtataaaaatctcttagaagtcaacaaaatgtggaatcaaggacaacaagtatggaaggtatggtga

SEQ ID NO: 46792 - DNA, 906 bp, Bacillus subtilis
ttggtgaaagagctgatcgaacagggcgcaaacgttacggggctagtcagggatcatgtgcctcaatccaatctttatcagggagaacatatcaagaaaatgaacatcgtgcggggctctcttgaggacttggctgtgattgaacgcgcgcttggcgagtatgagatcgacacagtctttcatcttgctgcacaagcgattgtcggcgtggcaaaccgcaacccgatttctacctttgaagcgaatatcctcggcacctggaatattctcgaagcctgccgcaagcatccgttaattaagcgggtcattgtcgcttcaagtgataaagcttacggcgatcaagaaaaccttccatacgatgaaaacatgccgctgcaaggcaagcacccgtacgacgtctcaaaaagctgcgcagatctgatcagccacacctattttcacacgtacgggcttccggtctgcattacgcgctgcggaaacttatacggcggcggagatttgaacttcaaccgcatcattcctcagacgattcagcttgtgctgaacggggaagcgccggaaatccgaagcgacggcacatttgtacgggactacttctatattgaagacgccgttcaggcttatctgcttcttgcagaaaaaatggaagaaaacaatcttgccggagaggcctttaacttcagcaatgagatccagctgaccgtacttgaactggtagagaaaatattaaagaaaatgaacagtaatctgaaacctaaggtgctgaatcagggaagcaatgaaatcaaacatcaatatttatccgcggaaaaagcaagaaagctgctgaattggacaccggcctacactattgatgagggacttgaaaaaacgattgagtggtatacggaattcttcaaaaagtaa

SEQ ID NO: 46793 - DNA, 1386 bp, Bacillus subtilis
atgagttcattatttagaaaaaaaccgcttgaaacattgagtgcgcagagcaagtcaaaaagccttgcccgtacgttaagcgcatttgatttaaccttgctcggtatcggttgtgtcatcggtacagggatttttgtcattacaggaacagtggcagcgaccggtgcaggtcccgccctcatcatatcgtttattttagcggggctcgcctgtgcgctggctgctttctgttatgctgagttttcgtcttccattccgatttcgggaagcgtgtactcatactcatacgtgacacttggagagctgctcgcctttttgatcggatgggatctcatgcttgaatatgtcattgcactgtcggcggttgccaccggctggtcttcatactttcaatcactgcttgccggcttcaatcttcatattccggctgcactgacaggagcgccgggaagcatggcgggcgccgtatttaaccttccggctgcggtgatcattctcctcatcactgcgattgtcagcagaggcgtcaaggaaagcacacgctttaacaacgtcatcgtactgatgaaaatcgcgatcatattattgttcattattgtcggcatcggctatgtgaaaccggataactggtctccttttatgccattcgggatgaaaggcgtcatacttagcgctgccactgtattcttcgcgtaccttgggtttgacgcggtttctaacgcatcagaggaagtgaaaaatccgcaaaaaaacatgcccgtcggcattatttcagctctagccgtctgtacggttctgtacatcgcggtatcgcttgtgctgacaggcatgatgccttatgccaaattgaatgtcggagatcctgtatcctttgcgctgaaattcgtcggacaggacgctgttgccggaattatttctgtcggtgcgattatcgggattacgacggtgatgctcgctttgctgtacgcacaggtccgcttgacatttgccatgagcagagacggccttctgcctggattgttcgcaaaggttcatccgtcatttaaaaccccgttccgcaacacatggctgacagggatcgttgcagcgggaatcgccggctttattaacctcggaacgctggcccatctggtgaacatgggaacacttgccgcgtttacggtcatttccattgctgtcattgtgttaagaaagaaacatcctgaaatcaaagcgtccttcagagtgccattcgttccggttgtgccgattatcagcgcaggcatctgcctttggttcatgtacagccttcccggcgtcacatggctttcatttgtcatctggatcgctgtcggaacgctggtttacttcctatattcgagaaaacacagcttattaaacaaataa

SEQ ID NO: 46794 - DNA, 1458 bp, Bacillus subtilis
atgtttcaatatgaagagttgaataaacagtttatcggcgggaaatggcaggagggcagcagcccaaatgtattggaaaacaaaaatccttatactcaaaaaacattcacaacattccgtaaagcgactgctgacgatgtagatgaagcgtatcgggcagcggcgctggcaaagaaaaaatgggatgcggtcaacccgttcgagaaaagaaccattttagaaaaagccgtcacgtatattgaagaaaatgaagaagccattatttatttgattatggaggagctaggcggtacaaggctcaaagcagcttttgaaatcggtcttgtcaaaaacatcataaaagaagcggcaacgttcccaatccgcatggaggggaaaattcttccgtcaacaatagatggcaaggaaaacagattatatcgcgtgccggcaggcgttgtcggtgtcatcagtccgtttaacttcccattctttttatctatgaaatcagtggcgcctgcactcggagccggcaatggcgttgtgctaaagccgcatgaggaaacgccgatttgcggcggaacgctgattgcgaaaatttttgagaacgcgggaattccagcggggctgctgaatgttgttgtcacagacattgctgaaatcggcgacagcttcgttgagcatccagtgccgcggatcatctcatttaccggttctacgaaagtcggcagctacatcggacagcttgcgatgaagcattttaaaaagccgcttcttgagcttggcgggaacagcgccttcatcgtacttgaggatgcagatatagaatatgcggtcaatgcggcggtgttcagccgatttacacatcaagggcagatttgcatgtcagccaaccgcgtgcttgttcattcttctatttatgacaagttccttgagctgtaccaggcaaaagtggaatcgctgaaagtcggcgacccaatggaccctgatacgattatcgggccattaatcaacagcagacagacggacgggctgatgaagactgtagagcaagcaattgaagaaggcgctgtaccagtgaagcttggcggatttaacgggacgatcgtggaaccgacgatcttaaaagacgtcaaaccgttcatgagcattgccaaggaagagctgttcggaccagtcgtctcctttatgaagtttgattcagaagacgaagcggtggatatcgcaaacgaaaccccgtttggcttgagcggtgccgtacatacgtcaaatcttgagcgcggcgtggcttttgcgaaacgcattgaaacaggcatgattcacgtcaatgacacgaccatcaatgatgaaccgaatgtagccttcggcggtgaaaagcaatcaggcctcggccgtttaaacggtgagtggagcctcgaagaatttacaacgctgaaatggatctcggtccagcacgaaaaacgcagcttcccttattaa

SEQ ID NO: 46795 - DNA, 1131 bp, Bacillus subtilis
atgacgcaaacttggccatttttacataatgcacaatcatttatacaagagaattggaatgcttccggctttcaaaagccaacccctgttcaggagcaggcagcccagctgatcatggacggaaaggatgtcattgcagaatcgccgacaggcacagggaagacgctggcgtatgcgctgccggtcttggagcggatcaaaccagagcaaaagcatccgcaggcggtgattttagcgccttcccgtgagctggtcatgcagatttttcaggtgattcaggattggaaagcgggctcagagctgcgcgcggcttccttaatcggcggggcgaatgtgaagaaacaggtcgaaaagctgaagaaacatccgcatatcatcgtcggcacgccaggcagggtgtttgaactgattaaagcgaagaaactcaaaatgcatgaagtgaaaacgatcgtgcttgatgaaacggatcagctcgtcctgccggagcatcgcgaaacgatgaagcaaatcattaaaacaacattaagagaccgccagcttctatgtttttctgccacgctcaaaaaggaaacagaggacgtgctccgcgaattggcgcaagagcctgaggtgttgaaggtgcagcgaagcaaggcggaggcagggaaagtgaagcatcaatacctgatttgcgaccagcgcgacaaagtgaagctgctgcaaaagctgtcaaggcttgaaggcatgcaggcactcgtatttgtgagagacattggcaacctgagtgtatatgcggaaaaactggcatatcaccacgttgaactcggcgttttgcacagtgaagcgaaaaaaatggagcgagcgaaaatcattgccacattcgaagacggagagtttcctcttttattggcgactgacattgccgcacgcggtttagatattgaaaacctgccatacgtgattcatgctgatattccagatgaagatggctatgtccacagatcaggacgaacaggccgggccggaaaagaaggcaacgtgctgagccttgtgacaaaattggaggaatctaagctgaaaaaaatggcgaagaagcttggtgttgagctgagtgaagctgtgtatgcaggcggaaaactgaagacgaaataa

SEQ ID NO: 46796 - DNA, 1437 bp, Bacillus subtilis
atggcttcagaaaaagacgcaggaaaacagtcagcagtaaagcttgttccattgcttattactgtcgctgtgggactaatcatctggtttattcccgctccgtccggacttgaacctaaagcttggcatttgtttgcgatttttgtcgcaacaattatcggctttatctccaagcccttgccaatgggtgcaattgcaatttttgcattggcggttactgcactaactggaacactatcaattgaggatacattaagcggattcgggaataagaccatttggcttatcgttatcgcattctttatttcccggggatttatcaaaaccggtctcggtgcgagaatttcgtatgtattcgttcagaaattcggaaaaaaaacccttggactttcttattcactgctattcagtgatttaatactttcacctgctattccaagtaatacggcgcgtgcaggaggcattatatttcctattatcagatcattatccgaaacattcggatcaagcccggcaaatggaacagagagaaaaatcggtgcattcttattaaaaaccggttttcaggggaatctgatcacatctgctatgttcctgacagcgatggcggcgaacccgctgattgccaagctggcccatgatgtcgcaggggtggacttaacatggacaagctgggcaattgccgcgattgtaccgggacttgtaagcttaatcatcacgccgcttgtgatttacaaactgtatccgccggaaatcaaagaaacaccggatgcggcgaaaatcgcaacagaaaaactgaaagaaatgggaccgttcaaaaaatcggagctttccatggttatcgtgtttcttttggtgcttgtgctgtggatttttggcggcagcttcaacatcgacgctaccacaaccgcattgatcggtttggccgttctcttattatcacaagttctgacttgggatgatatcaagaaagaacagggcgcttgggatacgctcacttggtttgcggcgcttgtcatgctcgccaacttcttgaatgaattaggcatggtgtcttggttcagtaatgccatgaaatcatccgtatcagggttctcttggattgtggcattcatcattttaattgttgtgtattattactctcactatttctttgcaagtgcgacagcccacatcagtgcgatgtattcagcatttttggctgtcgtcgtggcagcgggcgcaccgccgcttttagcagcgctgagcctcgcgttcatcagcaacctgttcgggtcaacgactcactacggttctggagcggctccggtcttcttcggagcaggctacatcccgcaaggcaaatggtggtccatcggatttatcctgtcgattgttcatatcatcgtatggcttgtgatcggcggattatggtggaaagtactaggaatatggtag

SEQ ID NO: 46797 - DNA, 1686 bp, Bacillus subtilis
atgaaaacagaacaaacgccatggtggaaaaaagctgtggtttatcaaatttatccgaaaagctttaacgatacgacaggaaatggtgttggcgatctgaacggcattattgaaaagctggattacttaaaaacgctacaggtggatgtgctttggctgacgccgatttatgattctccccagcatgataatgggtacgatattcgtgattattactcgatttatcctgaatacggaacgatggaggattttgagcggctagtgtccgaagcacataaaagagacctgaaagtcgtcatggatcttgttgtcaatcatacgtcaacagagcacaaatggtttcgcgaggcgatctcttcaatagacagcccgtaccgtgatttttatatatggaaaaaaccgcaggaaaacggttctgttccgacgaactgggaatcgaaattcggcggctcggcatgggagcttgacgaagcatcgggccaatactatttgcatctgtttgatgtgacgcaggctgatttgaattgggaaaatgaagaggtcagaaagcatgtctatgacatgatgcatttttggtttgaaaagggaatagacggctttaggcttgatgtcatcaacctgatttctaaagatcagcgctttccgaatgcggaggaaggcgacggccgctctttttacactgacgggccgcgggtgcacgaatttctgcatgaaatgaacgaaaaggtgttttcacattacgacagcatgacggtcggtgagatgtcttcaacaaccgtagaccactgcatccggtatacgaatcctgacaataaagaacttgatatgacattcagcttccatcatctcaaggttgactatcctaacggcgaaaaatgggccttggcgccgtttgattttttgaagctgaaggagatcctatctgactggcaaacggggatgcacgcaggagggggatggaacgctctgttctggtgcaatcatgatcagccgcgcgtcgtatcaagatatggagatgatggcgcatatagggtgaaatcggcgaaaatgcttgctacggccattcatatgatgcagggcacgccttatatttatcagggcgaggagctggggatgacgaatccgaagttcactgacataagctcctatcgggatgtcgaatcgctgaacatgtatcacgcctttaaggaaaaaggaatggctgatcaagatattacagccattttacaggcgaaatcccgtgacaattccagaacccccgttcagtgggatgctacggaaaatggtggttttacaacgggcacaccatggataccggttgcaggaaattaccgggaaatcaatgctgaagcggcgctgagggatcagaattcggtgttttaccattatcaaaaattgattcagattcgcaaaatgtatgacattgtgacagagggtacgtatgagataattgcaaaggatgacccgaacatttttgcgtatctcagacacggcagcaatgaaaagctgctcgtgatcaataatttttacgggacagaggcggcctttacactgccggactctttagcgcctgacgaatggaaggcagaggtgctgttgacgaacgatgaagcaagggaagggcttcagaacatgacgcttcgcccatatgagtccattgtttatcgtttaacgaaaccgtgttaa

SEQ ID NO: 46798 - DNA, 4389 bp, Bacillus subtilis
gtgagaatacagaaaagacgaacacacgtcgaaaacattctccgtattcttttgcccccaattatgatacttagcctaatcctcccaacaccacccattcatgcagaagaaagcgcggctcctcaggtgcatctgagtattttggctacgactgatattcatgccaacatgatggattacgattactacagcgacaaagaaacggcggatttcggtctggcgagaacagcgcaattgatccaaaagcaccgcgagcaaaaccctaacaccctgcttgtggataacggcgacttgattcaagggaatccgctgggtgaatacgcggtgaaatatcaaaaagacgacattatctccggcacgaaaacccatccgattatcagcgtcatgaatgcgctgaaatacgacgccggaacgcttggcaatcatgaattcaactacgggctcgactttctcgacggcacaatcaaaggagccgatttcccgattgtaaatgccaacgtcaaaacaactagcggcgaaaaccgttatacgccgtatgtgattaatgaaaaaaccctcattgatgaaaacggtaatgagcagaaagtaaaagtcggctacataggctttgtcccgccgcaaatcatgacatgggacaaaaagaatctcgaggggcaagttcaggtgcaggatatcgtagaatccgccaatgaaacgatcccgaaaatgaaggcggaaggcgcagatgtcattattgccctcgcccacaccggcattgaaaagcaggcgcaatcatcaggcgcagaaaacgccgtgtttgaccttgccaccaaaacgaaaggcattgacgcgattatctcgggccatcagcacggactctttccttccgccgagtatgcgggtgttgctcagttcaatgtggaaaagggaacaattaacggcattcctgtcgtcatgccaagcagctggggcaaatatttaggcgtgattgacctcaagcttgaaaaggcggacggctcatggaaggtagcagattccaaaggaagtattgaatctattgctggcaacgtcacatcaagaaacgaaaccgttacaaacaccattcagcaaacacaccaaaacacactggagtatgtccgaaagccagtcggcaaaaccgaagcagatattaacagcttctttgcacaggtcaaagatgatccttccattcagatcgtgactgacgcgcaaaagtggtacgctgaaaaagaaatgaaggataccgagtacaagaacctgccgattttatccgctggagcgccgtttaaagcaggcggcagaaacggagccaattactatacaaacattccagccggagatcttgcgattaaaaatgtcggtgacttgtatctttacgataatactgttcaaatcgtcaagctgacaggcagcgaggtcaaggactggctggagatgtcagcaggccaattcaatcaaattgatccagctaaaggcggcgaccaggccttgctgaacgagaatttccgctcctataattttgacgtgattgacggtgtcacatatcaggtcgatgtgacaaaaccggctaaatacaatgagaacggaaaagtgatcaatgcggattcatcccgtatcatcaatctttcctatgaaggcaagccgatcagcccaagccaggaatttctcgtagtcaccaataactatcgtgcgtccggaggcggcgggttccctcatctgacgagcgataaaattgtccacggctctgcagttgaaaataggcaggtgctgatggattacattattgaacaaaaaacagtcaatccaaaagcagacaacaactggtcaatcgcgcctgtttccggcacgaatctgacgtttgaatcctcgcttttggccaagccatttgccgataaagcagacgatgtcgcttatgtaggcaagtctgcgaatgaaggctatggtgtgtataagctgcaattcgatgatgattcaaatccagatcctcctaaagacggactgtgggatctgaccgtcatgcacaccaatgatacgcacgcccatctcgatgatgcagcgagacgaatgacgaaaatcaacgaagtacgcagcgaaacaaatcacaatattctccttgatgcgggagatgtgttttccggcgatctgtattttactaaatggaacggtttggccgatctgaaaatgatgaacatgatgggctatgacgccatgaccttcggaaaccatgaatttgacaaaggcccgacggtgctttctgattttctaagcggaaacagcgcaaccgttgatccggcgaaccgctatcactttgaagcgccggaatttccgattgtcagtgcaaacgtagatgtgtcaaatgagcccaagctgaaatcatttgtcaaaaagccgcaaacctttacggcaggtgaaaagaaagaggccggcattcacccttacattctgttagacgttgacggggagaaagtcgccgtattcggcctgacaacagaagatacagccaccacatcaagcccgggcaaaagcatcgtattcaatgatgcctttgaaacagcacaaaacaccgtcaaagcgattcaagaagaagaaaaggtaaataaaattattgctttaacccacatcggacataaccgggatcttgagctagccaaaaaagtaaaaggcattgatttgatcatcggcggacacactcacaccctcgtagacaaaatggaggtcgtgaacaacgaagaaccgacgatcgtggcgcaggcaaaagaatacggccaattcttggggcgcgttgatgtcgcgtttgatgaaaaaggcgttgtgcaaacagataaatcaaatctgagcgtgctgccaattgatgaacatacagaagaaaacccagaagcaaaacaagagctcgatcagttcaaaaatgaattagaggacgtgaaaaatgaaaaagtcggctacacggatgtggcgcttgacggccagcgtgagcatgtgcgcacgaaagaaacgaatctcggaaacttcatcgcggacggtatgctggcaaaagcgaaagaagcagccggcgccagaatagcgataacaaatggcggcggcatcagagcaggcattgacaaaggtgatatcacactcggcgaggtgctcaacgtgatgccgttcggcaatacgctttacgtggccgatttaaccggaaaacaaattaaagaagcccttgaacaaggcctaagcaatgtggaaaatggcggcggcgctttccctcaggtggccggaatcgaatatacctttacattaaacaacaaacctggacaccgtgtgttagaagtgaaaattgaatcgcctaacggagacaaagttgctataaatacggatgatacctaccgcgtggcaacaaataattttgtcggtgccggaggagacggatattctgtctttacagaagcctcccatggtgaagaccttggctacgttgattatgagattttcaccgaacagctgaaaaaactaggaaacaaggtctctcctaaagttgaaggacgaatcaaagaagtattcctgccgacaaagcagaaggacggcagctggacacttgatgaagacaaatttgcgatttatgctaaaaatgccaacacgccatttgtctattatggaatacatgaaggatctcaagagaagcctatcaatcttaaagtgaaaaaagatcaggtcaaacttttgaaagaaagagagtcagatccttcattgacgatgttcaactactggtacagcatgaagatgccaatggcgaaccttaaaaccgcagacactgcaatcggaatcaagtctacgggagaattggatgtgtcactgtcagatgtatatgactttacagtgaagcaaaaaggaaaagaaataaaatcattcaaggagcccgtacagctttcgcttcgcatgtttgatattgaagaagcccataaccctgccatttatcacgtcgatagaaaaaagaaagctttcacaaagacaggtcacggatcagtcgatgatgatatggtgacaggatatacaaaccacttcagcgaatacacgatcttaaattccggttcaaacaacaaaccgccggcattcccgtcagatcaaccgacaggcggtgatgacggcaatcatggcggaggctccgacaaaccaggcggaaaacagccaactgacggaaacggaggaaatgatacgcctcccgggactcaaccgactaacggctctggtggaaacggttcgggcggatcaggaacagacggtccggctggcggcctgcttccggacacagccacatccatgtactcgatcctgttggccggatttctgatcagcgcactcggaacggcaatgtacttacatcagaggagaaaacagaatagagcgaatcaggcataa

SEQ ID NO: 46799 - DNA, 3447 bp, Bacillus subtilis
ttgtctcagcaatcgatacaaaaagtattagtagcaaacaggggagaaattgcaatccgaatattccgggcgtgtaccgagttgaatattcgtacagttgcggtctattcaaaagaagattccggttcctaccatcggtacaaagcggatgaagcatacttggtcggtgaagggaaaaaaccgattgatgcttacctggatattgaaggtatcattgatattgcgaaaagaaacaaagtcgatgcaattcatccgggatacggtttcttatctgaaaatattcattttgcgagacgatgtgaagaagaaggcatcgtattcatagggccaaaatccgagcatctcgatatgtttggtgacaaggtaaaagcgcgtgagcaggcagaaaaagcgggaatccccgtgattccgggaagcgacggtcctgccgaaacgcttgaagccgtcgaacaatttggacaagctaacggttatccgatcatcattaaagcctcgcttggcggcggcggccgcggtatgcggattgtcagatctgaaagtgaagttaaagaagcatatgagcgtgctaaatcagaggcgaaagcagcctttggcaatgatgaagtttatgtagaaaaattaattgagaatccgaaacatattgaggttcaggtcattggagacaagcagggcaatgtcgtccatctttttgagagggattgctccgttcaaagacgccatcaaaaagtcattgaagtggcgccgagtgtctcgctgtcacctgaattaagggaccaaatttgtgaggctgcagttgcgcttgccaaaaatgtaaactatataaatgcggggacggtcgaattccttgttgcaaacaacgagttctactttattgaagtaaatcctcgcgtacaagttgaacacacgataacagaaatgattactggtgtcgatattgttcaaactcagatccttgttgcccaagggcacagccttcacagcaaaaaagtaaatattcctgagcaaaaggacatttttacaatcggctatgccattcagtcacgggttacgactgaggatccgcaaaatgatttcatgcctgatacaggaaaaatcatggcttaccgctcaggcggcggttttggtgtccgtcttgataccggaaacagcttccagggcgccgtgatcacaccatactatgattcacttctcgttaagctttcaacttgggctttaacgtttgaacaggcagctgccaaaatggtgcgaaaccttcaggagtttagaatcagaggcataaaaacgaacattccgttccttgagaacgttgcaaagcatgagaagttcctgacagggcaatatgatacatctttcattgatacaacgcctgaattatttaatttccctaaacaaaaagaccgcggaacgaaaatgctcacttacatcggcaatgtgacagtgaacggcttccctggaatcgggaaaaaagaaaaaccggcgtttgacaaaccgttaggcgtaaaggtagacgttgatcagcagcctgccagaggaacaaagcaaattctcgatgaaaaaggtgcagaagggcttgcaaattgggttaaggagcagaaatctgtccttttaactgatacgacattcagggatgcccaccaatcgttattggcaactagaatcagatcgcatgatttgaaaaaaatcgcaaatccgacggctgcgttatggcctgaactattcagtatggaaatgtggggaggcgcgaccttcgatgtagcctaccgattcctgaaagaagatccgtggaaacgtttggaagatcttcgcaaagaagtgccgaataccttattccagatgttgcttcgctcatcaaatgcggtcggctatacgaattatccggacaatgtgattaaagaatttgtgaagcaatcagctcaatccggtattgatgtgtttcgtattttcgacagcttaaactgggtaaaagggatgacgttagccattgatgctgttagggataccggcaaagtggcagaagctgcgatttgttatacgggagatatccttgacaagaaccggacgaagtacgaccttgcatattatacatcgatggcgaaggagcttgaggcggccggagcccatattctcgggattaaagatatggcagggctgttaaaaccgcaggctgcatatgagctcgtttctgcgttgaaagaaacgatcgacattccggttcaccttcatacgcatgatacgagcggaaacggtatttatatgtatgcgaaagctgttgaagccggcgttgatatcatagacgtggcggtcagctcaatggcgggattaacgtcacagcctagcgcgagcggattttatcatgcgatggaaggcaacgaccgccgtccggaaatgaatgtccaaggcgttgaattgctgtcccaatattgggagtcggtgcgtaaatattatagtgaatttgaaagcggaatgaagtctccgcatactgaaatttatgaacacgaaatgccagggggccaatacagcaacctgcagcagcaagccaagggagtaggccttggcgaccgctggaacgaagtcaaggaaatgtacagacgcgtgaacgatatgttcggtgacatcgtcaaggtaacgccttcctcaaaagtagtcggagatatggcactctacatggtgcaaaacaatctgactgaaaaagacgtttacgaaaaaggtgaatctttagatttccctgattctgtcgtggagctttttaaaggaaatatcggccagcctcatggcggattcccagaaaaactgcaaaagctgatcttaaaagggcaggagccgattacagtcagaccgggcgaactgcttgagccggtgtcatttgaagcgatcaaacaggaatttaaagagcagcataacttggaaatttcagatcaggatgctgtggcatatgccctttatcctaaagtcttcactgattatgtgaaaacgacagaaagctatggagacatctcggtattagatacaccgacattcttctacggtatgacattaggtgaagagatagaagttgaaattgagcgcggcaaaacgctgatcgttaagctgatttcaatcggtgagcctcagcctgatgccacccgcgtcgtttatttcgaactcaacgggcagccgcgtgaagtagtcattaaagatgaaagcattaagtcttccgttcaggaaaggctgaaagcagaccggacaaatccaagccacatcgcagcttccatgcctggaacagttattaaggtattggctgaagcaggcacaaaagtcaataaaggtgatcatttgatgattaatgaagcgatgaaaatggaaacaacggttcaggcgcctttctcaggaacaatcaagcaggttcatgtgaaaaatggtgagccgatccaaacgggagatctgctccttgaaattgaaaaagcataa

SEQ ID NO: 46800 - DNA, 1281 bp, Bacillus subtilis
ttggatcaacaaatatactctttgcaaaaaaaagtggaagaacataaggaggagcttattcagcttgcgaaaacgctgatttcttatcaaacacctgctccgcctgcaagaaatacagagggcattcagtcttggattgcgggatatttaaatgaattgggattctcgatcgacaaatgggatgtgtaccctggagatcccaatgttgtagggaggctaaaaggaacagattcagcagattattatagcctgattatcaatggccatgtagatgtggcagaggtaaaagaggatgaagaatggaagcacgatccgtttcatcccattgaaaaaaacggtctcttaatcgggcgaggcgcttccgatatgaagggcggaatggcttgtgtgctgtttgctgtcaaattaattcgtgaagcaagcattgaacttccaggtgatctgattctgcaatcggttattggggaggaagttggagaggccggcacacttgaatgctgcaagaggggctaccacgctgattttgcaattgtcgcggatacgagcgatatgcatattcaaggccaaggcggtgtcattacaggctggatcgaaatcaaaagcagtcaaacatttcatgatggaacgagacggaatatgattcatgcaggcggaggaacattcggagcaagcgcaattgaaaaaatggcaaaaatcattgcggggctcggtgaacttgagcgccactggtctattatgaaaagttatcccggttttaaaccaggcacaaatacgattaacccggcagttatagaaggcggcagacatgcggcttttatagcggacgaatgccggctgtggatcacagtccatttttatccgaatgaaacccatgaccaagtggcagcggaaatagaagattacgtcaatcggctgagtgacagtgatatttggcttagggaaaaccgccctgtattcaagtggggaggctcatctatgatagaagacaggggagaaatttttccggcattggaagttgaccctggccacccaggcgtcttagcgctaactgcctctcatcagaaagtgaaacgggagtgtccaattattgacgtttctcaatcagttacagatggcggatggctgtatgatgccggtattccatgcgtaatatacggtcctggagatctgcacaatgcacactctgtgaacgagaaggtatcgattgagcagctagtagagtatacaaaaattatactcgattttatcatcagctggtgcagccggaaaaaagaacaatga

SEQ ID NO: 46801 - DNA, 546 bp, Bacillus subtilis
ttgaatcaaaaagctgtcattctcgacgaacaggcaattagacgggcgctgaccaggattgctcacgaaatgatcgaacgcaataaaggaatgaataactgcattcttgtcggcattaagacaagagggatttacctggcaaaacgccttgcggaacgcattgaacagattgagggaaatcctgttacagtcggtgaaattgatattactctttacagagatgatctttctaaaaaaacaagcaacgatgaaccgcttgtaaaaggtgcagatattccggtagatattacagatcaaaaagtcattctcgttgatgatgttctgtataccggaagaacagtcagagcaggaatggatgcgcttgttgatgtaggcagaccttcctccattcagcttgcagtgcttgtggacagaggacaccgggagctgccgatccgagcggattatatcgggaaaaacatcccgacatcaaagtctgaaaaggttatggtacagcttgatgaggtagaccaaaacgatctcgtcgccatttatgaaaacgaataa

SEQ ID NO: 46802 - DNA, 915 bp, Bacillus subtilis
atgaagcatttaacgacgatgagtgaacttagcactgaggaaatcaaagatttgcttcaaacagcacaagagctcaaaagcggaaaaacagacaatcagcttacaggaaagtttgcagcaaacctgtttttcgaaccgagcacgagaacgcggttcagctttgaggtcgcagaaaaaaagctgggcatgaatgtgcttaaccttgatggaacaagcacaagcgtgcaaaaaggcgaaaccttatatgacacgatccggacgcttgaatcaatcggtgtggacgtctgcgtcatcaggcacagtgaggatgagtattatgaagagcttgtcagccaggtgaacattccgattctgaatgcgggagacgggtgcggccagcatccaacacaatcactgcttgatttaatgacgatttatgaagagttcaatacgtttaaagggcttaccgtctccattcacggcgacatcaagcatagcagagtggcaaggtcaaatgcggaagtgttgacaagattgggtgcccgggtcctattttccggcccttcggaatggcaggatgaagaaaatacattcggcacgtatgtctcaatggatgaagcagttgagtcttccgatgttgtcatgctgctgcgcattcaaaatgaacgacatcagtccgctgtcagtcaggaaggctatttaaacaaatacggcttgaccgtagaacgggctgagcgtatgaagcggcatgcgatcatcatgcatcctgctccggtaaacagaggagtggagattgatgacagcttagtagaaagcgaaaaatcaagaatcttcaagcaaatgaaaaatggcgtatttatcagaatggcagtgatacagtgtgccttacaaaccaatgtgaaaagaggagaagcagcgtatgtcatatctcattaa

SEQ ID NO: 46803 - DNA, 1095 bp, Bacillus subtilis
atgaagagacgattagtactggaaaacggagcggtattcgagggagaagctttcggaagcttagaacacaacatgggagaagtcgtttttaatactgggatgacaggctatcaggaaattttatctgatccttcttactgcggacagatcgtaacattaacatacccgcttatcggaaattacggcattaaccgtgatgattttgaatccattaccccttttgtcaaagggctgatcatcaaagaattatgtgagctgccttccaactggcgttcagcatacaccttagacgagtatttaaaaatgaaaaacattcccggactccagggaattgatacaaggaagctgacaagaatgatccgcacggcaggcgcgctaaaaggaacattcgcttcatctgatgaagatatcgaagcagtgctgaaaagactgaacgaaacggaattgccaagaaatcaagtatcccaagtatcagcaaaaacagcatatccgagcccgggaagaggcaaacgcattgtcttggttgacttcggcatgaaacacgggattctaagagagctgaacaaacggaaatgtgacgtcatcgttgtgccttacaacattacagcggaagaggtgcttcagctgaaaccggacggtatcatgctttctaacggacctggagacccgaaggatgtgcctgaagcgattgaaatgattaaaggtgttcttggaaaagtgccattattcggaatatgtctcggccaccaattattcgcgctggcgtgcggggcgaatactgaaaaaatgaaattcggccacaggggctcaaaccacccggtaaaagagctggctacaggaaaagttgccttaacatctcaaaaccatggatatacagtttcgtctatcagtaaaacagaactggaagtgacgcatatcgcaattaacgacgatacgattgaagggctgaagcataaaacattgccggcatttacggttcaatatcatcccgaagcctcacctggtcctgaggatgccaaccatctatttgacagattcatcgaaatgatcgaaacaacagagaaagaaggggaagcggtatgccaaaacgcgtag

SEQ ID NO: 46804 - DNA, 3216 bp, Bacillus subtilis
atgccaaaacgcgtagacattaacaaaattttagtaatcggatctggaccgatcatcatcggccaagcagcagaatttgactatgcgggaacacaagcctgtcttgctttgaaagaagaaggctatgaagtcatccttgtcaactcaaaccctgcaacgatcatgacagatacagaaatggctgaccgggtttacatcgaaccgctcacacctgaattcctgacacgaatcatcagaaaagagcgcccggatgccattcttcctacactcggaggccaaaccggtttgaatcttgcggttgagctttctgaaagaggcgttttggcagaatgcggcgtcgaagtgcttggcacgaaactgtctgcgattcagcaagctgaagaccgtgacttgttcagaacattaatgaatgaactgaatgaaccggtgcctgaaagtgagattatccactcccttgaagaagcagaaaaattcgtcagtcaaattggattccctgtcattgtccgcccggcatatacattaggcggaacaggcggaggcatctgctcgaatgaaacagagctaaaagaaatcgttgagaacggcttgaaattaagcccggtacaccaatgtctgcttgaaaaaagcatcgccggctataaagaaatcgagtatgaagtcatgagagacagccaggatcacgccattgtcgtttgtaacatggaaaacattgatccagttggaatccatactggagacagtattgttgtcgcgccgagccaaacgctcagcgatcgcgaatatcagctcttgcggaatgtatcgttaaaactgattcgcgcgcttgggatcgaaggcggatgtaatgtccagctcgccttagatccagacagcttccaatattacattattgaagtaaatccgcgtgtcagccgttcatctgcccttgcatcaaaagcaacggggtacccgattgcaaagctcgctgctaaaattgcagtcggactttcattagatgaaatgatgaacccggtgacaggaaaaacatatgcagcatttgaacctgctcttgactatgtcgtatccaaaattccgcgctggccgtttgataagtttgaatcagcaaacagaaagcttggcacgcaaatgaaagcgacaggtgaggtcatggcaatcggccgcacgcttgaagagtcattgctgaaggcagtgcgatcactggaagcggatgtgtatcatcttgaattgaaggacgccgctgacatttcagatgagcttcttgaaaagcgaattaaaaaggccggtgatgaacgcttattctacttagctgaagcgtacagaagaggctacacggtagaagacctccatgaattttccgctatcgatgtcttcttcttgcataagctgttcggaatcgtacagtttgaaaaagaattgaaggccaatgcgggcgatacagatgtgctgagacgggcaaaagaactcggcttctctgatcagtacatcagccgtgaatggaaaatgaaagaatctgagctttacagcttgagaaaacaagcggggattgcgccggtattcaaaatggtagatacatgcgcggcggaatttgagtcagaaacgccatacttctatagcacatatgaagaagaaaatgaatctgtcgttacagataagaaaagtgtgatggtgcttggttcgggtccgattcgaatcggtcagggtgtcgagttcgactatgcgacggttcactctgtatgggcaattaaacaagcaggctatgaagccattattgtcaacaacaacccggaaaccgtttcaacagacttcagcatctcagacaagctgtattttgaaccgcttacgattgaagatgtcatgcacatcattgacctcgaacagccaatgggcgttgtcgtacaatttggcggacaaactgcgattaaccttgctgacgagctttctgcacgcggagtgaaaatccttggaacttcattagaagatttagaccgtgccgaagaccgggataaatttgaacaagcgcttggagaacttggtgttcctcagccgcttggcaaaacagcgacatcagttaatcaggcggtaagcatcgcaagtgatatcggttatccggtactggtacgcccttcctatgtacttggcggccgggcgatggagattgtttaccatgaagaggaactgcttcattacatgaaaaatgcagtcaaaatcaatccacagcaccctgtattaattgatagatacttgaccggaaaagaaattgaagtcgatgcagtatccgacggtgaaacagtcgtcattccgggaattatggagcacattgaacgtgcgggcgttcactccggagactcaatcgctgtttatccgcctcagtctctcacagaggacattaagaaaaaaattgaacaatacacgatcgcattggctaaagggctgaatattgtcggtttgctcaatattcaattcgtcttgtcgcaaggcgaggtgtacgtgctagaagtgaatccgagatcaagcagaaccgtaccgtttttaagcaaaattacgggtatcccaatggcgaatctcgcaacaaaaatcattcttggtcaaaagctggctgcgtttggctatacagagggccttcagcctgaacagcaaggtgtatttgtaaaagcgccggtcttctcctttgccaagctgagaagagtggatattacgttagggcctgaaatgaaatcaacaggtgaagtcatggggaaagattcgacacttgaaaaggcgctctacaaagccttgatcgcttcaggtattcaaatcccgaactacggttccgtgcttttaacagtagctgataaggacaaagaagaagggcttgccattgctaagcggttccacgcgatcggctacaacattttagcgacggaaggaacggcaggctacctgaaagaagcttccattccagcgaaggtcgtcggaaaaatcggtcaggatggcccgaacttgcttgatgtcatcagaaacggagaagcgcagtttgtcatcaatacgctgacaaaaggaaagcagccggcaagagacggttttagaatcagacgtgaatcagtagaaaatggtgttgcctgcctaacatctttagatacggcagaggcgatattgcgagtgctggaaagcatgacattccgtgctgatcaaatgccggcagtcaacacaaatcaggaggcggcagtcactatatga

SEQ ID NO: 46805 - DNA, 702 bp, Bacillus subtilis
atgttaacgtatgataattgggaagaaccaacgattacatttccggaagacgatccttataaaggagcgctgtcagttttaaaatgggcatacggccattacggcgatcagcttgtttatgcctgcagtttcggaattgagggaatcgttctgattgacttaatttataaagtgaaaaaagacgcagagattgtgtttcttgatacaggacttcattttaaagaaacctatgaaacaattgaacgagtgaaagagcgttatccgggtcttaatatcatcctgaaaaaaccagatctcacccttgaggaacaagccgaagaacatggtgacaaactatgggaaagagagccgaatcagtgctgctatcttagaaaggtcgttcctttaagagaggcgctttcaggacatccagcctggctttccggcctgcgccgtgatcaagggccaagccgtgccaatacgaatttcttaaacaaagatgaaaaattcaagtcagtaaaagtttgcccgcttatccattggacttggaaagacatttggagatatacatcccggaatgaactggactacaatccgcttcatgaccaaggctatccaagtattggctgtgcgccttgcacttctcccgcttttacagcagaagatttgcgctcaggcagatggaatggtatggcgaaaacagaatgcggactgcatgaataa

SEQ ID NO: 46806 - DNA, 1149 bp, Bacillus subtilis
atgagcttagcaccacacggaggaacattagtaaacagagtagatgaatcatatgatgtgagcggcattcaaaaagaaattgaacttgatttaatttctttcgcggatttggaattgatcggtatcggtgcatacagcccgattgaaggtttctttaatgaaaaagattacgtatcagtggtcgaaaacatgcgtctttcttccggcgttgtctggtctcttccaatcacgcttccggtcgatgcgcaaaaagcagcggaactgtcacttggtgaaacggtaaagttaacgtatgaaggagaaacttacggcgttatccaaatcgaagacctgtacgtgcctgacaaacaaaaagaagctgtcaatgtgtacaaaacagatgaacaggagcatcctggtgttaaaaagctgttcagccgcggcaatacatatgtcggcggaccgattacgttgattaaaaaagcttcaaaacagttccctgaatttacatttgaaccgtcagaaacgagacgccagtttgcggaaaaaggctgggaaaccattgtcggtttccaaacaagaaaccctgttcacagagcgcatgaatacattcaaaaaacggctcttgaaacagtagacggcttgttcttgaatccgttagtaggtgaaacaaaatctgatgacattccagctgatgtacggatggaaagctaccaagtgcttcttgatcattattacccgaaagatcgtgttttccttggtgtctttttagcggcgatgcgttatgcaggcccgagagaagcaattttccacgcgcttgtcagaaagaactacggctgcacacatttcatcgtcggccgtgatcatgcaggtgtaggcgactattacggaacatacgaagcacaggaactgtttgacacatttaaacctgaagaactcggaattacaccgctgaaatttgagcacagcttcttctgtaaaaaatgcggaaatatgggaacagcaaaaacttgccctcatggcagagagcatcacgtcattttatcaggcactaaggtaagaggtatgctgagagacggtgtgctgccgcctgctgaattcagtcgaaaagaagtagtagaagtgttaatcaaagggatgaagaaaaaagaagaagtaggcgtatcttaa

SEQ ID NO: 46807 - DNA, 594 bp, Bacillus subtilis
gtgacaaatcgcgatattgtatggcatgaagcctctatcacaaaagaagagtatcagcaaaaaaacaagcataaaagctccattctctggctgacagggttaagcggctcaggcaaatcaaccattgccaacgccgctgcgagagaattgtttgagcaaggctaccaagtcattgtgctggacggggataatatccgtcacggcctaaatagggatcttggtttttctgatgaagaccgaaaagaaaacatccgccggatcggagaggtggcgaagctttttgttcagcagggaaccattgtgattactgcttttatctctcctttccgcgaggacagacaacaggttcgcgagcttgtggaagcgggcgaatttaatgaagtctacattaaatgcgaccttgatatttgtgaacaaagagatccgaaagggctttacaaaaaagcaagaaacggcgagattccgttctttacaggaattgattctccttatgaagaaccggaagctccagagctcgttcttgattcaggacagcatgaccgtgaagcgtgtaaaaatcagctgatcgagtttgttaaacaaaaattgagctga

SEQ ID NO: 46808 - DNA, 2673 bp, Bacillus subtilis
atgaagtttcatgaaatgggacaaacagatttactagaggcaaccaatacgtccatgaaacaaggattaacagaaaaagaggtaaaaaaacgccttgacaagcatggaccaaacgagctgcaagaagggaaaaaaacttcagcgcttctcttgtttttcgcgcagttcaaagattttatggtgcttgtgcttctggcggcaacgttaatctcaggatttcttggtgaatatgtagatgcggttgcgattattgcgattgtgtttgtgaatggcatactcggtttctttcaagaaaggcgtgctgagcaatctcttcaggctttaaaagagctttcaacaccgcacgtcatggcactcagggaaggaagctggacaaagattccttctaaggaactggtgccgggtgatattgtgaaatttacgagcggggacagaattggcgcagacgttcgaattgttgaagcgagaagccttgaaatagaagaatcagcgctaaccggggaatcaatcccggttgtgaagcatgctgataaattgaaaaaaccggatgtttcactcggcgatattaccaatatggcatttatgggtacgattgtgacccgcggcagcggtgtcggggttgtcgtcgggacaggaatgaatacggctatggggaaaattgccgacatgcttgaatcggcagggacattgtcaaccccgctgcaaagaagactggagcagctcgggaagattttgattgttgttgcattgcttctgaccgtacttgtcgttgctgtcggtgttattcagggtcatgatctgtacagtatgtttttagcaggtgtctcgttagcggtagccgctattccggaggggctgccggcgattgtgacagtggcgctttcgcttggtgtacagaggatgattaaacaaaaatccattgttagaaagcttcctgctgttgaaacgcttgggtgtgcgtctatcatttgctcagataaaacagggacaatgacccaaaacaaaatgacagtgacgcatgtctggtccggagggaaaacatggagagtggcaggggccggctatgaaccgaaaggaagcttcacactaaacgaaaaagagatcagtgtcaatgaacataagccgcttcagcagatgcttctgttcggagcgctttgtaacaactccaatattgagaaaagagacggcgaatatgtgcttgacggagatccgacagagggagcgctgctcaccgcggcaagaaaaggcggtttttcaaaggagtttgttgaatctaattacagagtgattgaagaatttccgtttgattccgcacggaaaatgatgactgtcatcgtagagaatcaagacagaaagcgctatatcattacaaaaggtgcgccggatgtactcatgcagcgatcttcccgtatttattatgatggctcagcggctcttttttcaaatgaaagaaaagcagaaacagaggcggtattaagacatttggcatcacaggcgctcagaacgatagcggtcgcctacaggccgataaaagcaggcgaaacaccgtcaatggagcaggcggaaaaagatctgaccatgcttggcctttcaggtatcattgatcccccgcggccggaagtcagacaggcgattaaagaatgccgtgaagcgggaattaagaccgtcatgattacaggtgatcatgtagaaaccgctaaagcgatagcgaaagacttgcgcctccttccgaaaagcggcaaaatcatggacggcaagatgctgaatgaactttctcaagaagagctttctcatgtggtggaggatgtgtatgtatttgcccgcgtttcccctgaacataaactaaaaatcgtaaaagcctatcaggagaacgggcatattgtggcgatgacgggagacggcgtcaatgatgctcctgccattaaacaggctgatatcggcgtctctatgggcattaccgggacagatgtggccaaagaagcatcatctcttgttctcgtggatgataattttgcgacgattaaatcagcgataaaagaaggcaggaacatctacgaaaatatcaggaagtttatcagatacctgttggcgtctaacgtcggagaaatccttgtcatgctgtttgcgatgctgcttgcccttcctttaccgctggttccgattcagattttgtgggtcaacttggtgacggacggattgccggcaatggcgctcggcatggatcagccggaaggagacgtcatgaagcgcaagccccgtcatccgaaagaaggggtatttgcccgcaagctaggatggaaggtcgtttccagaggatttttaatcggagttgccactattttagcgtttatcattgtgtaccaccgcaatccggaaaacttggcttatgcccagacgatcgcgtttgccacattggtgctcgctcagcttattcacgtgtttgactgccgcagcgaaacttctgttttctctagaaatccgtttcaaaacctgtatttaatcggcgcggtattgtcatccattttgctgatgcttgtagtaatctactatccgccgcttcagccgattttccatactgtagccatcacgccgggggactggatgctcgtcatcggtatgtccgccatccctacttttttgctggcggggtcacttttaacaagaaaaaaataa

SEQ ID NO: 46809 - DNA, 954 bp, Bacillus subtilis
atgagtaagattgcatttttattcccgggtcagggatcacaatttatcggcatgggaaaagagctttatgagcaggtgcctgctgcaaagcgtctgtttgatgaagccgatgaaacgttggaaacaaaactcagctcgcttatttttgagggggatgctgaagaattaacacttacatacaatgcgcagcctgctttgcttacgacaagcatcgctgttcttgagaaatttaaagaatctggcattacacctgatttcacagcaggacacagccttggtgaatattctgcactggttgcggctggcgctctgtctttcaaagatgctgtttatactgtcagaaagcgcggagagtttatgaatgaagcggtgccggctggcgaaggagcaatggctgcgattctcggcatggatgctgaagcattaaagcaagtaaccgataaagtcacagaggaaggcaaccttgtacagcttgcgaatctcaactgtcctggccaaatcgtcatttccggaacagctaaaggggttgagcttgcatctgaactggcaaaagagaacggcgcaaaacgcgcaattccgcttgaagtaagcggtccgttccattctgaactgatgaaaccggctgctgaaaagctgaaagaggtattggacgcctgtgacataaaagacgctgacgttccggtcatctcaaatgtttctgctgacgtgatgactgaaaaagcagatatcaaagaaaaacttattgagcagctttactctccggttcgttttgaggaaagcattaacaagctgatcgcagagggtgttacgacttttattgaaatcggtcccggaaaagtgctttcaggccttgtgaaaaaagtgaatagacggttaaaaacaattgctgtatcagatccggaaacgatcgagctggcaattcaaacgcttaaggaggagaatgataatgcttaa

SEQ ID NO: 46810 - DNA, 741 bp, Bacillus subtilis
atgcttaatgataaaacggctattgtcactggcgcatcccgcggaatcggccgctcaatcgcccttgatctggcaaaaagcggagcaaatgttgtcgtgaactactccggcaatgaagcgaaagcaaatgaagtggtagatgaaatcaaatcaatgggcagaaaagcaattgctgtaaaagcggatgtatcaaatcccgaagatgtacaaaacatgataaaagaaacattgtctgttttttctacgattgacattctggttaataatgcgggaattacaagagacaatctcatcatgagaatgaaagaagacgaatgggatgacgtcattaacattaacctgaagggtgttttcaactgcacaaaagctgttacaagacaaatgatgaaacagcgttcaggccgcattattaacgtatcgtctatcgtcggcgtcagcggaaaccctggacaagccaactacgtggctgcaaaagccggcgtcatcggtttaaccaaatcttctgctaaagagctcgccagccgaaatattacggtaaacgcaatagcgccaggatttatctcaactgatatgacagataaacttgcaaaagacgttcaagacgaaatgctgaaacaaattccgctcgcgcgctttggtgaacctagcgatgtcagcagtgttgtcacgttcctagcttcagagggagctcgttatatgacaggccaaacgcttcatattgacggcggaatggtgatgtaa

SEQ ID NO: 46811 - DNA, 3561 bp, Bacillus subtilis
atgttcctcaaacgtttagacgttataggatttaaatcatttgcagaacggatttccgtagacttcgttaaaggcgtgacagcagttgtcgggccgaacggaagcggaaaaagcaacatcacggatgccattcgctgggttctcggcgaacaatcggcacgctctcttcgcggcggaaaaatggaagacatcatttttgctgggagtgattcaagaaagcgattaaatctagctgaagttacgcttactcttgataatgatgatcatttcttgccaattgacttccacgaggtgagtgtcacaagacgtgtgtacagatcaggtgagagtgagtttctgattaacaatcagccatgccgcttgaaagatattattgatttatttatggactctgggcttggtaaagaagcattttctattatcagccaagggaaagtggaagagatcctgagcagcaaagcggaggatcgccgcagtatctttgaagaagcggccggggtgcttaaatataaaacgagaaagaaaaaagcagaaaataaactgtttgagacacaggacaatctaaatcgggtagaagatatattacatgagcttgaaggacaggttgaacctcttaaaattcaagcttcaatagcgaaagactaccttgagaaaaagaaagagctggagcatgttgaaattgcgctgactgcctatgatatcgaaaagctgcatggtaaatggtcgactcttaaagagaaagtgcagatggcaaaagaagaagagcttgctgaatcgtctgctatttctgcgaaagaagcaaagattgaggatacaagggacaaaatacaagcgcttgatgagtcagtaaatgagctccagcaagttttactggtaactagtgaagagctggaaaagcttgaaggccgtaaagaagtcctgaaagaacgaaagaaaaacgctgtgcaaaaccaagaacagcttgaagaagccatcgttcagttccagcaaaaagaaacggttctgaaagaagagctttcgaagcaggaagctgtcttcgaaacgcttcaggctgaggtgaagcagttaagggcgcaagtaaaagaaaaacagcaggctctcagtcttcacaatgaaaatgtcgaagagaaaatcgagcagctgaaaagtgattattttgagctgttaaacagccaggcttcgatacgcaacgaactccagcttcttgatgaccagatgtcccaatccgctgtcacattgcagagacttgcggacaacaatgaaaagcacctgcaggaacggcatgatatttctgcgcgtaaagccgcatgtgaaacggaatttgcccgaattgagcaggagattcacagtcaagtcggtgcatatcgtgatatgcagacaaaatatgagcagaaaaagcgccaatacgaaaaaaatgaatccgctctgtatcaggcataccaatacgttcagcaagcgagatcaaaaaaggacatgcttgagacgatgcagggagatttctccggcttttatcaaggtgttaaagaagtgctgaaagcgaaagagcgccttggcggaattcgcggagcggttcttgagctgatttctacagaacagaagtatgaaacggccattgaaatagcgctcggcgcttctgctcaacacgtcgtgaccgacgatgaacaatctgcccgcaaagcgattcaatatttaaagcagaattccttcggccgggcgacgtttctgcctctttctgttattagagaccgccagcttcaaagccgtgacgcggaaacagccgcccggcattcatcatttctcggggttgccagtgaacttgtcacatttgatcctgcgtatcgaagcgtcatccagaatcttcttggaaccgttctgatcacagaggacttaaagggtgcaaacgagcttgcgaagcttctcgggcaccggtaccgcatcgtaacccttgagggagatgttgtgaaccccggtggttcaatgacgggcggcgcggttaaaaagaaaaataactccctccttggaagaagccgggagctagaagatgtgacgaaacggctcgctgaaatggaagagaaaacggcactgcttgaacaagaggtcaaaacccttaagcactccattcaggatatggagaaaaaactggctgacttaagagaaaccggggaaggcttaaggttaaagcagcaggatgtgaaaggccagctgtacgaacttcaagttgccgagaaaaatatcaatacccatttagagctctatgatcaagaaaaatctgctctgtcagaaagcgatgaagagagaaaagtgcgcaaacgcaagcttgaagaagagctctctgccgtatctgaaaagatgaaacagcttgaagaggacatagacagactgacaaaacaaaaacaaacgcaatcctcaacgaaagagtctctctccaacgagctgactgagctgaagatcgcagcggccaaaaaagagcaggcttgcaagggggaagaggacaaccttgccagattaaagaaagagctcactgaaacagagcttgcgttaaaagaagcaaaagaagacttaagcttcttaacgtcagagatgtcatctagcaccagcggcgaagaaaagctggaagaagcagcaaaacataaattgaatgacaaaacgaaaacgatcgaactgattgcattaaggcgcgatcagcgcatcaagcttcagcatgggcttgatacgtatgagcgtgagctgaaagaaatgaaacgcctgtataaacaaaaaacaacgctcttaaaagacgaagaagtcaaacttggacgaatggaagtcgagcttgataatttactccaatacttacgggaggaatacagcttgtcctttgagggggcaaaagagaaatatcagcttgaaactgatccagaggaagccagaaagcgcgtgaagctgattaaactcgcaattgaagagctgggtaccgtgaacctcggaagcatagatgagtttgagagggtcaacgaacggtacaagtttctgtcggaacaaaaagaagatttaacagaagcgaaaaataccttgttccaagtgattgaagaaatggatgaagaaatgacgaagcgctttaacgacacattcgtccaaatccgctcacactttgatcaagttttccgctccttattcggaggagggcgagctgaactgaggctcaccgatcctaacgatctgcttcattcaggagtcgagattatcgctcagccgccggggaaaaagctgcaaaacttaaacctcctgtcaggcggagagcgtgcgcttactgctatagcgctcttattctcaatcctaaaggttcgtccagtgccgttttgcgtccttgacgaagtagaggctgcgctcgacgaagcgaatgtgttccgatttgcgcagtatttaaaaaaatacagcagcgatactcagtttattgtgattacccacagaaaaggaacgatggaggaagcggatgtgctttatggcgtaaccatgcaggaatccggtgtttccaaggtaatttcagttaagctggaagaaacaaaagaattcgttcagtaa

SEQ ID NO: 46812 - DNA, 1158 bp, Bacillus subtilis
atgaatatccatgagtaccagggaaaagaagtcctcagaaaatatggggtatctgttcctgaaggtaaagtggcttttacagcagaagaagcagttgagagtgcaaagagcttatccagctcggtttatgtcgtaaaggctcaaattcatgctggcggtcgaggcaaagctggtggggtaaaaatagcaaaatcattagacgaagtaaaagcgtatgccgaagaactattagggaagaccctagttacacatcagacgggtccggacggccaagtaataaaacgcttacttattgaagaaggctgcgatattaaaaaagaatattacatcggtctagtgcttgaccgcgccacttcaagaatcgttttaatggcttctgaagaaggcggaacggaaattgaagaggttgcggagaaaacaccagaaaaaatcaaaaaagctgtcattgatccagctgttggccttcaaggctatcaagccagagaaattgcattcgctattaatattccaaaagagctcgtgggaaaagctgctaaatttatgcttggactatataaagcgtttgttgagaaagactgctcaatcgccgaaatcaatccgcttgttgtgactggcgacggaaatgtgatggcgcttgatgcaaaattgaattttgacagcaatgcgttgtaccgacaaaaggacattatggaatacagagatttggatgaagaagatccgaaagaaattgaagcgtccaaatatgatctaagctacatttcccttgatggaaatatcggctgtatggtaaacggcgcgggacttgcaatgtctacgatggatattatcaagcattatggaggagaaccggccaacttccttgatgtgggcggcggtgcaaccgcggaaaaagtcacggaagcatttaaaatcattctttctgatcaaaacgttaaagggatttttgtcaacattttcggcggcattatgaaatgtgatgtcatcgcagaaggggttgttgaagcgactagacaagttggtttgacattgccgcttgtcgtccgtcttgaaggcacaaacgtggatctagggaagaaaatccttagtgaatcaggattaaacattacatctgcggaatcaatggctgacggcgcgcagaaaatcgtatccttagtttaa

SEQ ID NO: 46813 - DNA, 903 bp, Bacillus subtilis
atgagtgttttcattaataaagatacaagagttattgtgcaagggattacaggttctaccgctttatttcatacgaagcagatgcttgaatacggcacaaatatcgttggcggtgtaacacctggaaaaggcggaacagaagcggaaggtgttcctgtatttaatacagtggctgaagcagttcaaacaaccggcgctaacgcgtctgttatatatgtgcccgcaccgtttgcagctgatgcgattatggaagcggtagatgcggagcttgatctcgtgatttgtatcacagaacatatcccggttttggatatggtgaaggtcaaacgcttcatggaaggcaagaaaacgagactgatagggccgaactgtcctggtgtcattacgcctgaagaatgtaaaatcggcattatgcccggatacatccataaaaagggtcatgtaggcgttgtatcacgttcaggaacattaacatacgaagcggtgcaccagctctcagaagcgggtgtagggcaatctacagctgttggaatcggcggcgaccctgtaaatggaacaaactttattgacgttttaaaagcgtttaacgaagatcctgacacacacgcagtcatcatgattggcgaaatcggcggtacggccgaagaggaagcggcagagtgggtaaaagccaacatgacaaaaccggtagtcggttttattggcggtaaaacagcacctcctgggaagcgcatggggcatgcaggcgccattatttccggcgggaaagggacagctgatgaaaaaatcaaaacccttaatgcatgcggaatcgaagttgcagagacaccttctgtcatgggtgaaaccttaatcaaggtgctgaaagagaagaacttgttcgaaacttgtaaaacgcattaa

SEQ ID NO: 46814 - DNA, 1323 bp, Bacillus subtilis
gtgcagctgaatgaagacacagagtctgatagattgtatagaatgacagactcgtataaacggtacggaaaagtcaagcgggtaatcggcttgatgattgaatcaaaagggccagcaagctcaattggtgacctgtgcctgatttatgcaaaaggacagtctgggaaagtcattaaagctgaggtagtcggcttccaggaagaaaatattttgcttatgccttatttagaggctgcgagcattgcacctggcagcattgtagaagctactggggaatcacttcgggttaaagttgggaccggactgatcggacaagtcatcgatgcttttggagaaccgcttgacgaaagcttctgccgaaaggtttcgcctgtatcaacggagcaatcaccgcctaacccgatgaaacggccgcctatccgtgaaaagatgggtgttggagtcagatcaattgacagcttgctgacagtcggtaaaggccagcggattggaatttttgcaggaagcggtgtcggaaaaagcaccttaatggggatgatcgccaagcagacagaggctgacttaaacgtcattgcacttgtcggagaacgcggacgagaggttcgggagtttattgaaaaagatctggggaaagaggggctgaaacgatcgattgtagtcgttgccacctcagaccagccagcattaatgagattgaaagcggcatatacagcgactgcaattgccgagtatttccgagataaaggccaaaatgtcatgtttatgatggattctgttacaagggtggcaatggcgcagcgagagattggactggctgcaggagagcctccgacgacaaaaggctatacaccttcagtgttcgctattttacctcgtttactagaacgaacaggtgcaaacgagcatggaaccattacggcattttatacagtgttggtagatggggatgacatgaatgagccgattgccgataccgtacgcggaattttagacgggcatattgtgttggacagggcgcttgccaataaaggccagtttcctgcagttaacgtactaaaaagcatcagcagggtgatgtcaaacatttcaacaaaacagcatctggatgcggcaaataaattccgtgaacttttatcgacatatcaaaattcggaagatctcattaatatcggagcttacaaaagaggatcatccagagaaattgatgaagcgatacaattttatccgcagcttattcaatttttaaagcagggaacagacgaaccggctttattggaagaaagcattgctgcattaactagtttgacaggaaatgaggaataa

SEQ ID NO: 46815 - DNA, 2151 bp, Bacillus subtilis
atggctaaaatgagagtatacgaatatgcaaaagcgttaaatgtttcaagtaaggaaattttgaccgcactgaagaacatggatttagaagtgaataatcacatggccatgcttgaagaaaaggccattaaaaagctagatgccaaatataaaaaaggcggcgcagctgctaaatctcaaaagccagcagaaacgaacaaaaacaaacagccacaaggggttaatcagcaatcagctggaaatcaaccaaataaaattcgagacggaaagaagaatgacgtgcagaataatcaatttaacaaaaacaagaagaataacaacaacaaaaaaaataaacgcaacaacaacaataataaaaaccaacatcagcaaaagcctgtaaagccgaaaaaagagcttcctgagaaaattacattctctggcactttaacagttggcgcacttgctgaagagcttggcaaagagccttcagaactcattaaaaagctgatgcttcttggcgtaatggcaaccattaaccaagagcttgataaagacacaatcgaactcattgcatcagaatatggtgttgaaacagaagaggtcattgtgcttgaagaaacagagctggaaaaatacgaagagcctgataatgaagaggatcttgaaattcgtcctcctgtcgtgacaatcatgggccacgttgaccatgggaaaacaacgcttcttgacagcatccgtaaaacaaaggttgttgaaggggaagcaggcggaatcactcagcatatcggcgcttatcaaattgaagagaacggcaagaaaatcacgttcttggatacaccgggccacgccgcatttacaacaatgcgcgcacgcggtgcagaagtaactgatattacgattcttgtcgtagctgccgatgacggtgtcatgccgcaaacagttgaagcgattaaccatgcaaaagcagcagaggttccaatcatcgttgctgtgaataaaatagataaagaatccgcaaaccctgaccgtgtaatgcaagaactgacggaatacggacttgtccctgaagcttggggcggagaaaccatttttgtgccgctttccgctttaactggaaaaggcattgatgagctcgttgaaatgattttgcttgtcagtgaggtagaggaactgaaagcgaatccgaatcgtcaggcaaaaggaacggttattgaagctgaactcgataaaggcagagggtcagtcgcgacgttgctcgtacagactggaacactgcatgtcggtgatccgatcgtagtcggcaatacatttggccgtgtccgtgcaatggtcaacgacattggccgccgtgtgaaaactgccggcccgtcaactccggttgaaattaccggtttgaatgatgtccctcaagcgggagaccaattccttgtctttaaggatgaaaaaacagctcgttctgtcggtgaagcccgtgcttcgaaacagcttgaagagcagcgcagcgataaagcgaagctcagtcttgatgatttatttgagcaaattaagcaaggtgatgtaaaagacatcaacctcatcgtaaaagctgacgttcaaggatctgctgaagctttaacggctgcacttcaaaaaattgaagtagaaggcgttaaagtgaaaatcatccatacaggcgttggtgcgattactgaatcagacattatcttggcatctgcttccaatgcaattgttatcgggtttaatgtgagaccggacggaaatgctaagagtacggctgaagctgaaaatgtagatattcgacttcaccgtatcatttacaaagtaatcgacgagattgaagctgccatgaaaggtatgcttgatcctgaatatgaagaaaaagtaattggtcaagtagaagtacgccaaacattcaaagtatctaaaatcggtacaattgccggcggatatgttactgaaggaaccattacgcgcgacagcggcctccgtttaattcgtgacggcgtcgtcatctttgaaggcgaagtagatgttctgaaacgctttaaagacgatgtgaaagaagtttcacaaggctatgaatgtggtattacaattaagaaatacaatgacattcgtgaaggtgacatccttgaagcgtttgtcatgcaagaaattgaaagaacgtga

SEQ ID NO: 46816 - DNA, 1230 bp, Bacillus subtilis
ttgattaaacgatatacgtgtccaaatggtgtaagaattgtgctggaaaataacccgacagtccgttctgttgcgatcggcgtatggatcggcacaggttcgagacatgaaacgccggagataaacggaatttctcactttttagagcacatgttctttaaagggacgagcacaaaatctgcacgcgagatagcagaatcttttgatcgtattggcggccaggtcaatgcgtttacttcaaaggaatatacctgctactatgcaaaggtgcttgacgagcatgcgaattacgcgctggacgtattagcagatatgttctttcattcaacgtttgatgaaaacgagctgaaaaaagagaaaaatgtagtatatgaagaaattaaaatgtatgaagatgcgccggacgacattgtacatgatttattgagcaaagccacttacggcaatcattctttaggctacccaattttaggaacggaagaaacgcttgcttcctttaacggtgactctctcagacaatacatgcatgattattatacgccggaccgagtggtgatttcggtagcgggcaatatatctgacagttttatcaaagatgtagaaaaatggttcgggtcatacgaggcgaaaggcaaagcgacaggccttgagaagcctgagttccacacggaaaaactgacgagaaaaaaagaaacagagcaggctcatttgtgccttggatttaaaggcttagaggttggccatgaacgtatttatgatttaatcgtcctcaacaatgtgctcggaggcagcatgagcagccggctgttccaagatgtgcgtgaagataaaggacttgcttattctgtttacagctatcacagctcatatgaggacagcggaatgctaacgatttacggcggaacgggtgcaaatcagcttcagcagctgtcggaaacaattcaagaaaccctggccacattaaaacgtgacggcattacctcgaaagaactggaaaacagcaaagagcaaatgaagggaagcttaatgctgagcttagaaagcacaaacagcaaaatgagccgaaacggaaaaaatgaactgctgctcggcaaacataaaacattagatgaaattatcaatgaattaaacgccgtgaacttagagcgtgttaatggccttgccagacaattgtttaccgaagactatgcattagcacttatcagcccttccggcaatatgccgtcttaa

SEQ ID NO: 46817 - DNA, 1041 bp, Bacillus subtilis
atgggaagaggtttacacgtagctgttgtcggagcgacaggggctgtgggacaacaaatgcttaaaacacttgaagacagaaactttgaaatggacacacttacattgctatcttcaaaacgctctgcggggacaaaagtcacgtttaaaggccaagagctgactgttcaggaagcttctcctgagagctttgaaggggtaaatattgctttgttcagcgccggcggaagcgtatcacaagcattggcaccagaagctgtaaaacgcggcgctattgttatagataatacgagtgcgttccgcatggatgaaaatacaccgcttgttgtgccagaagtgaatgaggcagacttgcatgaacacaacggcattattgccaatccaaactgctctacaatccaaatggttgcggcacttgaaccgatccgcaaagcatatggcttaaacaaggtcatcgtatcaacttaccaggcagtatcaggagcgggtaatgaagctgtaaaagagctttacagccaaacacaggcgattttaaataaagaagaaatagagcctgagatcatgcctgtaaaaggtgacaaaaaacactatcaaatcgccttcaacgcgattccgcaaatcgataaattccaagataacggctatacgtttgaggaaatgaaaatgataaatgaaacgaaaaaaatcatgcacatgcctgaccttcaagtagcggctacatgtgtgagactgccaatccaaactgggcactcagagtccgtctacatcgaaatagaccgtgatgacgctacagttgaagatattaaaaatctattgaaagaagctccgggcgtgacacttcaggatgatccaagccagcagctttatccgatgcctgctgatgctgtcggcaaaaacgatgtgtttgtaggccgcatccgcaaagacttggacagagcaaacggttttcatttatgggttgtttctgataacctattaaaaggcgcggcatggaactctgttcaaattgcagaaagcctgaaaaaactaaacctcgtataa

SEQ ID NO: 46818 - DNA, 1215 bp, Bacillus subtilis
gtgaagataattgttcaaaagttcggcggaacatcagtaaaagatgataaaggccgcaaactggctttagggcatattaaagaagcaatcagtgaaggatataaggttgtcgttgtcgtttcagcgatgggccgaaaaggggacccgtatgcaacagattctttgctcgggctgctttacggcgatcagtcagcgatttctcctagggagcaggatttgcttttatcttgcggagagactatttcctctgtcgtctttacaagcatgctgcttgataacggtgtgaaagcagctgcgctgacaggggctcaggctggctttttaacgaatgatcagcatactaatgcgaaaatcattgaaatgaaaccggagcgtttattcagtgtgctcgccaatcatgatgcggtagtcgtcgcaggcttccagggcgcaactgaaaagggtgatacaacaacaatcggcagagggggcagcgatacgtctgcagccgcactcggagcagctgttgatgcggaatacatcgatattttcaccgatgtagaaggcgtgatgactgctgacccaagagtggtagaaaatgcaaaaccgcttcctgttgtgacgtatacggaaatctgcaacctggcgtatcagggggccaaggtcatttctccgcgtgctgtggaaatcgcaatgcaggccaaggttccgatccgcgtccgttcgacttattcgaatgataaaggcacattggtgacatcacatcactcttccaaggtcggcagtgatgtttttgaaaggctgattacgggaatcgcccatgtcaaagatgtcacgcagttcaaagtgcctgcgaaaatcggccagtataacgttcagactgaagtgttcaaggctatggcaaacgctggaatcagtgtcgatttctttaacattacacctagtgaaatcgtctatacggtagccggaaataaaacagaaacagctcagcgtattttaatggatatgggctatgatccaatggtgacgagaaactgcgcgaaggtatcggcggtcggcgcgggcattatgggtgttcccggtgttacgtccaaaattgtatcggctctttcagaaaaagaaattccgatccttcagtcggctgacagccatacgacgatatgggtgctcgtccatgaagcggatatggttcctgctgtaaacgctttgcatgaagagtttgaactttcgaagtaa

SEQ ID NO: 46819 - DNA, 873 bp, Bacillus subtilis
atgaatttcggaaatgtgtctacagcgatgattacaccctttgacaataaagggaacgtagactttcaaaaactgtctacactgattgattacttgttgaaaaacggaacggattctttagtagtagcgggaacaactggagaatctccgaccctttcaactgaagaaaaaattgcgctttttgaatatacggtaaaagaagtaaacggacgggtgcccgttatcgctggtactgggagcaacaacacgaaagattccattaagctgacaaaaaaagctgaggaagcgggcgtggacgctgttatgcttgttaccccgtattacaataaaccttctcaagaaggaatgtaccagcattttaaagcaattgcggcagagacatctcttccggttatgctctataatgttcctggccgtacggttgcttctcttgctcctgaaacgacgatccgtttggcggcagacattccgaatgtggttgcgattaaagaagcgagcggagacctcgaagcgattacaaaaattattgctgaaacacctgaagacttctatgtctattcaggggatgatgctctaacgcttccaattctttcagttggaggtagaggagttgtgtcagtggcgagccatattgcaggcactgatatgcagcaaatgatcaaaaattatacgaatgggcaaacagctaatgcggcactgattcatcagaaactgctgccgattatgaaggaactgtttaaagcgcctaatcctgctccagtcaaaacagcgcttcagctgagaggtcttgatgtcggttctgtgcgtctgcctctagtcccattaactgaggatgaacgtctgagcttaagcagcacgatcagcgaactgtaa

SEQ ID NO: 46820 - DNA, 729 bp, Bacillus subtilis
atgaacaaaacagcactaatcaccggagcaagctgcggcattggcaaaagcatcagcgaaacccttgcagctagaggatacaatctgctgctgcattacaatacaaatcaaaacgcggcagcggagcttgctgaaaaactaagtcagatgtttggcgtaaatgcggagatattacaagctgacctgtccgcgcaagatggagcagataagctgacaagttcaattgttcagccgattgatgcgattgttttaaacagcggacgaagccattttgggctgattacggatgtagataacgcaacggtccaggaaatggttcagcttcatgtggcgagtccgtatatgctgacgagaaaccttctgccaggcatgattcggaataaatcgggagcgattgtggctgtcagctcgatttggggagagactggagcatcctgtgaagtgttgtacagcatggcaaaaggagctcagcattcatttgtaaaaggattggctaaggagctggcgccaagcggaatcagagtaaacgccgtagcgccgggtgcagttgatacaaatatgatgaatcaatttaccccggctgaaaaagaagagatcgctgatgagattccgatcggccggctgggccggacgcaagaaattgcggatgcaacagcttttctcctgtctgaaaaagcgtcatatatcaccggccaaattctgtcggtgaatggcggctggcactgctga

SEQ ID NO: 46821 - DNA, 1044 bp, Bacillus subtilis
atgcagagtggaaagatgaaagctctaatgaaaaaggacggggcgttcggtgctgtgctgactgaagttcccattcctgagattgataaacatgaagtcctcataaaagtgaaagccgcttccatatgcggcacggatgtccacatttataattgggatcaatgggcacgtcagagaatcaaaacaccctatgttttcggccatgagttcagcggcatcgtagagggcgtgggagagaatgtcagcagtgtaaaagtgggagagtatgtgtctgcggaaacacacattgtctgtggtgaatgtgtcccttgcctaacaggaaaatctcatgtgtgtaccaatactgctataatcggagtggacacggcaggctgttttgcggagtatgtaaaagttccagctgataacatttggagaaatcccgctgatatggacccgtcgattgcttccattcaagagcctttaggaaatgcagttcataccgtactcgagagccagcctgcaggaggaacgactgcagtcattggatgcggaccgattggtcttatggctgttgcggttgcaaaagcagcaggagcttctcaggtgatagcgattgataagaatgaatacaggctgaggcttgcaaaacaaatgggagcgacttgtactgtttctattgaaaaagaagacccgctcaaaattgtaagcgctttaacgagtggagaaggagcagatcttgtttgtgagatgtcgggccatccctcagcgattgcccaaggtcttgcgatggctgcgaatggcggaagatttcatattctcagcttgccggaacatccggtgacaattgatttgacgaataaagtggtatttaaagggcttaccatccaaggaatcacaggaagaaaaatgttttcaacatggcgccaggtgtctcagttgatcagttcaaacatgatcgatcttgcacctgttattacccatcagtttccattagaggagtttgaaaaaggtttcgaactgatgagaagcgggcagtgcggaaaagtaattttaattccataa

SEQ ID NO: 46822 - DNA, 1179 bp, Bacillus subtilis
atgacgaaggaatttgagtttttaaaagcagagcttaatagtatgaaagaaaaccatacatggcaagacataaaacagcttgaatctatgcagggcccatctgtcacagtgaatcaccaaaaagtcattcagctatcttctaataattacctcggattcacttcacatcctagactcatcaacgccgcacaggaggccgttcagcagtatggagccggcaccggatcagtgagaacgattgcgggtacatttacaatgcatcaagagcttgagaaaaagctggcagcctttaaaaaaacggaggcggcacttgtattccaatcaggcttcacaacaaaccaaggcgtactttcaagtattctatcaaaagaggacattgtcatctcagatgaattgaaccatgcctctattattgacggaattcgactgacaaaggcggataaaaaggtgtatcagcacgtcaatatgagtgatttagagcgggtgctgagaaagtcaatgaattatcggatgcgtctgattgtgacagacggcgtattttccatggatggcaacatagctcctctgcctgatattgtagagctcgctgagaaatatgacgcatttgtgatggtggatgacgcccatgcatccggagtacttggcgaaaacggcaggggaacggtgaatcacttcggtcttgacggcagagtgcatattcaggtcggaacattaagcaaggcaatcggagtgctcggcggctacgctgcaggttcaaaggtgctgatcgattatttgcgccataaaggccgtccatttttattcagcacatctcatccgccggcagtcactgcagcttgtatggaagcgattgatgtcttgcttgaagagccggagcatatggagcgcttgtgggagaatactgcctattttaaagcaatgcttgtgaaaatgggtctgactctcacgaagagtgaaacgccgattcttcctattttaataggtgatgaaggtgtggcaaagcaattttcagatcagctcctttctcgcggtgtttttgcccaaagtatcgttttcccgactgtagcaaagggaaaagccagaattcgcacgattataacagcagagcacaccaaagatgaactggatcaggcgcttgatgtcatcgaaaagacggcaaaggagctccagctattgtaa

SEQ ID NO: 46823 - DNA, 2577 bp, Bacillus subtilis
atggccggttatacgcctatgatacagcaatatttaaaaataaaggcagagcaccaggatgcctttttattttttcgcctgggtgatttttatgaaatgttttttgaggacgccaaaaaagcgtcacaagagctggaaattacgttaacgagcagagacggcggtgcggctgaaaaaataccgatgtgcggtgtgccgtatcattctgcttccgcgtatatcgaacagcttattaaaaaaggatacaaagtggcgatctgtgaacagacggaagatccgaaagccgcaaagggcgttgtgaaaagagaagtagttcagctgattacgcccggaactgtaatggacggcaaaggcatccatgagtcggaaaataattttatcgcatctgtttcagcctgctcgaacggatacggacttgctctgtctgatttaacaacgggagaaaatttggctgttttgattgaacggcttgaagacgtcatatcagaaatttattcagtcggcgcacgggaaatcgtggtttcaggaagcttggatgccgatacagtggcacagctgagagagcggtgcggtgcaacgatttcaattgaagacggagaaacagacgaacacgtaacgatcattgagcacttaaataatgaagatataacaaaaacatttctgcgcttatatacgtatttgaaaagaacccaaaagcgcagccttgatcatcttcagcccgtgcaggtgtatgagcttgaggaagcgatgaaaattgacttgtactcaaagcgtaatctggagctgaccgaaacgattcgttcgaaaaataaaaaaggctcccttttgtggctgctggatgaaacaaaaacggcaatgggaggccggctacttaaacagtggattgaccggccgcttatcagagtcaatcaaatcgaagagcgccaagaaatggtggaaacattaatgtcccatttctttgaacgggaagatctgcgtgaacgtttaaaagaagtatatgacttagaacgccttgccggccgcgttgcattcggaaatgtcaatgcccgggatttgattcagctgaaggaatcgttaaagcaagtgcctggcatcaaacagctggttgcttcactggctcatgacaaggccaaggaacgtgcaaagcgcattgacccttgcggggatgtacttgaactgctggaagaagcgctgtacgaaaaccctcctttatcggtaaaagaagggaacctgattaaagatggttataatcaaaagcttgatgaatatcgtgatgcaagcagaaacggaaaagactggattgcccgcctggaacagcaggagcgggaatacacaggcattcgctctttaaaggtcggctttaataaagttttcggttattacattgaagtgacaaaagcaaacttgcatttgcttgaggaagggcgttatgagcggaacgagacgttaaccaatgcagagcgctacattacacctgaattaaaagaaaaagaagcgctcattttagaggcggaaaataacatctgtgagctggagtacgagctgtttaccgagctgcgcgagaaagtgaagcagtatattccgcggctgcagcagcttgcaaaacagatgagcgagctggacgcactgcaatgctttgcgacaatcagtgaaaatcgccactacacgaaaccagagttctctaaagatgaagtcgaagtgattgaaggcagacacccggttgttgaaaaagtcatggacagccaggaatatgtcccgaacaactgtatgatgggcgataacagacaaatgcttctcattacaggtccaaacatgtcagggaaaagcacgtatatgagacaaatcgcgctcatttccattatggcgcaaatcggctgctttgtacccgcgaaaaaagcggtgctcccgattttcgatcaaatttttacgcgaatcggcgctgcagatgatttgatttccggacaaagtacatttatggtagaaatgcttgaagcgaaaaatgcgattgtcaatgcgacgaaaaacagcctcattctgtttgatgaaatcgggcggggaacgtccacttatgacggcatggcgctggcacaggcgattattgaatatgttcacgatcatatcggcgccaagacgctgttcagcacacactatcacgagctgaccgttcttgaggacaagctgccccagctgaaaaacgttcatgttcgcgctgaagaatataacggaacggttgtctttcttcatcaaattaaagaaggtgcggctgataaaagctatggtatccatgtagctcagcttgccgaactgccgggagatctgattgcgcgcgctcaagatattttaaaagagcttgagcattcaggaaacaaaccggaagtgccggtgcagaaacctcaggtgaaagaagagccggcacagctgtccttttttgacgaagcggaaaagccggctgaaacaccaaagctttcaaaaaaagaaaagcaagtgatcgatgctttcaaatcacttaatatactggatatgacaccgcttgaagcgatgaatgaaatgtacaagctgcaaaagaaattacattaa

SEQ ID NO: 46824 - DNA, 1884 bp, Bacillus subtilis
gtggcaaaagtcatccaactgtcagatgagctttcaaataaaatagcggcgggcgaggttgtggaacggcccgcctcagtcgtcaaagaattggtggaaaatgcgatcgacgctgacagcacagtcattgaaatcgatattgaggaagcaggccttgcatccattcgggtcttggataacggcgaaggaatggagaatgaagattgcaagcgagctttccggcgccacgcaacgagtaaaataaaagatgaaaatgatttattcagggtgagaacgctcggtttcaggggagaagccctgccgagtatcgcgtcagtctctcatctggagattacaacaagcactggtgaaggagctgggacgaagctcgtcctccaaggaggaaacatcatttccgaatcgcgttcctcaagcaggaagggaactgaaattgtcgtttccaacctgttttttaacacaccggcccgtttgaaatatatgaaaaccgttcatacagagcttggaaacattacagatgtggttaaccgtattgctctggcgcatccagaggtatcgatccgcctgcgccatcatgggaaaaacctgcttcaaacgaacggaaacggagatgtgcgccatgtactggcagcgatttacggcacggctgtcgccaaaaaaatgcttccgctgcatgtgagctccttggattttgaagtaaagggatatatcgccctcccagagattacacgggcgtcgagaaactatatgtcgtctgtggtcaatggccgttacattaaaaatttcccgctcgtcaaagcggttcatgaaggctatcatacgcttctgccgatcggacgccatccgattacttttatagaaattacgatggacccgattttagtcgatgtcaacgtgcatccatcgaagcttgaggtccggctcagcaaggaaacagagcttcatgacttaatacgtgacggaattaaagatgtgtttaaacagcagcagctgattcctagtgcccaggtcccgaaaaaatcagcacctgccatcaaaaatgagcagcagtttataacctttgatgaaaagcctccggaaaaaaaagttccggaaaaatcgactgcgccatcttattcaccgatgaagctcagctcagtcgtaaaagagccggttgatgcggaggaaaaattgccccctctccaatttgatgctcctcctatcgttgatcaggaacaaacccttgaggtgtccgatgtttcagcagaacagcctgaaacatttgagcaggaatgccatgaggaacagccgcagccagcgtctgatcgggttccaattatgtacccgattggccagatgcacgggacttatatattggcacaaaacgaaaacggcctatatattatcgaccagcacgccgcccaagaacgtattaaatatgagtacttccgtgaaaaggtgggggaggttgagcctgaggtgcaggagatgattgtaccgctgacgttccactactccacaaatgaggctttgattattgaacagcacaaacaagagctcgaaagcgtcggtgtctttttagagtcattcggctctaacagttacatcgtccgctgccacccagcctggtttccaaagggagaagaagcagagcttatagaagaaatcattcagcaggtgctcgactccaaaaatatagatattaaaaaacttcgcgaggaagcggcgattatgatgagctgcaaaggctccatcaaagcaaatcgccacctcagaaacgacgaaatcaaagcgcttctggacgacctccgaagcacatcagacccatttacatgcccgcacggccgcccgatcatcattcaccactcgacatatgagatggaaaagatgttcaaacgcgtgatgtag

SEQ ID NO: 46825 - DNA, 678 bp, Bacillus subtilis
atgaatcttacttacaaggtgcatccaattaaaacaaggtatcagggctggacgaattattgctatatcattgaagatattgtaagcagatctgcaattgttgttgatccctcatgggaattgagtaagataaccactacactttccgaactcgaagcggaattaaaggcagtcgcattgacacactctcattatgatcatgtaaatctggtagacccgctgacgaagatgtttaacgctcaagtttatatgtcgaaaaaagaaattgattattatcaattccgatgcagaaatttaattagcctagatgatcatcagacgatcagcataggaaacacaagagcacagtgccttctcacaccggggcatacagccggcggaatgtgttatttgttttctgagagtatttttaccggagatacggtgtttacagaagggtgcggcatatgtgaggatgatggcagctctgcggaagagatgtttgatagcattcaaagaataaagtcggaggtttcaccccatgtacgggtgtatcctggtcactcatttggcaaatcgcccggccattcgataaaggatctttatcagcataatatttactttcaaattgataagaaagaatattttgtgaaatttcgcactcgtaaaaaccaaaaaggtatttttgattttaaataa

SEQ ID NO: 46826 - DNA, 867 bp, Bacillus subtilis
atgatcacatatgtttttccaggtcagggttcacaaaaacagggaatgggcagcggcctattcgatgaatttaaagaactgacggatcaggcagatgagatcttaggatattctatcaaacgtctttgcctggaaaatccttattccaatttaaacaaaacgcaatttactcagccggcattatatgtggtaaacgcactaagctatctgaaaaaaatcagggatgaagaagttaaacctgactttgtcgccgggcacagcttgggtgaatacaatgcgttatttgcagctgaagcctttgattttgagacaggtttacagcttgtcagaaaaagaggcgagctgatgagtctgataagcaacggcggtatggcagctgttatgggactaaatgaagagcaggttgcaaaggctctgaaagaatatcatttacatgatgttgatatcgctaatgtgaatgccccatatcaaattgtaatttcaggaaaaaaagatgagattgaaaaagccgcatctctttttgaaacgatgactgaagttacaatggtactccccttaaacgtaagcggcgcgtttcattccagatacatgaataaagcaaaagaagaattcgaggagttccttcatgccttttatttttcgcctccgtctatcccggttatttctaatgtgtatgccaaaccgtatacatacgaattcatgaaacagacgctggctgatcaaattaatcattcagtgaaatggactgacagcataagctacttaatgaaaaaaggccatatggagtttgaggaggtagggcctggaaatgttttaactgggttaattcatcgcataaagaaagatgcggaagcaatgccccgctaa

SEQ ID NO: 46827 - DNA, 1251 bp, Bacillus subtilis
atgacaaagtgcaatctgcctgaggtggtggtgaccggtgtaggcgttacggcctctatcggtcaagggaaagaggactttgcttcctcgctgctgtccggcagacatgcctttgatgtcatgaagcgttcaggcagacaaaaagacagccggtttatcggagccgaaattgcgtcattgtcttatcctgaccgactctctaaaaaaatgttgcgaaaagcatcattctccagccgcgctgcattggtaactctcacagaggcttgggaggaggctgaattggacgatgcagattcctcacgtatcggactggttgttggcggatcaaattttcaacagagagaaaactttgaagtttatgaaaggtatcaagaccgctccggttttatttctccggcgtatggtctgtctttcatggacagcgatctttgcgggatatgtacagatcagtttggcatcacgggattagcatatacggtgggaggagcttcggccagcggccagcagttagcagtcattcatgcgattcagcaagtcctgtcaggcgaagttgatacttgcatagcacttggtgctttaatggatctttcttatatggaatgcgaggcgctaagggctttaggcgctatggggacggacaaatatgctgatgaacctgaaaatgcgtgccgtcccttcgatcaaaacagagacgggtttatctatggagaatcgtgcggtgcattggtaatagaacgaaaggagacggctttacgaagaggtctaaaaccttatgcagcattgtctggctggtcaatcaaactggacggaaaccggaatcctgatccttcattagaaggagagattcatgtcatccagaaggcactggagcgtgccaggcttttaccagaagatattgattatattaatcctcatggaacaggctcttttattggagatgaaatagaattaaaggcgctccgtgcatgccggctttcccatgcttatatcaatgcaacaaaatcgataaccggacacgggcttagtgcggcgggcatcgtagagattatttctgttttgctgcaaatgaaaaaatctgccctgcatccgagcaggaatttggatcatccaatcgatgattcctttcattgggtaaatgagaaatcgatttcataccgcatcaaaaatgcgctgagcttaagcatggggtttggcggaatgaacaccgcggtttgtatacaaaacattgagaaatgtggaggcgaatcataa

SEQ ID NO: 46828 - DNA, 1038 bp, Bacillus subtilis
ttgctgatcacttgctctgaatccgggatcgactttgggaaatcgttaagtacatatatccatgaatatttaggtctcaaccgcaactgccgtttgtttgaggttaaacaggcgtgttattcagggacagcgggatttcagatggcggtgaattttatattatcccagacttctccgggtgccaaagcactggttatcgccagtgatatttcacgttttttaatcgctgagggcggagacgctttaagcgaagattggtcttatgcggaaccgagcgccggagcgggagcggtggccgttttagttggcgaaaatcccgaggtgtttcaaatagatcccggagcaaatggttattacggctatgaagtgatggacacgtgccgccccattcccgacagtgaagcgggagattctgatctgtctttaatgtcatatttggattgctgcgaacagacttttctggaatatcaaaagcgtgtaccgggtgccaattatcaggacacgtttcaatatcttgcttaccatacgccctttggcgggatggtgaaaggtgcgcaccggacaatgatgcgtaaggtagcgaaggtgaaaacatccgggattgagacggattttttaactcgggtaaaaccaggtttaaactactgtcaacgggttggaaatattatgggggcagccttgtttctggcattggccagcacgatagaccaagggagatttgatacgcctaaacgaattggctgtttttcctacggatccggctgctgttctgaattttacagcggaattacaactccgcaaggccaggagcgtcagcgaacatttggtattgagaagcatttggatcgccggtatcagctctccatggaagagtatgagctattgtttaaggggagcgggatggtgcggtttgggacgcgcaatgtaaagctggactttgagatgataccgggcatcatgcagtccactcaagagaagccgcgcttgtttttagaagaaatttctgagtttcatcggaagtacaggtggatctcgtga

SEQ ID NO: 46829 - DNA, 1674 bp, Bacillus subtilis
atgagaaataatgataatatccgcatattaactaatccttctgtcagtcatggggagcctttacatatatctgaaaagcagccggcaacaatacctgaagttttatacagaacggcgacggagcttggggatacaaagggaatcatttatttgcagccggatggaactgaagtttaccaatcatacagacgattatgggatgatggattgcgcattgcgaaggggcttcgccaatcaggcctgaaagcaaaacaaagctggattttgcagcttggtgacaattcacagcttctccctgcgttctgggggtgtgtgttaacaggggttgttccggctccattagccgttccgccaacgtatgctgaatcgagcagcggcactcaaaagctgaaagacgcatggacgcttcttgataagccagcggtgattacggaccgggggatgcatcaggaaatgctcgattgggcaaaagaacaagggcttgaagggttcagggcaattattgtagaggatctgctcagcgctgaagcggacacagattggcatcaatccagtcctgaagacttagcgcttttattgctgacttcaggcagtacgggaacgcccaaagcagttatgcttaatcatcgtaacattatgagcatggtgaaagggattattcaaatgcaaggcttcaccagagaggatattacgtttaactggatgccgtttgaccatgtcggagggatcggaatgctgcatttgcgggatgtttatcttggctgtcaggaaattaacgtctcaagcgaaacgatcttaatggagccgttgaaatggctggattggattgatcattaccgagcttctgttacgtgggcgccgaattttgcgtttggtctggttactgattttgcagaagaaataaaagataagaaatgggatctgtcttcaatgcgatacatgctcaatggcggtgaagcaatggtagccaaggtagggcgtagaatacttgagcttttagaaccacatggactgcctgctgacgccatccgacctgcctggggaatgtccgaaacttcatcgggcgttattttttctcatgaatttacccgggctggaacaagtgatgatgatcattttgttgaaataggctctccaatccccggcttctctatgagaattgtgaatgaccataatgaattggttgaagagggtgagatcggccgttttcaagtctcgggtctttctgttactagcggttattaccagcggcctgatttgaatgagagtgtgtttacagaagacggctggtttgaaaccggagatcttggctttttgcgaaacgggcgcttaaccataacaggccgtacgaaagatgcaattatcattaacggcattaattattacagtcatgcaattgagtctgcagttgaagaattacctgaaattgaaacttcttatactgctgcttgcgctgtccgtctgggccagaattcaacagatcagctggctatcttctttgttacttccgcaaaattaaatgatgagcagatgtctcagcttcttagaaacatacaatcccatgtctcacaggtgatcggagtcaccccggaatatttgctgcctgtacaaaaagaagagattccaaaaacggctatcggaaagatccagcgcacccagctcccaatcggatga

SEQ ID NO: 46830 - DNA, 13344 bp, Bacillus subtilis
ttgctcacctgtttgactgaggagctgcacgtttcccacgattgggtggagccaaatgcaaatgcaaatatccaaagtcttggtgtgaattctatcaagatgatgaagctcattcgatcgatcgagaaaaactatcatatcaaactaacagctagagagatacatcaatatcctacaattgaacgcttagccagctatctatcagaacatgaagacctcagcagcttgtctgctgacaaaaagggcacggacacatataaaaccgaaccggaaaggagtcaggcaacttttcagcctctctctgaggttcaaaaaggattatggacattgcaaaaaatgtcacccgaaaaaagtgcatatcacgtacctctctgttttaaattttcgtcagggcttcaccatgaaacattccagcaggctttcggccttgtattgaatcagcacccaatcttaaagcacgtcatccaagagaaagacggagtgccatttcttaaaaatgagccagcactttcaattgaaatcaagacagaaaatatctcaagtttgaaagagtctgatattcctgcttttcttagaaagaaagtaaaggaaccgtatgtaaaggaaaacagcccgttagtgcgtgtcatgagcttttccagatctgaacaagagcattttttattagttgtcattcaccatttgatttttgacggagtttcgtctgtcacatttatacgcagtctgtttgatacctatcagcttcttttaaaaggacagcagccggaaaaagctgtttctcctgccatttatcatgattttgcggcatgggagaaaaacatgcttgccggcaaagacggtgtgaagcaccgtacatattggcagaaacagctatcgggaactttgccgaatcttcagctgcctaatgtcagcgcaagttcagtcgattctcagtttagagaggatacatacaccaggcggttgtccagcggcttcatgaatcaggtcagaacgtttgcgaaagagcattctgtaaatgtcacgacggtattcttaagctgctatatgatgctgcttggccgttacacaggccaaaaagaacagatcgtcggcatgccggccatggtgaggccggaagaaagatttgatgatgccattggacattttctcaatatgctcccgattcggagtgagctgaacccggcagacactttttctagctttatatcaaaattgcaattaacgatattggatgggcttgatcatgcagcatatccttttccaaaaatggtgagggatctgaatattcctcgcagtcaagcaggttcaccggtatttcaaaccgcttttttctatcagaattttcttcaatccggaagctatcaaagcttgctgagccgctatgctgacttcttttctgtcgatttcgttgagtatattcaccaagagggcgaatacgaattagtatttgaactgtgggaaacagaagaaaaaatggagctgaacatcaagtacaatactgggctgtttgatgcggcttctatatccgccatgttcgaccattttgtttatgtaacagagcaggcgatgttgaatccttctcagcctttaaaagagtattctttattacctgaggcagagaagcagatgattctcaaaacatggaacgccacaggaaaaacgtatccatatataacttttcatgagttgtttgagcagcaggcgaaaaagacgcctgatagagcggctgtcagctatgaaggtcaaacattgacgtatcgggagcttgatgagaaaagcacacagctggccatttatttgcaggcgcatggagtgggtcctgaccgtctggcggggatctatgtggatcgatcgctggacatgctagtgggtttattagcgatcctcaaggctgggggagcgtatgtgccgctagacccgtcctatccggctgaacgattagaatacatgcttgaggacagtgaagttttcattacactgacgacatcggaattagtaaatacgttgagttggaacggtgtcacaacagcccttttagatcaagattgggatgaaattgctcaaacagcctctgatcgaaaagtgcttacacgcactgtcacgccagagaacttggcatatgtcatttatacatccggcagcacaggaaagccaaaaggtgtcatgataccacataaagctttgacaaactttctcgtttcgatgggggaaacaccaggtcttacggcagaggataaaatgcttgctgtcacaacctactgttttgatattgcagctctggaattatttttgcctttaataaagggcgcacactgctatatttgtcaaacggagcatacaaaagacgttgaaaaactgaaacgggacatccgcgcgatcaaaccgacagtgatgcaggcaacccccgctacgtggaagatgctcttttattcaggctgggaaaatgaagagagcgtgaaaattttatgcggtggcgaagcattgcctgagacattaaaacgatatttcttagatacgggcagcgaagcctggaatatgttcgggccaaccgaaacaactatctggtcagcggttcagcgcattaacgttgaatgctctcatgccacgataggaaggccaatcgccaatacacaaatctatattacggattctcagctcgcgccagtgccggcaggtgttccgggtgagctgtgcattgcaggagacggtgtggcgaagggctactacaaaaaggaagaattaacggattcgagattcattgacaacccttttgagcctgggtctaagctttatagaacgggagacatggcccgttggcttacgggagggcgaattgaatatataggccgcatcgataatcaagtaaaaatccgcggattccgtattgaacttggtgatattgaaagcaggcttagtgagcatcccggcattctggaatgcgttgtggtcgcagatatggataacctagctgcctattatacagctaaacatgcaaatgcttctctcacagcgagagagctgcgtcattttgtgaaaaacgctttgcctgcctatatggtgccttcttattttattcagcttgatcatatgccgttaactccgaacggaaagatagatagaaacagccttaagaatatcgatttatcaggggagcagctaaagcaaaggcagacctctcctaagaacattcaggatactgtttttaccatttggcaggaagtgctgaaaacgagtgacattgaatgggatgacggatttttcgatgtgggcggggattcgcttctcgcggtcactgtggctgatcgtatcaaacatgaactatcctgtgagttttctgtcacagacctgtttgagtattcaacgattaaaaatatcagccagtacatcactgaacagcgaatgggcgatgcaagtgaccatataccgacagacccggcagctcatatagaagatcagtctaccgagatgagtgatctcccggactattatgacgatagtgtggcgattattggcatatcgtgtgaatttccaggggcaaaaaatcatgatgaattttgggagaacctcagagacggcaaggaaagcattgcgtttttcaataaagaagagcttcagcgctttggcatttcaaaggagatagcggagaatgccgactatgtccctgctaaagcttcaattgatgggaaagacagatttgatccaagcttctttcaaatctctcctaaagacgctgaatttatggaccctcagcttcggatgctgctgactcattcatggaaagcaatagaagatgccggttatgctgcgaggcagattccgcaaaccagtgtttttatgtcggcaagcaataattcttatcgcgcgctgctgccgtcagatacaacagagagcctggagacgccggacggctatgtttcgtgggtgcttgcacagagcgggacgattccgacaatgatttctcataagctcgggctgagagggccaagctattttgtccatgccaactgctcatcctctctgattggattgcattctgcctataagagcctcctgtcgggtgaatctgattatgctttagttggcggtgcaacgctgcataccgagtcaaatatcggatatgtgcatcagcctgggctgaacttttcgagtgatggacatattaaagcttttgacgcttcagctgacggaatgataggcggtgagggcgttgctgttgtattgctgaaaaaagcagctgatgcagtaaaggacggggatcatatctatgccttgctgagaggcattggtgtaaataacgacggcgctgacaaagtcggcttttatgctccaagcgttaaaggccaggctgacgtggtccaacaggtcatgaatcaaacgaaggtacagcctgaatccatctgctatgtagaagcacacgggaccggaacgaagctgggggacccgatcgagctggcggctttaacaaacgtttacaggcaatatacaaataaaacgcaattttgcggcattgggtcggtgaaaaccaatatcggacatttagatacagccgccggtcttgcgggctgcattaaggttgtgatgagtctttatcatcaagagcttgcaccgagtgtcaattataaggagccgaatccaaatacagacttagccagctctcctttttacgtcgtcgatcaaaagaaaacgttaagccgtgagatcaaaacgcacagggctgcacttagctcgttcgggcttggcgggacaaatacccatgccatttttgaacaattcaaaagggattcagataagggaaagatagacggaacctgcatcgtcccgatctcggcgaaaaataaagagaggctgcaagagtatgcagaagacattctggcctatttagaaagaagagggtttgagaacagccagctgcctgattttgcgtatacccttcaggtggggcgcgaagcgatggagcatcgcgttgtctttattgccgatcatgtaaatgagttaaaacagaggctcacagattttatcaatggaaatacagcgattgaaggctgttttcaaggaagtaagcacaatgccagagaggtttcatggctgacggaggatgaggacagcgctgaactcatacgtaagtggatggccaaaggaaaagtaaacaagcttgcagaaatgtggagcaagggagcgcatatagattggatgcagctttacaagggagagcgcccaaacagaatgagtctgccgacttatccatttgcaaaggaacgatactggccgtcgcaggatgaccgcaaaccggtggcgcagatatccggaaatcagacagggatcggctctattcatccattgcttcatcagaatacatctgatttttctgaacagaaattcagttcggttttcactggtgacgaatttttcctgagagaccatgtggtaagaggaaagcctgtgcttcctggtgttgcgtaccttgaaatggcgtacgcggctataaaccaggcggcaggaagtgaaattggccaagatgtcagaatcagattgaatcatacagtctgggttcagcctgttgtggttgacagacattcagctcaagtggatatcagtctctttcctgaagaagatggaaaaatcacctttgacatttacagtacacaggaagacggggacgaccctgttattcatagtcaaggcagtgcggagctggcatctgccgccgaaacgccagtcgcagatctcactgaaatgtcacgccgttgcggcaaaggaaagatgtcgcctgatcaattttacgaagaaggcagaagcagaggaatgttccatggtccggcctttcaaggaattaagaatgtgaatataggaaacagagaggttttggcgcagctgcagcttccagaaatcgtttctggaacgaatgaacagtttgtgctgcacccaagtatcatggattccgccttgcagacagcaacaatatgcatcatgcaggaattgacggatcaaaagctgattttgccatttgcgcttgaggagcttgaagtgatcaaagggtgttcttcttctatgtgggcttatgcccgcttaagtgacagcgatcactccggaggggttgttcagaaagcggatatcgatgtcattgacgagagtggaaccgtatgtgtcaggatcaaaggattttcaacgagagtattagaaggggaggttcatacttcaaagccttcaacacggcacgaacgcttaatgcttgaaccggtgtgggaaaaacagaatgaagaacgagaggacgaagatctttcgtacacggagcatatcattgttctcttcgaaactgaacgaagtgtcacagacagcattgcctcccacatgaaagatgcccgtgtgattactctaaacgaagctgtaggacatattgctgaacgttatcaatgttacatgcagaacatttttgaactcctgcaaagcaaggtccgtaagctttctgcaggccgtatcatcattcaagcgattgttccgctggaaaaagagaagcaattgtttgccggcgtttccggtctgtttaaaacagcagaaatagagttcagcaaactgactgctcaggtcatcgaaattgagaaacctgaagagatgatagaccttcacctcaagctgaaagacgacagccggagaccatttgacaaacagattcgatatgaggctggataccgttttgtgaaaggctggagggaaatggtgcttccttcagctgatacgcttcacatgccgtggagagacgagggtgtttatctaatcacaggcggagcaggaagcttaggccttctgtttgcaaaggaaattgccaatcgaactggccggtctactattgtgctgacgggacgatctgttttaagtgaggataaggaaaacgagctggaggctcttcgaagcatcggagcggaggttgtctatcgagaggctgatgtaagtgatcagcatgcggttcgtcatcttttggaggaaatcaaagaaagatatggcactctcaatggaattattcacggtgcaggcagcagtaaagatcgcttcatcattcataaaacgaatgaagagtttcaagaagtgttgcagccaaaagtgagcgggttgttacatgtagacgaatgcagcaaggatttcccattggactttttcattttcttctcttctgtttcgggatgtttaggaaacgctggacaagccgattatgcggcagccaattcgtttatggatgcatttgctgaataccgccgttctcttgcggcatcaaaaaagagattcggctccaccatttccttcaattggccgttatgggaagaaggcggtatgcaagtcggcgctgaagatgaaaagagaatgctgaaaacgacgggaatggtcccgatgccgacagatagtggcttgaaagcattttatcaagggatagtatctgataagccgcaagtttttgtgatggaaggacagcttcagaaaatgaagcaaaaactgctttccgcaggatcgaaagccaagcggaacgatcagagaaaggcggatcaggatcaaggacaaactagaaaattggaagcagccttaatccaaatggttggcgcaattttgaaagtaaacactgacgatatcgatgtcaacacagagctgagtgagtacggattcgactcagttacattcactgtctttacaaacaagatcaacgaaaaatttcaattggagctaacaccgaccatattctttgaatatggcagcgtccaaagcctggctgaatatgtagttgctgcgtatcagggcgaatggaatcaagatgctactgctaaaggcaaagatgaaagaacaaacttagtgcacagtttaagcagcctggaggcatcattaagcaacatggtcagtgcaattttaaaagtaaatagtgaagatattgatgtcaatacagagctgagtgaatacggatttgattcagttacatttacggtctttacaaacaagatcaacgaagaatttcagttggagctaacgccgaccattttctttgaatatggaagcctccacagcctggctgagtatttgaccgttgaacatggtgacaccctggttcaggagcgagaaaaaccagaggggcaggaagagttacagacaaaatcttctgaagcgccgaaaatcacatcacgtagaaagcgccgctttacacagcctattattgcaaaagcagaaagaaacaaaaagcaggctgccgattttgagccggttgcaattgtcggcatcagcggccggttccctggcgctatggatatagacgaattttggaaaaacctagaagaaggaaaagacagcatcacagaagttccaaaagatcgatgggattggcgggagcattatggaaacccagacactgacgtcaataaaaccgacatcaaatggggtgggtttattgatggtgtcgcagagtttgatccgttgttttttggtatttcgccgcgagaagctgattatgtagaccctcagcagcgcttgttaatgacatacgtgtggaaggcattggaagatgcgggttgctcgccgcaaagcctttcgggtacagggaccggtatctttatcggtacgggaaacaccggttataaagatctattccatagagcgaatcttccaattgaaggccatgctgctacaggtcatatgattccttcggtaggcccgaatagaatgagttattttttaaatattcatggtccgagcgagccagtagagacggcttgttccagttctcttgtagccattcaccgtgctgtgactgcgatgcaaaacggtgattgtgagatggcgatcgctggaggcgtgaatacgatcttaaccgaggaggcgcatattagctacagcaaggcggggatgctcagcacagacggcaggtgtaaaaccttctccgccgatgcgaatggctatgtcagaggcgaaggggtcggaatggtcatgttgaaaaagctggaagatgccgagcgcgacggaaatcatatttacggcgttattcggggcacggcggaaaatcacggcggaagagccaataccctgacatcgcctaatccgaaagcacaagctgatttgttggtgcgtgcatatcgccaagcagacatagatccaagcactgtcacatatatcgaagcacatggaacagggacggaattgggcgatccgattgaaataaatgggctgaaagccgcgtttaaggaactatccaatatgagaggcgagagccagccggatgttccggatcaccgttgcggcatcggctcagttaaaagcaatatcggtcatttagagctagcagccggtatttccggtttgatcaaggtgcttttgcaaatgaagcataaaacgttagtgaaaagcctgcattgcgagacgcttaatccttatcttcagctgactgacagtccgttttacatcgttcaggaaaaacaggaatggaagtctgtcacagatcgtgacggaaacgagcttccgcgccgtgccggaatcagttcgtttgggattggcggagtaaacgcgcatattgtgattgaagaatatatgccaaaagccaattcagaacacacggctacagaacagccaaacgtaattgtgctgtcggctaaaaataaaagcaggctgatagatcgtgcttcgcaattgcttgaggtgattcgcaataaaaaatatactgatcaggatttgcaccgcatcgcttacaccctgcaggtcgggcgcgaagaaatggatgagcgtctggcgtgtgttgcggggacaatgcaggagcttgaagagaaactgcaggcgtttgttgacggtaaggaagaaacagacgaatttttccggggacagtctcatcgaaataaagagacccagactatttttacagcagatgaagatatggcgttggcacttgatgcttggatcagaaaaagaaaatacgccaaacttgctgatttatgggtcaaaggggtctcaatccagtggaacacattatacggagagaccaaaccgcgcctgatcagcctcccttcatatccgtttgcgaaggatcactattgggtgccggcaaaggaacattcagaaagagacaaaaaagaactggttaatgcgattgaagatcgcgccgcatgctttttgacgaaacaatggagtttgagtccaattggatcagcagtgccggggacaagaactgttgccatcctgtgctgtcaagagacagcagatttagcagcagaagtgtcttcgtattttccgaatcatctcttaatagatgtgagccggatagaaaatgatcagtcagacattgattggaaagagtttgacggcctagtggatgtcatcggatgcggttgggatgatgagggccggctggattggattgaatgggtgcaaagactggttgaattcgggcataaagaggggctcaggctgctttgtgtgacgaaggggctcgaatcgtttcaaaacacatctgtccggatggctggcgcctcacgggctgggttgtatcgaatgctccaatgcgagtacagccatcttatatcaaggcatatggatgctgaggaggttactgatcatcgccgtctcgcgaagttgatcgctgatgagttttattccgattcttatgatgcggaggtttgctacagggatggtttacggtatcaagcttttctaaaagctcatccggaaacaggtaaggccacggaacagagcgcggtcttcccgaaagatcatgtacttctcattacaggcggcacacgaggcatcggactattatgcgcccgtcattttgcagagtgctatggagtgaaaaaactggtgctgaccggacgagaacagcttcctccgcgagaggagtgggctcgttttaagacatcaaacacatcattggcagagaaaatccaggcagtgcgggagctggaagcgaagggtgtacaggtggagatgctgtcgctgacgttatctgatgatgctcaggttgagcaaacgctgcaacatatcaagcgaacattaggaccgattggcggtgtcattcattgtgcaggtctgacggatatggatacgctggcatttatccgaaaaacttcggatgatatccagcgggtgctggaacctaaggtgtcaggtcttacaacgttatatcgccatgtgtgtaacgagcctttacagttttttgtcttattttcttctgtttcagccattattccggagctttcggcgggacaagctgactatgcgatggccaatagctatatggattattttgcagaagcacatcagaaacatgcgccgatcatcagtgttcagtggccgaactggaaagaaaccggtatgggtgaagtgacaaatcaagcgtatcgggacagcggcttgttgagcattacgaattcagaaggcttacgttttctagatcaaattgtatcgaaaaagttcggaccggttgttctccctgcaatggcgaatcaaacaaactgggagccggaactgctgatgaagaggaggaaaccgcatgagggcggtttgcaggaagctgctttacagagcccgccagccagagacattgaagaggccgatgaagtttccaaatgtgatggattattatctgaaacacagtcctggcttattgatctgtttaccgaagagctgagaatagatcgtgaagacttcgagattgacgggttgtttcaggattatggcgtggattcgatcattttggcacaggtgctccagcgtataaaccgcaaattagaggcagcgctcgatccatcgattctatatgaatacccgacaattcaaaggttcgcagattggctgatcggttcttattccgaaaggctgtccgctttattcggaggcaggatatcggatgcatcagcacctttggagaacaaaatagaggcggaggcatctgttcctgggaaggatcgagctcttacacctcagattcaggcgccagcgattttgtcaccggactctcatgcagaaggtattgccgttgtcggactctcttgccgattccctggggcagagacattggagtcatattggtcgttactatccgaggggcgttcgtcaatcggcccgattccggcagagcgttggggctgtaagacgccatattatgccggcgtgattgatggcgtcagctattttgatcctgatttctttttgcttcacgaagaagacgtaagggcgatggatccgcaagcactgctcgtgttggaagagtgtctgaagctcttgtatcacgccggttatacacctgaggaaataaagggcaagcccgtcggtgtttatatcggaggcagaagccagcacaaacctgatgaagacagccttgatcatgccaagaatccgatcgtgacagtcggccaaaattatttagccgctaatctttcacaattttttgatgtccgcggtccaagtgttgtagttgacactgcatgctcgtcagctttggtcggcatgaatatggccattcaggcgctgcgtggcggagatattcaatccgccatagtcggcggtgtcagcttgctgagctcagatgcgtctcacaggctgtttgaccggcgcggcattttaagcaagcattcatccttccatgtgtttgatgagcgtgctgacggagttgtgttaggtgaaggcgtcggaatggtcatgctaaaaaccgtaaaacaggcactggaagacggagatatcatatatgctgtcgtcaaagcggcctcggtcaataacgacggaagaacggcgggacctgcaacacctaatcttgaggcacaaaaggaagtcatgaaagatgcgcttttcaaaagcggaaaaaaaccagaggacatcagctaccttgaggcaaacgggtcaggttcaatcgtaaccgatctccttgagctaaaagcgatccaatcagtgtaccgttctgggcactcatcgcctctttctcttggctcaatcaagccgaacatcgggcatccgctatgtgctgaagggatcgccagcttcattaaggttgtgctgatgctgaaagagcgccgctttgtcccatttttatcaggtgaaaaagagatggcgcatttcgatcaacagaaagcgaacatcacgttcagccgagccctggaaaaatggacagattcgcagcctactgcggctattaactgctttgccggtggggggacgaatgcccatgtcatcgtagaggcgtgggaaaaagatgaaaaacacgccatcaagcgcagtccaatatcgcctcctcaattaaagaaacgaatgctttcgccaggcgagccaaagctggaagcggagacttcaaaaatgactgcggcaaacatatgggatacttatgaggtggaggtctaa

SEQ ID NO: 46831 - DNA, 12822 bp, Bacillus subtilis
atgataactgaacaactgcacatttcattaaataatccaatcatgtccaaccacaaggtatatggacaagcgttattacccggccttgcttatatagatttaatctaccaagtattccaggaacatggttatgcataccaagagcttgaattaaaaaacctaaccattttttaccctttgatcgcagatgagtcatatgacattgccctgaccattcacgtgtctgagagagaggaagggacatggtccatcatcatcgacggacaaaaacagcatggagaatcactatctgacaagagacaatatgagactgctgacatgcatcgtaaagagcaaaccgcttttgccgaatcaatagaccttaatcagtggaaaagtacagctgacaggattctgaatttagatgaaatctatgaacaatgccgatctcaagagttagtgcataccggcatgatgaaggcggaaggacagatttatgaagccaaagagggggctgtaattgatttagcagtcggacaggaagcattgcgtcattctgatgcttttctgtttcatccgacgcttattgacggcagcggcataggttcaagctgcctgatctcagatcaaacgatgtacctgccattgtattatgaatcgttttctgcttcagaacgattgcaaaaaggatgtacagcacggatcctctcctcatctgtgcgccaaaagaaagaactcacttatatgacgattgaatattttaattcagcaggacaaaaagtggccgagctgaaacaatttgcaggcaagtctgtacggaatatgtcagcctttcattctgcaaaacaaattcaagaagaaagagctgctgtctctcagaacatcactcgggactatcccgcatttgaaatgtatttgcgtcagctgcttgctaagcagcttgaaaggccggcagaacaaatggatatccacgctgggtactatgagcttggtctggattcttcgtcattgcttaccgtggttcaggaaattggagataaggttggggcggatcttgctccgacactgctgtttgaatttacaacaattgcagaactagctgctcatcttgctgatcactattcaattggagaggcggacgatgctgtccgccaatctccttcaccaattgatggtgttacctcttcaccagagatcggggaggacatagccattatcggaatggcgggacgctatcctaaggcgaaaaatatacaggaattttgggaacagcttaaagcgggtaccgactgcatcacagagattccaaactcacgctgggaatggaaagaaagcgatggactggattcacctgcaggcaagccgctctcgaaatggggcggctttatcgaggaggctgattgctttgatcctcaatttttcagaatctctccgcgtgaagcggaaatgatggaccctcaggaacgcttatttttagagacgtgctgggaagctattgaagatgcgggttatacaccagagacaattgcttcaccgcagggagaaaataaaagacagcatgtcggtgtgtttgccggcgttatgcataaggactattctcttataggagctgaagctctatcagaacacaatccatttcctttatcgctgaattatgcgcaaatcgccaacagggtctcttactattgtaatttccacggcccaagcatggcggtggacacggtctgctcttcctcattaactgcggttcatctggcaatagagagcatccggaatggagaatgcgaggccgcgcttgccggaggcgtcaatttgtcactgcatccggctaaatatatcagctatggcagtgtagggatgcactcaagtgacggctattgccatactttcggcaaaggcggggatggctacgtatctggagaaggtgtcggcacagtattgctaaaaccgctgcgaaaagctgaacaggacggtgaccgaatctatgctgtcatcaaaggcagtgcgataaatcatgtaggaaaagtaagcggaattacagtaccgagcccggtagctcaagctgatgtaatcgaagcatgtctagaaaaaacaggaattgatccgcgcaccatcagctatgttgaacccatggcactggcacctcattgggagatccgattgaaggtacaggggttagtaaaagctttcagccgcaatacgcaggacaagcaattctgttcaatcggttctgtgaaatcaaatattggccatgctgaagctgcagccggcattagcggcttaacgaagactgtcctgcagctgcatcataaaaccttggtgccgtcattacattcagaagagctgaatccttatttgaagcttgatcaaaccccattttttgtccagcatgaaacaaaggaatgggagcagccatcttttacagaaaacggggtggacgtcacatatccccgccgtgccggtttaagttcgtttggcgcttcaggatcaaatgcgcatcttattttggaagaatatattccggcagagagccattcagagacgattttaacgaaaaatgaagaaatagtgatacctttgtctgcgagaaacaaagatcgtctgcaggcttacgctcttaaacttcttgattttcttagcgaggacgtcaatcttttagcgttagcttataccatgcaggcaggacgggttgaaatggaggagcgtgcggccttcattgtaaaagacataaaagatttaacggctaaacttcgggcgtttgccaatggcgaagaagagatcgagggctgctggaccggacgagccaaggagaatcaggaggcggctgggctagcatcggtaaatgcgctgaataacaatttgataagagacagtgaaatgatggaaatggcgaaagcatgggttcaaggaaagcgggtcacctgggacgacctatacggcgatcgcaagccgcttaagatcagtgttccgacctatccgtttgcaagggagcgctactggatctcggttcctgaaatgaaaaccagcactgtgaatcatatcttacatccgctggtgcaccgcaatacatcagactttactgagcagcgctttagctctgtatttacaggcacggaatttttcctgtcagatcatgttgtacagggacagaaaattttgccgggcgttgcctatttagaaatggcaagggaagcagcggaaaaagctgcaggcgatctggacggcgaacaaagagtggtgtcgcttaaagacattgtgtgggtgcgtcctatcacgatagaaagtgaaccaaaagaaatacatattggcctttttcctgaggataacggggacatttcctttgatatttatagcagctctgaacataaagaagaagccctgacgatacactgccaaggtcgcgctgtcatttcagatgaagcggagacttccattttaaacctttcatcaatacagacagaatgcagcctggacacagtgacgtcagaacaatgctatgcagcgtttcgaaagattgggcttgactatggcgagggctatcaagggattgaaaaagtctatgtcggcaaagatcaattgcttgcaaaaatctcgttacccgcttttctaaaaaacgacaagcagcattttgcgctccacccgagtttgatggattccgcgttccatgccacagtcggttttatcgttagctcagtcaatgccgctggacaagctcagacgctgtctcttccatttgcgttacaggaggttgatattttcagcccatgtccagagaagatatggtcttatattcgatacagttcagacagtaaagcggagaacaaagtcagaaagtatgacattgatttatgtgatgagaacggacgtgtttgtgtgcgaatgaagggtgcctcgatgcgggcacttgatggagagcagcattcaaagccgcaactattaactgattctcagctgaccgggcatacggtgatgatccccgtctgggaaccagtctctctagaagcggaggataatgcttcgtttgctggtaaaagagctgttttatgcggagctgctgaagctgatcggactttcataaagcatcattatccgcaaatttcctttgtcgatatccgccctgcagatgacattgaggcaatagcggacaaactgcaagcgtacggaagcattgaccatgtattgtggattgccccgtcacaccggggaagtataggtagtgatggacaagaagaagctgttcttcacttatttaagcttgtgaaagcatgcctgcaattaggctatggcgagaaacaacttgaatggtctcttgtgaccgtccaagcgcagccggttacgcaacatgaggcagtacaacccgctcatgcaagcattcatgggcttgccggcacaatggcaaaggaatatccacactggaaaatccgtcttctcgatcttgaaaaaggctgcacatggccggtaaatcacatgtttgcgctcccagctgaccgccttggccatgcttgggcctatcgtaatcagcaatggcatcagcagcaattgatcccatatcggtcctcactgtcaggcgacacgctatatcggaaaggcggagtctatgtggtcatcggaggagccgggtatatcggagaggcgtggagtgagtacatgatccgccgctaccaggcgcaaatcgtttggattgggcgaagtcaacttaatgctgccatccagtcaaaaatagaccgactttcggcgcttggccctgagcctttctacattgcagccgatgcagccgataagcattcactgcagcaggcttatgaacaagtgaaaaaacgtcatcctcatattcacgggattgttcactctgcgatggttttatttgagcaaagcctggaaaaaatgaagccggaagaattcaccgctggactggcggcgaagatcgatgtcagtattcggatggcccaagtgttccgccaggagaatgtagattttgttttattcttctcttcgcttgtagcccatatcaaaaatgtgaagcaaagccattatgcctctggctgtacatttgcagatgcttttgctcaccagctttctcagagctgggcatgccctgtaaaagtcatgaactggggatattgggggaatagtgaagcggctgaggatgaacattatgtacagctcatgaatcaaatcggcttaggtttaattgagcccgcggaggctatgaaggcgctggaagcactgctttctgggccagtcagccaaacagctttcattcatacgacaaagcctgtagcagtcgaaggcgtgaatcagaatgaattcatcactctttatccagagcaaccttcagcagatgcagagagcctgatggagcgtctgccgactacgggacgatttcaaagagtgacacatgaagagcttgatgatcttctttacaggctgttgttaggacagctgcaaacagccgagctgtttgatggttatacattatcggttgaacgtcttcaacaatataagactcgtgaattttatggaaaatggattcggcaaacgagcgaatttctcttgcagcatggctatcttaagaaagttggagattcattggtgaggaaggaccaagcagaggatatcgagctgctttggctagaatggaacgcgaaaaaagaaaagtggcttaaagacagcgagacaaaggcgatggttgtattagcagaggccatgctgcaagcattaccggatattttgacagggaaagtccctgcaacagatatcatgttcccgcattcctcgatggaactggtggaaggcatttataagcataaccaagtggcagactattttaataaagtgcttgccgatacattattagcttatctggatgaacgtctgaagcacgaccctgaggcatcgattcgcattatggaaataggcgcaggcacaggcggcacgagtgccggaatctttgaaaaactgaaaccatatcaaaagcacatcaatgaatattgctatacagatctgtctaaagcatttttgctgcatgcagaaaaggaatatggggcggaaaatccgtacctgacatatcagctttttgatgtggaaaaaccgattgatcagcaggaatttgaagcgggaggctatgatgtcgtcattgccgctaatgtccttcacgcaacaaaaaatatccgtcaaacactgcggcatacaaaagcggtaatgaaaaacaacggaatgctgctgctgaatgaaatggcgggaaacagcctgttccctcacatcacctttggtcttttggaaggctggtggctgtatgaagatcctgcagtgcggattcccggctgtccaggcttacatcctgacagctggaaagcggcacttgaaagcgaaggctttgaatctgtctttttcccggccgaggcggcacatgatctgagtcaccaaatcgtcgcagcctcaagcaacgggctggttcgacgtatgatgaaaaatgtgatcttgccggagaaggttgtttcacaagcgtctaatcaggagccagcctacattcataccatagattcagaggaagctggacaatcgaaacatgctctcctaagagaaaaaagcacagaatatatgaaaaaactaatcggggaaacgttgaaaattcctgcaggaaagattgagtcatctgaacctcttgaaaagtacggtattgattctatcgttgttgtccagctgacgaatacattgcgtaaagaatttgaccatgtaagcagcactttatttttcgagtaccagaccattgacgcattagtggagcatttcatcaaaacaaaaacagaagctctgatgaaattaacaggtcttgaccgtcaagttcaacaacatacaccggccgaaagcagaacccaatcttcacagaaacctgatcaggccgctaaaagaacacggcgctttcgcaagcttggcttcagcggggagaaagaaacaccgacaaacactcttgcaagccgtgacgttgccgttatcggcatttctggacgctatcctcaggcggaaacagcagaagacttttggaacaacctaaaagaaggaagaaattgtattgaggaaattccgaaagatcgctgggattggaaagcttattacgataaagaaaaaggaaaagaaggatcaatttatacgaaatggggcggatttatcaaggatatggacaagtttgacccattattctttcagatttctccgcttgaggcagaaagaatggaccctcaggagcgattatttctgcaaaccgcttatgcaagtattgaagacgcgggatacacgcctgactcgctctgttcaagcagaaaaatcggcgtctttgccggagtcatgaacaaaaattatccgactggctacggctattggtctatcgccaacagaatatcctatttactgaatttccaaggcccgagtcttgcagtcgatacagcctgctcatcctccctgacagcgattcatttagcgctggaaagcatctatagcggatcgagtgattgtgccattgccggcggtgtcaatttagttgtcgacccggttcactatcagaatttatctgtcatgaatatgctctctgctagtgatacatgtaaatcattcggcgatgatgcagatggatttgtcgacggtgaaggcgtaggcgccattgtgttaaagccgctgcagcaagcaatagcggacggtgaccatatttacggtgtgataaaggcaagtgccattaatagcggaggaaaaacaaatggatacacggttccaaatcctcatgcacaggcacaggtgattaaagaagcaattgagcgcgccgacattcctgcccgaaccatcagttatttagaggcgcatggaacaggcactgcattaggagatccgattgagatagcggggttaacaaaagcattcgagaaagatacgcaggagaaacagttttgtgcgatcggctccagcaaatcaaatatcggccattgtgaaagtgcagccggaattgcagggctgacaaaaatactttttcagtttaaatatggccaaattgcgccatcattgcatgctcagcggttgaatccgaacatcgagttcagccatacgccatttgtcgttcagcagcaacttggtgaatggaaacgcccggtgattggcgggcaagaggtgcctaggcgcgctggcttgagcagttttggcgccggagggtccaatgcccatatcatcctggaagaatatattccaagaacgggggcgcaaacgccgaaagaccatcctccagcgctgattgtgctgtcggccaaaaacatggaacgtttgcaagaaaaagcggaacagctgcttacagccatcaaacaaaaaaggtactgcgaaacagacctgatcaggatcgcctataccttgcaaacaggccgtgaagcaatggaggaacggctggcctttatagcggaatcactagaggatcttgagagaaagctgaacgattttatcgaaaacaaagcagacagcctgtatctggatcgcatcgatgataacaaaaaagcgttagcagtcttatcagcggatgaggatacggaaaaaatcatagaagcatggatgagcaaagggaaatacacgaaactgctggatctttgggtgaaaggcttgtctttcgactggggcatgctgtacggcacccaaacgcctgtccggatcagtcttccggcatatccatttgcaaaagaacgttactgggcaccaggcgcggcaaaggccccggtgtctatagaacaggatcatgatcagcaaacagaagaacctttcaaggttatgacgtttcaagaagtgtggaaagaagagccggcgactctcacatcgaaacgtatcaaaacgctcatctgttttctgactgaaagagaaaagcaaaacgcatttgcttcagccctgaaaaacgttgatcaagacaccaaggtcatttttatatcacagggcgaagtgtacagcaaacagtctgaatatagctaccagattgtgcggcaagaacccgttacttttgaaaaggccttccagagcattaaagaagaacttggagagccagatgcaatcctctatatgtggcctatggaagacaagcgctgtataaaggaccattcctgtattgtttacctattacaaggtatgtccgcagcaaagcttcatccttcacggctgctgctggcaggatgttttgaagatagtcttgaccgaagttatctggaatcatggattggcttcgaacgttcactcgggcttgtccttccgcacacaaaagtgactggaatctttcagcccgcggaacaaggatcgatggatgattggacacgtaaagtctgggcagaattacaggcttcaactgaacaaacggttttgtatcagaatctgaaacgatatgtaaatcacattgaacagacaacgatacaaccggacaacagcaaattgaagtctggcggtacttacctgattacaggcggtgtaggagggcttggttatttatttgccaagcatttggccaaaaactatgccgcaaacctgattttgacagggaggtcgccttttaatgatgagaagcaaaagcaaataaaagaattaaaggatctaggcggcgaacggatgtatgcagaagcagatgtgtctgatcctatcgcaatgggagactgcgtaaaaagagggaaagaccgattcggtgccatcaacggtgttattcatgcagccggaatcgagagcgactctgctatttttgacaaaaagatcgaaagcttccagcgcatcattgaaccgaaaatcaacggcacgatagcgcttgatgaatggcttaaaaatgaagaccttgattttatgtgttatttttcttcttcttctgcggttttaggggattttggatgttgtgattatgcgattggcaataggtttcagatggcttacgcacaatacagaaatgagctgcataacggtaaaacgtttgtcatcaactggcctgtgtggaaggatggcggaatgaagatcggtgatgaggaaacaacggatatgtacctgaaatcaagcggccaacgcttcctagaagccgaggaaggtatccgtatgtttgagcacatcctagctcagcaggatgctcagcatctcgtgatagccggtcagcccagccgtgtcagcagatttttaggaatgactgaaccagctattccagaaccggccactcaagcccctctagcacaagaaaacaaggatgaggtaaaaacactaagcattgaaaagcgtttagaacacgacttgaaagagcatattcacacattgcttaagatttcaaaggacaggctgaatttgaacaaaaattgggccgacttcggatttgattcgatctatttggctaaattctcgaacgtgttatcaaagcatttcaacatcgaagtgacaccggctttatttttcggctattcaactttacaagaattgatcagctttttcttaaccgatcataaagagctgattgaagcattttaccgggatgatgcatcagaggcgcaaaagccccctgaagcttatgcagtaattcctgtagctttagaaccagaagccagtaaaaaaagcattcggcaggttcacgatgagcctattgccattatcggcatgagcggcaggttccctcaagctgattcggtccatgagctgtgggataatctgaaaaacggtaaatcgtgtatctctgacattccgggcgaacgccgggactgggggagagctaacagagatccagaaaaagcagtgccaaggtggggtgcatttttgaaggacatagaccggtttgatccgctgttttttcaaatatcgcctaaagaagccgaaagcatggacccgcgtcagcccatttttctagaggaagcatggcacacgtttgaagacgccggctatatgggagatcggataaaaggaaaatcctgcggtgtttatgtaggtgtggaagaaggggaatatgcgcatctaaccggagatacggattacattaacggaacacaaaacgccacattgtctgcgagaatcgcatacgcattggatttaaaagggcctaatatggctttgacagcagcatgttcatctggactggtggcgattcaccaggcatgttcagctctgcgtcagggggattgtgaaatggctttagcggcgggcgtcacgttgaatatttctcacatgtcttttgaggcgctgacaagggccgaaatgctgtctccgaacggacaatgcaaagtgtttgaccaggatgccaatggtcttgtgccaggtgaagcggtggctgctgttctcttgaaaccattatcaaaggcaattgaagataaagatcatatttatggctgcatcaaggccagcggcgtgaattacgatggcaaaaccaacggcattactgcgccaaatccttttagccaggcagaattgatcgaaaacatttatgaaaaaaatgaaatcaatccgctcgatattcaatatgtgatggcgcacagtaccggctcgaatcttggtgatccgcttgaggtccaagcgttaacgagcgtgttcagcaaatatacgaagcagaagcaattctgtatgatcagctcaattaaacctttaatcggacatacatttgcagcgtcaggaacggttgctttaatcagtatgctgatggctatgaaaaaccagatcattccggccactcatcactgtgaatcggaaaacccgtatattccgtttaaagaaagcccatttgtgctttgcaaagaaaaccgttcgtggatcaagaaaaatcagaagccgaggatgggaacgatcagcacgactggaatcagcggcaccaatgcacatgcagtcattgaagaatacattccggatgatcagccgtccacacagcggcatcaagggtcaccgcagatctttgtgatttcagcccaaaatgacgatcggcttcaggatgctgcctgccgcatgattgcgtatctggagcagaatcataacctttctttacctgatgtggcatatacgcttcaggttgggagaaaagccatggaagcaaggctcgcgatcgttgcaaacaatcaggagcaattggtgcgaaaattgaaggaatatgtggaagcaatgaagaatggtggggtatcaggccaacagagatccctttatacaggatatacagaagggattttagaagaacaagatgaagcagttctgcaagctctcgcaaaagaaagaaatttggaaaacatcgcggaatgctgggtgaaaggatatcagattccttgggaactccttcatgatggcgatgacgttcggatggtttctttacctggttatccatttgcaagggaacggtattggatttcgtcaggcactcagcaatcagaggccgttaaacagcattcacaagatatgaaaacagagattgacgagccgaatggcaaaacccatattcaaaagatcattgttcaatttttagcacgagaattgggcatatctgaggatcgaatcaatttcaaaagaaacttcctggattatgggatggattcaattcttggccgaaaattgatgcggcatatcgaaaaaaccacgcagctgaagatggccggccgggaaatccttgaatgtcagacagtccaagctctatctgaccatttggccttaaaagcggaaaaacaaaatcatagcgcagcagcacatcacataaagggcacgtatacagacgagcaaatcattggattgatgcaagaggtggcgctagggaaattggattttaagagtgtgcaaaacatcatagaagggagaaatcgtatgatcataaagaaattctcgatgccttcagatcaggagaattaa

SEQ ID NO: 46832 - DNA, 2103 bp, Bacillus subtilis
ttgtcacaaaatcaagtgccaaaatggatccagttaaataacgaaatcatgatccaaaaagatgggaaattccagtttgataaggataaagaagctgtacatagctattttgtagattatatcaatcaaaacacagtcttctttcacaatttaaaagagaagctggattatttggttgaaaaccaatactacgaagaggaattcttaagcctttattcttttgaagacattaaagaagtgtttaagacagcttacgctaagaagtttcgttttccttccttcatgagtgcgtttaaattctataatgactatgctttgaaaacgaatgacaagaaaaaaatcctcgagcgttatgaggaccggatctcaattgttgcgctgttcttcgctaacggcgacactgagaaagcaaaagaatatgtaaacctgatgatcaatcaagaatatcagccgagcacaccgacatttttgaatgccggcagaaaacgccgcggtgaacttgtgagctgcttcttgctcgaagttaatgattctttaaatgacatttcaagagcaatcgatatctccatgcagctttctaagcttggtggcggggtttctcttaacctgtccaagcttcgcgcgaaaggtgaagccattaaagatgttgagaatgcgacaaaaggcgttgtaggcgtcatgaagcttcttgataacgcgttccgttacgctgaccaaatgggacaaagacaaggctccggcgcggcgtatttaaacattttccaccgcgatatcaatgattttcttgatacgaaaaagatttctgcggatgaagatgtgcgtgtcaaaacgctttcgatcggtgttgtcattccggataagttcgttgagcttgcacgcgaggacaaagcggcttatgtattctacccgcacacgatttataaagagtacggccagcacatggatgagatggacatgaacgaaatgtacgacaagtttgtcgacaaccctcgggtgaaaaaggaaaaaatcaacccgcggaaactgcttgaaaaattggcgatgcttcgttctgaatcaggctatccatacatcatgttccaagataacgtcaataaagtgcatgcgaataaccatatttccaaggtcaaattttctaacctttgctctgaagtgctgcaggcatctcaagtttcttcatacacagactatgatgaagaagatgaaatcggtctggatatttcctgcaacctgggttcgcttaacattctcaatgtcatggagcataaatcaatcgaaaagacagtcaagcttgcgacagactctttaacacacgtgtctgaaacaacagacatccgtaatgcgcctgctgtaagacgggcaaacaaagcgatgaaatcaatcggcctcggtgctatgaaccttcacggctaccttgcgcaaaacggcattgcgtatgaaagtccggaagcgcgtgactttgcaaacacgttctttatgatggtgaatttctactccatccagcgttctgcggaaatcgcaaaagagaagggcgaaacgtttgatcaatatgaaggatcaacctatgcgacaggtgaatacttcgacaaatacgtttcaactgatttctcaccgaaatacgaaaaaatcgctaatctgtttgaaggtatgcatatcccgacgacagaggactggaaaaagctaaaagcatttgtcgctgaacacggtatgtatcacagctacagattatgcattgcgccgacaggctctatctcatacgttcaatcaagcacggcgtctgttatgccgattatggaacggattgaagaacgaacatacggcaactcaaaaacgtactacccaatgcctgggcttgcatctaataactggttcttctataaagaagcctacgatatggacatgttcaaggttgtggatatgatcgccactatccagcagcacattgatcagggaatcagctttacattgttcttaaaagacacaatgacgacccgagatttaaaccgaatcgatctgtatgcacatcatagaggaattaaaaccatttactatgcaagaacgaaagatactgggcaagacagctgcctttcttgtgttgtttga

SEQ ID NO: 46833 - DNA, 990 bp, Bacillus subtilis
gtgacaaaaatttatgacgcagcaaactggtcaaagcatgaagacgattttacccaaatgttctataaccaaaacgtgaaacagttctggcttccggaagagattgctttaaacggcgatctcctcacatggaagtacctcggaaaaaatgagcaggacacttatatgaaggtactggccggacttacgcttcttgacacagagcaggggaatacggggatgccgatcgtggctgaacacgtagatggccaccagcggaaagcggtgctgaactttatggcgatgatggagaacgctgtccatgcgaagtcgtactctaatattttcatgacccttgcaccgactgaaacgatcaatgaagtatttgaatgggttaaacaaaataaatatttgcagaaaaaagcgcaaatgattgtcgggctttacaaagccattcaaaaagatgatgaaatttcactgttcaaagccatggttgcttccgtctatctggaaagcttccttttctacagcggtttctattatccgttatatttctacggacaaggaaaactgatgcaaagcggtgagatcattaacctgatccttcgtgacgaagcgattcacggcgtgtatgtcggtctccttgctcaggaaatttataataaacagacagaagagaaaaaagcagagcttcgtgaatttgcgatcgacctcctgaatcagttatatgaaaatgagcttgagtatacagaggacttgtacgatcaagtcgggctctcacatgatgtaaagaaattcatccgctataatgcgaataaagcgctgatgaaccttggatttgatccatacttcgaagaggaagacattaatccgatcgttttaaacggattaaacacaaaaacaaaatcgcatgacttcttctctatgaaggggaatggctataaaaaagcgacagttgagccgctcaaagatgatgacttttattttgaagatgaaaaagagcagatataa

SEQ ID NO: 46834 - DNA, 1500 bp, Bacillus subtilis
atgaagtatgtcattggaatagatcttggaacgagtgctgttaaaaccattttagttaaccaaaacggcaaggtttgtgcagaaacgtccaaaaggtatccgctcatccaagagaaggcgggatatagtgagcaaaatcctgaagactgggttcagcaaacaattgaagcattggctgaattggtttctatatccaatgttcaagccaaggatattgacgggataagctattcgggacaaatgcatggattagtactgcttgaccaagatcgtcaggtgttacgtaatgcaattctttggaatgataccagaacaacgcctcaatgtataaggatgaccgagaaatttggcgatcatcttcttgacatcacaaaaaaccgtgttttagaagggtttacattacctaaaatgttatgggtaaaggaacatgaacctgaactttttaaaaaaactgctgtgtttttgcttccgaaagactacgtgcgattccgtatgaccggtgtcattcacaccgaatactccgatgcagcaggaactttacttttacatattactcgcaaggagtggagcaatgatatttgcaatcaaattggtatttctgcagatatttgtcctccgcttgttgaatctcatgattgtgtaggatcgctgcttccgcacgttgccgcgaagaccgggctattagaaaaaacaaaagtgtacgctgggggagcagataatgcttgcggcgctattggagcaggtatcctttcttccggaaaaacattatgcagtattgggacgtcaggggtcatactttcctacgaagaagaaaaagaaagagactttaaagggaaagtccacttttttaatcatggaaaaaaggattctttttatacgatgggcgtcacgctcgctgcaggatacagcttggactggtttaaaagaacgtttgcaccaaacgaatcgtttgagcaattattgcagggggtggaagctattccgataggagccaatggactgctatacactccttatttggttggtgaaagaacgccgcatgctgattcttctattcggggaagcttgatcggaatggatggagcccataatagaaagcattttttgagggcaataatggaaggtatcacattctctttacatgaatcaattgagctattccgcgaagcgggaaaatcagttcatactgttgtttctattggtgggggagctaaaaatgatacgtggctgcaaatgcaagctgatattttcaatacgagggtaattaagttagaaaatgaacaagggccagctatgggggctgcaatgctggctgcctttggaagcggttggtttgaatcacttgaagaatgtgcagagcagttcattcgtgaggctgctgcattttatccaaaggcgcaaaatgttcaaaaatataaaacactatttgatttgtataagaacatttacactcacacaaaggatctcaatacagctttgaagagctttcgaaaaaactaa

SEQ ID NO: 46835 - DNA, 1260 bp, Bacillus subtilis
atggatatgaatgaacatcgaaatcgaaggttgaaattaataatgatttcagcaacttttggagggcttctctttggatatgacaccggagttataaatggagctttaccttttatggcaaggccagatcagcttgatttaacacctgttacagaagggcttgttacgagtattcttttattaggtgccgcgtttggagcgttgttatgcggaagattggctgatcgagatcgccgccgtaaaatgatccttaatctttcctttttatttttcctggcatcactgggaacagcgttagcacctaatgttttcatcatggcggtctttcgttttttactggggctggctgttggaggagcctcggcgatggtgccggcctttttagcagaaatggcaccgcatgaaaagagagggcgtatggtaacccaaaatgaactaatgattgttggcgggcaatttttagcatatgtttttaatgcgatcctcggtgtaacaatggcaaatacgggacatgtttggagatacatgctagtcatttgtgctgtaccggctatcatgttatttgccagtatgcttaaggtaccagaaagcccccgatggctaatctccaaaggcaaaaacagtgaggcgctgcgagttcttaaacaaattcgagaagataaacgtgcagaagctgaatgtagagaaattcaagaagcggtagaaaaagatacagcactagaaaaggcatcactcaaggacttttctacaccatggctgcgccgtcttttatggattggaatcggtgttgccatcgtgaatcaaattacaggtgtgaactcgattatgtattatggcacacaaatccttaaagaatctggttttggtacaaaagcggctttaatcgctaatattggaaatgggctgatatcagttattgcagttatatttgggatttggctggtcggaaaagtgagacggcgtccaatattattgattggtttggcagggacgactacagcgctcctattgattgcgattttctcaattgtgcttgatggatctatggcacttccttatgtagtgctttctttgaccgttttatttcttgcctttatgcaagggtgtgtaggacctgtgacttggcttgtcatagcggaaatattccctcaaaggttaagaggacttggttctgggataagtgtttttttcctttggatattaaactttgtgatcggttttgctttcccgatcttgcttagctctgtaggtttgtcttaa

SEQ ID NO: 46836 - DNA, 2004 bp, Bacillus subtilis
atggatacaattgaaaagaaatcagttgctaccattcgcacactgtcaatagacgctattgaaaaagcaaattctggtcacccagggatgccgatgggagccgctccaatggcatacacgctgtggacaaaatttatgaacgtaagtccggcaaaccctggctggtttaaccgtgaccgttttgttttatctgctggacacgggtcagcactattatacagcatgcttcatttaagcgggtttgatcttagtattgaagatcttaagggattccgccagtggggcagcaaaacaccaggacatccggaattcggacatactgccggtgttgatgctacaacaggtccgcttggccaaggaattgccatggcagtcggtatggcaattgctgaacgccatttagcggaaacatacaaccgcgattcatttaacgtagtcgatcattatacatacagtatttgcggtgatggtgatttaatggaaggtatttcttctgaagccgcttcactcgcaggccatcttcagcttggccgtctgatcgtactatacgattctaatgacatctctcttgatggagacctcgaccgttcattctctgaaaacgtgaaacagcgttttgaagcaatgaattgggaagttctttatgttgaggatggaaacaatattgaagaattaacagcggctatcgaaaaagcacgccaaaatgaaaagaaacctacattaattgaagtgaaaacgacaatcggattcggttcacctaaccgtgccggtacatccggtgttcacggtgcgccgcttggtaaagaagaaagcaaattaacaaaagaagcttacgcgtggacatatgaagaagacttctacgttccgtcagaagtttatgagcatttcgctgtagctgttaaagaatcaggtgagaaaaaagaacaagaatggaatgctcaattcgctaaatataaagaagtttatcctgaacttgctgaacagcttgaactggcaatcaaaggagagcttccgaaggactgggatcaagaggttcctgtgtatgaaaaaggaagcagtttggcatcccgtgcatcttccggtgaagttctcaacggacttgcgaaaaaaattcctttctttgtcggaggttctgctgacctagcgggatcgaacaaaacgactattaaaaatgccggtgattttacagcggttgattactcaggcaaaaacttctggtttggtgtacgtgaatttgcgatgggtgcggccttaaacggtatggcgcttcatggcggtcttcgtgtattcggcggaactttctttgtcttctctgattacctgcgtcctgcgattcgccttgcagcgttaatgggccttcctgtgacatatgtcttcacacatgacagtattgcggttggtgaagacggtccgacgcacgagcctgttgaacagcttgcttcactccgtgcgatgcctaacctttctttgatccgtccagcagacggcaatgagacagcagcagcatggaagcttgcagtgcaaagcactgaccacccaacagcgctagtgcttacacgtcaaaaccttcctaccatcgatcaaacatctgaagaagcattggcaggagtagaaaaaggtgcatatgtcgtttctaaatctaaaaacgaaacacccgacgctcttctcatcgcttccggatcagaggtaggtcttgcaattgaagcgcaggctgaattggcaaaagaaaatatcgatgtttctgttgtcagcatgccttcaatggaccgttttgagaaacaatctgatgaatacaaaaacgaagtccttcctgcagatgtgaaaaaacgtcttgcaattgaaatgggctcatcatttggatggggcaaatacacggggcttgaaggtgacgttctcggcatagaccgattcggtgcatctgctcctggtgaaaccatcattaacgaatacggcttctcagttccgaacgtagtgaatcgagttaaggcattaatcaataagtaa

SEQ ID NO: 46837 - DNA, 2730 bp, Bacillus subtilis
atggcaaacgagcaaaaaactgcagcaaaagacgttttccaagcgagaaaaacgtttactacaaatgggaaaacatatcattactactctttaaaagcgttagaagattcaggtataggaaaggtttcgaagcttccttattccatcaaagttcttttagaatcagtattgcgtcaagttgacggcttcgttatcaaaaaagaacacgtggaaaatttggcaaaatggggaactgccgaattaaaggatatcgacgttccgttcaaaccgtctcgtgttattttacaagacttcacaggggttccggcagtagtagatctggcttcactgcgtaaagcaatggcagctgtcggcggagatcctgataaaatcaaccctgaaattcctgttgatctcgttatcgatcactctgtacaggtagataaagcgggtacagaagatgcattagcagtaaatatggacttggaattcgaaagaaatgcagagcgctacaaatttttaagctgggcaaagaaagcgtttaacaattatcaggcagtaccgcctgcaacaggtattgtgcaccaggtcaaccttgagttcttggcaagtgttgtccatgccattgaagaagacggcgagcttgtaacgtatcctgatacgcttgtcggaacagactcacacacaacaatgattaacggtatcggtgttctcggctggggtgtcggtggaattgaagctgaagcgggaatgcttggacagccttcttacttcccagttccagaggtaatcggcgcgaaacttgtcggcaagcttccaaacggaacaacagctactgacttggcgttaaaagtaacacaagtgctgcgtgaaaaaggcgttgtcggtaaatttgttgaattcttcggaccgggaattgctgaactgccgcttgcagatcgcgcaacaattgcgaatatggctccggaatacggtgctacatgcggattcttcccagtagatgaagaagcgcttaactacctgcgcctgactggccgtgatcctgaacatattgatgttgttgaagcatactgcagaagcaatggcttgttctacactccagatgcggaagaccctcaatttactgatgtggttgaaattgacctgtctcaaattgaagcaaacttatcgggtccaaagcgtcctcaggatttgatcccgctatctgctatgcaggaaacgtttaaaaagcaattagtcagccctgcaggtaaccaaggattcggtttaaatgctgaggaagaaaataaagaaattaagtttaaactccttaacggcgaagaaacagttatgaaaacgggtgcgatcgccattgctgcgattacaagctgtacaaatacatcaaacccatacgtgctgatcggcgccggactggtagcgaaaaaagcggttgagttagggcttaaggtgcctaattacgtgaaaacgtcacttgcaccgggttctaaagttgttacaggatatcttgtgaattcaggccttcttccatacatgaaagagcttggctttaacctcgttgggtacggctgtacaacatgtatcgggaactcaggtccgctttcaccggaaatcgaagaagcggttgcgaaaaatgatcttctgattacgtctgtcctttccggaaaccgtaactttgaaggacgtattcacccgcttgttaaaggcaactatcttgcttcaccgccgcttgttgtggcatatgcgctggctggaacggtaaacattaacttaaaaaccgatccaatcggtgtgggcaaggatggtcaaaacgtatactttaatgatatttggccgtcaatggacgaaatcaatgcacttgttaagcaaactgttacgccagagctattccgcaaagagtatgaaacagtatttgatgacaacaagcgctggaacgaaattgaaacaacagatgaagctttatataaatgggataacgattcaacttacatccaaaacccaccattctttgaagagatgtctgttgagccaggcaaggttgagccattaaaaggactgcgtgttgtcggtaaattcggcgattcagtcacaactgaccatatttctcctgcgggggcaatcggaaaagatacgcctgccggaaagtatttgcaagaaaaaggtgtttcacctcgtgactttaactcctacggctcccgccgtggaaaccatgaagtcatgatgagaggaacatttgccaacattcgcatcaaaaaccaaatcgcaccgggtacagaaggcggatttacgacgtactggccgactggtgaagtaacatccatctatgatgcatgcatgaaatacaaagaagataaaaccggtcttgtcgtattagcaggaaaagactatggtatgggatcttcacgtgactgggctgcaaaaggaacaaaccttctcggcatcagaacggtcattgcagagagcttcgaaagaattcacagaagcaatcttgtattcatgggtgtgctgccgcttcagtttaaacaaggtgaaaatgcggatacactcggcttaacgggtaaagaagtcatcgaggtagatgttgatgaaacagttcgtcctcgtgaccttgtgactgtaagagcaatcaatgaagacggcaatgtaacaacttttgaagcagtcgtccgctttgatagtgaagttgaaattgattactaccgccatggcggcatccttcaaatggtgcttcgtgaaaaaatgaagcagtcctga

SEQ ID NO: 46838 - DNA, 1527 bp, Bacillus subtilis
atgatgcgaaggaggaaaagatcagatatgaaacggtcaatctctatttttattacgtgtttattgattacgttattgacaatgggcggcatgatagcttcgccggcatcagcagcagggacaaaaacgccagtagccaagaatggccagcttagcataaaaggtacacagctcgttaaccgagacggtaaagcggtacagctgaaggggatcagttcacacggattgcaatggtatggagaatatgtcaataaagacagcttaaaatggctgagagatgattggggtatcaccgttttccgtgcagcgatgtatacggcagatggcggttatattgacaacccgtccgtgaaaaataaagtaaaagaagcggttgaagcggcaaaagagcttgggatatatgtcatcattgactggcatatcttaaatgacggtaatccaaaccaaaataaagagaaggcaaaagaattcttcaaggaaatgtcaagcctttacggaaacacgccaaacgtcatttatgaaattgcaaacgaaccaaacggtgatgtgaactggaagcgtgatattaaaccatatgcggaagaagtgatttcagttatccgcaaaaatgatccagacaacatcatcattgtcggaaccggtacatggagccaggatgtgaatgatgctgccgatgaccagctaaaagatgcaaacgttatgtacgcacttcatttttatgccggcacgcacggccaatttttacgggataaagcaaactatgcactcagcaaaggagcacctatttttgtgacagagtggggaacaagcgacgcgtctggcaatggcggtgtattccttgatcaatcgagggaatggctgaaatatctcgacagcaagaccattagctgggtgaactggaatctttctgataagcaggaatcatcctcagctttaaagccgggggcatctaaaacaggcggctggcggttgtcagatttatctgcttcaggaacattcgttagagaaaacattctcggcaccaaagattcgacgaaggacattcctgaaacgccatcaaaagataaacccacacaggaaaatggtatttctgtacagtacagagcaggggatgggagtatgaacagcaaccaaatccgtccgcagcttcaaataaaaaataacggcaataccacggttgatttaaaagatgtcactgcccgttactggtataaagcgaaaaacaaaggccaaaactttgactgtgactacgcgcagattggatgcggcaatgtgacacacaagtttgtgacgttgcataaaccaaagcaaggtgcagatacctatctggaacttggatttaaaaacggaacgttggcaccgggagcaagcacagggaatattcagctccgtcttcacaatgatgactggagcaattatgcacaaagcggcgattattcctttttcaaatcaaatacgtttaaaacaacgaaaaaaatcacattatatgatcaaggaaaactgatttggggaacagaaccaaattag

SEQ ID NO: 46839 - DNA, 894 bp, Bacillus subtilis
atgagaaaaaaagtgagaaaagcggttatacccgcagcgggtttaggaacgagatttctgccggcgacaaaggcgcagcctaaagaaatgcttccaatcgtcgacaaaccagcaatccaatatattgtagaagaggccgcagagtcaggaattgaagatatactgattattacagggagaaacaaacgctcgattgaagatcattttgatcggtcggcggaattggaattcaatctccgggaaaaaggcaagacggagacacttaaggaaatgcagcagattgccgatttggccaacattcattacatccgccagaaagaaccgctcggattaggccatgcggtgctgtgtgcggagcattttatcggagatgagccttttgctgttctcttaggtgatgatattatggtgtctgaaacaccggctcttcggcaattaatggatgtatatgacgtttatggcacagaggttgtcggtgtacagtcagttctccctgaggatgtcagcaaatatggtattataaatacatcagggtctcaagggcatgtatatgaagtgaacgatttagtggaaaagccttctcctgaagaagcaccttcggaaatcgcagtaatgggacgttatgtgctgaattcttcgatcttctccgttttgaagacaattggcagaggcgcgggcaacgaaattcagctgacagatgcgcttcgtgaggtttgccgtaaggagccgatccatgcccggctgctggaaggaaatcgatatgacattggcgataagctgggctgttttaaagcgagcaccgaaatcggcttaatgcgtcccgaaatgagatctcagcttttggcctatttagaagatgtgatcaaacgggaaacgaaagaaatgctgcggtaa

SEQ ID NO: 46840 - DNA, 900 bp, Bacillus subtilis
atgccatatcctaaaaaagtgacaatcaaagaagtcggcccgcgtgatggcttacaaaacgagcccgtttggatcgcaacagaggataaaataacctggatcaaccagctttcccggacagggctgtcgtatattgaaatcacatccttcgttcacccgaaatggattccggcgcttcgagatgctatcgatgtagcaaaaggcatcgaccgagaaaaaggggtaacgtacgcggcacttgtcccgaatcaaagaggactggagaatgcacttgaaggaggcattaacgaggcttgcgtttttatgtccgccagcgagacgcacaacagaaaaaacatcaataaatccacttctgaatccctccatatactcaaacaagtaaacaacgacgcacaaaaagcaaacctcacaacaagagcctacctctcgactgttttcggctgtccgtacgaaaaagatgtccccattgaacaagtcattcgcctttcagaagctctatttgaatttgggatttctgaactgtcgcttggagatacgattggagcagctaatcccgcccaagtggaaactgtacttgaagctcttttggcacgattcccggctaatcaaattgccctgcattttcatgatacgagaggaaccgctctggccaacatggtcacagcactccaaatgggcatcacggtgttcgacggctcggcaggcgggcttgggggatgcccatatgcgccaggttcatcaggaaacgccgcaactgaggatatcgtgtacatgcttgaacagatggatatcaaaacaaatgtaaagctagaaaaactgctatctgcggccaaatggattgaagaaaaaatgggcaaaccgctgccgagcagaaatttacaggtgtttaaatcatcttga

SEQ ID NO: 46841 - DNA, 1335 bp, Bacillus subtilis
atgtttacaaaagtactgatcgccaaccgcggtgaaattgcaatgagaattatccgaacatgcagccgtctcggcattaaaacggtcgctgtttattcagaagcagacaaggacgcgccccatacaaaagccgctacagaggcatatttgatcggggaatcgagagtcagtgaaagttatttaaatatagagagaatcataaagacggcgaaaaaagcaaaagccgacgcgatccacccgggatatggattgttatcagaaaacagccggttcgctgaacgctgcaagcaagaaaacatcgtgtttatcggaccttcccctgatatcatcgcaaagatgggcagcaaaattgaagcgcgaaaagcaatggaggctgcaggtgtccctgtggtgccgggcgtttctgaatccctcggagatatagaggcagcctgccgcaccgcaagtcaaatcggctatcctgtcatgctgaaagcttcagcgggcggaggcggcatcggaatgcagcgtgttgaaaatgaagaagcattaaaaaaagcgtacgagggaaacaaaaagcgcgcagcagattttttcggtgacgggtctatgtatatagaaaaagttattgaacatgcgcgccacatcgaggttcagcttttggccgatcaacacggccatacagtacatctgtttgaacgtgattgctctgttcagaggcgccaccaaaaagtcattgaagaagcaccgtctccatttgtagacgatgaactaagaatgaagatcggtcaaacagcggtaaaagcagcgaaggcaatcggctatacgaacgcaggcaccatcgaatttatagttgaccagaaacaaaatttttatttcctcgaaatgaatacgagactgcaagttgaacaccccgtgactgaagaaataacaggcctggacttagttgagcagcagctgcggattgctgcgggccatacactcacattctcccaaaaagacatccaacggaacgggcatgcgatagaggttcgaatatacgcggaagatcccaagaccttcttcccgtcaccaggtacgatcactgcgttttcacttcctgaccaaaaaggagtcagacacgaatgtgcggtagcaaaagacagcaccgttacccctttttatgacccgatgatcgctaagatgattgtcaaaggccaaaccagaacagaagcaattgaaaaactagagacagcgcttcgcgactatcgtgtagagggaatcaaaacaaaccttccgctcctcatacaggctgcggcaacaaaggcatttaaagaaggggatgtcacgactgactttttgaaacagcacctataa

SEQ ID NO: 46842 - DNA, 1650 bp, Bacillus subtilis
atggctgaactcatccattccacaatcggcaggctgctggaacaaacagctgatgcgtatcccgatcgagatgctgttgtgtatccagaccgaaatatccgctatacgtacgctcaatttgacagtctgtgccgtcaaaccgctaaaggtctcatgcggatggggattggaaaaggagaccacgtcgccatatgggcttctaatatctctgaatggcttgccgtccagttcgcaactgcgaagatcggagccgtgctcgtgaccgtcaataccaattatcaagcacatgagcttgattacttgttaaagcaatcggatgccgcggcgcttattatcatggattcatacaggggcacttcttatccagacatcgtgaacagtttaattccagaactgcaagaagcaaagcccggccaactgaaatctgaacgctatccctttttaaaaacgctgatctatattggcaataaacgattgtctggcatgtatcattgggacgatacagagatattggcgaaaacagtgacagatgctgagcttgaagagagaatgaacagcctggataaagacaatgtgattaatatgcaatacacatcaggaacgacagggtttccaaaaggcgtgatgctgacccatttcaatgtcatcaataacgctgctaatatcgctgaatgtatggctttaacctctcaagaccgcatgtgcatccctgttccgttttttcactgctttggatgcgtccttggggttttggcatgtgtatccgtcggggcagccatgatacccgtgcaagaatttgatcccgttaccgtccttaaaacggtagaaaaagagaaatgcacagtgctccatggtgtgcctaccatgtttatcgccgagctgcatcatccggattttgatgcatatgatctatcgacgctccgaacaggaatcatggccggctctccctgtccaagtgaagtgatgaaagctgtgattgaaaggatgggcatgaaagacattacgatcgcctatggacaaaccgaagcctcgccagtcattacacaaacgagagcaaatgattccttcataagaagagtcgaaacaaccggccgtgccctgccacatactgaggtgaaaattgtagaacccgggacatgtcaagaagttcaaagaggcatgcagggagaactgtgcacccgtggctatcacgtcatgaaaggctattataaagacaaagatgcgaccagaaaagcaatcaatcatgacggatggctgtttaccggagatcttgctgtcatggatgaagacgggtactgccgcatcaccggaagattaaaagatatgctcatcagaggcggcgagaacatttatccgcgggaaattgaagaatttttataccagcatcccgctgttttagatgtacaggtggttggtgtgcctgacgccaaattcggggaggaagctgcagcctggattaaactgaaagacggtaaaagcgtttcacctgatgagcttaaagcctattgcaaagggaaaatcgcccgccacaaaattccgcgttatgttatttttacggatgactatccgatgacggcctcaggcaaaattcaaaaatataaactgcgagaaaaaacgattgaaatgttcaacttatcatcaagtcaatga

SEQ ID NO: 46843 - DNA, 1143 bp, Bacillus subtilis
gtgaattttgagctgacaaaagaacaacaaatggtgcgtgaaatggtaaaagattttgcgaaaaaagaaattgctcctcacgctgaacatgtagatcaaacaggcgagttcccgatgcaaacatttaaaaaaatgggtgaactcggtctgatgggtattccatttccagaagaatacggcggatctggcggtgatacgatttcatatgccttagcggttgaagaagtcggcaaagcctgcggcagtactggattaagctatgctgcagcggtctcgctaggcgcaagccctctttactacttcggaacagaagagcaaaaacagacgcatttgacgccgctggcttcaggcacagcactcggatcattcggcctgacggagccaaatgccggctcagatgcaggaggcactcaaacaaaagcgatttcaaatggtgacgagtatgtaatcaacggcgaaaagtgctggatcactaatgcaagctacgcacgcacagttattgtaaccgccgtaacaggcaaaaacaaagacggaaaaaacatcatctccgcattaatcgtgccaactgacacaccaggacttacgattacgagcccgtacgataaaatgggcgtccgcggttcgaatacagcggaaatcttgcttgaagatgtaagagtgcctgcggccaacttacttggcgatccaacaaaagggtttaaacagtttctatatacgctggatggtggtcgaatctccatcgctgctcttgcagtcggcattgcccaagcggcccttgacgcatcattggcatatgcgaaagagcgaaagcagtttggacagccgatttcttcctttcaagcgattcaatttaagcttgctgacatggcgatggaaattgatctggcacggcaaatggtgttaaaagccgcctggctgaaagatcataaccgcccgttcaccaaagaagcggcgtacgccaagctattcgcatctgaaatggcgacaagagcttgcaatcaagccattcaaatccatggaggttcaggctatatgaaagagtatggggtggaacggatgctgcgggacgcaaaattaatggaaatcggtgaaggcacatctgaaattcagcgtctcgtgatcgccagacagcttttaaaataa

SEQ ID NO: 46844 - DNA, 813 bp, Bacillus subtilis
atgcgaacaaaaaagcgaacaaaggagatgttaccgatctttgatcaaaagaaagtagcctttataggagcaggatctatggcggaaggaatgatatcaggtatcgttcgagccaacaaaatcccgaaacaaaacatctgcgttacaaaccgcagcaatacagagcgattaactgaacttgaacttcaatatggcattaaaggcgccttgccgaaccaactatgtattgaagacatggatgtgctcattttggcaatgaagccaaaagacgccgaaaacgctctgtcatcactaaaatcacgtattcaaccccatcaattaatattgtcggtccttgccggcataactacctcttttattgaacaatcattgcttaatgaacagccggttgtcagagtgatgcccaacacttccagtatgattggcgcttctgcaacagctattgcccttggcaaatatgtgtcggaagacctgaagaagctggccgaagcattgctcggatgcatgggcgaagtctatacaatccaagaaaatcaaatggatatattcaccggaattgcaggcagcggacccgcgtatttttattatttaatggaattcattgaaaagacaggcgaggaagcgggcctcgataaacagttatctcgaagcatcggcgcacagacacttttaggtgccgcaaaaatgctcatggaaacaggagaacatcctgagatcttaagagataatatcacgtcaccgaacggaacgacagcagcggggctgcaagccttgaaaaagagcggcggcgagaagcgatttctcaagcaataa

SEQ ID NO: 46845 - DNA, 1464 bp, Bacillus subtilis
atgaaaaaacaaaaaggctatctcgtttttgatattggcacaggcaatgcgagggtagcggtcgtgagtgtaactggcagtgttctaacagttgaacgggaggacatcgagtattccacagagacgctttacccggacagccgttatttttctcctcaggtgctgtggaagcaggtgatgaatttggcaaaacgtgcgctatcccgttcgtgtgatattgacatcattggtttgacatcgacgagccaaagacaggggattgttttgattgatcaaaacggcaatccttttctcgggctgccgaacatcgataatcgcggccgagagtgggaggcgggcattcccgattgggaagagatatacagcagcacaggccgcctgccaactgcacttttttctgcgctcaagctttatggattaaaacagcgccagccctctttatgggaaaagactgcaagctttacaagcatcagtgattgggtgacgtaccaactgagcggaatattaacatatgaaccatcacaggcaacagaaaccctgctatttgatgtgaagcaaaacacttggtcagaagagatgtgcgacattttcggcttttctccatctatccttccgcctcttgtaagagcgggaacagcaattggaacgatagcaaatgaatatgcatccgaattaggcctttcaataaatgctaaggttatagcagggggcggggatacacagctggctgtcaaaagcaccggagctggacttgaggacattgtcattgtatcagggacaacaacgccaataaccaaaattactgaggatcatggcgacacaaaacataaagcctggttgaactgtcatacggatcaagggcattggcttgtggaaacgaatccgggaattaccggcttgaattatcaaaaattaaaacagattttttatccgaatgaaacgtacgaagtaatggaggaggagatttctgcacttgcaaaagaagaccatgcatgtgtagcggctctcggctcttatttatcggctgaaaagaatgcgttaacgagaggcggttttctttttgatgccccgctgtcagcacatttaaagagggcacattttgtacgtgcagcgctagaagagatcgcattttcaatcaaatggaactttgacattttaacagaggttactccgtttgaacgtgattatgtttgggtgtgcggagggggattccaaagcaaagcgctcactcaatatatcgcggatcttcttcaaaaaaaggtctatgtccaagagggatatcatcaggcatctgtcgtcggtgctgcagtcatttgcaatgaaacctttcaattaacggaggagatgtcagcaaatgtccgggtgatcgaaccgaaggactgtcagatagaattggctttatatgaggaatggaagcaaacacagcgctttttttcaggatcagaaagcaaagtattaatttaa

SEQ ID NO: 46846 - DNA, 2034 bp, Bacillus subtilis
atgagatcttttgccacacaacaaaacggcattttcaaatccgtttgctcgctggactgcccggatcagtgcggattgttaatacataaaaaagacgggaaaatcgtaaaagtgcaaggagaccctgatcatcctgtcacagctggaaacatatgcaacaaagtccggaatatgacggagcgcatctatgatgaaaagcggctgactacaccgctcaaacgaacaggtgcgaaaggccaagcgatatttgaaccgatttcctggaaagaggcaatcgatacgatcacctcccgctggaaacagctgattgatgaagagggagctgaaagcatacttccttacagcttttacggaaatatggggaaattgacagctgaaggaatggaccgccgctttttttaccgcatggggtcaagccagcttgaacggacgatttgcagcaaagcgggatctgaaggctataaatatacaatgggcataagcgcgggaatcgatcctgaggaaaccgttcatacaaaactatttattttttggggaatcaacgcggtcagcacaaatatgcaccaaattacgatcgcccaaaaagcgcgaaaaaaaggtgccaaaattgtcgtgatcgatgtgcataaaaatcaaacaggacgtcttgcagattggtttatcccaataaaaccgggaaccgacagtgcacttgctcttggcatcatgcacattttatttaaagaaaaccttcatgatgaagcatttctgtccgagtacacggttggctatgaagagctccgtgaacacgtgaaacaatatgatcctgaaaaggtatcgacgatcaccggtgtcagtaccgaagatatttaccgactggcaaaaatgtacggggaaacctccccttcttttatcagaatcggaaacggaccccagcatcacgataacggggggatgattgtaaggacgattgcctgtcttccggcgatcaccggccaatggctgcacacagggggcggcgcaattaagcataacagcggaattttagaatataacacaaatgccttgcagcggcccgacttattgaaagggcgcaccccgaggtcgtttaatatgaatcagcttggcagggtgcttttggaaacagacccgccgattcgctctctatttatttacggaacgaaccctgccgtcgtcgcgcccgaagcaaacaaagtcagacagggcttgctgcgggaagacttgtttactgtggttcatgatttgtttttaacggaaacggctgcatatgcggacattgtactgcctgcaacatccgcttttgaaaatactgatttttacacctcctactggcaccattacattcagcttcagcagccggtgattgagagatatggggaaagcaagtctaacactgaggttttccgattactggctgaagccatgggattcacagaccaggagcttaaagattcagatgaagtattaatccgccaggcgcttgaccatccagataatccgcatttggcagagattgattacgattcacttactaagcattcatttatgaaagcgaaacgtgaaaagccgctgtttccgggcgaacttccaacgccaagcggaaaaatagaattatattcagaaaaaatgaaacaagacggcttccctgctttaccgacatatacacctcttgtaaccgataatgaacatccgtttatgtatgttccggggccaaaccataatttcttaaactcaacattttccaataatgaaaaacacatcaagcttgaaaagacgccaaagctctttatcaacacaaaagatgctgaaaaacacggaatcgttgatggggcacctgtacgaatttggaacagccggggagaatgcgagctgaccgctgcagttggagaacaagtgctgccaggtgtcgttgtcagccaaggattatgggcggatgaacaagggaaaaaaacagcttgtaaacgcgctaaccccagatcgcttgtccgatatgggcggcggcgccacctttttttcaggccgtgtacagattga

SEQ ID NO: 46847 - DNA, 1341 bp, Bacillus subtilis
ttgtccgggcttgtatcagcatctttgttgaaaaatgccggtcacagagtaacgattctcgaagcgagcggcagagcgggcggccgtgtctgcactttgagatctccctttagtgatgatttgtatttcaacgctggcccgatgcgcataccgaataaccattcgttaaccttagaatatatcaaaaaattcaaattgccaacaaatgtatttatcaacagaaccccgatggacatcatttatgcaaatggaatcaaaacacgtctccaagtttttgaacgagctcctggaatattgagatatccagttgcaccaaatgaacaagggaaaacgtctgaagagctgatgctttctttactgcagcctattctaaattttatcaatcaaaatccagcaagaaattggcggattgtcgaagaacaatacaaaaatcattcgttaagctcttttttaaacacgtatttttcatatggcgcgatcgatatgatcggtgtacttttggatatggaagcgtatatggggatgtcccttgttgaagtattgcgggaatctatctttttttcatcccccgctcacttctatgagataactggcggtatggatctgctgcctcacgcgtttcttcctcaattaaaaacaaacattctataccatcaaaaaatgatgaaaatgtctcagggtgaaaatcgtgttacgatccattgtcagcatcaacaaacggcagaattcacatcattcacagctgatctcgctattgtaaccattcctttttcaacattgcgatttgtaaaagtcgaaccataccattcattctcttactataaacggagggccatccgtgagctaaactatatcagtgcaacaaaaatcggcatagagtttaaaagccgattttgggaaaaagccggtcagcacggcggcaaatctattactgatcttccgattcgtttttcatattatccaagcagaaatattggagcaaatggacatgctgtcattctggccagctatacatgggccgatgaggcactgatatgggacagtctttcagaaggagagcgaatccagtatactttactgaatttatctgaaatctatggtgatattgtgtggtctgaatttgtgtctggcacttcttttagctggagccagtacccgtattctgcgggaggttttacagctttcgaaccaggacaagaattagagctgtatccctatattcctgtccctgagggcagagttcatttcgccggagaacacgcctcactcactcatgcgtggatgcaaggcgcgattgaatctggaatacgtgttgcttatgaggtcaatcgcttaccttag

SEQ ID NO: 46848 - DNA, 1059 bp, Bacillus subtilis
atgactgaacaaaccattgcacataaacaaaaacagctgacaaagcaagtcgctgcatttgctcagcctgaaacaaaaaacagcctgattcagcttttaaacacgtttatcccattcttcggcctatggtttcttgcttatctcagcctcgatgtctcctatcttcttacgttagcattaacggtgattgccgcaggttttctgacaagaatttttatcatcttccatgactgctgccatcaatcttttttcaaacaaaaacgctataaccacattctcggttttctgacaggtgtcctgactttattcccgtatcttcaatggcagcacagccattcgattcatcatgcaactagcagcaatctggataaacgcggaacaggagacatctggatgttaacagtaaacgaatataaagctgcatccagacgaacaaagcttgcatacagactttatagaaacccgtttatcatgtttattctcggaccgatttatgtttttctgatcacgaaccgttttaacaaaaaaggcgcaagacgcaaggaacgtgtaaacacataccttacgaatctggcaattgtcgcgttggctgccgcttgctgtctgatctttggctggcaatcgtttttactggtgcaaggcccgatatttctgatttcaggttcaatcggtgtttggctgttttatgtgcagcatacctttgaagattcttattttgaagcggatgaaaactggagctacgttcaggctgctgttgaaggcagctcattttataaactcccgaaactgcttcaatggctaacaggcaatattggttaccaccacgttcatcatttgagtccaaaggtgcctaactataagcttgaagttgctcatgaacatcacgaaccattaaaaaacgtaccgacaatcaccttaaaaacaagcctgcaatcacttgcgttccgtctatgggatgaagataacaaacagtttgtgtcatttcgggctataaaacatatacctgtaagccttccgcctgattcaccagaaaaacagaagctgcggaagaatgcctga

SEQ ID NO: 46849 - DNA, 1488 bp, Bacillus subtilis
atgagttctttaacgatgcaagtgacgaaaaggctggagacatttttacagggaacaaagaagctttatattgacggaaagtttgttccgagtgcctcaggggcaacctttgacactccaaacccggcgaccggcgaaaccttgatgacgctgtatgaagcccaggctgcggatgtggacaaagctgttaaagctgcccggaaagcctttgaccaaggtgaatggagaacaatgtctccagcttcgagaagcagactgatgtataagctggcagacttaatggaagagcataaaactgagcttgctcagcttgaaacacttgataatgggaaaccgatcaatgaaacgactaatggagatattccgctggctattgagcatatgcgctattacgccggctggtgtacaaaaataacaggacagacgattccggtttccggcgcttattttaattatacgcgtcatgagcctgtcggtgtcgtcggccagatcattccatggaatttcccgctcctgatggcgatgtggaaaatgggcgcggcacttgcaacaggctgtacaatcgtcctcaaaccggctgaacaaacaccgctttcagctctttatttggcagaattaattgaccaagccggtttccctgccggtgtaatcaacatcatcccaggattcggtgaagatgcgggagaagcgctgacgaaccacgaagcggttgataaaattgcctttaccggttccactgaaatcggaaagaaaatcatgtccaccgcagcgaaaagcattaagcgtgtgacattggagctgggcggaaaatcgcctaatattcttctgccggatgcgaatttaaaaaaagccatcccgggcgctttaaacggtgtgatgtttaaccagggccaagtctgctgtgcgggctcacgtgtcttcattcataaagaccaatatgatgaagttgttgatgaaatggcatcctatgctgagtcactccgccaaggagcgggacttcataaagatactcaaatcgggcctctcgtaagcaaggaacagcatgagcgcgttctttcctatattcaaaaaggaaaagatgaaggagcaaaagcagtgaccggcggaagctgtccttttgaagcaggatattttgtcgcaccgactgtgtttgcgaatgttgaagacgaaatgaccatcgcaaaagaagaaattttcggacccgtgctgactgcaattccgtacgaaacagtcgatgaagttattgaacgggcaaaccattcagaatatgggcttgcagccggactatggacagagaacgtcaagcaggctcactatatcgcggaccgacttcaagccggaaccgtttgggtcaactgctataatgtgtttgacgcggcgtctccatttggcggttataaacagtcaggactcggacgagaaatgggatcatatgccttggataattacacagaagtcaaaagtgtatgggtaaaccttgaagactaa

SEQ ID NO: 46850 - DNA, 1671 bp, Bacillus subtilis
atgggcacacttcaggagaaagtgaggcgttttcaaaagaaaaccattaccgagttaagagacaggcaaaatgctgatggttcatggacattttgctttgaaggaccaatcatgacaaattccttttttattttgctccttacctcactagatgaaggcgaaaatgaaaaagaactgatatcatcccttgcagccggcattcatgcaaaacagcagccagacggcacatttatcaactatcccgatgaaacgcgcggaaatctaacggctaccgtccaaggatatgtcgggatgctggcttcaggatgttttcacagaactgagccgcacatgaagaaagctgaacaatttatcatctcacatggcggtttgagacatgttcattttatgacaaaatggatgcttgccgcgaacgggctttatccttggcctgctttgtatttaccattatcactcatggcgctccccccaacattgccgattcatttctatcagttcagctcatatgcccgtattcattttgctcctatggctgtaacactcaatcagcgatttgtccttattaaccgcaatatttcatctcttcaccatctcgatccgcacatgacaaaaaatcctttcacttggcttcggtctgatgctttcgaagaaagagatctcacgtctattttgttacattggaaacgcgtttttcatgcaccatttgcttttcagcagctgggcctacagacagctaaaacgtatatgctggaccggattgaaaaagatggaacattatacagctatgcgagcgcaaccatatatatggtttacagccttctgtcacttggtgtgtcacgctattctcctattatcaggagggcgattaccggcattaaatcactggtgactaaatgcaacgggattccttatctggaaaactctacttcaactgtttgggatacagctttaataagctatgcccttcaaaaaaatggtgtgaccgaaacggatggctctgttacaaaagcagccgactttttgctagaacgccagcataccaaaatagcagattggtctgtcaaaaatccaaattcagttcctggcggctgggggttttcaaacattaatacaaataaccctgactgtgacgacactacagccgttttaaaggcgattccccgcaatcattctcctgcagcatgggagcggggggtatcttggcttttatcgatgcaaaacaatgacggcggattttctgctttcgaaaaaaatgtgaaccatccactgatccgccttctgccgcttgaatccgccgaggacgctgcagttgacccttcaaccgccgacctcaccggacgtgtactgcactttttaggcgagaaagttggcttcacagaaaaacatcaacatattcaacgcgcagtgaagtggcttttcgaacatcaggaacaaaatgggtcttggtacggcagatggggtgtttgctacatttacggcacttgggctgctcttactggtatgcatgcatgcgggttgaccgaaagcatcccggtatacaaaaggctctgcgttggctcaaatccatacaaaatgatgacggaagctggggagaatcctgcaaaagcgccgaaatcaaaacatatgtaccgcttcatagaggaaccattgtacaaacggcctgggctttag

SEQ ID NO: 46851 - DNA, 1254 bp, Bacillus subtilis
atggcggaaattaaggtacctgaattagcagaatcaatctcagaaggaacaatagcccaatggttaaagcagcctggtgactatgtagaacagggtgaatatctgcttgaactagaaacggataaagtgaatgttgaattgacagcagaagaatcgggtgtacttcaagaggtattgaaagattcgggtgataccgtccaggtcggagaaattatcggtacgatttcagaaggcgcgggtgaaagttctgcccctgctcctacagagaaaacagaaagcaaggaaagcgtaaaagaagagaaacaggctgaaccagctgcacaagaggtgagcgaggaagcacaatctgaagcaaaatcaagaacgatcgcttctccgtcggcccgtaagcttgcgagagaaaaaggaattgacctgtctcaagttccaactggagatccgcttggaagagtgcgcaagcaggatgtcgaagcgtacgaaaaaccggcatcaaaaccggctcctcagcaaaagcagcagcctcaggctcaaaaagcacagcaaagctttgacaaacctgttgaagtgcaaaaaatgtcacgccgcagacaaacgattgcaaaacgccttgtagaggtacagcaaacatcagcgatgctgactacatttaatgaagtggacatgacggctgtcatgaatctcagaaaacgccgcaaagatcaattttttgagcaaaatgaagtgaagctcggctttatgtctttcttcacgaaagcggtcgtggctgcattgaaaaaatatccgctgttgaatgcagaaattcaaggcgatgagttgatcgttaaaaaattctacgatatcggaatcgctgttgctgctgtagaaggtcttgtcgttccggttgtacgggatgcggatcgcctgacatttgcaggaatcgaaaaagagatcggcgagcttgcgaaaaaagcaagaaacaataaattaacccttagcgagcttgagggaggctccttcacgattacaaacggagggactttcggttcattgatgtcaactccaattttaaacagcccgcaagtcggtatactgggcatgcataagattcagctgcgccctgtagccattgatgaagagcgtttcgaaaaccgtccgatgatgtatatcgctttatcttatgatcaccgaattgtagacggtaaagaagcggttggtttcctcgtgacaatcaaaaatttactggaagatcctgaacagcttttattagaaggataa

SEQ ID NO: 46852 - DNA, 2814 bp, Bacillus subtilis
atgtttcaaaatagtatgaaacaacgaatgaattgggaagatttttacggtccgaacctcggctatgcgctggagctttacgatcagtatacccaggatccgtacagcattgacccggatttgaaggaaatgttcgacgagctcggtgctccgccaagcgatataaaagaggcctcgggaacaaaagaaaagggacgtgttacagccgatctgattcaaaagatcgcatccgcagtcagacttgcagaagatatccgaacctatggccatttgaacgcttccgtcaatccgctcagaaaggatgagaaaaagagcgaactttttccattatccgattacgggctaacagaagaggaaataaaagcaatacctgcgtctgtcatctgcaaagacgctcctaaaaacatttcgaacggtttagaagccattcagtatttacgaaatacgtataaaagaaccatctcttttgaatttgaccatgtgcatgacttcaaagagcgcgagtggctgacaagaaagattgaatctggcgagctgttccagaagaactcagctgaaaagctgtcagctgtgctggaaagattgacagaagtagagggctttgagcagtttttgcaccgcacattcgtcgggcagaagcgcttttccattgagggtctggacgctcttgttccagtgcttgatgacattattgcacaatctgtcaaatcaggcacgacaagtgtcaacatcgggatggcgcacaggggacgcctgaatgtcttggcacatgtgctcggcaaaccgtatgaaatcatcttctctgaattccagcatgcgccgagaagtcttgtaccgtctgaggatccattggaatcagctacggatggacgggggatgtcaaataccatttgggggcgaatcgggagcttcaagacgctgaaacaaaatcagcccgcattaccgttagcgaacaacccgagccacttggaatttatcaatccgattgttgaaggcagcacaagagcggcacaggaaacgcgaacacaaagcggatacccggtacaagatgaaacaaaatcgctggccattttaatccatggagacgctgcattccctggggaaggaattgtagctgaaacattgaatttaagctctttaaaagggtatcaagtaggcggtgcgattcatattatcgccaataacatgatcggattcacaacagaaagcgctgaatccagatcgacaaaatatgccagcgacctggccaagggttatgaaattccgattgttcacgtgaatgcggacgatcctgaagcttgtctttcagctgttaagtttgcggtcgaataccgaaaaacattcaacaaggattttctgattgatttgatcgggtacagacgctatggacacaacgaaatggatgaaccgtcaaccactcagccaatgctgtatgatgctgtcagaaagcatccgacgtcaaacaaattttcgctgaaaaagctggtaaaagaaggcgtggttaccgaggaagtcgttcaaaacatcgaaaaatcggtaacgaagcgcattgaggtagctatacagaaagttccgtctaaaaaggaacacactgcttgtgaaattgaacttccagagcctgtatcaaacggtttcccagatgtggacacttcgattcattttcatgtgctccgcaagctgaatggcgaattgatcactggcgagtcatttatgttttcgcaagctaaagcgcattttagaaagacggccaaggcgttcgatgatgacagaaaagtggaatggtctttggcagaatcactcgcgtttgcttcaattttgaaagacggaacaccgattcgtttaacaggacaggattccgagcgcggaacgttcgcccaaagaaaccttgtgcttcatgacagtgagacgggcaaagaatttgtgccgcttcatcacttatctgactgcagcacatcatttgctgttcataacagcccgctgtctgaaggatcggttctcggttttgaatacggctataacgtgcattcaccggaaacgcttgttttgtgggaagcacagtacggagattttgccaacgctgctcaagtgtattttgaccaatttatttctgccggacgcgcgaaatggggccaaaaatccggattagtcatgctgctcccgcacggttacgagggacaggggcctgagcactcaagcggaagaattgagcgattcctgcagcttgcagcggaaaacaactggacggttgccaacctgacaagcgcggcacagtatttccatattttaagaagacaggctaaaatgctgcttcgtgaagaaatcagaccgctcgtcattatgacgccgaagagccttcttcgcaacccaaatacggtgtcggaagtgcaggagctcagcgaaagccgcttccagcctgtttatgaacagtcgggactttctcatgactatgaaaaagtaaccagacttgtattatccagcggtaaagtgtctatagacattagcgtacattttaataagttagaagacggtaaagagtggcttcacattgcgagaatcgaacagctgtatccattcccggcaaaaggagtcaaagaattatttgcaaaacttccgaacctgaaagaaatcgtttgggtgcaggaagagccgcagaacatgggggcttggggttatatcagcccgtatttgacagagattgcaccagagggagtaagcgttcaatatattggacgaagaagacgatccagccctgcagagggagatccgactgagttcataaaaaagaacaggaacgtattgtatctgatagcttga

SEQ ID NO: 46853 - DNA, 1335 bp, Bacillus subtilis
atgagcagttatttgattaagccagagcttagctcggcctatccggttgtcagttatgcgaagggttcatatgtttatgatcagaccggaaaaaaatatctcgacggctcgtcaggtgcggtgacatgtaatatcggccacggagttcgtgatgtgactgagaagctgaaagaacagcttgatcaggtgtcttttgcttaccgctcacagtttacgagtgagcccgccgagcaattagccgctctcttggcacaggagctgcccggagatgtgaattggtctttttttgtcaacagcggatcagaagcgatagaaacagctatgaaaatcgccattcagtattggcaggaaaaaaagcaaacacaaaaatccatctttttgtctcgatggagcagttaccacggaataactttgggagcgctttcattgtctggtttttatgaaaggagataccggttcacccatctcattgagcggtatccagctatctcagctccacatatttatcggctgaatcacgagacggaagaagactttgttcagactgcagctgatgaactggacaccatgattaaaagaatcggaagccaattcatcgccggctttgtggctgagcctattattggtgctgcaggagcagcgattactccgcctccgggatattatgagagattaagtgaggtatgccgcacacacgatgtgctttttattgcagatgaagtgatgacggggcttgggagaacaggaaggatgctcgcgacagagcattgggataccgtacctgatattgctgtactggggaagggactcggtgcggggtatgcacctattgctgctgccgtcgtatctgattctattattgaaaccataaaacaagggtcaggtgtgattatgagcggtcacacatatagtgcacatccctattcagccaaagctgctcttgaagttttgcgatatgtgttaaagcacggcttgatcaaacaatcagaaaaaaagggcgctgtgctgaagaagaagcttgatgaggcggcatctcaaagcggcattataggtgaggtgcgcggaaaaggactgctattaggcattgaatttgtggcagaccaaaaaacgaagaaagtgtttccgccagagcaggcgataacccagcttattgtcagcgaggcgaaaaaacgcgggctgattgtttatccttccaaagctggaatagacagtggagaaggagatgctgtcattattgctcctccttttactatttcagacggtgaaatggaagagcttatctctattttttcagaaacagttgcagcggtcgaaaaaaacttaaaaaaggattga

SEQ ID NO: 46854 - DNA, 1098 bp, Bacillus subtilis
atggcgtttattttatccattggaacaagtcttcctgcgtataatgtaaaccaagagaaagcggccgagttcgcccgctatatgtttcagcattcttttaaggatattgacaggctgttatcctcctttaaaaacgggcaaatccattcgagacagtttgttaagccgattgaatggtataaagaggggcacagctttgaagaaaaaaatcaaatatacatagaagaaacacttaaacacagcagagcggctgttcgtgagtgcctctctcatccggaattttttcaagaagccattccttatgagaaagtggaagctgtttttttcgtctccagtacaggtctttccacaccgagtatcgaggcgcggcttatgaatgaacttccgttttctccatatacgaagcggattccgatttgggggcttggctgtgcaggaggagccagcggacttgcgcgtgcagccgaatactgcaaagcgtatcctgaggcttttgtgcttgtcatttctgccgagctgtgcagcctgacattccagccggaagataaaacaaaaagcaatctgatcggcacctcgctttttggtgacggcattgccgcagctttattatgcggagagaaggcggaccgcagggtgtcaaagctgaagcttgcgccgaagataatggacgcccaatctgttttgatgaaacaatcagaagatgtcatgggctgggactttaccgatcaaggattcaaagtcattttctcacgagacattccgaccttggtggaaaaatggctcaaaacaaatgtacagatttttttggacaaacataagctgtcattccatgatatcagtgtttttttggcgcatccaggcggaaaaaaagtgatcgatgcatacatcaaaagtctcgggctgtcgtcagaaaagctttcatctgcgcaaagcattttgcaaaagcacggaaatatgtcttcagccacaatcttgtatgtgatcaaagaccatctgcagaacggacataaaaaggaagctgaacgaggactgattggcgcattagggccgggtttctcatcagagttgctattattcagctgggaaaagggggcctga

SEQ ID NO: 46855 - DNA, 585 bp, Bacillus subtilis
atggaagcactgaaacggaaaatagaggaagaaggcgtcgtattatctgatcaggtattgaaagtggattcttttttgaatcaccaaattgatccgctgcttatgcagagaattggtgatgaatttgcgtctaggtttgcaaaagacggtattaccaaaattgtgacaatcgaatcatcaggtatcgctcccgctgtaatgacgggcttgaagctgggtgtgccagttgtcttcgcgagaaagcataaatcgttaacactcaccgacaacttgctgacagcgtctgtttattcctttacgaagcaaacagaaagccaaatcgcagtgtctgggacccacctgtcggatcaggatcatgtgctgattatcgatgattttttggcaaatggacaggcagcgcacgggcttgtgtcgattgtgaagcaagcgggagcttctattgcgggaatcggcattgttattgaaaagtcatttcagccgggaagagatgaacttgtaaaactgggctaccgagtggaatctttggcaagaattcagtctttagaagaaggaaaagtgtccttcgtacaggaggttcattcatga

SEQ ID NO: 46856 - DNA, 975 bp, Bacillus subtilis
atgaagcttgatgcggtgacattcggggaatcaatggccatgttttatgcaaatgagtatggaggccttcatgaagtatccactttttctaaagggcttgccggagcagaaagcaatgtcgcctgcggccttgccagactcggatttcgaatgggatggatgagcaaggtcggcaatgatcagctcggaacgtttattttacaagagcttaaaaaagagggagtggatgtgtcccgcgtgatccgctcgcaggacgaaaatcccaccgggctgctgctgaagtcaaaagtgaaagaaggcgacccgcaagttacctactataggaaaaactcagctgcaagcacattaactacagctgaatatccgagagattattttcaatgcgcaggccatttgcatgtgacaggtattccgcctgctttatcagccgagatgaaagacttcacgtatcatgtcatgaacgacatgagaaacgcagggaagaccatttcattcgaccctaatgtaagaccttcgctttggcctgatcaagcaacaatggtacacacaatcaatgatctggctgggcttgcagactggtttttcccgggtatcgcagagggagagctattgaccggagaaaaaacacctgaaggcattgccgactattatttgaaaaaaggtgccagctttgttgctattaaacttggaaaagaaggcgcttactttaaaacggggacaagtgaaggatttctagaaggctgccgggtcgaccgggtggttgatacggtcggcgccggagacggatttgcagtcggtgtaatcagcggtatcctagacggtttgtcgtacaaggatgcggtgcaaaggggaaatgcgattggcgctttgcaagtgcaggcaccgggggatatggacggtttgccgaccagggagaaattagcttcttttttatctgctcaaagaacggttcaccaaaagaaaggggattattaa

SEQ ID NO: 46857 - DNA, 765 bp, Bacillus subtilis
atgggttatctacatgacgccttttcattaaaaggaaaaacagcgctggtgacaggcccgggaacagggatcggtcaaggaatagccaaagccctagccggggctggcgctgatattatcggcacatcacatacaagcagtctgtctgaaacacagcagcttgtggaacaggaaggccggatatttacatcttttacattggacatgagcaagccggaagcgataaaggattctgcagctgagctgtttgaaaacaggcagatcgacatccttgtcaataatgccggcattattcatcgggaaaaagcggaagattttccagaagagaactggcagcacgtactgaatgtcaatctaaacagcctgtttattctgacacagcttgctggcaggcacatgctgaaaagaggtcatggaaagattattaatattgcctctctcctgtcttttcaaggcggcatcctcgttccggcttacaccgcgagcaaacacgctgttgccggtttgacaaaatcatttgcaaatgagtgggcagcgtcaggtattcaggtcaacgcaatcgccccaggctatatttctactgcgaatacaaagcctattcgggatgacgaaaagcgaaatgaggacattttaaagagaattcctgccggccgctggggccaagcggatgatatcggggggactgcagtctttttggcatcacgtgcttcagattatgtaaatggacatattttagcagttgatggcggctggctatcccgctga

SEQ ID NO: 46858 - DNA, 1182 bp, Bacillus subtilis
ttgaaactggcaaaaagagtatccgcattaacaccatcaaccacactggcaatcacagcgaaagcgaaagaactgaaagccgcaggccatgatgtcatcggcttaggagcaggcgagcctgacttcaatacaccgcagcatattattgatgccgctgtgcgttcgatgaacgagggccatacgaaatacacgccttccggtggtttggctgaactgaaaaacagcattgcagagaaatttaaacgcgaccagaatattgaatacaaaccgtctcaaattattgtctgcactggtgccaaacatgctctgtatacccttttccaagtgattttggatgaagaagatgaagttattattccaacgccttactgggtaagctacccggagcaggtgaaactcgctggcggaaagcctgtttatgtagaagggcttgaggaaaatcacttcaaaatttcgcctgagcagctgaaaaatgcaattacggaaaaaacaaaagcaatcgttattaactctccaagcaacccgactggtgtcatgtatacggaagaagaactatctgcgctcggtgaagtgtgccttgaacatgatatcttgattgtgtcagatgaaatttatgaaaaacttacatacggcggaaagaaacatgtttccattgcacagctgtcagacagactgaaagagcaaacggtcattataaacggcgtatcgaagtcccacagcatgacaggctggagaatcggttatgcggcaggctctgaagacattattaaagcgatgacgaaccttgcaagccacagcacgtcaaacccgacatcaatcgcacaatacggagcgattgctgcttataacgggccttctgagccattggaagaaatgagagaagcatttgaacatagattaaatacgatctatgcaaagctcatagaaatcccagggttcagctgcgtgaagccggaaggtgctttttacttgttcccaaatgcaaaagaggcagctcaatcttgcggtttcaaagatgtagatgaatttgttaaagcgcttctcgaggaggaaaaagttgcgattgttccaggatccggatttggctctcctgagaatgtccgtctttcttatgcaacatcgttagatcttcttgaagaagccattgaaagaatcaagcgttttgtagaaaaacatagctaa

SEQ ID NO: 46859 - DNA, 1134 bp, Bacillus subtilis
atgagaaaactaaaaataggaatcacatgctatccgagcgttggaggctcaggtatcattgcgacagaactggggaagcagcttgctgaaaagggacatgaaatccatttcatcacatcaagcattccgtttagactgaatacatatcatcccaatattcattttcatgaagttgaggttaatcaatatgctgtttttaagtatcctccgtatgatttgacattggcaagcaaaatcgctgaggtggcggaacgggagaatttagacattatccatgctcactatgctctcccgcatgccgtttgcgcctatcttgcaaaacaaatgctgaaacgcaatatcggcattgttaccactttgcatggcacggatatcacggtgttaggttatgatccgtctctaaaagatctgatccgttttgctattgagtcatcagacagggtgacggccgtctcctcagcgcttgcggctgaaacatacgatttaattaaaccggagaaaaaaattgaaacgatttataactttatagacgagcgcgtgtatctgaagaaaaacacagcggcaattaaagagaaacatggaattttaccagatgaaaaagtcgtcatccatgtgtccaacttcagaaaagttaaacgcgtgcaggatgtcatccgtgtgttccgcaatatcgctggcaaaacgaaagcgaagctgcttttagtcggagacggtccggagaaatcgacagcctgcgagcttatcagaaaatatggcttggaagaccaagtcttaatgcttggaaatcaagaccgtgttgaagatctttattctattagcgatttgaagctgctgctatctgaaaaagaaagctttggccttgtcctgcttgaagcgatggcttgcggagtgccttgtattggaacaaacattggcggtatccctgaggttataaaaaacaatgtgagcggatttttggtggatgtcggtgatgttacggccgcaacagcccgcgcgatgagcattttagaagatgaacagctaagcaatcgttttacaaaggcggcaatagagatgcttgaaaatgaattttcttctaaaaaaattgtcagccagtatgaacagatttatgccgatttagcagaaccggagtga

SEQ ID NO: 46860 - DNA, 804 bp, Bacillus subtilis
atgtcaaacgaaacaattaaattagtcattgcgggaccgcgtggaagaatggggcaggaagctgttaaattggcagaacgaacaccacattttgaccttgtaggggccatagaccatacatacgatcagcaaaaattatctgatgtgatgcctgttgagtcagatgctttcatttacacagatatccatgcctgttttacagaaacacaaccggatgtcttgattgatttaacaacgcccgaaatcggaaaagtacatacaaaaattgcattagagcacggagtccgtccagttgtcggaacaaccggtttctcagaagctgatttaaaagagctcacatctttaacagaagaaaaagggatcggagccatcatcgcgccaaattttgcgctcggtgcgatactgatgatgaaattttcaaaaatggctgccaactattttgaggatgttgagattattgagcttcatcatgaccagaagcttgacgcaccaagcggaactgcgcttaaaacagcggaaatgatttcagaagtccgtaaagaaaagcagcaaggacatccggatgaaaaagaaattctcccaggagcaagaggagcggagcaaaacggtattcgcttgcacagcgtccgtcttccgggactgatcgcgcatcaggaggtcatgttcggcatggatggccaaacgcttcagatacgccatgattcttataaccgtgcttctttcatgtcaggcgttaaactgtcagtcgaacaagtcatgaagattgatcagcttgtgtatggtttagaaaatatcattgattag

SEQ ID NO: 46861 - DNA, 1287 bp, Bacillus subtilis
atgaaacgagataaggtgcagaccttacatggagaaatacatattcccggtgataaatccatttctcaccgctctgttatgtttggcgcgctagcggcaggcacaacaacagttaaaaactttctgccgggagcagattgtctgagcacgatcgattgctttagaaaaatgggtgttcacattgagcaaagcagcagcgatgtcgtgattcacggaaaaggaatcgatgccctgaaagagccagaaagccttttagatgtcggaaattcaggtacaacgattcgcctgatgctcggaatattggcgggccgtcctttttacagcgcggtagccggagatgagagcattgcgaaacgcccaatgaagcgtgtgactgagcctttgaaaaaaatgggggctaaaatcgacggcagagccggcggagagtttacaccgctgtcagtgagcggcgcttcattaaaaggaattgattatgtatcacctgttgcaagcgcgcaaattaaatctgctgttttgctggccggattacaggctgagggcacaacaactgtaacagagccccataaatctcgggaccacactgagcggatgctttctgcttttggcgttaagctttctgaagatcaaacgagtgtttccattgctggtggccagaaactgacagctgctgatatttttgttcctggagacatttcttcagccgcgtttttccttgctgctggcgcgatggttccaaacagcagaattgtattgaaaaacgtaggtttaaatccgactcggacaggtattattgatgtccttcaaaacatgggggcaaaacttgaaatcaaaccatctgctgatagcggtgcagagccttatggagatttgattatagaaacgtcatctctaaaggcagttgaaatcggaggagatatcattccgcgtttaattgatgagatccctatcatcgcgcttcttgcgactcaggcggaaggaaccaccgttattaaggacgcggcagagctaaaagtgaaagaaacaaaccgtattgatactgttgtttctgagcttcgcaagctgggtgctgaaattgaaccgacagcagatggaatgaaggtttatggcaaacaaacgttgaaaggcggcgctgcagtgtccagccacggagatcatcgaatcggaatgatgcttggtattgcttcctgtataacggaggagccgattgaaatcgagcacacggatgccattcacgtttcttatccaaccttcttcgagcatttaaataagctttcgaaaaaatcctga

SEQ ID NO: 46862 - DNA, 1083 bp, Bacillus subtilis
ttgcgtatcaaagaacatttaaaacagctgaagccttatcagcctggaaagccgattgaagcagtgaaatcagaatatggcttggataaagttgtgaagcttgcttcaaacgagaatccttacggctgttcagaggctgcaaaagaggcgcttcatcatgagattcaacagctagccctttacccggacgggtatagcgccgctttgcggacaaggctcagtaagcacctcaatgtcagcgaaacatcacttattttcggcaacggttctgatgaaatcatacagatcatctgccgggcatttttaaacgataaaacaaacacggttactgctgcccccacttttccgcaatataaacataatgcggttattgaaggtgctgaagtacgtgaaattgcacttcgtcccgacggctcacatgatttagacgccatgttagaagccatcgacgaacagacacaagtcgtttggatatgcagcccgaataatccgactggcacttatacatctgaaggagaattactcgcatttctggagcgcgttccttctcgtgtccttgtcgttcttgacgaagcatattatgaatatgtaacagcagaggattacccggaaaccgtgccgctcttaagcaagtattccaatttgatgattttgcgcacattttcaaaggcatacggtctggcagcgctcagagtcggatacggaattgctgacgagaacctgattcgccagattgagccggcgagagagccgtttaataccagccgtctgggccaggctgcggcgattgcagcactttatgatcaagcgtttattgcttcctgtgtcgagcaaaataatgcaggccttcagcagtattatgattttgcgaaaactcatggtttaaagtgctacccttcacagacaaattttgtgttaattgactttaaacgtcctgctgatgaactgtttcaggctctgctggaaaaaggctatatcgtccggtcaggaaacgcattaggtttcccgacatcactccggattacgatcggaacaaaagagcaaaatgaagaaatacttgccattttagctgaaattttataa

SEQ ID NO: 46863 - DNA, 648 bp, Bacillus subtilis
gtgaagaagccggcattaaaatattgcggcatacggtcactgcaggatttgcagcttgcagcagactcacaggcggattatctgggctttatttttgctgaaagctaccgaaaagtatctccgcaagatgtgaaaaagtggctgagtcaagtttgtgtcgaaaaacaggttgcaggggtttttgttaatgaatcgatagagacgatgtcacggattgccgaagacttaaatctagacgtcattcagcttcacggtgatgaggaacctgcggatgccgatgcgcttcgcatgctgacagattgtgaaatatggaaggcgcttcaccatcatgagaacacaactcaagagatagcccgctttaaagatgatgtggacggctttgtgattgattcatctgtcaaaggggcaagagggggcactggtgttgctttttcttgggactgtgtgccggaataccagcaggctgctataggaaaacgttgttttatcgcaggcggcgtgaatccggacactatcacagacttaatgaaatatcagccggcaggaattgaccttgccagcggaattgaaaaaaacggacaaaaagatcagaatctgatgaggcttttagaagaaaggatgaaccgatatgtatccatatccgaatga

SEQ ID NO: 46864 - DNA, 1089 bp, Bacillus subtilis
atgaagacactgcatgttcaaactgcttcctcgtcatatcctgtttttatcggacaaggtatcagaaaaaaggcttgcgaactattaacctctttaaacaggcctttaacaaggattatgtttgtcacggatgaagaagtggaccgcctgtatggtgatgaaatgctccatttgctgcaagaaaaatggcctgtgaaaaaagtgacggtaccgagtggagagcaggcaaaatccatggacatgtacacaaaattgcagagtgaagcgattcgttttcatatggatcgctcctcatgcatcatcgcattcggtggcggtgttgtaggggatcttgccggttttgtggctgccacttttatgcgcggcattgatttcatccaaatgcctacgacgctcttggcgcatgacagcgcagtcggaggaaaagtagccgtgaaccatccgcttggaaaaaatctaatcggtgcgttttatcagccgaaagccgtgctctatgatacagatttcctgcgttctctgcctgaaaaagagcttaggtccggaatggcagaagtgattaaacacgcttttatctatgacagagcgtttctggaggagctgctgaatatccactcactgcgtgatatcactaatgatcagctgaatgacatgatttttaaaggcatttcaattaaagcgtctgtcgttcagcaggatgaaaaagaagaggggataagagcttacttaaactttgggcatacgctcggccatgccgttgaggcggaatatggatatgggcagatcactcacggtgatgccgtagccctcggaatgcagtttgctttatatataagcgaaaagactgtaggctgtgaaatggacagaaaacgtttggtcagctggctaaaaagcctgggttatccaagtcaaatcagaaaagagacggaaacttcggttctcttgaaccgtatgatgaatgataagaaaacccgtggcgggaagattcagtttattgtgctcaacgaattagggaaagttgctgatcatacattttccagaaatgaacttgagagctggctgaacaaatggcgattggaggagacatcatga

SEQ ID NO: 46865 - DNA, 1107 bp, Bacillus subtilis
atgagatatttaacagccggagaatcacacggcccccaactgacaaccattattgagggtgtacctgccgggctttacataacggaggaagatatcaattttgagcttgccagacgccaaaaaggacacggccgcggccgccgcatgcagatcgaaaaagaccaggccaaaattatgagcggggtgcgccatgcacgtacactcggttcgccaattgctctcgtagttgaaaataacgattggaagcattggacaaaaatcatgggcgccgctccgattacagaagatgaagaaaaggaaatgaagcgccagatttccagaccgagacctgggcacgctgacttaaacggtgcaattaaatataatcatcgtgatatgagaaatgtgcttgagcgttcttcagcaagggaaacaactgtcagagtggcggcaggggctgtagctaaaaagattctttctgagcttggcattaaggtggcgggccacgtgttgcaaattggcgctgttaaagctgaaaaaacagggtatacgtcaattgaagacttgcagcgtgtaacggaagagtctcctgtcagatgctacgatgaagaggcaggcaaaaaaatgatggctgccattgatgaagcaaaggcaaacggagattccatcggcggaatagtagaagtcattgtcgagggaatgccggtaggcgtgggcagctatgtccattatgaccgcaagctggatagcaagcttgctgccgctgttctgtcaattaacgcatttaaaggtgtggaattcggcatcggatttgaggcagcagggcgaaatggaagcgaagtccatgacgagatcatttgggacgaggaaaaaggatacacccgtgctactaacagacttggcggactggaaggcggcatgacgacagggatgccgattgttgtccgcggagtcatgaagccgattccgactttgtataaaccgctgaaaagtgtcgatattgaaacgaaagaaccgttttctgccagcattgaacgttcagacagctgtgctgttcctgcggcaagtgtagtcgctgaagcgctgtcgcttgggaaattgcaaccgtcgttgaacaattcggattag

SEQ ID NO: 46866 - DNA, 450 bp, Bacillus subtilis
atgatggaaaagacttttatcatggtgaaaccagacggtgtccaacgtcagctcattggggacattttatctagattcgaacgtaagggcttacaattagctggcgccaagttaatgagagtgactgaacaaatggctgagaaacactacgccgaacatcaaggtaagcctttcttcggagagctcgttgagtttattacttcaggacctgtattcgcaatggtgtgggaaggcgaaaatgtcattgaagtgacgagacagctgatcgggaaaacaaaccctaaagaagctttacctggtacgattcgtggggattatggcatgtttgtcggaaaaaacatcatccacggctctgattctctcgaaagtgcagaacgcgagattaacattttctttaagaatgaagaattagtatcatatcagcagcttatggcaggctggatctattaa

SEQ ID NO: 46867 - DNA, 1047 bp, Bacillus subtilis
atgttaaatatcattcgtttactggcggagtcgctgccacgcatatcggatggaaatgaaaacacagatgtttgggtgaatgatatgaaatttaaaatggcctactcttttttaaatgacgatattgatgtaatcgaaagagaacttgaacaaaccgtacgttccgattacccgcttttaagcgaggcaggtcttcacctgctgcaggccggagggaaacgtattcggcctgttttcgtgctgctttctggcatgtttggcgattatgatattaataagattaaatatgtcgccgtcactctggaaatgattcacatggcatctttggttcatgatgatgtcattgatgatgcagagcttcgccgaggaaaaccgacaatcaaagcaaagtgggacaatcgtattgcgatgtacacaggcgattatatgcttgcgggatctcttgaaatgatgacgagaattaacgaaccgaaagcccataggattttgtcacagacgatcgttgaagtttgtctaggggaaattgagcagatcaaagacaaatacaacatggaacaaaatctcagaacgtatctccgccgtatcaaaagaaaaacagctctcttgatcgcggtcagctgccagcttggtgccattgcgtctggagctgatgagaagattcataaggcattgtactggtttgggtattacgtcggcatgtcttatcagattattgatgatattcttgattttacttcaactgaggaagagctgggtaaacccgtaggaggagatttgcttcaaggaaacgtcacattgccagtgctgtatgccctgaaaaatcctgcattaaaaaaccagcttaaattgattaacagtgagacaacgcaggaacagcttgaaccaatcattgaagaaatcaaaaaaacagatgcaattgaagcatctatggcagtaagcgaaatgtatctgcagaaagcttttcagaaattaaacacgcttcctcgagggcgcgcacgctcgtctcttgcagccatcgcaaaatatatcggtaaaagaaaattttaa

SEQ ID NO: 46868 - DNA, 573 bp, Bacillus subtilis
atgaaagaagttaataaagagcaaatcgaacaagctgttcgtcaaattttagaagcgatcggagaagacccgaatagagaagggcttcttgatactccgaaaagagtcgcaaagatgtatgccgaagtattctccggcttgaatgaagatccaaaagaacatttccagactatcttcggtgaaaaccatgaggagcttgttcttgtaaaagatatagcgtttcattctatgtgtgagcatcaccttgttcccttttatggaaaagcacatgttgcatatatcccgcgaggcggaaaggtcacaggactcagcaaactggcacgtgccgttgaagccgttgcaaagcgcccgcagcttcaggaacgcatcacttctacaattgcagaaagcatcgtagaaacgcttgatccgcatggcgtaatggtagtggttgaagcggaacacatgtgcatgacgatgcgcggtgtaagaaaaccgggtgcgaaaactgtgacttcagcagtcagaggcgtttttaaagatgatgccgctgcccgtgcagaagtattggaacatattaaacgccaggactaa

SEQ ID NO: 46869 - DNA, 1038 bp, Bacillus subtilis
atgaaaaaagtcacaatgcttggagcggggagttggggaacagcactggctttagttctaactgataatggaaatgaagtgtgtgtgtgggctcaccgtgcagatttaattcatcaaattaatgagttgcatgaaaacaaagattatttgccgaatgttaagctgtctacatccattaaaggaacaacagatatgaaagaggctgtttcagacgcagatgtcattatcgttgcggtcccgacaaaagcaattcgggaagtgctgagacaggctgtcccttttataacgaaaaaggcagtctttgttcatgtcagcaagggtattgagccagattcacttctgcgcatttctgaaattatggaaattgagctcccgagtgatgtcagaaaagatatcgttgtcctttccggcccgagtcatgcggaagaagtagggctgcggcaccccacaactgttactgcatcttcaaagagcatgagggcagcagaagaggtgcaggatctatttattaatcacaattttcgggtgtacacaaatcctgacattatcggagttgaaatcggaggggctttaaaaaatattattgcccttgctgcaggaattacagatggtttagggtacggtgacaatgccaaagctgctttgattacacgcggacttgccgaaatcgcgagactcggaacgaaaatgggcggaaatcccttgacgttctctggattgacaggagtaggcgatctgattgtgacgtgcacaagtgttcattccagaaactggcgtgcgggcaatttgctcggaaaagggtacaagcttgaagatgttcttgaagagatgggaatggtagtcgaaggcgtccgcacgacgaaagcggcttatcagctttcgaagaaatatgatgttaaaatgccgattacagaagctctccatcaggtcctattcaacggacaaaaagtggaaaccgctgttgaatctttaatggcgagagggaaaacccacgagatggaggatttggtaaatacgtttgaaaatcaagtgaagtaa

SEQ ID NO: 46870 - DNA, 1281 bp, Bacillus subtilis
atggcagccgatcgaaacaccggtcatacagaagaggacaaacttgatgtattaaaatcaacccaaaccgtaatacataaggctctggaaaaattgggatatcccgaagaggtatacgaattgttaaaagagccgatgagattattaacggtaaaaatacctgttcgtatggacgacggttcagtaaagattttcacaggatatcgtgcgcacaatgactctgtcggtccaacgaaaggcgggatacgttttcacccgaacgtaacagaaaaagaggtgaaggcggtgaaggcgctttcaatttggatgagtttaaaatgcggcataattgatcttccatatggcggtggtaaaggcggaattgtttgtgatccaagggatatgtcgtttagagagctggagcgtctgagcagagggtatgtcagagcgatcagccaaattgtcggcccgacaaaagacgtgccggcaccggatgtatttacaaactcacaaatcatggcttggatgatggatgagtattcaagaattgatgaatttaattcgcctggatttattacaggcaaaccgcttgtgcttggcggatctcacgggagagaatctgcgacagcaaaaggtgttaccatctgtattaaagaagcggctaagaagagaggcatcgatattaaaggtgcgcgtgtcgttgtccaaggcttcggaaacgcgggaagctatttggcaaaatttatgcatgatgcgggggcaaaagttgtcggcatctcagatgcgtatggcggactttatgatccggaaggccttgatatcgattatttactcgaccgacgcgacagcttcggtaccgtaacaaagcttttcaacgataccattaccaaccaagagctgctggagctggattgtgatattctcgttcctgctgcgattgaaaatcaaattacagaagaaaatgcccataatatccgggctaaaattgtcgttgaagcagcgaacggaccaacaacgcttgaaggaacaaaaattctttcagaccgggacattctgcttgtaccagacgtgctggcaagtgccggtggcgtaacagtttcttattttgaatgggttcagaataaccaaggcttctactggagtgaagaagaggtagaagaaaaattagaaaaaatgatggtcaaatcatttaacaatatttacgaaatggctaacaaccgaagaattgacatgaggctcgctgcatatatggtcggcgttcgcaaaatggctgaagcttcgcgttttagaggctggatataa

SEQ ID NO: 46871 - DNA, 768 bp, Bacillus subtilis
gtgaacgtgttaacgattaaaggagtttccatcggggaagggatgccgaaaatcatcattccgctgatgggaaagacggaaaaacaaattctgaatgaagcagaggcagtaaaattactgaatccggacattgttgaatggagagtcgacgtatttgaaaaagcgaatgacagagaagcggtcacaaagctcatttctaagcttcgtaaatctttagaagacaagctatttctatttacattcagaacccacaaagagggcgggagcatggagatggacgaaagctcctatcttgctttgctggaatcggcaatccaaacaaaagacatcgatctgatagacatcgaattattttcaggagatgcaaatgtaaaagcgttagtatcgctggcggaagaaaacaacgtctatgtggtgatgtcaaatcacgactttgaaaaaacacctgtaaaagatgaaattatttccagacttcgaaaaatgcaggacttaggcgcgcatattccaaaaatggctgtcatgccgaatgatactggagatctcctaacactgcttgatgcgacgtatacaatgaaaacaatatatgcagaccgccccattattacaatgtcaatggctgcaacagggctcatcagcaggctgagcggtgaggtttttggatcggcttgtacttttggagctggagaagaggcgtccgcaccaggccaaattcctgtttctgagctaaggagtgtcttagatattttgcataaaaacacacggggatag

SEQ ID NO: 46872 - DNA, 1320 bp, Bacillus subtilis
ttgttcttacacggcacaagcagacaaaatcaacatggtcatttagaaatcggaggtgtggatgctctctatttagcggagaaatatggtacacctctttacgtatatgatgtggctttaatacgtgagcgtgctaaaagctttaagcaggcgtttatttctgcagggctgaaagcacaggtggcatatgcgagcaaagcattctcatcagtcgcaatgattcagctcgctgaggaagagggactttctttagatgtcgtatccggaggagagctatatacggctgttgcagcaggctttccggcagaacgcatccactttcatggaaacaataagagcagggaagaactgcggatggcgcttgagcaccgcatcggctgcattgtggtggataatttctatgaaatcgcgcttcttgaagacctatgtaaagaaacgggtcactccatcgatgttcttcttcggatcacgcccggagtagaagcgcatacgcatgactacattacaacgggccaggaagattcaaagtttggtttcgatcttcataacggacaaactgaacgggccattgaacaagtattacaatcggaacacattcagctgctgggtgtccattgccatatcggctcgcaaatctttgatacggccggttttgtgttagcagcggaaaaaatcttcaaaaaactagacgaatggagagattcatattcatttgtatccaaggtgctgaatcttggaggaggtttcggcattcgttatacggaagatgatgaaccgcttcatgccactgaatacgttgaaaaaattatcgaagctgtgaaagaaaatgcttcccgttacggttttgacattccggaaatttggatcgaaccgggccgttctctcgtgggagacgcaggcacaactctttatacggttggctctcaaaaagaagtgccgggtgtccgccaatatgtggctgtagacggaggcatgaacgacaatattcgtcctgcgctttaccaagctaaatatgaagctgcggcagccaacaggatcggagaagcgcatgacaaaacggtatcaattgccggaaagtgctgtgaaagcggagatatgctgatttgggatattgacctgccggaagtaaaagaaggcgatcttcttgccgttttttgtacaggcgcttatggatacagcatggccaacaattataaccgtattccgagacccgccgttgtatttgtcgaaaacggtgaggctcatttagtcgtgaagcgagaaacatacgaagatattgtaaaacttgatctgccatttaaaacgggtgtaaagcaataa

SEQ ID NO: 46873 - DNA, 1428 bp, Bacillus subtilis
atgttaaacggccaaaaagaatatcgcgtggaaaaagacttccttggggaaaaacaaattgaagcagatgtttattacggaattcagacgctccgtgcttctgaaaattttccgatcacaggatacaaaatccatgaggaaatgattaacgcactggcgattgtgaaaaaagctgcggctcttgccaacatggacgtgaaacggctgtatgaaggaattggccaagctatcgtacaagccgctgacgagattctggaaggcaagtggcacgatcagtttatcgtcgatccgattcagggcggtgccggaacttctatgaacatgaacgcgaatgaggttatcggaaaccgggcgcttgaaatcatgggacataaaaagggagattatatccatttaagtccaaacacacatgtgaacatgtcacagtctcagaacgatgtgttcccgactgctatccatatttccacattgaagctcttagaaaaactgctgaaaacaatggaagatatgcatagtgtgtttaaacaaaaagcacaggagtttcactctgttattaaaatgggccggacacaccttcaagatgcggttccgatccgtcttggccaggaattcgaagcttacagccgtgttctcgagcgtgatatcaaacgaatcaagcaatcgcgccagcacctgtatgaagtcaacatgggcgcaactgctgttggtacagggctgaacgctgatcctgaatatatcaaacaggtagtaaagcaccttgctgatattagcgggcttcctcttgtcggcgctgatcatcttgttgatgcgacacaaaatacagatgcctatacagaggtatcagcttcattaaaagtctgcatgatgaacatgtcgaagatcgcaaacgacctgcgcttaatggcgtcgggaccgcgcgccggacttgcggaaatttctctgcctgcacgtcagccgggttcatctattatgccggggaaagtcaatccggttatggcggagctgatcaaccaaattgcgttccaggttatcggaaatgacaatacaatctgccttgcttcagaagccggccagcttgagttgaacgtcatggagcccgtgcttgtctttaatttgcttcaatccatcagcatcatgaacaacggcttccgttcgttcactgacaactgcttaaaaggcattgaagccaacgaaaagcgtatgaagcaatacgtagaaaaaagcgcaggcgtgatcacagctgtcaatccgcatcttgggtatgaagcggcagctagaattgccagggaagcaattatgacagggcaatctgtccgggatctttgtctgcagcatgatgtgctgactgaagaagaattggatattattttaaacccatatgagatgaccaaaccaggtatcgcagggaaagaactattagaaaaataa

SEQ ID NO: 46874 - DNA, 921 bp, Bacillus subtilis
atgagaaagcgcaaattgggtacatctgatttagacattagcgaagtcggactcggctgtatgtctcttggaactgaaaaaaacaaagcattgtccattctggatgaagcgatcgagcttggcatcaactatttggacacagcggatttgtatgaccggggacgcaatgaagaaattgtcggtgatgcgatccaaaacagacgccatgatattattctggcaacaaaagcgggaaaccgttgggatgacggaagcgagggctggtattgggacccttcaaaagcttacataaaagaggcggtaaaaaagagccttacacgtctgaaaacagattatatcgacctttatcagctccacggcggcacgatagaggacaacattgatgaaacgattgaagcgtttgaggaattaaaacaagaaggtgtcatccgctactacggcatttcttccatccgcccgaatgtgattaaagaatatgtaaaaaaatcaaacatcgtcagcattatgatgcaattcagcctgtttgacagacgccctgaggaatggctcccgcttttagaggaacatcaaatcagcgtagtcgccagaggtcctgttgccaaagggctcttaactgaaaaaccgcttgatcaagcttcagaaagtatgaaacaaaacgggtacttgtcctattcattcgaggaactgacaaatgcccgtaaggcaatggaggaagtggctcccgatctttccatgacagaaaagtcgctgcagtatctgctagcacagccggctgtcgcttcagtgattacaggcgccagtaagattgagcagttacgggaaaatattcaggcagcaaatgcacggcgtttaaccgaagaggaaatcaaagcgctccaatctcatacgaaacaagacatttacaaagctcatcgctcatag

SEQ ID NO: 46875 - DNA, 837 bp, Bacillus subtilis
atgaaaaagataggatttgtcggcgccgggtcaatggcagaagcaatgatcaacggcattttgcaaagcggcatcacaaaaccagaacatatctatattacaaatcgctcaaatgacgagcgtctgattgaattaaaggaaacgtacagcgtgcgtccatgcagagataaaaatgagtttttcactcacaccgatatcattatcctcgctttcaaaccgaaagacgcggcggaaagcatcgacagcatccggccgtatatcaaggaccagcttgtcatttcagtacttgcaggccttaccatcgaaaccattcagcattattttggcagaaagctcgcggtcattcgcgtcatgcctaatacatcagcggcaatcagaaaatcagcaaccggattttccgtaagcacggaagcaagcaagaatgatattattgccgcaaaagctctattggaaacaatcggtgatgcaacactggttgaggagcggcatcttgacgctgtcactgcaatcgcaggcagcggcccggcctatgtgtatcgttatattgaggcgatggaaaaagcagcacaaaaagtaggattagataaagaaacggcaaaagcactcattttgcagacaatggcaggggcaacagatatgctcctccaaagcggcaaacagccggaaaagctgcgtaaagaaatcaccagtcctgggggcactacagaggcaggtcttcgcgctttacaggactcccgctttgaagaagcaattattcactgtattgaagaaacagctaaacggagcgcagaaatcaaagaacagtttgccggtgccgccttagagagacattcttag

SEQ ID NO: 46876 - DNA, 1470 bp, Bacillus subtilis
gtgaaaacaaaccaacaaccaaaagcagtaattgtcatattcggtgcaactggagatttagcaaaacgaaaattgtatccgtctattcaccgtttatatcaaaacggacaaatcggagaagagtttgcagtggtaggagttggaagaagaccttggtctaatgaggatcttcgccaaactgttaaaacatccatttcctcatctgcagataagcatatagatgatttcacgtctcatttttactatcacccgtttgacgtgacaaaccctggttcttatcaagagctaaacgtattgcttaaccagctggaagatacatatcaaattcctaacaacagaatgttctacttggcaatggctcctgaattcttcggaacgattgcaaaaacattaaaatcagagggtgtaacagctacaaccggctggtcccgccttgtcatcgaaaaaccgttcggccatgatctgccaagcgcacaggcattgaataaagaaatccgcgaagcatttacggaagatcaaatttacagaatcgaccattatctaggcaaacaaatggttcagaacattgaagtgattcgatttgccaatgcgattttcgaaccgctttggacaaaccgctacatttcaaacattcaaatcacatctagcgaatcactaggcgttgaagaccgcgcaagatattacgaaaaatcaggcgcccttcgcgacatggtgcaaaaccatattatgcagatggttgcccttcttgcaatggagccgcctatcaaattgaacacagaagaaatccgcagcgagaaagtgaaggtgctgagagcactgcgtcctattgcaaaagacgaagtggatgaatactttgtgcgcggacaatatcatgctggtgaaattgacggtgtaccggttcctgcttatacagatgaagataatgtcgctcctgactccaatacagaaacctttgttgccggcaagctcttgatcgacaacttcagatgggctggtgttccattctacatcagaaccggaaaacgaatgagagaaaagtccacaaaaattgtcgttcaatttaaggacattccgatgaacctgtactacggtaatgaaaacaacatgaatccgaacttgcttgtcattcatattcagcctgacgaaggcattacgctttacttaaatgctaaaaagcttggcggagcagcacacgcacagccaatcaaactcgattattgcagcaattgcaatgacgagttgaacacccctgaagcatatgaaaaactaattcacgactgtcttcttggcgatgcaacaaactttgcacactgggatgaagttgccctttcttggagctttgtcgactctatttctgaaacatgggcagcaaacaaaaccttatctcctaactacgaatcaggctcaatgggaccgaaagaatctgatgatcttttggtgaaagacggcttacactggtggaacatataa

SEQ ID NO: 46877 - DNA, 1221 bp, Bacillus subtilis
ttggaaacaccgcgcaaaatcttattaatggttaaagcgggaactgcaacagatgcgacaattcaatctcttcttcctcatctagagaaggatgatattttaattgacggcggtaatacatactataaagatacacagcgccgtaacaaagaactcgctgaaagcggcattcattttatcggaacaggcgtttccggcggagaagaaggagcgcttaaaggaccttctatcatgcctggcggacaaaaagaagcacatgagcttgtaaaaccgattcttgaagccatttctgcaaaagttgacggagaaccttgtacgacatatatcggtccggacggcgccggccattacgtaaaaatggtgcacaacggaattgaatacggagatatgcagctgatctctgaatcatatttcattctgaaacaggtgctgggcctttctgctgatgagcttcatgaagttttcgctgaatggaataaaggtgagcttgatagctacctgattgagattacggctgacatcttcacaaaaaaagacgaagaaacaggcaaaccgcttgttgatgtgattcttgataaagcaggccaaaaaggaacaggaaaatggacaagccaaagcgcacttgacttaggcgttccgcttccgattattactgaatctgtattcgcacgctttatctcagctatgaaggaagagcgtgtaaaagcgagcggacttctttcaggaccagaagtgaagcctgttacagaaaataaagaagagctgattgaagcggtcagaaaagcgttgttcatgagtaaaatctgttcatacgcgcaaggatttgcccaaatgaaagctgcttctgaagaatacaactgggatctgaaatatggtgaaatcgctatgatcttccgcggtggttgcatcattcgcgcggcattccttcagaagatcaaagaagcttacgatcgcgagcctgagcttgacaacctgcttcttgacagctatttcaagaatattgtagaaagctatcaaggagcgcttcgccaagtgatttcacttgcagttgcccaaggtgtgccggtgccatcattctcaagcgcattagcctactatgacagctaccgcacagccgtactgcctgcaaacttaatccaagcacagcgcgactactttggcgctcatacttatgagcgtactgacaaagaaggcatcttccatactgaatggatgaagtaa

SEQ ID NO: 46878 - DNA, 1275 bp, Bacillus subtilis
atggcaattgaacaaatgacgatgccgcagcttggagaaagcgtaacagaggggacgatcagcaaatggcttgtcgcccccggtgataaagtgaacaaatacgatccgatcgcggaagtcatgacagataaggtaaatgcagaggttccgtcttcttttactggtacgataacagagcttgtgggagaagaaggccaaaccctgcaagtcggagaaatgatttgcaaaattgaaacagaaggcgcgaatccggctgaacaaaaacaagaacagccagcagcatcagaagccgctgagaaccctgttgcaaaaagtgctggagcagccgatcagcccaataaaaagcgctactcgccagctgttctccgtttggccggagagcacggcattgacctcgatcaagtgacaggaactggtgccggcgggcgcatcacacgaaaagatattcagcgcttaattgaaacaggcggcgtgcaagaacagaatcctgaggagctgaaaacagcagctcctgcaccgaagtctgcatcaaaacctgagccaaaagaagagacgtcatatcctgcgtctgcagccggtgataaagaaatccctgtcacaggtgtaagaaaagcaattgcttccaatatgaagcgaagcaaaacagaaattccgcatgcttggacgatgatggaagtcgacgtcacaaatatggttgcatatcgcaacagtataaaagattcttttaagaagacagaaggctttaatttaacgttcttcgccttttttgtaaaagcggtcgctcaggcgttaaaagaattcccgcaaatgaatagcatgtgggcgggggacaaaattattcagaaaaaggatatcaatatttcaattgcagttgccacagaggattctttatttgttccggtgattaaaaacgctgatgaaaaaacaattaaaggcattgcgaaagacattaccggcctagctaaaaaagtaagagacggaaaactcactgcagatgacatgcagggaggcacgtttaccgtcaacaacacaggttcgttcgggtctgttcagtcgatgggcattatcaactaccctcaggctgcgattcttcaagtagaatccatcgtcaaacgcccggttgtcatggacaatggcatgattgctgtcagagacatggttaatctgtgcctgtcattagatcacagagtgcttgacggtctcgtgtgcggacgattcctcggacgagtgaaacaaattttagaatcgattgacgagaagacatctgtttactaa

SEQ ID NO: 46879 - DNA, 984 bp, Bacillus subtilis
atgtcagtaatgtcatatattgatgcaatcaatttggcgatgaaagaagaaatggaacgagattctcgcgttttcgtccttggggaagatgtaggaagaaaaggcggtgtgtttaaagcgacagcgggactctatgaacaatttggggaagagcgcgttatggatacgccgcttgctgaatctgcaatcgcaggagtcggtatcggagcggcaatgtacggaatgagaccgattgctgaaatgcagtttgctgatttcattatgccggcagtcaaccaaattatttctgaagcggctaaaatccgctaccgcagcaacaatgactggagctgtccgattgtcgtcagagcgccatacggcggaggcgtgcacggagccctgtatcattctcaatcagtcgaagcaattttcgccaaccagcccggactgaaaattgtcatgccatcaacaccatatgacgcgaaagggctcttaaaagccgcagttcgtgacgaagaccccgtgctgttttttgagcacaagcgggcataccgtctgataaagggcgaggttccggctgatgattatgtcctgccaatcggcaaggcggacgtaaaaagggaaggcgacgacatcacagtgatcacatacggcctgtgtgtccacttcgccttacaagctgcagaacgtctcgaaaaagatggcatttcagcgcatgtggtggatttaagaacagtttacccgcttgataaagaagccatcatcgaagctgcgtccaaaactggaaaggttcttttggtcacagaagatacaaaagaaggcagcatcatgagcgaagtagccgcaattatatccgagcattgtctgttcgacttagacgcgccgatcaaacggcttgcaggtcctgatattccggctatgccttatgcgccgacaatggaaaaatactttatggtcaaccctgataaagtggaagcggcgatgagagaattagcggagttttaa

SEQ ID NO: 46880 - DNA, 993 bp, Bacillus subtilis
atgagtacaaaccgacatcaagcactagggctgactgatcaggaagccgttgatatgtatagaaccatgctgttagcaagaaaaatcgatgaaagaatgtggctgttaaaccgttctggcaaaattccatttgtaatctcttgtcaaggacaggaagcagcacaggtaggagcggctttcgcacttgaccgtgaaatggattatgtattgccgtactacagagacatgggtgtcgtgctcgcgtttggcatgacagcaaaggacttaatgatgtccgggtttgcaaaagcagcagatccgaactcaggaggccgccagatgccgggacatttcggacaaaagaaaaaccgcattgtgacgggatcatctccggttacaacgcaagtgccgcacgcagtcggtattgcgcttgcgggacgtatggagaaaaaggatatcgcagcctttgttacattcggggaagggtcttcaaaccaaggcgatttccatgaaggggcaaactttgccgctgtccataagctgccggttattttcatgtgtgaaaacaacaaatacgcaatctcagtgccttacgataagcaagtcgcatgtgagaacatttccgaccgtgccataggctatgggatgcctggcgtaactgtgaatggaaatgatccgctggaagtttatcaagcggttaaagaagcacgcgaaagggcacgcagaggagaaggcccgacattaattgaaacgatttcttaccgccttacaccacattccagtgatgacgatgacagcagctacagaggccgtgaagaagtagaggaagcgaaaaaaagtgatcccctgcttacttatcaagcttacttaaaggaaacaggcctgctgtccgatgagatagaacaaaccatgctggatgaaattatggcaatcgtaaatgaagcgacggatgaagcggagaacgccccatatgcagctcctgagtcagcgcttgattatgtttatgcgaagtag

SEQ ID NO: 46881 - DNA, 1374 bp, Bacillus subtilis
atggcaactgagtatgacgtagtcattctgggcggcggtaccggcggttatgttgcggccatcagagccgctcagctcggcttaaaaacagccgttgtggaaaaggaaaaactcgggggaacatgtctgcataaaggctgtatcccgagtaaagcgctgcttagaagcgcagaggtataccggacagctcgtgaagccgatcaattcggagtggaaacggctggcgtgtccctcaactttgaaaaagtgcagcagcgtaagcaagccgttgttgataagcttgcagcgggtgtaaatcatttaatgaaaaaaggaaaaattgacgtgtacaccggatatggacgtatccttggaccgtcaatcttctctccgctgccgggaacaatttctgttgagcggggaaatggcgaagaaaatgacatgctgatcccgaaacaagtgatcattgcaacaggatcaagaccgagaatgcttccgggtcttgaagtggacggtaagtctgtactgacttcagatgaggcgctccaaatggaggagctgccacagtcaatcatcattgtcggcggaggggttatcggtatcgaatgggcgtctatgcttcatgattttggcgttaaggtaacggttattgaatacgcggatcgcatattgccgactgaagatctagagatttcaaaagaaatggaaagtcttcttaagaaaaaaggcatccagttcataacaggggcaaaagtgctgcctgacacaatgacaaaaacatcagacgatatcagcatacaagcggaaaaagacggagaaaccgttacctattctgctgagaaaatgcttgtttccatcggcagacaggcaaatatcgaaggcatcggcctagagaacaccgatattgttactgaaaatggcatgatttcagtcaatgaaagctgccaaacgaaggaatctcatatttatgcaatcggagacgtaatcggtggcctgcagttagctcacgttgcttcacatgagggaattattgctgttgagcattttgcaggtctcaatccgcatccgcttgatccgacgcttgtgccgaagtgcatttactcaagccctgaagctgccagtgtcggcttaaccgaagacgaagcaaaggcgaacgggcataatgtcaaaatcggcaagttcccatttatggcgattggaaaagcgcttgtatacggtgaaagcgacggttttgtcaaaatcgtggctgaccgagatacagatgatattctcggcgttcatatgattggcccgcatgtcaccgacatgatttctgaagcgggtcttgccaaagtgctggacgcaacaccgtgggaggtcgggcaaacgatttcacccgcatccaacgctttctga

SEQ ID NO: 46882 - DNA, 1119 bp, Bacillus subtilis
atggaggagaaacagcattattctccagggttggacggtgtgattgcggcagaaactcatatttcttatcttgacacgcagtccagccagattttgataagaggctatgatttaatagaactttctgaaacaaaaagctatctggagcttgtccatttattgctggagggcaggctgccagaagaaagtgaaatggaaacgctggaacgtaaaataaacagtgcctcaagcctgcctgctgatcatctccgtctgcttgagctgctccctgaggacactcatccaatggatggtctgcgtaccggcctgtcggcacttgctggctatgatcggcaaattgatgatcggtctccttccgcaaacaaagaacgcgcctatcagcttcttgggaaaatgcctgccctcactgctgccagctacaggatcattaataagaaagaaccgattcttccgcttcaaaccctatcctacagtgcgaattttctctacatgatgacagggaaattgccgtcttcattggaagaacagatttttgaccggtcgctcgtcctgtacagtgagcatgagatgccgaattcaacctttgcggccagggtcattgcatctacacattcagatctttatggggctttgactggggctgtcgcttccctgaaagggaatcttcacggaggagcaaacgaagctgtgatgtatttgcttttggaggcaaaaacgacatctgattttgagcagcttttgcaaacaaaactgaaaagaaaagaaaaaatcatgggcttcggccaccgggtgtatatgaaaaaaatggacccgagagcactcatgatgaaagaggcgctgcagcaattatgcgataaagccggtgaccatcgtttatatgagatgtgcgaagcgggtgagcggctgatggagaaggaaaaagggctttacccgaatttggattactatgctgccccagtgtattggatgctcggcataccgattcctttatatacgccgatctttttcagcgcgagaacgtccggtttatgcgcccatgtgatcgaacagcatgccaataatcggctcttccgtccccgtgtcagttacatgggcccgcgatatcaaacaaaatcatga

SEQ ID NO: 46883 - DNA, 1137 bp, Bacillus subtilis
ttgcatgtaacccaagagcaagtcatgatgcgaaaaatggtgcgtgattttgcacgaaaagaaattgctcccgctgcggaaatcatggagaaaacggacgaatttccctttcagctgatcaaaaaaatgggtaaacacggactgatgggaataccggtgccggaacaatacggcggtgctggagcggacgttgtttcttatattttggcaattcatgagatttctagaatcagcgcggctgtcggcgtgattctctccgttcatacctcagtcggcacgaatccgattctgtatttcggcaacgaagaacagaagatgaaatatataccaaatctcgcgtcaggagaccatttgggcgcatttgcactaacggagcctcactcggggtcggatgccgggagcctccgcacaacagcaatcaaaaagaacggcaaatacctattaaacggatcgaaaatattcataacgaatggcggagcagctgatatctatatcacatttgctttaacagctccagatcaaggcaggcacgggatttcggcttttattgttgaaaaaaacacacccggttttaccgttggaaaaaaagaaagaaagctggggctttatggctccaatactacggaactgatttttgataatgcagaagtgcctgaagccaatttgcttggcaaagagggggatggctttcacattgccatggcgaatttaaatgtcggccggatcggcattgcggcacaggccctcggaattgcagaggcggctcttgagcatgccgttgattatgcgaagcagcgagtgcaatttggaaggccgattgcagccaatcaaggcatatcatttaagctggctgatatggcgactagagctgaggcggcaagacatcttgtctaccacgctgcagaccttcataaccgcggcctaaactgtggaaaagaagcgtctatggctaaacaatttgcttccgatgcagccgtaaaggcgttagacgccgttcaaatttatgggggatatggctatatgaaggattatccagttgagcgcctgcttcgcgatgcaaaggtgacgcaaatttatgaagggacgaacgagattcaaagactgattatttccaagtatttgcttggcggaacctga

SEQ ID NO: 46884 - DNA, 735 bp, Bacillus subtilis
ttgaaacggctgaagaaacagctggcccgtgatgctgagaaaggaaaaaggaccgagacggaagtgaagagcgtaatcaaccgcatttcgatttctcaaacacttgaggaggcagagcatgcggacattgtgattgaggctatcgcagaaaacatggcggcaaaaactgagatgtttaaaacacttgatcgcatttgcccgcctcatacgattttggccagcaatacatcttccttgcctattacagaaatcgctgctgtaacaaaccggcctcaacgggttattggcatgcattttatgaatcccgtccctgtaatgaagctggtagaagtgattcgaggcttggctacatcagaagaaacggccttagatgttatggcattagcggaaaagatggggaaaacagcggtagaagtcaatgattttcctgggtttgtttccaaccgtgtgcttcttccaatgattaatgaagccatctattgcgtgtatgagggagtgcgaacggaggcaatagatgaagtgatgaagctgggcatgaatcatccgatgggtccgcttgcattagcggattttatcggactggatacgtgtttatcaattatggaagtccttcactcaggccttggcgattccaaataccgtccttgcccgctgctccgcaagtatgtcaaagcaggctggcttggcaaaaagagcggacgcggtttttatgactatgaggagaagacttcctga

SEQ ID NO: 46885 - DNA, 1182 bp, Bacillus subtilis
atgaggaaaacagtcattgtaagtgctgcaagaactccatttggcaaattcggcggagttttgaaagaggtgaaagctgctgagcttgggggcattgtgatgaaggaggcgctgcaacaggctggagtctctggagatgatgtagaaggaaacgtcatgggcatggttgtccaggccggctcagggcagataccttcccgtcaagctgcccgtctggcgggaatgccttggagtgtgccgtcagaaacactgaataaagtctgtgcttccggccttcgcgctgtcactttatgtgatcaaatgattcgggcgcaggatgcggacatacttgttgcgggggggatggaaagcatgagcaatattccgtatgccgttcccgccgggcgctggggagcacggatgggggacggcgagcttagggacttaatggtgtatgacggattaacgtgcgcatttgacgaggtgcacatggctgttcacggaaatacagctgccaaggaatatgcaatctcacgaagagagcaggacgaatgggcgttgagaagtcatgcaagggcagctaaggccgccgatgaagggaagtttcaggatgaaattgttcccgtcaactggatcggtcgaaaaggaaaaccaaacgttgttgataaagatgaagcgattcgccgtgacacaagtctggatcagctcgcaaaacttgctccgatttatgcaagtgacggttctatcacagccggcaatgctcctggagtcaatgacggagccggcgcgttcgtgctgatgtctgaggaaaaagctgctgagcttggcaaacggcctctggctacaattcttggtttttcaactacgggaatgccagcgcacgagctggcggcagcgccagggtttgctattaacaagctcctgaaaaagaatggtttaactgtccaagatattgacttgtttgaagtaaatgaagcttttgcttcagttgttttgacatgtgaaaaaatcgtaggtttcgatcttgaaaaagtaaatgtgaatggcggtgcgatcgcgctcggccacccgatcggcgcgagcggtgcgagaattctcatgacgcttgtttatgaattaaagcgacggggagggggtctgggcgttgccgctatttgcagcggggcagcacagggagacgccgtcttagtgcaggttcattaa

SEQ ID NO: 46886 - DNA, 1731 bp, Bacillus subtilis
ttgttagctgaactatcgattaaaaactttgccattattgaggaactgacggtttcttttgaacgcgggcttacggttttaacaggagaaaccggagccggcaaatccatcatcatagatgccatttctcttttagtcggaggccgcggatcatctgaatttgttagatatggggaagcaaaagccgaacttgaagggctgtttctgttggagagcggccatcctgttttaggcgtatgcgctgagcagggaatcgacgtttcagacgaaatgatcgtcatgagaagggatatcagcacgagcgggaaaagcgtttgccgtgtcaatggcaagcttgtcacgattgcttcactaagagagatcggcaggcttttattagatattcacgggcagcacgataaccagctgttaatggaagacgaaaatcatctccagcttttggacaagtttgccggggccgaagtggaaagcgcgctcaaaacgtatcaggaagggtaccagcggtatgtgaagctgctcaaaaagcttaagcagctttctgaaagcgaacaggaaatggcccattgtcttgatcttattcaatttcagctcgaagaaatcgaatcggcaaagcttgagcttaacgaagatgaacagctccaagaagagcgccagcaaatttcaaactttgagaagatatatgagtcgctgcaaaatgcatataacgcgcttcgcagtgagcagggcggattggactgggttggaatggcatcagcgcagcttgaagatatatctgatataaacgaaccgctgaaaaaaatgtctgaaagtgtttcgaactcctactatttgcttgaggatgccacatttcagatgagaaatatgctggatgagcttgaatttgatccggaacgcctgaactatattgagacgcgacttaatgaaatcaaacagctgaaacgaaaatacggtgccactgttgaagacattttggaatatgcttctaaaattgaagaagagattgaccaaattgaaaacagggacagccaccttcaaagcttgaaaaaggagcttgactccgtcggcaaagatgtcgcagtggaagcggcaaatgtgtcacaaatccgaaaaacatgggcgaaaaagctggctgatgagattcatcgggaattaaaaagcctgtacatggaaaaatcaacttttgatacggaatttaaggtcagaacagcgtcacgcaatgaagaggcgccgcttgtaaacggccagcccgttcagctgactgaacaagggattgacctggtgaagtttttaatttcaaccaatacaggcgagccgctgaaatccctttcgaaagtcgcttcaggtggagagctgtcacgggtgatgcttgccataaaaagcattttttcctcacaacaggatgtgacatcgatcatttttgacgaggttgataccggtgtaagcggcagggtcgcacaggcaattgctgagaagatccataaggtgtcaataggatcacaagtgctgtgcattacacacctgcctcaggtggctgccatggccgatacgcatctttatattgcgaaggagttaaaagacggcagaacgacgacacgtgtcaagccgctctctaagcaggaaaaggtagcggaaatcgagcgcagtattgcaggtgtcgaagtaaccgacttaacgaaacgccatgcgaaagaacttttaaaacaagcggatcaagtcaaaacaactgggtaa

SEQ ID NO: 46887 - DNA, 1902 bp, Bacillus subtilis
ttggatcttttatcaatacaggacccgtcgtttttaaaaaacatgtccattgatgaattagagaaattaagtgatgaaatccgtcagtttttaattacaagtttatccgcttccggcggccacatcggcccaaacttaggtgtcgtagagcttactgttgccctgcataaggaatttaacagcccgaaagacaaatttttatgggatgtaggccatcagtcgtatgtccataagctgctgacaggacgcggaaaagaatttgcgacgcttcgccagtacaaagggctttgcggatttccaaagcggagtgaaagcgagcacgatgtttgggaaaccgggcacagctcgacttctctttcaggcgcgatgggaatggcagctgcccgtgatattaaaggaacggatgaatatattattccgatcattggtgacggcgcgctgaccggcggtatggcgctcgaagcccttaaccacatcggcgacgagaaaaaagacatgattgtcatccttaatgataatgaaatgagtattgcgccaaacgtcggtgccattcactctatgctcggacggctccgcactgcggggaaataccagtgggtcaaagatgagcttgaatacttatttaaaaagattccggcagttgggggcaagcttgccgccacggcggaacgggtcaaagacagcctgaaatacatgctcgtctccggaatgtttttcgaggagctcggttttacgtatttgggcccagtggacggacattcttatcatgagctgattgagaatcttcaatacgccaaaaaaacgaaaggccctgttcttctgcacgtcattacgaaaaaagggaaggggtacaaaccggctgagaccgatacgattgggacatggcatggtaccggaccatataaaattaataccggtgactttgtaaagccgaaagccgcagctccttcgtggagcggtcttgtcagcggaactgtgcagcgaatggcgcgcgaggacggacgcattgtagccattacgccggctatgcctgtcggttcaaagcttgaaggcttcgcaaaggaattccctgaccggatgttcgacgtaggaatcgcagaacagcatgccgcaacaatggctgcagctatggcaatgcagggtatgaagccgtttttggcgatttactcaaccttcctgcaaagggcatatgaccaagttgttcatgacatctgccgccaaaacgctaatgtgtttattggaattgaccgtgctggactcgttggcgctgatggagagacacatcaaggcgtgtttgatattgcgtttatgcgccacattccaaacatggtcttaatgatgccgaaagacgaaaatgaaggccagcacatggttcatacagcacttagctatgacgaaggcccgatagcaatgcgttttccgcgcggaaacggactcggcgtaaaaatggatgaacagttgaaaacgattccgatcggtacgtgggaggtgctgcgtccagggaacgatgctgtcatcttaacattcggcacaacaatcgaaatggcgattgaagcagccgaagagctgcagaaagaaggcctttccgtgcgcgttgtgaatgcgcgttttattaagccgattgatgaaaagatgatgaagagtatcctaaaagaaggcttgccaattttaacaattgaagaagcggtcttagaaggcggtttcggaagctcgattttagaattcgctcatgatcaaggtgaatatcatactccgattgacagaatgggtatacctgatcggtttattgaacacggaagtgtaacagcgcttcttgaggaaattggactgacaaaacagcaggtggcaaatcgtattagattactgatgccaccaaagacacacaaaggaattggatcatga

SEQ ID NO: 46888 - DNA, 819 bp, Bacillus subtilis
gtgacaaataaattaacgagctttctggcggaccggaaaaaaacaattgaaaatcagctttctgtctatacagaaaagcttgatatgccggactcattaaagaaatctatgctatattctctacaggccggcggaaagcggttgcggcctctgattgtactggctgttttaaatgcatatggaaaaagcgaaaaagacggcattccggtgggctgtgctgtcgaaatgattcacacgtattcgttaattcatgatgatcttccatgcatggatgatgacgatttgcgccgcgggaagccgacaaaccataaagtgtttggtgaagcgacggcagtattagcgggtgacgggctgctcacagaaagctttaagctgattacctcccacgtgtcagacgaggtgtcagcagaaaagcgcctgcggcttgtgaatgaactgatttcagcggcaggcaccgaaggcatggtcggtgggcaagtagctgatatggaagcgggaaaccgacaagtcacgcttgaagagctcgaatccattcatgaacggaaaacttccaagctccttggcttttgtgtaatcgccggtgctattttggctgatgcgcctgaggaagacattgaaacactgcgtaccttcagcagccacattggaatcggatttcaaatcagagacgatattttagatttagaaggcagtgaagagaaaatcggcaaacgtgtcggctcggataccacaaatgacaaatcgacatacccgtcgcttctttcattggaaggggccaaacataaattggatgttcatataaaagaggcgaacgattga

SEQ ID NO: 46889 - DNA, 852 bp, Bacillus subtilis
atgactgcaacaatcatcgacggaaaagaaacggctagagaaaaacgcgaacaattggcaaaagaggtagaagagcttaaaaagcaaggcgtcactcccggactggcggttattttgattggagatgatcctgcttctcactcttacgtgcgaggaaagaaaaaagcggcagaaacaatgggaatgaatttcaagctcgatcaatttgacagcagcctcacagaagctgaactgctttccattattgatcaatataaccaagaccctgagtttcatggcattctcgttcagcttccgctcccagaccatatttctgaaaaagcggtgatcgaacgtatctcccctgataaagatgtagacggttttcatccgttaaacgtagggaaaatgctgcttggcgaagatacgtttcttccttgcacgcctcatggaattgttgagcttttgaagaaaaccaatattgacctttccggtaaagaggttgttgtagtcggccgaagcaacattgtcggcaaacctgtcggccagcttttattaaatgaaaacgcgacggttacttactgtcattcaagaacagaaaatattactgaacatacgaaaaaagcggacatcctggtggtggcagtcggcagagccaacttcatcagtgcagaccagatcaaagagggcgctgttgtcattgacgtcggcgttaaccgtctggaaaacggaaagctttgcggagacgttgaatttgaaggggcaaaggaaaaagcgtccttcataacgccggttccgggcggagtaggtccgatgaccatcacgatgcttgcgcataatactgttaaatctgcgaaacgtacgttatcatag

SEQ ID NO: 46890 - DNA, 1353 bp, Bacillus subtilis
atgattaaaaagctattgatcgccaacagaggagaaattgctgtcagaatcatcagagcctgcagagagctcggaattgagactgtcgctgtttattcagaagctgataaagatgcccttcatgttcaaatggccgatgaagctttttgtatcggaccgaaagcatcaaaagacagctatttaaacgttacaaatattgtgagtgttgcaaagctgactggcacggacgccattcatccgggatacggatttttagctgaaaatgctgatttcgctgaattatgtgaagaagtgaatgtcacgtttgtcggcccgagccctgacgccatttcaaaaatgggaacaaaagacgttgcgcgggaaacgatgaaacaggccggcgtgccaatcgtaccgggttcacagggaattatagaaaatgtggaagaagcggtttcgcttgctaatgaaattgggtatcctgtaattataaaagccaccgcaggcggaggcggaaaaggaattagggttgcccgcactgaagaggaactgattaatggcattaagattacacagcaggaagcggcaactgcatttcggaatccaggtgtatacatcgaaaaatacatagaagattttcgccacgttgagatccaagtgcttgctgataactacggaaatacgatccatttgggcgaacgcgactgctcgatccaaagacgcctgcaaaagcttttggaagaatcaccatctcctgcccttgattcagaaatcagggagcaaatgggagatgcagcggtaaaggctgccaaagcggttggctatacaggtgctggaacagttgaatttatctatgactacaatgaacagcgctattacttcatggaaatgaacacgagaatccaggtggagcacccagtcacagaaatggtgacgggaactgacctgatcaaggaacaaatcaaagtggcttcaggaatggaactgagcctcaagcaagaagatgttgaatttgaaggctgggccatcgaatgccgaatcaacgcagaaaacccaagcaaaaatttcatgccgtcacctggtgaaattaaaatgtacctgcctcctggcggtcttggtgtccgtgtcgattcagctgcgtaccctggctattccatcccaccgtactatgacagcatgattgcaaaggtaatcacatacggaaaaacgagagatgaagcgattgcccgcatgaagcgcgcattgagcgaattcgtcatcgaaggcattgagacaacaatccctttccatttaaaactgcttgaacacgaaacatttgtgagcggagagtttaataccaaatttttagaaacatatgatgtaatgggctcataa

SEQ ID NO: 46891 - DNA, 447 bp, Bacillus subtilis
gtgcctcattttttgattttgaacggaccgaatgttaaccggcttgggagtcgtgagcctgaagtattcggccgccagacactgaccgatattgaaacagatctttttcagtttgctgaagccttacatatccagctcactttcttccagtctaatcacgaaggtgatttgatagatgcgatacatgaggctgaggagcaatacagcgggattgtcctgaaccccggcgccctgagtcattacagctatgcgatcagggatgctgtttcaagcatcagtcttcctgtggtagaggtgcatttatcaaacttatacgccagggaagaattcaggcatcagtcggttatcgctcctgttgcgaaagggcagattgtcggtcttggagctgaaggctacaagcttgctgttcgctacttattaagccagcaagggggagaatcaagatga

SEQ ID NO: 46892 - DNA, 1317 bp, Bacillus subtilis
atgaaagaaacgaaatttgaactttatgaattgaaaccatttattatagatgcagtacatcgccttggtttttacgaaccgactgatatccagaaaaggctgattcctgcagtgttaaaaaaagaaagcgtcatcggccagtctcagacgggtactggaaagactcacgcttatttactgcctttattaaacaaaatcgatcctgctaaggatgtcgttcaggtagtcattacggctccgacaagagagcttgccaaccagatttatcaggaagcgcttaaaatcacgcagggtgaagaaggaagtcagattcgctcgaaatgttttatcggaggcactgataaacaaaaatcaattgataaattgaaaatacagccgcatcttgttgtcggtacacctggacggattgctgacttaatcaaagaacaggcgttaagtgttcataaagcggaatctcttgttattgatgaagcggatttaatgctggacatgggattccttgcagatgtagattacatcggttcccgcatgcctgaggatctgcaaatgcttgtgttctcagcgaccataccggaaaagctgaaaccattcttgaagaaatacatggaaaatccgaaatacgcccatgtggagccaaaacaggtgactgctgcgaaaatcgagcatatcctcattccttcgaaacatcgtgacaaggacaagctcctttttgacatcatgtcgcatctgaatccatacctggggattgtgtttgccaacacgaaaaatacggctgaccatattgcccagtatctgactggcaaaggcatgaaaatcggcttgctgcacggcggattaacaccacgtgagcggaaaaaagtcatgaagcagatcaatgatttggaattcacatatatcattgcaactgaccttgccgcaagaggtattgatattaaaggtgtcagccatgttatcaactatgagctgccggatgatctcgatttctatgttcaccgtgtgggcagaacggctcgtgccggctcatcaggacaagcgatgaccatttatgagcttactgatgaggatgcattagtaagacttgaaaaaatgggcatcgaatttgagtacttagagcttgaaaagggcgaatggaaaaaaggcgatgaccgtcagcgccgcaaaaaacgtaaaaaaacgccgaatgaagcggatgaaattgctcatcgtctcgtgaaaaagccgaagaaggttaagcctgggtataaaaagaaaatgagctatgagatggagaaaatcaagaaaaaacagagaagaaaccaatctaagaaaagaaagtag

SEQ ID NO: 46893 - DNA, 1119 bp, Bacillus subtilis
atgagtaagcgtgattactatgaagtgctgggagtaagtaagagcgcttcaaaggatgaaattaaaaaagcttatcggaagctgtcaaaaaaatatcatcctgatattaacaaagaagccggatcagatgaaaaatttaaagaggtaaaagaagcatacgaaacgctgtcagatgaccaaaaacgtgcgcattacgatcaatttggtcacactgaccctaaccaaggcttcggcggcggaggttttggcggcggcgatttcggcggttttggtttcgatgatattttctcaagtatattcggcggaggcacaagacgaagagatccaaaactccgcgccaggggtgctgatttacagtatacgatgaccctgtcgtttgaggatgcggctttcggtaaagaaacaaccatcgaaattccccgcgaggaaacgtgcgaaacatgtaaaggctcaggtgcgaaacctggaacaaatccagaaacatgctcccactgcggaggctccggccagttaaacgtggagcaaaatacaccgtttggaaaagtcgttaacagacgggtctgccaccactgtgaaggtacaggcaaaatcattaaaaacaaatgtgcggactgcggcggcaaaggaaaaatcaaaaaacgcaagaaaatcaatgtgacaattccagccggtgtagatgacgggcagcagcttcgtctctcgggacagggtgaaccaggaataaacggcggcctgccggatttatttgtcgtgttccatgtacgcgcacacgagttcttcgagcgtgacggcgatgatatttactgtgaaatgccgttaacgtttgctcaggctgctcttggagatgaggtagaagtgccgacgctgcatggaaaagtgaaaattccggccggtacacaaacaggaacgaaattcagattaagaggcaaaggcgttcaaaatgtcagaggctatggacagggtgaccagcatatcgtcgtccgcgtcgttacgccgacaaatctgactgataaacaaaaagacattatccgcgaatttgccgaagtcagcggaaacctgcctgacgaacaggaaatgagtttctttgacaaggtaaaacgcgcgtttaaaggcgattaa

SEQ ID NO: 46894 - DNA, 822 bp, Bacillus subtilis
ttgaagataggctttatcggcacaggaaatatgggtacgatccttatcgaatcatttattgaatcaaaagcggccgatccctcaaacatgacaatcacaaaccgcacaattgaaaaagcgttgcacataaaaaaccgctacaacagcataaacgttaccgaaagtctcgaaaagctcgtttctgaaaacgagatgatttttatttgtgttaagccgcttgatatatatcctttactggcaagagcgttaccttatttaagaaaagatcatattctcatttcaattacaagccccgttcaaaccgaacagctcgaacaatatgtgccgtgtcaagtggcgcgagtgatcccaagtattacgaacagagcgctggcaggtgtttctctcgtcactttcggcacaagctgcggcgaatctgcaaaagcgaaaatcaatgagctgatgcagcatatctctcatccgctgcaaattgaaagtgacatcacgagggttgcatcagacatcgtaagctgcggccccgcttttatgagctatctgattcagcggtttatagatgcagctgtttcggaaacatcagtgtctaaacaggacgcgattttgatgtgtaaggaaatgcttgtcggaatgggaaaactgttagaaaccgaattgtataccctgcctgcattacaggaaaaggtttgcgttaaaggcggtgtaacaggagaaggcattaaagcgctggaaagcggtgtgcaggatatgtttcaccgggtatttcaaaatactcatatgaagtacgaggaggatatttccgcagtgaaaaagcagtttcatgtgtag

SEQ ID NO: 46895 - DNA, 843 bp, Bacillus subtilis
atgaaaaagctgtacggggttatcggaaatcctattggccattctatgtcacctgatattcataacgcatcattgaaagacctcgggcttgacggacattatcatgccttcaaggtagaagagaatgatctggaggatgcggtaaaaggaataagagctctaggcgtacaaggaatcaatgtgactgttccgcacaaggtttccattatggattatttggatcatattgatgagagtgcaaaagtgctcggtgccgtaaacacggtcagaagagagggagataagcttgtcggatacaataccgatggggaaggcttcgtgaagtcattaatgaaggtattagacaagcccatctctgaactgtcattcttaatgatcggcgctggcggagcggcgagagccatttttacaacatttgtccgaaataccccgaaaaaatttgacatttgcaaccggacgttagaaaaagcaaagcggcttacagaagctactccctcgtttcacaataaagaagtattaagcataaaagaagcagaagaacgtcttgagcagtatgatgttatcatccatacaacgtctgtgggcatgtatccgaacgtggacgatgtgccgctttcattacagcgtgccgcgagcagtgccgtcgtatgtgatatcgtgtataatccaatacagacggcacttttaaaagaagcaagccaaaaaggcttgaaaacactcgatggtgtgggcatgtttgttgaacaggcagcattgtctttccaattgtggactggacaagagcctaatattgaaaaaatgagatctattgtaataggaaaattaggaggaacagaatgttaa

SEQ ID NO: 46896 - DNA, 894 bp, Bacillus subtilis
atgaaaatcggattaatcggcttagggaaaatgggcataaacataggaaagcaattcattgaccgcaatcatcaagtggttggatatgatgtaaatcaagcggctgttgatgaactgaaagcatacggggctgaggggacaacaaatcttaaagagttcatttctttattacacccgccgcgcatcctatgggttatggtaccgcatggcattgtcgatgctgttttgcgtgatgtatcacctttattaagtaaaggcgatatgattatcgaagctggaaactctcattataaagaatcaattcgccgctacaatcaaatgaaagaagcgggtatccattatctcgatgccggaacgtcgggcggaatggaaggcgcacggcatggagcctgttttatggtggggggcgatcatgaagcatgggagattgtggaaccgctttttcgtgatactgccgtcgaaaatggttatctatacgctggtgaagcgggaagcggacattttttaaaaatgatccataatggaattgagtatggaatgatggccgcgattggtgaaggattcgaagtgcttgaaaacagccaatttgattttgactacgagaaggttgccagagtgtggaatcatggttctgtcattcgttcttggcttatgggactgactgagcgagctttcgctaaggatgcgaaactggatcagatcaagggcattatgcattcctcaggtgaaggaaaatggacggtggaaaccgcgcttgatctgcagacggcaacgccggtcatcgccatgtcactaatgatgagataccgttctttaacagacgatacgtttacaggaaaggtggttgctgcgcttcgaaatgaatttggaggccatgcgacagaaaaaaagtaa

SEQ ID NO: 46897 - DNA, 834 bp, Bacillus subtilis
atgaaaatcagtatgcaaaaagcagatttttggaaaaaagcagcgatctcattacttgttttcaccatgttttttaccctgatgatgagcgaaacggtttttgcggcgggactgaataaagatcaaaagcgccgggcggaacagctgacaagtatctttgaaaacggcacaacggagatccaatatggatatgtagagcgattggatgacgggcgaggctatacatgcggacgggcaggctttacaacggctaccggggatgcattggaagtagtggaagtatacacaaaggcagttccgaataacaaactgaaaaagtatctgcctgaattgcgccgtctggccaaggaagaaagcgatgatacaagcaatctcaagggattcgcttctgcctggaagtcgcttgcaaatgataaggaatttcgcgccgctcaagacaaagtaaatgaccatttgtattatcagcctgccatgaaacgatcggataatgccggactaaaaacagcattggcaagagctgtgatgtacgatacggttattcagcatggcgatggtgatgaccctgactctttttatgccttgattaaacgtacgaacaaaaaagcgggcggatcacctaaagacggaatagacgagaagaagtggttgaataaattcttggacgtacgctatgacgatctgatgaatccggccaatcatgacacccgtgacgaatggagagaatcagttgcccgtgtggacgtgcttcgctctatcgccaaggagaacaactataatctaaacggaccgattcatgttcgttcaaacgagtacggtaattttgtaatcaaataa

SEQ ID NO: 46898 - DNA, 1050 bp, Bacillus subtilis
atgtgtaatcaacatcaaacccgtgtattaagcgtgtcacatgcaaaagccaaatttgaacaaacgacgattgagcgaagaggattacggccgcacgatgtcttaatcgatattaaattcagcggcatttgccattcagacattcatagcgcttttgatgaatggggcggtggcatcttcccaatggtgcctggacatgaaatagccggtgttgtaacagccgttggaacaaaagtcaccaagttggctgtcggggaccgcgttggtgtcggctgttttgttgactcttgcggagaatgcgaatactgtctcaacgcagaggaacaattctgcacgaagggtgttgttcaaacgtataactcagtagactacgacggaaaccccacttatggcgggtacagccaaaaaatcgttgtcactgacagatttgttgttcgcataccagatcgtttggaaatggatgttgccagtccgctgttgtgtgcaggtatcacaacgtattccccgctgaaacactggaatgttggccctggtaaaaaggttgcgattgtaggcgtaggtggccttggacatttggcaattcaatttgcacatgcgatgggtgcagaagtaaccgtcctgagccgttccatgaataagaaagaggaagctctggaactcggtgcaaatcattactatgcaacaagtgacccagccacattcactgcattggccgggcgttttgacgtgatcttaaatacggtatcggcaaatctcgatgtagatgcctatttatcaatgcttcgtatagacgggacacttgtaagcgttggagctcctgccaagccggacacatacagtgtgttttccctaatcatggggcgccgcagcattgcaggttctctagtcggcggaattcaagaaactcaagagatgctggatttcgcagctgagcatggcatcgaacctaaaatcgaagtcatcggagctgaccaagtggacgaggcatacgaacgtatcctccgaagcgatgtccgttatcgatttgtgattgatatttccacattgtaa

SEQ ID NO: 46899 - DNA, 2034 bp, Bacillus subtilis
atgaaaaagagactgattcaagtcatgatcatgttcaccctgctgttgactatggcattttcggcagatgcagccgattcaagctactatgatgaggattaccgtcctcaatatcacttcacaccggaggcaaactggatgaatgacccaaacggaatggtatattatgctggggaatatcacttgttctatcaataccatccatacgggcttcagtgggggcccatgcattgggggcatgccgtcagcaaagatttggttacatgggaacaccttcctgttgcgctgtatccggatgaaaaaggcacgatcttttctggaagcgcagttgtagataaaaataacacaagcggttttcaaacaggcaaagagaagccgcttgtggccatttatacacaggatcgggaaggccatcaagtgcaaagtattgcctatagcaacgacaaaggaagaacatggacgaagtacgctggcaaccctgtcattccaaacccgggtaaaaaagattttcgcgatccaaaagtcttttggtatgagaaagaaaaaaagtgggtgatggtgcttgcggccggtgaccgaatcctcatttatacatcaaaaaatctgaagcagtggacgtatgcaagtgaatttggacaggatcaaggaagccacgggggagtatgggaatgcccggatttatttgagcttccggtagacggcaatccgaatcaaaagaaatgggtcatgcaggtcagtgtcggaaacggagcggtctcgggaggatcaggcatgcaatattttgtaggggactttgatggaactcattttaaaaatgaaaacccgccaaacaaagttctctggacggattacggcagagacttttatgcggctgtatcctggtctgatattccatccacagacagccgccggctatggttagggtggatgagcaattggcaatatgcgaatgatgttccgacatccccatggagaagtgcaacgtccattccaagagagttaaaattgaaagcgtttaccgaaggggttagagtggtccaaacaccggtgaaagagctggaaaccattcgcggaacctctaagaagtggaagaatctgaccatatcgcctgcaagtcataatgtgttagcggggcaatctggagatgcctatgaaataaatgcagaatttaaagtaagccctggttcagctgctgaatttggttttaaggtccgaacaggtgaaaatcaatttacgaaggtcggctatgaccgaaggaacgccaaattgttcgttgaccggagcgagtcaggcaacgacacctttaatccggcctttaacaccggaaaagaaacagccccgttgaagccggtaaatgggaaggttaagttgcgcatttttgttgaccgctcctcggttgaagtatttgggaatgacggaaagcaggtcataacggatattattctcccagaccgatcaagcaaagggcttgaattatatgctgcaaatggcggtgtaaaggtaaaatctttaacgatacaccctttaaaaaaggtatggggaacgacaccttttatgtccaatatgactggctggacgactgtaaatggcacgtgggcagacacaattgaggggaaacaagggaggtcggacggcgattcctttatcttgtcttcagcatccgggtcagacttcacttatgaatctgatatcaccattaaggatggaaacggaagaggggcaggagcactaatgtttcgctctgacaaagatgccaaaaacggttaccttgccaatgtggatgcgaagcatgacctagtgaaattctttaaatttgagaacggtgctgcttctgtcattgctgaatacaaaacaccgatagacgttaataaaaagtatcatctgaaaacagaggccgagggcgatcgctttaaaatctatttagatgatcgtcttgtgattgatgcacatgattccgtattttcagaaggccaatttggcttgaatgtgtgggacgcgactgctgtctttcagaatgtaacgaaggagtcttaa

SEQ ID NO: 46900 - DNA, 1380 bp, Bacillus subtilis
ttgataggcaattctagcaaagacaattttggccagcaacagaaattgtctagaggccttaaaaacaggcatatacaattaatggcgattggaggtgcaatcggtacaggtttatttttaggttcaggtaaatccatccattttgcaggaccatccattttatttgcttacttgatcaccggcgtattttgctttttcattatccgttcgctcggagaactgctcttatcaaatgcgggataccactcttttgttgattttgtaagggactatttaggaaacatggcagcatttatcactgggtggacctactggttctgttggatttccctcgcgatggctgatttaacggcggtcggcatttatacgcaatattggcttcccgatgtgcctcaatggctgccgggtcttcttgcgcttattatcctgctgatcatgaaccttgccaccgttaaacttttcggagaattagaattttggtttgcattgatcaaagtcattgccatactggctctgatcgtaactggtattctcctgattgcgaaaggtttttccgcagcttccggccctgccagcctcaacaacctttggagccacggcggcatgttcccaaatggatggcatgggtttatcctatctttccaaatggtcgtcttcgctttcgtgggtattgaacttgttggactgacagcaggtgaaacagaaaatccccaaaaagtgatccctaaagccatcaatcaaattcctgtccggattttacttttttatgttggcgcacttttcgtgattatgtgtatctatccttggaatgtgttgaatccaaacgaaagcccatttgttcaggtcttctctgcagtaggcatcgttgtggctgccagtttgatcaattttgttgtattaacatcagccgcatcagctgcaaatagcgctttattcagcacaagccgaatggtctattcacttgcaaaggatcatcacgcacctggactattaaagaaattaacttcttctaacgtgccaagcaatgcgctcttcttttcatccatcgccattctgattggcgttagtctgaattatttaatgcccgagcaagtcttcacgctgattacaagtgtttcaacaatatgcttcatttttatttggggcatcacggtgatttgccatttgaaatatcgaaaaacaaggcagcatgaagcgaaagcaaacaaatttaaaatgcctttttacccattatccaactatttaacacttgcatttctcgcgttcattcttgtcatattggcactggcgaatgatacacgtattgctttgtttgtcaccccggtctggtttgttttattgattattttgtataaggtgcaaacccagcagaggacataa

SEQ ID NO: 46901 - DNA, 2943 bp, Bacillus subtilis
atgatggacgttaagtcgatcagtgtccgtgtagacggaacagaaattcaagcacgagcaggggccacaattttagatattttaaatgaaaacggaattgagtacccgcagatttgccacgtaccagaggttgacccgattcaaacttgtgatacttgcatagtagaggcaaacggcaagctggttcgttcatgcgcgacggttgcagaaaacgggatgtctattgatctttcaggaaatcgagtgaaagaagcgcaaaccgaagcgatggaccgccttcttgaaaatcatttgctgtattgtacagtttgcgataacaacaatggaaactgtacgctgcataatacagcggaaatgatggggatcgagcatcaaaaatacccatacacgccaaaagaagatccttcttgcgcggttgatatgtctcatcctttttaccgctatgatccaaaccaatgtattgcctgcggccagtgtgttgaggtctgtcaaaaccttcaggtaaatgaaacactctcaatcgactgggaacgcgaacgccctcgcgtcatttgggatgagggagttccgatcaatgaatcttcctgtgtcagctgcggtcagtgtgtaacagtatgtccatgtaatgcactgatggaaaaatcaatgctcgggcaggctggttttatgacaggcattaaagaggacgtcatggaaccgatgattgatctcgtgaaaaatgttgaaccggggtatggcagcatttttgccatttctgaagtcgaagcggcaatgcgtgaaacgagaacgaaaaaaacgaaaactgtatgtacgttctgcggtgtcggatgttcatttgaagtatggacaaaaggacgggatattttaaagatccagcctgtttctgatgctccggttaacgcaatttccacatgtgtcaaagggaaattcggctgggattttgtcaattcaaaagagcggatcacaaagcctttaatccgtaaaaacggagcctttgtggaatcttcttgggaagaagccctcgatcttgtcgcaagcagattaggatcaattaaagagcagtacggtaaaggctctgtagggtttatttcttcttctaaaattacgaatgaagaaaactacgtcattcaaaaactagcgcgtcaggtatttgaaacaaacaacgtcgataactgctcacgctactgccagtctcctgctacagacggattgttccgcactgtcggcatgggcggtgacgccggcacgattaaagatattgccaaagcaggcctggtcatcattgtcggtgccaatccggcggaaggacacccagtgctcgcaacacgcgtcaaacgggcacacaagctccacggtcaaaaactgattgttgctgacctgcgtaaaaatgagatggctgagcgatctgatctgttcatcagccctaaacaaggcacagaccaagtttggctgatggctgttacgaaatatatgatcgaccaaggctggcacgatcaggcgtttattgatgagaacgtcaattactttgaagattataaagaaacccttaaaacgtatacgcttgattatgcagaacgcatcacaggcctttcaaaagaaaacatcattcaaattgctgaaatgattcgtgatgctgacggcacttgtgtcctttggggaatgggtgtcacacaaaatacaggcggttctgatacatcagcagccatttcaaacctgcttctcgctacgggcaactatcgccgtccaggtgccggcgcttatcctctgcgcggacacaataacgtgcaaggcgcatgtgatatgggaacattgcctggctggctgccgggatatcagcatattacagatgacaaagcacgcgctaaatttgaagaggcatatggtgtcgagattgatggaaagcctggtttagataatattcaaatgcttcatgccattgaagaaggaaaaatgaaagctatgtatcttgtcggtgaggatatggcactggtcgattcaaacgcgaaccatgtgcatgatattttatcaagccttgatttcttcgtggtacaggacatcttcctgtcaagaacagctcaatatgctgatgtcgtcttgccggccactccttcacttgaaaaagacggaacatttaccaacacagaacgccgtgtccagcgattgtatcaggcgcttccgacgcttggtgacgcaaaaccggactggtggattattcaagaggtggcaaaccgtttaggagcgaattggaattacagccatccaagtgacattttctctgaaatggcgagtctttctcctctgtttgccaaagcaagctatgaggtgcttgaaggctggaacagcttcctatggggcagcttcacaggtgaaagcacaccgcttctgtatgaagacggatttaatttccctgacaaaaaagcccgctttgccctttctgattggaccgagccagcggcatttccggaggaatatgaccttcatatcaataacggccggatgctggagcatttccacgaaggaaacatgacaaataaatcgaaaggcatccaagcgaaagtgccgaatgtattcgttgagatctcacctgagcttgcacaagagcgaggtgtttgtgacggttcgcttgtacggctcgtttctccgttcggagcagtcaaattgaacgcgctgatcacagaccgggtacggaaaaatgaactctatttgccaatgaactcgacagacaaggagtcagcgattaacttcttgacgggccctgcagctgataaacggacgaacacgcctgcttataaacagacaaaggtccgcatggaagtgcttggcggctgtgaaacagcgccgcttccaaaaacaaatccgcgcaacaaaaaacggcatccgcaaaacggagtcgaagcagaaagaaaatggaaccgccctggctatgtacatctgactgattaa

SEQ ID NO: 46902 - DNA, 1140 bp, Bacillus subtilis
atgaagaaaaaaacattgatgatacatggcggaatcacaggtgatgagaaaacaggcgcagtttccgtgccgatttatcaagtaagcacgtacaagcagccgaaagcagggcagcatacaggctacgagtattcaagaacggccaatccgactcgaaccgctctcgaagcacttgtgacagaactggaaagcggggaagcaggctatgcgttcagctcaggaatggctgccattacagcggttatgatgctgtttaacagcggagatcatgtcgtgttgactgatgatgtgtacggcggaacatatcgcgtgatgacaaaggtgcttaaccgtcttggcattgaatcaacatttgttgatacgagcagcagggaagaagttgaaaaagcgattcgccctaatacaaaagcaatttatattgaaacaccgacaaacccgttgctcaaaatcaccgacctgacgctcatggctgatatcgcaaaaaaagcgggtgttctgcttatcgtagacaatacctttaatactccttattttcaacagccgcttactttaggcgctgatatcgtactgcacagtgcgacaaaatatcttggcggacacagtgatgtcgtcggaggtttagttgtgacagcttcgaaagagcttggagaagagctgcattttgtgcaaaactccacaggcggcgtgctcggccctcaagattcctggctgttaatgagaggaatcaaaacgttgggactcagaatggaagcgatcgatcaaaatgcgcggaaaatcgcaagctttcttgagaatcaccctgctgtccaaacgttatattaccctggttcttcaaatcatcccggacatgagcttgcaaaaacgcaaggagcgggcttcggcggcatgatctcctttgatattggcagtgaagaacgggttgatgcgtttttaggaaatctgaaactgtttaccattgctgaaagcctgggggcggttgaaagcttaatttctgttcctgcaagaatgacacatgcctctattccgagagaacgccggcttgagctcggcattacggacggcttgatcagaatttctgtaggaattgaagatgcggaagacttgttggaagatatcggccaagcgcttgaaaatatataa

SEQ ID NO: 46903 - DNA, 513 bp, Bacillus subtilis
atggatttaaaacaatacgtaacaattgtaccggattacccgaaagagggcgtgcaatttaaagatattacgacactgatggataaaggcgatgtataccgctatgccacagatcaaattgttgaatatgcgaaagaaaagcaaattgatttggtcgttggccctgaagcgcgcggctttattatcggctgtcccgttgcttacgcgcttggcgtaggttttgcgccggtccgcaaagaaggcaagttgcctcgtgaagtaatcaaagtggattatggcttggaatacggaaaagacgtattaacgatccacaaagatgcgattaagcctggtcagcgtgtgcttattacagatgacctgcttgcgacaggcggcacaattgaagcgacaatcaaacttgttgaagaacttggcggcgttgttgctggtatcgctttcttaatcgagctttcttaccttgacggcagaaataagctcgaagattacgacatcttaacattgatgaaatactaa

SEQ ID NO: 46904 - DNA, 1596 bp, Bacillus subtilis
atgtctaaaaagacgattgcagtcatcggttcaggggcggcggcactttccttagctgcagctttcccgccctcatacgaagtgactgttatcacaaaaaaaagcgtcaaaaacagcaattctgtctatgcacaaggcgggattgctgcggcctatgcaaaagatgactcgattgaagcccatctggaggatacgttatacgcagggtgcggccataataatctagctattgtagcagacgtattacatgatggaaaaatgatggttcaaagcctattggagcgtggatttccattcgaccgcaatgaacgaggcggtgtttgtcttggaagagaaggggcccactcatacaaccgcatatttcatgcaggcggagacgcaacaggcaggctgcttatcgattatttgctcaaacggatcaacagcaaaatcaagttaatcgagaatgaaacggcagcagatttgcttatagaggacggacgatgtatcggcgtcatgacaaaagacagcaaagggcggctcaaggtaaggcacgcagacgaagttgtgctggctgccggcggctgtggaaacctgtttcttcaccatacgaatgatctcactgtcacaggtgacggtctttctctggcttaccgggccggggcggaattaacggatttggagtttactcagtttcacccgacactgcttgtgaaaaatggtgtttcctacgggcttgtttcagaagctgtcagaggggaaggcggatgtttagtagacgaaaacggccgcaggattatggctgaacggcatcctttaggtgacctggctccaagagatattgtctcacgggttattcacgaagaaatggcaaaaggaaatcgcgtttatatagacttcagtgcgatttctgattttgaaacgcgtttccctaccatcaccgctatttgtgaaaaagcagggattgatatccacagcggaaaaattcctgttgctccgggaatgcatttcttaatgggaggtgtttcagttaatcgctggggagaaacgacagtgccggggctttatgcgattggcgagacagcatgctccggtttacatggagcaaaccggcttgcaagcaattctttattggaagcgctggtatttggaaaaagggcagcagagcatattatccaaaaaccggtttataacaggcaatatcaatcagggctagaaaccagtgtcttctacgaggtgccggatatagaggggcatgaactgcaaagcaaaatgacaagccacatgtctattctgcgggaacaaagcagtttgattgagcttagcatctggcttcatacgctgccttttcaggaagtaaatgtgaaggatatcacaattcggcagatggaactttctcatctatggcaaactgcaaagctgatgacgttttctgcgcttttgcgggaggaaagcagaggggctcacttccgcaccgattttcctcatgctgaggtgagctggcaaggaagacaaattgtccatacaaaaaaaggaacgaagatcagaaaaaacgaggggatttggaacaatgaatcatttacagctgaaaaaattactgaatcacttttttcttga

SEQ ID NO: 46905 - DNA, 1293 bp, Bacillus subtilis
ttgtttactgcatatcaagatgcgcgcagctggattcacgggaggctgaaattcggggtgaagcccggacttggtcgaatgaaacagctgatggcgcggttaggacatcctgaaaaaaaaatccgagcgttccacgtcgcaggaacaaacggtaaaggatcaactgtcgcttttatccgttctatgctgcaggaagccggatatacggttggaacatttacatcgccttatattattacgtttaatgaacggatcagcgtaaacgggataccgatttcagatgaggaatggacagcactcgtcaatcaaatgaaaccgcacgttgaagcccttgatcaaacggaatacggacagccgacagaatttgaaattatgacagcttgtgcatttttatattttgcagagtttcataaggtcgattttgttatttttgaaacaggtctgggcggtagattcgattctactaatgtggttgaaccgctcttaactgtgattacaagcatcggacacgatcatatgaacattttgggaaacaccattgaagaaattgcaggagaaaaggccggcattattaaagaaggtattccaatcgttacagcagttacccagccggaagctttacaggtcatccgccatgaagccgaacggcatgctgcgccgttccagtcattgcatgatgcatgtgttattttcaatgaagaggctctgcctgcaggagaacagttttcattcaaaacggaagagaaatgctatgaagatattcggacatctctgattggcacccatcaaagacaaaatgctgctttgtccattttggctgcggagtggctcaataaggagaatatcgcccatatcagtgacgaagcgttaaggagcgggcttgtgaaggctgcttggccgggacggttagagcttgttcaggaacatcctccggtatatttagacggtgcgcataacgaagaaggtgttgaaaagctggcggaaacgatgaagcagcgtttcgccaattcacgcatttctgtggtgtttagcgcgttaaaggacaaaccgtatcagaacatgattaaaagactggaaaccattgctcatgcgattcattttgcttcttttgatttcccgcgtgcttcccttgcaaaagatctctatgatgcaagtgaaatcagcaataaaagctggagtgaagatccagacgatgtaatcaaattcatagaaagtaaaaagggctcaaatgaaattgtgctgattaccggatctctttactttatttctgacattcgaaaaaggttgaaataa

SEQ ID NO: 46906 - DNA, 1293 bp, Bacillus subtilis
atgagaagctatgaaaaatcaaaaacggcttttaaagaagcgcaaaaactcatgccgggcggtgtgaacagtcccgttcgcgcatttaaatcggtagacatggacccgatttttatggagcgcggaaaaggctcgaaaatctttgatattgacgggaatgaatatattgactacgtcttgtcatgggggcctttaattttagggcatacaaatgaccgcgtcgtagaaagcctcaaaaaagtggctgaatacgggacaagctttggtgctccgactgaagtagaaaatgaactggctaagctcgtcattgatcgtgtgccatctgtagaaattgtacgaatggtaagctccggaacagaggctacaatgagtgccctccgtttggcaaggggctatacgggccgcaacaagattttaaaatttgagggctgctaccacggacacggcgattctctcttgattaaagctggttcaggtgttgccactctcggtctgcctgacagcccgggggtgcctgaaggcattgcgaaaaacaccatcaccgttccgtacaatgatttagaaagtgtaaagcttgctttccagcaattcggtgaagacattgcgggagtcattgtagagccagttgccggaaatatgggtgttgttccgccgcaagaaggtttccttcagggtctgcgtgatatcactgagcagtacggctccctgctgatttttgatgaagtgatgactggcttccgggtcgattataactgcgctcaaggctacttcggcgtaacgcctgatctgacttgtttaggaaaagtaatcgggggcggacttcctgtcggcgcttatggcggaaaggcagaaatcatggagcagatcgctccaagcggtccgatctatcaagctggtacattgtcaggcaacccgcttgcgatgacggctggcttagagacattgaaacagctgacacctgaatcctacaagaatttcatcaaaaaaggcgacagactggaagaaggaatttcaaaaaccgccggggctcatggcattccgcatacctttaaccgtgcaggttcgatgatcggtttcttctttacaaacgaaccagtcatcaattatgaaacagcgaaatcatctgatttgaagctgttcgcaagctattataaagggatggcaaatgaaggggtattccttccgccatcacaattcgaaggtcttttcctctcaacggcccatactgatgaagatattgaaaacacaatccaggcagctgagaaagtatttgctgagatcagccgcagataa

SEQ ID NO: 46907 - DNA, 975 bp, Bacillus subtilis
atgagtcaatcatttaatagacaccgccgcctgcggacatcaaaagcaatgagagaaatggtaaaggaaacacgtttgcatccatcagattttatatatccgatttttgtcgttgaagggctggaaggcaaaaaagctgttccgtcaatgcctgatgttcaccatgtatcattagatttattgaaggatgaagtagcggagctggtcaaactgggcattcaatctgttatcgtgttcggcatcccggaagaaaaagatgattgcggaacacaagcgtaccatgatcacggaattgtccaaaaagccatcacagaaattaaagaacacttccctgaaatggttgttgtcgctgacacgtgcctgtgcgaatatacagaccacggccattgcggacttgtcaaagacggagtcattctcaatgatgaatcgctggagcttttggcgcagacagctgtcagccaagcgaaagcaggtgcggatatcattgcgccatcaaacatgatggacggatttgttacagtgatcagagaagcacttgataaagaaggattcgtcaatattcccatcatgtcttacgctgttaaatattcaagtgagttttacggtccgttccgtgatgcagcaaacagcacaccgcaattcggagaccgcaaaacatatcagatggaccctgccaaccgtatggaggcactccgcgaagcacaatcagatgttgaggaaggcgcggactttttgattgtcaaaccttcgctttcttatatggatatcatgcgtgacgtaaaaaatgagtttactttgccgctcgtcgcttataatgtaagcggagagtattcaatggtgaaggctgcagcgcagaacggctggatcaaagaaaaagaaattgtgttggaaattttgacaagcatgaagcgcgcgggtgccgacctgattattacgtatcatgcgaaagacgcagcgaaatggcttgcggagtaa

SEQ ID NO: 46908 - DNA, 789 bp, Bacillus subtilis
atggaaaatgattttccgttgaaaggaaaaacagtgcttgtcacccggaataaggcacaggcagcatcatttcagcaaaaagtggaggcgcttggcggtaaagcggttttaacctctttgattacgtttcgccgcgctttgccgaatgatgttgcggaacaggtaagagaggatcttgccgcgccaggctggcttgtttttacaagtgtgaacggggcagacttctttttttcttatctgaaggaaaatcagcttattctccctgcgcataaaaaaattgcagccgtcggtgaaaaaaccgcgcgccgtttaaaaatgcataacgtatcggttgatgtgatgccacaggagtatattgctgaacaattggctgacgctcttaagcagcatgctgaaccgggggagaccattaccgtgatgaaagggaatttgtcacgtgatgtgataaaacaagagcttgtcccgctcggttttgaagtaaaggaatgggttctctacgaaacgattccggatgaagaaggcattgaggcattgaaagacgctgcgggtcaatattcctttgactatgtaacatttacgagttcatcaaccgtacatacgtttatgcatgtcttgggagaagaattaaaaaagtggaaggcgaatgggacggcctgtatcagcattgggcctttaacaaatgatgcccttctgacgtacggcatcacatcgcatacgcctgatacatttacaatagatggcatgcttgagttaatgtgcagcatgtcaagagaggaagagagaatatga

SEQ ID NO: 46909 - DNA, 945 bp, Bacillus subtilis
atgatgagaacgattaaagtaggttccagacggagcaaactcgctatgactcaaacaaaatgggttattcaaaaactgaaggaaatcaatccttcgtttgcttttgaaattaaagagatcgtgacaaagggcgaccggattgtcgatgttacactctcaaaagtgggtggaaaagggctttttgtcaaagaaattgaacaggcgcttttaaacgaagagattgatatggcagtgcacagcatgaaggacatgcctgctgttttgcctgaaggccttgtgatcggctgtattcctgaacgggaggacccgcgtgatgcccttatttcaaagaatcgcgtaaagctttcagaaatgaagaaaggtgctgtcattggcacaagcagtttaagaagaagcgcgcagcttttgattgagcgccctgaccttacaattaaatggattagaggtaatattgatacaagacttcaaaagctggaaacagaggattatgacgcaattattttagcggctgccggcctttccagaatgggttggaagcaagatgtcgtaaccgaattccttgagcctgagcgctgtttgcctgctgtggggcagggagccctggcgattgagtgccgagaatcggatgaagagctgttggcgttgttttctcagtttacagatgaatatacaaaacggactgtcttagcggaacgtgcttttttaaacgcgatggagggcggctgccaggttccgatcgcgggctactccgtgttaaatggacaggatgaaattgaaatgacaggtcttgtcgcttcacctgacggcaaaatcatttttaaagaaaccgtcaccggaaacgatccggaggaagtaggaaagcgctgtgccgctcttatggctgacaaaggagcaaaagatttaattgatcgtgtaaaacgggagcttgacgaggatggaaaatga

SEQ ID NO: 46910 - DNA, 1368 bp, Bacillus subtilis
atgcatatacttgttgtgggagtagattataaatccgcccctattgagatacgtgaaaaagtaagttttcagccgaatgagctggcagaagcaatggtgcagctgaaagaagagaaaagcattcttgaaaacatcattgtctcaacctgcaaccgcactgaaatttatgcggtagtcgaccagcttcataccggccgttattatataaaaaagtttttagctgattggtttcaattaagcaaagaagagctgtcaccgttcttaacgttttatgagagcgatgccgctgttgagcatttattccgtgtagcctgcggacttgattctatggtgattggcgaaacgcagattctcggacaggtacgcgacagctttaaaacagctcagcaagaaaaaacgatcgggactatttttaatgagctgtttaagcaggcagttacagtgggcaaacggactcacgccgaaacagacattggctcaaatgcggtgtcagtaagctatgctgcagttgaacttgccaaaaaaatcttcggaaatctttcaagcaagcacatattgattctcggtgcgggaaaaatgggcgagcttgctgcggaaaacctgcacggacagggaatcggcaaggtcactgtcattaaccgaacatacttgaaagcgaaggagcttgcagaccgtttttcaggtgaagcgagaagcttgaatcagcttgaaagcgcgcttgcggaggctgatattttaatcagttcaaccggtgcaagtgaatttgtcgtgtccaaagagatgatggaaaacgcgaataagcttcgcaagggacgtccgctgtttatggtcgacattgccgtgcctagagatcttgatccggcgctgaatgatcttgaaggtgtttttctttatgatatcgacgatctggaaggcattgtagaagcgaacatgaaagagcggagagaaacagctgaaaaagttgaactgttaattgaagaaaccattgtggaatttaaacaatggatgaatacacttggtgttgtgcctgttatttctgcattgcgcgaaaaggcgcttgccatccagtcagaaacgatggacagcattgagcgtaagctgcctcacttaagcacaagagagaaaaaactgttgaacaaacacaccaaaagtattattaaccaaatgcttcgtgatccgattttaaaggtgaaagagcttgcggcagatgctgattctgaagaaaagctcgcgttgtttatgcagatttttgatattgaagaagctgcgggccgtcaaatgatgaaaaccgttgaaagcagccagaaggtccactcttttaagaaggctgaatcaaaagcgggctttagcccacttgtaagtgagtga

SEQ ID NO: 46911 - DNA, 2325 bp, Bacillus subtilis
atggcagaagaattaaaacgcagcatcccgctcctccctttaagaggtttattagtgtacccgacgatggttttgcatttagatgtaggacgtgacaagtcggttcaggctcttgaacaggcaatgatgcatgatcatatgatatttttagccactcagcaggatatttcgatagacgaacctggtgaagacgagattttcactgtcggcacctatacaaaaattaagcaaatgctgaagcttccgaacggtacgattcgtgtgttggtggagggcctcaagcgcgcccatatcgtcaaatacaatgaacacgaggattacacgtcggttgacattcaacttattcatgaagatgattcaaaagatacagaagacgaagcattgatgcggactttgctagaccactttgatcagtacataaaaatttctaaaaaaatctcggccgaaacgtacgctgcggttactgatatcgaagagccggggagaatggcagacatcgttgcttctcatctgccccttaaactaaaggataagcaggatattttagaaacggctgatgtcaaagacaggctgaacaaggtcattgattttattaataatgaaaaagaagtgctggagattgagaaaaaaatcggccagcgcgtcaaacgttcgatggagcgtacgcagaaggaatactacttgcgtgaacaaatgaaggcgatccaaaaagagcttggcgataaagaaggcaaaactggcgaagttcagacgctgacggaaaaaatcgaagaagcaggcatgcctgatcatgtgaaagaaacagcgcttaaagaattgaacagatatgaaaaaattccgtcaagttctgcggaaagctctgtgatccgcaactatatcgactggctggttgctcttccgtggacggatgaaacagatgataagcttgatttgaaagaagcaggacgtctcttggacgaagagcaccacgggcttgaaaaagtaaaagaacgtattttagaatatttggctgtccagaagctgacaaaatccctgaaaggcccgattctctgtttggcaggacctccaggtgtcggaaaaacgtctttagccaaatcaattgcaaaaagcttgggacgcaaattcgtcagaatctcactcggaggagttcgggatgaatcagagatacgcggacacagacggacctatgtcggagcaatgcctggacgtattattcaagggatgaaaaaagcgggcaagctgaatccggtcttcttattagacgaaattgacaaaatgtcatctgattttagaggagacccatcatccgctatgcttgaagtgcttgatccagagcaaaacagcagcttcagtgatcactatattgaagaaacctttgatttatccaaagtgctgtttatcgcaacggcgaacaatttggccacaatcccgggcccgctcagagacagaatggaaattattaatatcgcaggctacacagaaatagaaaaacttgaaattgtaaaggatcacttgcttccaaagcaaatcaaagaacacgggctgaagaaaagcaatcttcagctgcgtgatcaggcgattcttgatattattcgttactatacgagagaagcgggtgtaagaagccttgaacgccagcttgccgcaatttgccgtaaagctgcaaaagccattgttgctgaagagcgaaaacgaattacggttactgagaagaaccttcaagattttatcggaaaacgcattttcagatatggacaagctgaaacagaggatcaagttggtgtagtgacagggcttgcgtatacaaccgttggcggagatacgctttcgattgaagtatcgctttcaccgggaaaagggaaattaatcctgacaggaaagctcggagatgttatgagagagtctgctcaggctgcattcagctatgtgcgatccaaaacagaagaacttggcattgaacctgactttcatgagaagtatgatattcatatacatgtaccagagggtgcggtgccaaaagatggtccgtcagccggtattacgatggcaacagcgcttgtttctgctttaacgggacgggcggtttcgcgtgaagtcggcatgactggggaaatcacgcttcgcgggcgcgtgctgccgatcggcggcttaaaggaaaaagcgcttggcgcacatagagcgggattaacgaccattattgcgcctaaagataatgaaaaagatatagaggatattccggaaagcgtcagggaggggctgacatttatattggcgtcccacttagacgaggttttggaacatgccttagtaggagagaagaaatga

SEQ ID NO: 46912 - DNA, 1098 bp, Bacillus subtilis
ttgaagaaacgtattgctctattgcccggagacgggatcggccctgaagtattagaatcagcgacagacgtactgaaaagtgttgccgaacgctttaaccatgaatttgaatttgaatatggcctgattggaggggcggctattgatgaacatcataaccccctcccggaggaaaccgttgctgcttgtaaaaatgcagacgcgatattgcttggtgctgtcggcggaccgaaatgggatcaaaacctttcggaactgagaccggaaaaagggctgctcagcatcagaaaacagcttgatttgtttgcgaatttgcggcctgtgaaggtatttgaaagcctttctgaccgttcgcctttgaaaaaagaatatatagataatgttgatttcgttatcgttcgtgagctcacaggcggcttgtatttcggccagccgagcaaacgttatgtaaacactgaaggtgagcaggaagcagtagatacactgttttataagcgaacggaaattgaacgagtgatcagagagggcttcaaaatggcggcagccagaaaaggcaaagtgacctctgtagataaagcgaatgttcttgaatcaagccggctgtggcgtgaagtggctgaggacgttgcacaagaatttcctgatgtgaagcttgagcacatgcttgtggataacgcggccatgcagctaatttatgcaccgaatcaatttgatgtcgtggtgactgaaaatatgttcggtgatattttaagcgatgaagcgtccatgcttacaggctcgctcggaatgctcccgtcagccagcctatcaagctctggccttcatctgtttgaacctgttcatggctccgcgcctgatattgccggtaaagggatggcaaatccgttcgcagccatattgtcagcggcaatgcttttgagaacatctttcgggcttgaagaggaagcgaaagctgtagaagatgcggtaaacaaagtcttggcttctggaaaaagaacaagagacttggcacggagtgaagagttcagcagcactcaggccattacagaggaagttaaggcagcaatcatgagtgaaaatacaatttctaatgtgtga

SEQ ID NO: 46913 - DNA, 762 bp, Bacillus subtilis
atgagtgaacaaaaaaccatacgatttattatcacacgtcaagatacagctgacagcacgccttatgatgaagaatttgagattccataccgcccgaatctgaacgtcatttccgctctgatggaaatccgccggaatccggttaatgtcaaaggtgagaagacaacccctgtcacatgggatatgaactgtcttgaggaagtatgcggcgcatgttcaatggttataaacggaaaaccccgccagtcttgtacggcgcttattgaccagcttgaacagccaatccgtttaaaaccaatgaaaacattcccagtcgttcgtgatttgcaggttgatcgcagcagaatgtttgattcattgaaaaaagtaaaagcgtggataccgattgacggtacgtacgatttaggaccggggccgagaatgccggaaaaacgtcgtcaatgggcatatgaattatcaaaatgcatgacatgcggcgtctgcctcgaagcttgcccgaatgtgaacagcaaatcgaagttcatggggcctgcaccgatgtcgcaagtccgcctgtttaacgcgcatccgacaggcgccatgaataaatctgaacgattagaagcattaatggatgaaggcggccttgcagattgcggcaactcgcaaaactgtgttcaatcctgtccgaaggggattccgcttaccacttcgattgcagccttgaatagagatacaaacttacaagcgttccgcaatttcttcggaagcgacagagtataa

SEQ ID NO: 46914 - DNA, 1761 bp, Bacillus subtilis
atgagtcaatcaagcattatcgtagtcggcgggggtcttgccggcctcatggcgacaattaaagcagcggaatcaggaatggcggttaaattgttttccatcgttcctgtcaaacgttctcattcagtttgtgcgcaaggcggcataaacggagcggtcaatacaaaaggggaaggtgactctccgtgggaacattttgatgacacggtatacgggggagactttcttgccaaccagccgccgctcaaggcgatgtgtgaagcggcgccttcgatcatccacttattagaccggatggccgtcatgtttaaccggacgcctgaaggcctgcttgatttccgccgattcgggggtacacagcaccacagaactgcttatgctggtgcgacgacgggacagcagctgctttacgcactggacgagcaagtgcgcagatacgaagttgcgggtctggtcacaaaatacgaaggctgggaattccttggcgctgttttagatgatgacagaacctgccgcggaattgttgcacaaaacctgacaaacatgcaaattgaatccttccgttcagacgctgtcattatggcgacgggcggaccgggaatcatctttggaaaatcaacgaactccatgattaatacaggatctgctgcgtcaatcgtttatcagcagggagcgtattatgcaaacggagaattcattcaaatccacccgacagccataccgggcgatgacaaactaagactgatgagtgaatcagcgcgtggtgaaggcgggcgcgtgtggacatataaagacggcaaaccatggtatttcctggaggaaaaatatccggcatacggaaacctggtgccgcgtgatattgcgacacgcgaaatatttgatgtgtgtgtgaaccagaagctcggtattaacggtgaaaacatggtatatctcgatctgtctcataaagatccgaaagagcttgatattaagcttggcggcatcattgagatttatgagaaattcatgggagacgacccgcgtaagcttccaatgaaaatcttcccggcggtccattattctatgggcggtttatgggtggattacgatcaaatgacaaatatccctggactgtttgcggctggggaatgtgattattctatgcacggcggcaaccgcttggagcgaacatccctgctgtctgcgatttacggaggcatggtggccggtccgaatgcggtgaaatatgtaaacggcttagaatcttcagcggaagacatgtcttcatctttattcgacgctcacgttaagaaagaagaagaaaaatgggctgatattatgattatggacggaaccgaaaatgcctatgttcttcacaaagagctcggtgagtggatgacggcaaacgtaacggttgtccgccataatgacaagcttttgaaaacggatgacaaaattcaggagttaatggagcgcttcaaaaagatcaacatcaatgacacgacaaaatggagcaaccagggagcgatgttcacacgccagttctcgaacatgcttcagcttgcgagggtgattacccttggcgcatacaaccgtaatgaaagccggggcgcccattataaaccggattatcctgaacgtaatgatgatgaatggctcaaaacaacaatggctaaacatgtaagcccgtatgaagcgccggaatttgagtatcaggatgtcgatgtatcactgataacgcctcggaaacgggattactcgaagaagaaggtggcgaaataa

SEQ ID NO: 46915 - DNA, 1227 bp, Bacillus subtilis
atgggtcttattgtacaaaaattcggaggcacttccgtcggctcagtcgaaaaaattcaaaatgcggcaaaccgcgcaattgcagaaaaacagaaaggccatcaagtcgttgtcgtcgtttcagcaatgggaaaatccactgacgaattggtcagccttgcaaaagctatttctgaccagccgagcaaacgcgaaatggatatgctgctggcgacaggcgagcaggtcacgatttcactcctttcaatggcattgcaggaaaaaggctatgacgctgtgtcttatactggctggcaggcgggaatccgtacggaggccattcacggaaacgccagaattacagatatcgacacttcggttttagcagaccagcttgaaaaaggaaaaattgtcattgttgcaggattccaaggcatgacagaggattgtgaaattacgacattgggccggggcggttcagatacaacagcagttgctttggctgccgctttaaaagctgataaatgtgacatatacacagacgtgccaggcgtgtttacaaccgatccgcgctatgtgaaatcagcgagaaaacttgagggcatctcatacgatgaaatgcttgagcttgccaatttaggcgccggtgttcttcatccgagagcagttgagttcgcgaaaaattaccaagtgccgttagaagtgcgttcaagtacagaaaccgaagcgggaacattaattgaggaggaatcatccatggaacagaatttaattgtcagaggcattgcatttgaagatcaaatcacaagagtaaccatttacgggctgactagcggcctgacaactttgtctactatttttacaacacttgccaaaagaaacataaacgtggatatcattatccaaacgcaggccgaggacaagactggaatttccttctctgtcaaaacagaagatgcagaccaaaccgttgcggtgcttgaagagtataaagacgcgctggaatttgagaaaatcgagacagaaagcaaattggctaaagtatctattgttggatccggcatggtctcaaatcccggtgtagcggctgaaatgtttgctgtactggcgcaaaaaaacattttaatcaaaatggtcagcacatctgaaatcaaagtgtcaacagtcgtaagcgaaaatgacatggtgaaagcagtcgagtcgcttcacgatgcatttgagctttcaaaacacccttcagctgtgtaa

SEQ ID NO: 46916 - DNA, 1488 bp, Bacillus subtilis
atgtctgaacatcaagcagtgattcaaacagatatcgcaaaaggaaccattaacaaaaatatatacggtcattttgctgagcatttaggaagagggatttatgaggggatctgggtcggaacggactcagacatccccaatatcaacgggatacgaaaggacgtgctggaggcgctcaaacagctgcacattcctgtccttaggtggccgggcgggtgttttgcggacgaataccattgggcaaacggtgtcggtgaccgtaagacaatgctgaacactcactggggcggtacaattgaatcaaatgaattcggaacgcatgaatttatgatgctttgcgagctgcttgaatgcgagccatatatttgcggcaatgtcggaagcggaaccgttcaggaaatgtcggagtggattgagtatatgacatttgaagaaggcacgccgatgtcagactggagaaagcaaaatggaagagaagagccttggaagctgaaatatttcggcgtgggcaatgaaaactggggctgcggcggcaacatgcatcccgaatactacgcagatctgtaccggcgttttcagacttatgtccgcaattacagcgggaatgacatttataaaattgcaggcggcgcaaatgtggatgattttaattggacggacgtgcttatgaaaaaagccgctggcctgatggacgggttgagtcttcattattacacgattccgggggatttctggaagggcaaaggatcagccacagaattcacggaagatgaatggtttattacgatgaaaaaagccaaatacatcgatgaattgattcaaaaacacggcacgattatggaccggtacgatccggagcagcgggtcgggctgattattgatgaatggggcacgtggtttgatcccgagccaggcacgaatcccggtttcttatatcagcaaaacaccattcgtgatgcactggtggcggcttctcatttccacattttccatcagcattgccgccgggtgcaaatggccaacatcgcccaaacagtaaatgttcttcaagcgatgattttgactgagggagagcggatgcttttgacaccgacgtaccatgtattcaatatgtttaaggtgcaccaggacgcttctcttttagccacagagacaatgtctgccgactatgaatggaacggtgaaacgtttccgcaaatcagcatttcagcgtcgaaacaagctgaaggcgatatcaatatcacaatttgcaacatcgatcaccaaaacaaagcagaggcggaaatcgagctgaggggcctacacaaggcagcggaccattccggagtcattcttacggcagaaaaaatgaatgcgcataacacgtttgacgatcctcatcatgtcaaaccggaatccttcagacaatacacgctcagcaaaaacaaactgaaagtaaaactcccgccaatgtcagtcgtcttacttacgctgcgtgctgattcttaa

SEQ ID NO: 46917 - DNA, 1683 bp, Bacillus subtilis
atgcagtctcaaaagccgtggcttgccgagtatcccaacgatatcccgcatgagcttccgttgccgaataaaaccctgcaatccatcctgacagactccgccgcacgattccctgataaaaccgcaatatcgttttatggaaaaaaactcacctttcatgacattctgacggatgctcttaaacttgcagcttttttgcagtgcaatggcctgcaaaaaggagacagagtggctgttatgctgcccaattgcccgcaaacagtgatttcttattatggcgtcttgtttgccggtggcatcgtggtgcagacgaatccgctttataccgagcatgagcttgaataccagcttagagatgctcaggtaagtgtaatcatcaccttagatttgcttttcccgaaggcaataaaaatgaaaacgttatcaatagtcgaccagattttgataaccagtgtaaaagactatttgccttttccgaaaaatattctttacccgctgacgcaaaaacaaaaagtgcatatcgactttgacaaaacagctaacattcacacgttcgcttcctgtatgaagcaggaaaaaactgaactcctgacaatcccgaagatcgatcctgagcatgatatcgctgtcctccagtataccggaggaacaaccggagctccaaaaggggtcatgctcacgcaccaaaatattttggcaaatactgaaatgtgcgccgcttggatgtatgacgtgaaagaaggcgctgaaaaagtgctgggcatcgttccattttttcatgtctacggactgacggcagtcatgaactattcgattaaactaggcttcgaaatgattcttcttcctaagtttgatccgctcgaaacacttaaaatcatcgacaaacacaaaccgacgctctttcctggcgcaccgacaatttacattggccttttgcatcaccctgaattgcagcattatgatctgtcatccattaaaagctgtcttagcggatcagccgcgctccccgtggaggtaaagcagaaatttgaaaaggtgactggtggaaagcttgtggaaggctatggtttgtctgaggcatccccagtgacgcacgccaactttatctggggaaaaaacaagccgggcagtatcggctgtccttggccgagtacggacgctgcgatctattctgaagagacgggtgagcttgccgctccgtatgagcatggagaaatcattgtaaaaggtccgcaagtcatgaaaggatactggaataaaccagaggaaaccgccgcagtgctgagagatggctggctgttcaccggggacatgggctatatggatgaagaaggctttttctatattgctgacaggaagaaggatatcatcattgccggcggttacaatatttacccgcgtgaggtagaagaagcgctttatgaacatgaagccatccaggaaattgttgtcgcaggcgttcccgattcctacaggggagaaacagtaaaagcatttgtcgtattaaagaaaggcgcaaaagccgatacagaagaactggacgcttttgcgagatcacgtctagctccctataaggtgcccaaagcctatgagttcagaaaggagctgccgaaaacggcggtgggaaaaattttaagaaggcgtttacttgaagaagaaaccgaaaatcatcatatcaaataa

SEQ ID NO: 46918 - DNA, 1413 bp, Bacillus subtilis
atgatcaccaaggatgtaaaggagcagctgattcaggtctccggaccagaaaactttgatgactcgaatgccggccgtctcgtctattcatatgatgcgacgcctcagtatcagtctatgcctgatgccgtgattgctccgaggaatactgatgaaatatcacgcattttaacaatttgcagcgaacatcgagtgccgatcgttccaagaggatcagggacaaacctgtgcggcggcacgtgcccgactgaaggcggacttgtgcttctctttaagcacatgaaccagattcttgaaattgatgaagaaaatttaactgccacagttcagccgggcgtcattacgttggatatgatccgggcagttgaaagcaaaggtttattttatccgcctgacccgagttctatgaaaatatcaactatcgggggcaacatcaatgaaaattccggcgggctacgcggattaaaatacggtgtcacccgcgactatgttattggactggaggttgttctcgcaaatggtgacatcatccgcaccggcggaaaactcgcaaaggatgtggccggatacgatctcacacgtctttttgtcggctcagaaggaacactcggcattgtgacagaggcaatcgtcaaactcgttccaaagccggaaacaaagaagacgctgcttgccctttatgaaaacatcgatgccgctgctcaaacggtatcggacattattgccgcaaaaattatacccgctacgcttgaatttctcgatcagcctacactattggtgattgaggattatgccaaaatcggacttccgacaagcgcaaaagcagttctgttaattgaacaagacgggccatttgaaactgttgaacgggatatggaaaagattgaggcgatctgcaaaaaaggcgacgccgtatccgttcagaccgcacaaacagaggaggaagcgtttgccctgactgaagcccggcgttctgcactttctgccctagcccgcctcaaaccgacgacgattttagaggatgcgaccgttcctcgctcagaaatcgccaatatggttaaagcgattaatgatattgctgctaaatatgatatttccatctgcacctttggtcatgcgggagacgggaaccttcacccgacatgcacgacagacataagaaataaggatgaaatggaacgtgtcgaacaggcttttgccgagatttttgagaaagcgattgaacttggcgggacgataaccggagagcacggagtcggggaaatgaaagcgccttacttggaaatgaagctgaaaaaagaaggcattgatgcgatgaaagcgttgaaagcggcatttgacccccggaacatattaaatcccggcaaaatgtttgcgaaagatgccagaaaacgtgtggtggcggaaagatga

SEQ ID NO: 46919 - DNA, 1503 bp, Bacillus subtilis
atgaaaaaagcgcgaatgattgtagacaaagaatataaaatcggtgaagtagataaacggatttatggctcgtttatcgaacatatgggtcgtgcggtatatgaaggcatatacgagcctgatcaccctgaagcggatgaagatggatttagaaaagatgtccagtcgctgatcaaagaattacaggttcccatcatccgctatccgggcggaaactttttatccggatacaactgggaggacggtgtcggaccagtcgaaaaccgcccgagacggcttgacttggcatggcaaacgacagaaaccaatgaagtgggaacaaatgaatttttatcttggccaaaaaaggtgaacactgaggtcaatatggccgtcaaccttggcacaagaggcatagatgccgcccgtaatctcgttgaatattgcaaccatccgaaaggctcttactggagtgatttaagaagatcgcatggctatgaacagccgtatggcatcaaaacatggtgcttaggaaacgaaatggatggaccatggcagatcggccacaaaacagctgatgaatacggacggcttgccgcagagacagcaaaggtcatgaagtgggttgacccatcaattgaactcgttgcctgcggcagctcaaacagcggtatgccgacctttatcgattgggaagcgaaggtgcttgagcatacgtatgagcatgtcgactatatctctcttcacacttactacggaaaccgggataacaatctgccaaactacttggcacgttctatggatttggatcattttatcaaatcagtcgctgcgacctgtgactatgtaaaagcaaaaacacgcagcaagaaaactatcaatctctctctggatgaatggaacgtctggtaccactcaaatgaggctgataaaaaagtcgagccgtggatcactgcgcgtccgattttagaggatatttacaattttgaagatgccttattagtcggctctctgctcattacgatgctgcagcacgcagaccgtgtgaaaattgcgtgtcttgcacagcttgttaatgtcatcgcgccgatcatgacggaaaaaggcggagaagcatggagacagccgattttctatccatacatgcatgcttctgtttacggaaggggcgagtcactgaaaccgcttatttcttctcctaagtacgattgttctgatttcactgatgtgccatatgttgatgctgctgttgtgtactctgaagaggaagaaacactcactatttttgcggtaaacaaggctgaggatcagatggagacggagatttcgctcagaggctttgaatcctaccaaatcgcagagcacatcgtacttgagcatcaggatatcaaagcaacaaaccagcataacagaaaaaatgtcgttccgcattccaacggatcatcgtctgtcagcgaaaacggcttaactgctcatttcacgccactttcctggaatgtgatccgcctgaaaaaacagtcataa

SEQ ID NO: 46920 - DNA, 1683 bp, Bacillus subtilis
atggcttacacaataggggttgattttggaactttatcaggaagagcagtgctcgttcatgtccaaacaggggaggaacttgcggctgctgtaaaagaatacaggcatgctgtcattgataccgtccttccaaaaacgggtcaaaagctgccgcgtgactgggcgctgcagcaccctgctgattacctcgaagtcttggaaacaaccattccgtctttactcgaacagacgggcgttgacccgaaagacattatcgggattggaattgatttcacggcatgtacgatccttcctattgacagcagcgggcagccgttatgcatgctgcctgaatatgaagaggagccgcacagctatgtgaagctctggaagcatcatgcggcccaaaaacatgctgatcggctcaatcaaatcgcggaagaagaaggagaggcttttttacagcggtacggaggaaaaatttcatcagaatggatgattccaaaggtcatgcaaattgccgaggaagcgcctcacatttatgaagcggctgaccggatcatcgaggctgcggactggatcgtgtaccagctgtgcggctcgctcaagcgaagcaattgtaccgcagggtataaagcgatgtggagtgaaaaagcggggtatccgtcagatgatttctttgagaaattaaatccttcaatgaaaacgattacaaaggacaaattgtcaggttctattcattcagtaggagaaaaagccggcagtctgactgaaaaaatggcaaagctgacagggcttctcccgggaacggctgttgcggttgccaatgtggacgctcatgtttcggtaccggcggtcggcattacagagccagggaaaatgctgatgattatgggaacctcgacgtgccatgttctacttggtgaagaggtgcatatcgttccaggaatgtgcggcgttgtggacaacggaattctcccgggctatgcgggatatgaagccgggcagtcctgtgtcggcgatcattttgactggtttgtgaaaacatgtgtcccgccagcttatcaagaggaagcaaaggaaaaaaacattggcgttcatgagctgctgagtgagaaagcaaaccatcaagcgcctggtgaaagcggcttgcttgctttagattggtggaatggaaaccgttcaactcttgttgatgcagatttaacagggatgctgcttggcatgacactgctgacgaagcctgaagagatttatagagcgttagttgaagcgacagcttacggaacccggatgattatcgaaacattcaaagaaagcggtgttccgattgaggaactgttcgcagccggcggaatagctgagaaaaacccgtttgtcatgcagatttatgcggatgtgacaaacatggacattaaaatctctggttcaccgcaagccccagccttaggatctgccattttcggcgcgcttgcagcaggcaaagaaaaaggcggctacgatgatatcaaaaaggcagcggcgaacatgggaaaactgaaagatataacttatacgccaaatgccgaaaacgccgcggtttatgaaaaattgtacgctgaatataaagagctggttcattatttcggaaaagaaaaccatgtcatgaagcgtctgaaaacgatcaaaaatcttcaattttcatctgccgccaaaaagaattga

SEQ ID NO: 46921 - DNA, 1497 bp, Bacillus subtilis
atgcttcagacaaaggattatgaattctggtttgtgacaggaagccagcacctatacggggaagagacgctggaactcgtagatcagcatgctaaaagcatttgtgaggggctcagcgggatttcttccagatataaaatcactcataagcccgtcgtcacttcaccggaaaccattagagagctgttaagagaagcggagtacagtgagacatgtgctggcatcattacatggatgcacacattttccccctcccaaaaattgtggaaaagaaggcctttccctccttatcaaaaaccgcttatgcatttgcatacccaatataatcgcgatatcccgtggggtacgattgacatggattttatgaacagcaaccaatccgcgcatggcgatcgagagtacggttacatcaactcgagaatggggcttagccgaaaagtcattgccggctattgggatgatgaagaagtgaaaaaagaaatgtcccagtggatggatacggcggctgcattaaatgaaagcagacatattaaggttgccagatttggagataacatgcgtcatgtcgcggtaacggacggagacaaggtgggagcgcatattcaatttggctggcaggttgacggatatggcatcggggatctcgttgaagtgatggatcgcattacggacgacgaggttgacacgctttatgccgagtatgacagactatatgtgatcagtgaggaaacaaaacgtgacgaagcaaaggtagcgtccattaaagaacaggcgaaaattgaacttggattaaccgcttttcttgagcaaggcggatacacagcgtttacgacatcgtttgaagtgctgcacggaatgaaacagctgccgggacttgccgttcagcgcctgatggagaaaggctatgggtttgccggtgaaggagattggaagacagcggcccttgtacggatgatgaaaatcatggctaaaggaaaaagaacttccttcatggaagattacacgtaccattttgaaccgggaaatgaaatgattctgggctctcacatgcttgaagtgtgtccgactgtcgctttggatcagccgaaaatcgaggttcattcgctttcgattggcggcaaagaggaccctgcgcgtttggtatttaacggcatcagcggttctgccattcaagctagcattgttgatattggcgggcgtttccgccttgtgctgaatgaagtcaacggccaggaaattgaaaaagacatgccgaatttaccggttgcccgtgttctctggaagccggagccgtcattgaaaacagcagcggaggcatggattttagccggcggtgcacaccatacctgcctgtcttatgaactgacagcggagcaaatgcttgattgggcggaaatggcgggaatcgaaagtgttctcatttcccgtgatacgacaattcataaactgaaacacgagttaaaatggaacgaggcgctttaccggcttcaaaagtag

SEQ ID NO: 46922 - DNA, 1023 bp, Bacillus subtilis
atgaaggtaaaagtagcgatcaacgggtttggaagaatcggaagaatggtttttagaaaagcgatgttagacgatcaaattcaagtagtggccattaacgccagctattccgcagaaacgctggctcatttaataaagtatgacacaattcacggcagatacgacaaagaggttgtggctggtgaagatagcctgatcgtaaatggaaagaaagtgcttttgttaaacagccgtgatccaaaacagctgccttggcgggaatatgatattgacatagtcgtcgaagcaacagggaagtttaatgctaaagataaagcgatgggccatatagaagcaggtgcaaaaaaagtgattttgaccgctccgggaaaaaatgaagacgttaccattgtgatgggcgtaaatgaggaccaattcgacgctgagcgccatgtcattatttcaaatgcgtcatgcacgacaaattgccttgcgcctgttgtaaaagtgctggatgaagagtttggcattgagagcggtctgatgactacagttcatgcgtatacgaatgaccaaaaaaatattgataacccgcacaaagatttgcgccgggcgcgggcttgcggtgaatccatcattccaacaacaacaggagcggcaaaggcgctttcgcttgtgctgccgcatctgaaaggaaaacttcacggcctcgccttgcgtgtccctgttccgaacgtctcattggttgatctcgttgttgatctgaaaacggatgttacggctgaagaagtaaacgaggcatttaaacgcgctgccaaaacgtcgatgtacggtgtacttgattactcagatgaaccgctcgtttcgactgattataatacgaatccgcattcagcggtcattgacgggcttacaacaatggtaatggaagacaggaaagtaaaggtgctggcgtggtatgacaacgaatggggctactcctgcagagttgttgatctaatccgccatgtagcggcacgaatgaaacatccgtctgctgtataa

SEQ ID NO: 46923 - DNA, 843 bp, Bacillus subtilis
atgacaacacatttacaagcaaaagcaacacttcataatggggtagaaatgccttggttcggcctcggcgtgttccaagtggaagaaggatctgaactggtaaacgcagttaaaactgccattgttcacgggtaccgcagtattgatactgcagcaatctatggaaatgaagctggagtcggagaagggattcgggaaggcattgaagaagcaggcatttcaagagaggatctgtttatcacatcgaaagtatggaatgcggatttaggctacgaagaaacactcgccgcgtttgaaacaagtctgtccaaactcggtctggattatttggatctatacctcatccactggcctgtagaaggaaagtataaagaagcttggagagcgcttgaaacgctgtataaagaaggccgtatcaaagcgattggcgtaagcaacttccaaattcaccatcttgaagatctgatgacggcagctgaaattaagcctatgattaaccaagtggaatttcacccgcgcctcacacaaaaagagttgataagatactgccaaaatcagggcatccagatggaggcttggtcacctttaatgcagggacagctgctggatcaccctgtattggctgacatcgctcaaacatataataaatctgtcgcacaaattattttgcgctgggatctgcagcatggcattataacgattcctaaatcaacgaaggaacaccgcattaaagaaaatgcaagcgtatttgactttgaattaacgcaggatgacatgaaccgaatcgatgcactgaatgaaaacttgcgcgtcggtcctgatccggacaactttgatttttaa

SEQ ID NO: 46924 - DNA, 939 bp, Bacillus subtilis
atgggaaatactcgtaaaaaagtttctgttatcggagcaggttttaccggagctacaactgcatttttaatcgctcaaaaagagctggcagacgttgttcttgttgacattccgcaattggagaacccgacaaagggaaaagcgcttgatatgcttgaagcaagcccggttcaaggctttgacgcaaaaattacgggaacatccaattacgaggatacagccggctctgacattgttgtcattacagccggtatcgcaagaaaacctggtatgagcagagatgatctggtctctacaaacgaaaagattatgagaagcgttacgcaggaaatcgtgaaatattctcctgactctattattgtggtgctgacaaatcctgttgatgcaatgacatacgcggtgtacaaagaatcaggcttccctaaagagcgtgtaatcggccagtcaggtgtgcttgatacggcaagattcagaacatttgtggcagaggaattaaacctgtcagtgaaagatgtgactggtttcgtactcggcggacacggtgacgatatggttccgcttgtgcgttattcttatgctggcggtatcccgcttgaaactcttattccgaaagaacggattgacgcaattgtggagcgcactagaaaaggcggaggcgaaatcgtgaatcttcttggaaacggaagcgcgtattatgcgcctgcggcttctctgacagaaatggtcgaagcgatcttgaaagatcagcgccgcgtccttcctacaattgcttatcttgaaggggaatacggctatgaaggcatctaccttggtgttcctacaattgtaggcggcaacggtcttgagcaaatcattgaacttgaactgacagactatgaaagagcgcagctgaataaatcagttgaatctgtcaaaaatgtcatgaaagtattatcctaa

SEQ ID NO: 46925 - DNA, 1272 bp, Bacillus subtilis
gtggcacaaggtgaaaaaattacagtctctaacggagtattaaacgtaccaaacaacccgattatcccatttatcgaaggagacggaaccggtcctgatatttggaacgcggcttcgaaggttttggaagcagcagtagaaaaagcatacaaaggcgaaaagaaaattacatggaaagaagtttacgccggagaaaaggcttataataaaacaggtgagtggctccctgctgaaacattagatgtgatccgcgaatatttcatcgcgattaaaggcccgttaacgacacctgtcggcggcggtatccgttctttgaacgtagcgctcagacaagagcttgacctattcgtctgcttaagacctgtaagatactttactggagtgccgtcaccggtaaaacgccctgaagatactgatatggtcatcttccgtgaaaatacagaagatatttacgcaggcatcgagtatgcaaaaggctctgaagaagtgcaaaagcttatcagcttccttcaaaatgagttaaacgtcaataaaatccgtttccctgagacatcaggtatcggcattaagcctgtttcagaagaaggaacaagccgcttggtcagagctgccattgattatgcgatcgagcatggccgcaaatctgtaacacttgttcacaaaggaaacatcatgaagttcacagaaggcgccttcaaaaactggggctatgaacttgctgaaaaagaatacggagataaagtcttcacatgggctcaatatgaccgcattgctgaagaacaaggaaaagacgctgccaacaaagcgcaaagcgaagcggaagcagcaggaaaaatcattatcaaagacagcattgctgacattttccttcagcagatcttaacgcgtccaaacgagtttgatgtcgttgcgacaatgaacttgaacggagattacatttctgatgctcttgctgcgcaagtcggcggaatcggcattgctcctggagcgaacatcaactacgaaacaggacatgcgattttcgaggcgacgcacggaacggctcctaaatatgcaggccttgataaagtaaacccatcttcagttattctttcaggcgttctgcttcttgagcatttaggatggaacgaagcggctgatttggttatcaaatctatggaaaaaacaatcgcttctaaagtcgtaacttacgattttgccagattaatggacggggcgactgaagtgaaatgttcagagttcggagaagaactgatcaaaaacatggactaa

SEQ ID NO: 46926 - DNA, 1119 bp, Bacillus subtilis
atgacagcgacacgcggtcttgaaggggttgtagcaacaacatcatctgttagttctattattgatgatacccttacatatgtggggtatgatatcgatgatttgacagagaatgcaagttttgaagaaatcatctacttgctttggcatctaaggctgccaaacaaaaaagagcttgaagagttaaagcagcagcttgcaaaggaagctgccgttccgcaagaaattattgagcacttcaaatcttattccctcgaaaatgttcatcccatggctgctcttcggacagcaatttcattactaggcctgcttgacagcgaggctgataccatgaacccggaagccaactacagaaaggcgatccgccttcaggcaaaggtgcctggcctggttgcagcgttttccagaattcgcaagggtcttgagcctgttgaaccgagagaagattacggtattgcggagaattttctttacacattaaacggtgaagagccttcaccaattgaagttgaagccttcaacaaagcattgattttacatgctgaccatgagctgaacgcgtcaacgttcacagcgagggtctgcgtcgcaacactttctgacatctattcaggcattactgcagcaatcggcgcgctgaaagggcctcttcacggcggagcgaatgaaggcgttatgaaaatgctgacagaaatcggtgaagtggaaaacgctgagccgtacatccgcgctaaacttgaaaagaaagaaaaaatcatgggattcggccaccgtgtgtataagcatggtgatccgcgcgcgaagcatctgaaagaaatgagcaagcgcctgaccaacctgacaggcgaaagcaaatggtatgagatgtcgattcgtatagaagacatcgtcacatcagagaaaaagcttccgcctaacgttgatttctattcggcttctgtatatcacagcctcggtattgaccatgatttgtttacaccgatttttgctgtaagcagaatgtccggctggctcgctcatattcttgagcagtatgacaacaaccgtctgatccgcccgcgggcagattacacaggccctgacaaacaaaaattcgttccgattgaagaaagagcctaa

SEQ ID NO: 46927 - DNA, 1758 bp, Bacillus subtilis
atgagaaaaactaaaattgtttgtaccatcggtccggcaagtgaaagtattgaaatgcttacgaaattaatggagtcaggaatgaacgtggctcgattaaacttttctcacggagattttgaggagcacggtgcaagaattaaaaatatccgcgaagcaagtaaaaaacttggcaagaacgttggaattctgcttgatacaaaaggtcctgaaatccgcacacatacaatggaaaacggcggtattgagcttgaaacaggcaaagagctcattatttcaatggacgaggttgtaggaacaacagataaaatttcagtgacatatgaaggtttagtccatgacgttgaacaaggttcaacgattctgttagatgacggccttatcggtcttgaggtacttgatgtagatgccgctaaacgcgaaatcaaaacaaaagtattaaacaacggaacactcaaaaataaaaaaggtgttaacgtaccgggcgtaagtgtcaatcttccggggattactgaaaaggatgcgcgagacatcgttttcggtattgagcaaggagtagacttcatcgcaccatctttcattcgacgttctacggatgtgctcgaaatccgtgagcttcttgaagagcacaacgctcaggatattcaaatcatccctaaaatcgaaaaccaagagggcgttgacaacatcgatgcgattctcgaagtgtctgacggcttaatggttgcacgcggagacttaggtgtggaaattccagctgaagaagtgccgcttgtgcaaaaagaactgatcaaaaaatgcaacgcgctgggcaaacctgttattacagcgacacaaatgcttgacagcatgcagcgcaacccgcgtccgactcgtgcggaagcaagtgacgttgcaaacgcgatcttcgacggaacagatgcgatcatgctttctggtgaaactgctgccggaagttacccggttgaagcagttcaaacaatgcataacatcgcgtcccgttctgaagaagcattaaattataaagaaattctctcaaaacgcagagaccaagtgggcatgacaattacagacgcaattggacaatctgtcgcacatacggcgattaacctgaatgctgctgcgatcgtaacgccgacagaaagcggccatacagcacgtatgattgcaaaataccgtccgcaggctccgattgttgcggttactgtaaatgactctatttccagaaagcttgccctcgtatctggcgtattcgcggaaagcggccaaaatgcgagctcaacagatgagatgcttgaggatgctgtccaaaaatcattgaacagcggaattgtaaaacacggcgatcttatcgttattacagctggcactgtcggtgagtccggcactacgaacttaatgaaggttcatactgtcggcgatatcatcgctaaaggccaaggcattggacgcaaatcagcttacggtccggttgtcgttgcacaaaatgcaaaagaagctgagcaaaaaatgactgacggtgcggtacttgttaccaaaagcactgaccgtgatatgattgcatcccttgaaaaagcgtctgctcttattacagaagaaggcggtttgactagccatgctgcggtagtcggattaagccttggcatcccggttatcgtgggtctggaaaatgcgacatctattttgacagatggccaggatattacagttgacgcttccagaggcgcagtctatcaaggccgtgcgagcgttctttaa

SEQ ID NO: 46928 - DNA, 960 bp, Bacillus subtilis
atgaaacgaataggggtattaacgagcggcggggattccccgggaatgaacgcagcagttcgcgcagtagtcagaaaagcgatctatcatgacgttgaagtttacggtatttacaacggatacgcgggattgatcagcggaaagattgaaaagcttgaactcggatcagtaggcgatattatacatcgtggagggactaagctttatacggcgagatgtcctgaattcaaaacagttgaaggccgtgaaaaagggatagcaaacttgaagaagcttggtattgaaggccttgttgttatcggtggagacggttcctatatgggtgcgaaaaaattaacggaacacgggtttccatgtgtaggtgtaccgggtacaattgataatgacattccgggcactgattttacaatcggtttcgatacagctttaaatacagtaattgacgcaattgataagattcgcgatacagcgacttctcatgaacgtacatatgtaatcgaagtaatgggccgtcatgccggcgatatcgcattgtgggccggtcttgcagggggcgcagaatcgatcttaatccctgaggcagactatgacatgcacgaaatcattgcccgcttaaaacgcggccacgaacgcggcaagaagcacagtattattattgttgccgaaggtgtaggcagcggtgttgaattcgggaaacgcattgaagaagaaacaaatcttgaaactagggtatctgtattgggccatatccagcgcggaggttctccgagtgctgctgaccgtgtgttggcaagccgtctcggcgcatatgcagttgaactgctgcttgaaggaaaaggcggacgctgtgtaggtatacaaaacaataagcttgtagaccatgatattatagaaatacttgagacaaaacacacagttgagcaaaacatgtatcagctttcaaaagaactgtctatctaa

SEQ ID NO: 46929 - DNA, 1233 bp, Bacillus subtilis
atgtcattaagagaagaagcattacacctgcataaagtcaaccaggggaaactggagtctaaatcaaaagtagaggtcagaaatgcgaaagatttaagcctcgcgtattctccgggtgttgcagaaccgtgtaaggatattcatgaagacattaacaaagtatatgattatacaatgaaggggaacatggtagcagttgtaactgacggtacagctgtgcttggccttggaaacatcggccctgaagcggcgcttcctgttatggaagggaaagcagttcttttcaaaagctttgcgggcgtagatgcgttcccgattgctttaaacacaaacgatgttgataaaatcgttgaaactgtaaaattgctggaaccgacatttggcggcgtcaaccttgaagatattgcagcgccaaactgctttatcattgaagagcgcctcaaaaaagaaacaaacatcccggttttccatgatgatcagcacggtactgccattgtaaccgtagcaggtcttgtgaacgcgctgaaactgtctggaaaatccatgtcatccattaaagttgtcgcaaacggcgcgggtgcggctggcattgcgattatcaagcttcttcatcattatggcgttcgcgacattgtgatgtgcgattccaaaggggccatttatgaagggcgcccgaacggcatgaacgatgtcaaaaatgaagtggcgaagttcacgaaccaagatcgcaaagacggttctctgaaagatgttatcgttgatgctgacgtatttatcggtgtctctgtagcaggcgcgttaacaaaagaaatggttcaaagcatggcaaaagatccgattatctttgcaatggcaaatccaaatccggaaatcatgccggaagatgcgcgtgaagccggagcaagcgttgtcggaactggccgttctgacttcccgaaccaagtaaacaatgttcttgcattccctggtattttccgcggagcgcttgatgtgcgtgccactcatattaacgaggaaatgaaaatcgcagcggttgaagccattgcttcactggtttcagaagatgagcttagcgcagactatgtcatccctgcaccgtttgataaacgtgttgcgcctgctgttgcgaaggctgtggcaaaagctgcgatggaaacaggtgttgcaagaatcactgttgaccctgaggaagtcgcagaaaaaacaagaaaacttacgattattggtgaataa

SEQ ID NO: 46930 - DNA, 780 bp, Bacillus subtilis
atgattgagattaaaaatatccataaacagtttggcatccaccatgtattaaaagggataaatctcacggtacgcaagggagaagttgtgacgattatcgggccgagcggatcagggaaaaccacctttttacggtgcctgaatttattagaacgtccagacgaagggatcatttctatacatgacaaagtgattaattgccgctttccgtccaaaaaagaggttcactggctcagaaaacagacggcaatggtatttcagcaataccacctgtttgctcacaaaacggtgattgaaaatgtcatggagggcttgacgattgcccggaaaatgagaaaacaagacgcgtatgccgtagcggaaaatgaactgagaaaggtcgggcttcaagataaattgaacgcttatccgagtcagttatcgggaggacaaaagcagagggtagggatagcaagggcgcttgccattcatcctgatgtgctgctgttcgatgagccgacggcagcgcttgacccggagctggtcggtgaagtgcttgaggtaatgctggaaatcgtgaaaaccggagccaccatgattgttgttacacatgaaatggagtttgcaagaagggtctctgatcaagttgtttttatggatgaaggagtcattgttgaacaaggaaccccggaggaagtcttccgccataccaaaaaagacagaacgaggcagtttctccgccgtgtttcgccggaatatttatttgaaccaaaagaacacataaaggagccggtgatatga

SEQ ID NO: 46931 - DNA, 768 bp, Bacillus subtilis
gtgcgacatgctttaattactgccggttcgaagggtttaggccgcaaagtgactgaaacgttgcttgcaaaggggtattcagtaacagtcaattacagacaggatgaggaggcagtcagccgcctgaaggaagcctgtcccgattgtcttgaccggctgcaatttgtaaaaggtgatgtcaccaaaaaagaagatctgctgcgtattgcagaggctgccttaaaccgcttcggaaggatcgactttttgattaacaacgctggaccatacatatttgaacgtaaaaagttagccgattatactgatgatgaatggtatggcatgctggaaggaaatttaagcgccgtctttcatttattcaaagcggttattcctattatgagaaaacagcaatttggacgcattattacgtacggattccaaggtgcggctcacgcgcccggctggcttcaccgatcggcatttggcgctgcgaaagtgggcttggcttctttgacgaagacaattgccattgaagaagccgaattcggcataaccgccaacatggtttgcccaggagacattgtcggcgacatgaaagaagcatcgatagaggaagccagaatgcgaatcggcaaagaaaaaacgccgataggaagatccggtacaggcgaggatattgccaggattatcgctttcttgtgtgaggagaactcagaccttgtgacagggactgtcattgaagccaccggaggcctcaatgtcattaacaagaatcaaacaacataa

SEQ ID NO: 46932 - DNA, 1386 bp, Bacillus subtilis
atgaagaagctttggggaggccgatttcaaaaaacaccggaaaaatgggtcgacgagttcggcgcgtccatatcatttgaccaaaatttagttgctgaagacattacagggtctctcgcacatgctgccatgctgaaaaaatgcggtattctgacagcagaagaagagttgaaaatccgagagggcctgaatacccttttgcaaaaagcagaggagggagcattggaattctcagtcgattatgaggatattcatttgaacattgagaaaatgctcattgacgaaatcggtcctcttggcggcaagctgcataccggcagaagccggaatgaccaggtggcgactgacatgcatttatacttgaagaatcatgtcggccacatcatcgagctgattgaggcattccaaagtgcgctgattgaaaaggcggaagcgaacgttgaaacgattctgccgggctacacacatttgcagcgcgcccagccgatttcattcgctcaccatctgcttgcgtatttctggatgcttgagcgcgacaaggagcgttttcaggattcaatgaagcggattaacaaatctccgctcggctgcggggcgctcgcgggaacaaccttcccaattgaccgtgattattcagcggaactgctcggctttgatgccatttatgaaaacagcttggacggcgtcagcgacagagacttcattttggagtttttaagcaacagcagtatgctgatgatgcacctatcccgtttctctgaagaaatcattttatggtgctcgcaggagtttaaattcatcgagcttgacgatacgtacgcaacaggaagcagcatgatgccgcaaaagaaaaaccctgatatggcggagctgatccgcggcaaaacaggacgcgtatacggcgatatgatggggctgtttacgatcatgaaaggacttccgctcgcttacaacaaagatctgcaggaagacaaagagggcatgtttgacacggtgaaaacggtggagggcagcctgcaaatcttcacaggcatgatccaaacaatgactgtaaacaaagacgtcatgaagcaagcaacaaaacaagacttttcaaacgcgacggaactggccgattatttagctaaaaaaggaatgccgttcagagaagcgcatgaagtggtcgggaaacttgtgtacacatgcatcgaaagagggatctatttaagcgatatgccgtttggcgagtttcagcaggcgagcacactatttgaagaagatatttacactgtgttagacccttactacgcagttgaaaaaagaatgagcgccgggggcaccggattcaaacaggtggaacaggcgcttgaaaaagcgaaagcttgcgtggcagcaggagtttgttaa

SEQ ID NO: 46933 - DNA, 1212 bp, Bacillus subtilis
atgtcagaacagaaaaaagtcgtattagcatactcaggaggtcttgatacttccgtcgcaataaaatggcttcaggagcaaggatataatgtaatcgcctgctgcctggatgtcggtgagggcaaagatttggcatttgttcagcagaaagcgcttgaagtcggcgcgacaaactcctacgtgatcgatgcaaaagaagaatttgcacaggattacgcgcttatctctttgcaggcccacacaatgtatgaaggaaaatacccgcttgtttcggcattatctcgaccgctgatcgcgaaaaaactggttgaaattgcggaaaaagaagatgcacaggcgattgcccacggatgcacagggaaaggaaatgaccaggttcgtttcgaagtctccattaaatcattaaaccctgacctagaagtcatcgcgccggttcgcgaatggcagtggtcacgtgaagaagaaattgaatatgcggctagccgcggcattccgattccgatcaatcttgacagcccgtattctatcgaccaaaacctctggggacgcgccaatgagtgcggcattttagaagatccatgggcggcgccgccagaaggtgcatacgatttaacagctccgctggaaaaaacgccggacacgccggaagtgattgaaattgcatttgaacagggcgtgcctgtctccattgacggtgtttcctactcgctttctgagctgatcttgaagctgaatgaaatggcgggcgcgcacggtgtcggacgtatcgaccacgtggaaaaccgcctcgtcggcattaaatcccgggaagtatacgaatgccctggtgcgatgacactgatcaaagcgcataaagaattagaagatttgacactggtgaaagaggtagcccactttaaaccgatcatcgagcaaaaaatgtcagaaatcatttacaacggcttatggttctcaccgttaaaagacgcgctgcacgctttcttaaaagaaacgcaaaagcatgtcacaggcattgtccgcgtgaagctgtttaaaggccatgcaattgtagaaggacgtaaatcggaatactctctatatgatgaaaaacttgcaacatatacaaaagacgatgcatttgatcaccatgcagcaatcggatttatcgagctttggggacttccgacaaaagtgaacagcatcgtgaaaaagaaggagcagattaaagcatga

SEQ ID NO: 46934 - DNA, 1596 bp, Bacillus subtilis
ttgttcgtgttaaaacgtgaagatttaattgcccctgtgcaatataatttagtgaatgaaatggaaaagttcagtgctgctggacaaaaaaccgctcttctttgggaggacgagtcgggcaagcaagaatcttggtcgtatgaaaagctgatggaagaaacaaataaaatcggagcggccttagctgatcttggatttaaaaagggagacaagctgattgtaatggttccgcgggtgcttgaagcctatgctgtttatttggctatcctgaaatcaggaatggttgtcattccgtgctccgaaatgcttcgcgcgaaagatcttgaataccggattgaacatgcagaggtaaaaggcgctatcgtctactccgaatttattggcgctttccgggatgtcagtacggctgacaaactgattacactgtctattggtgaaaatgatgccggctggaaaaacctcttatcaattgaagcggacggaagccaatttaaaacagctgacacaacaagagatgatatggctttcttatcttatacatccgggacaacaggtcagccgaaaggtgttgtacatacacatggatgggcatttgctcatttaaaaacttctgccggcgcttggcttgacatttctgaaaaggatatcgtctgggcaactgctgcccctggctggcaaaagtgggtatggagtccgtttttagcggtgcttggcagcggagcaaccggttttgtgtaccacggcagattcaaagcagaaaaatatctagagcttttaaatcgctacaaaatcaatgttttctgctgcactccgacagaataccgcttaatggcgaaggttgaaggcttgaaacgctttgatctttctgccctgcacagcgctgtttccgcaggtgagccgctcaaccgtgaagtcattgatgttttccaaaagcactttggcattaaggtacgggacggatatggccaaacagaaagcacgcttttggttggtgttttgaaagatacgcctattaaaccgggaagcatgggaaaaccgacaccgggaaatcaggtggagatcataaatgaagacggtgaaatctgcaaacctggtgaggttggcgatatcgctgttcacctcagtacgcctgcgctctttaaagagtattttaaagatccggaaagaatgaaaacacaaattcgcggcgattatttcctaacgggagacagagcaagaaaagatgaggaaggttacttctggtttgaaagccgaaatgacgatattattatcagctccggctatacgatcgggcctttcgaggtggaagacgcgcttgttaagcacccagaagtaaaagaatgtgctgttgtcgcaagccctgatgaaatcagaggctccatcgtaaaggcatatgttgtcctgcaaaatcatgaaaaacgcagtgatgagcttgtcaaaatgctgcaaaaccatgtgaagacgattaccgctccatacaaatatcctagagaaattgaatttgtggaaagcctgccgaaaacggcttctgcaaaaatcagacgagtggaattaagaaaacgtgaagaacagctcaaagccaataaaaaggcgtaa

SEQ ID NO: 46935 - DNA, 807 bp, Bacillus subtilis
atgcaaaagcgagacggacatattcacacaccattttgccctcacggctccaatgacacactcagacaatatgcagaagaagccttaaaaaaagggttcgaatcgattacttttaccgaacacgccccattgccgccatcttttaccgatcccacgccgctgaaagacagcgcgatggcgcaagcttctttggaacgctatattcatgaaatttccggattaaaaaaagaatatcgcggacagcttagcatacggacagggcttgaagtcgattatatcgctgaatttgaagacgaaattacattattcctagacacatacgggccatatttagatgacagcatcttatccgttcattttttgcgcacagactcttcctatctatgccttgattatgacgagcataccttcaaagagctgatttcagcctgcggaagcattgaagcggtatatgaacaatattaccggagtatctattcttccattgtagcatctctcggcgtttataagccaaaaagagtcggtcacatcacactcgtccaaaaattcatcaagctgtttccatacagcatgtcagagcatattcgcggcctcgtttctctgtgcctgaatgccattgaagaaaacggaatggagctcgacttcaatacttccggcttaagaaaaacttacgctggcggtatttatatcgaggattggatgctgaatgaagcgaagcaaaagaagatcccgcttgtgtttgggtctgatgcccatcaagcgggagatgtcggatatgcgtatgaggcgtttttggaacggtgctag

SEQ ID NO: 46936 - DNA, 1719 bp, Bacillus subtilis
atgaacttgaaagcgttaccagcaatagagggggatcataacttaaaaaactatgaagaaacgtaccggcattttgattgggccgaggcagagaaacatttctcttggcatgagacagggaaactgaatgcggcgtatgaagcgattgaccgccatgccgaatcgtttcgaaaaaacaaagtagcgctttattataaagacgcaaaaagggatgaaaaatacacatttaaagaaatgaaggaagaatcaaacagagccgggaatgtgctgagacggtatggaaatgtggaaaaaggggaccgcgtttttatttttatgccgagatcacccgagctttattttattatgcttggcgcaatcaaaattggcgccatcgccgggccgctgttcgaagcatttatggagggagcggtgaaagaccggcttgaaaacagtgaggcaaaggttgttgtcacaacgcctgagctgctggagagaataccggtagacaaactgcctcacttgcagcatgtcttcgtagtcgggggagaggctgagagcggcacgaatatcatcaattatgatgaagcagcgaaacaggaaagcacaagattggatatcgaatggatggataaaaaagacggctttctgcttcactatacatcaggttccactggtacgccaaagggcgtgttgcatgtccatgaagcgatgattcagcaatatcaaacaggaaagtgggtccttgatttaaaggaagaagacatttattggtgcacggctgatccaggctgggtgacaggtacggtatacggcatttttgcaccgtggctgaacggagcgacaaatgtcatcgtcggcggacgtttcagcccggaaagctggtatggaacgattgaacagcttggcgtcaatgtctggtacagcgcgccgacagcttttcggatgctgatgggagcgggagatgaaatggctgcgaaatatgatctaacttcactccggcatgtgctcagtgtcggtgagccgctaaatccggaagtcatcagatggggacataaagtttttaacaaacgaatccatgatacctggtggatgaccgaaacgggcagtcagctcatctgcaactatccttgcatggatattaaaccgggttcaatgggtaagccgattccaggagtggaggcagcgatcgttgacaatcaaggcaacgagctaccgccgtaccgaatgggcaatctcgccatcaaaaagggctggccttccatgatgcataccatttggaataaccctgaaaagtatgaatcgtatttcatgccgggcggctggtatgtgtctggggattctgcttacatggatgaagagggatacttttggttccaaggcagagttgatgacgtcatcatgacctccggtgagcgcgtcggcccatttgaagtggaaagcaagcttgtcgaacatccggctattgcagaagcaggcgttatcggaaagcctgacccggtgcgtggagaaatcattaaagcctttattgcactcagggaaggatttgagccgtctgataaactgaaagaagagatccgcctatttgtaaagcagggtcttgcagcccatgcggctccgcgtgagatcgaatttaaagataagcttccgaaaaccagaagcggaaagatcatgaggcgcgtgctgaaggcatgggagcttaatctgccggctggagatctgtcaacaatggaggattaa

SEQ ID NO: 46937 - DNA, 1164 bp, Bacillus subtilis
atgagagacagtgtatttatctattctccatcctaccaaacctatatgtttcatcaggagcatccctttaatcagcagcgggttctgttaacatatgatttgcttaagacgatcaatgcctttgatgatggagacattgtcacccccagactcgcttcagaagaggagctttcccttgtccacacggacgattacattcaggccgtaaagcttgcgggcgccggaaagctccccgctgaagaaggagaaagctacgggctcggcactgaagacacacccgtctttgccggcatgcacgaagcggcatcactcttggtcggcggcactttaacggccgcagactgggtcatgtcaggacaagccctgcatgcggcaaaccttggcggagggcttcatcacggctttcgcgggagagcatcaggattctgcatatacaacgacagcgctgtggctattcaatatatccagaaaaaatatagcgccagagtgctttatattgatacggacgcccaccacggggacggtgtgcaatttacattttacgataatcctgacgtatgcacgctgtccattcatgaaacaggaaggtatttattccctggaaccggtcagatccaagaaaaaggaagcggaaaaggatatggctattcctttaatattccgcttgacgcttttacagaggatgattcttttcttgaggcttaccggacagcagcttcagaagtcgccgcgtatttcgagcccgatgtcattatcagccaaaacggcgccgatgcccattactacgacccgctgacgcatttatcagcaacaatcaatatatacgaagaaatcccccgtcttgcacacactttggctcatcaatattgcggagggaaatggattgcagtcggaggcggcggatatgatatttggcgtgtcgtgccccgcgcctgggccagaatatggcttgaaatgaagggaattgacccgggtcacgagatcccgccggaatggattgttaaatggcaaaaacaatgccccgtggcccttccgtcgagctggagcgatccggctgatttatatcctccgattccccgcaagcctgaaattacagaaaaaaatgcccaaactgtcagcaaagcattatatgcgatacgttctgaacagcaaagaacaaagtaa

SEQ ID NO: 46938 - DNA, 1077 bp, Bacillus subtilis
atgagcaacacagagttagagcttttaaggcagaaagcagacgaattaaacctacaaattttaaaattaatcaacgaacgcggcaatgttgtaaaagagatcggtaaagcgaaggaagcacagggtgtcaaccgatttgaccctgtcagagaacgcacaatgttaaacaatatcattgaaaacaatgacgggccgttcgaaaattcaaccatccagcacatttttaaagagatattcaaagccggtttagagcttcaggaagaagatcacagcaaagcgctgcttgtctcccgcaagaaaaaacctgaagatacaattgttgatatcaaaggcgaaaaaatcggagacggccagcaaagattcattgtcggcccatgtgcggtagagagctatgagcaggtagctgaagtcgctgcagctgcgaaaaaacaagggattaaaattttgcgcggtggagcctttaagcctcgtacgagcccatacgatttccaagggcttggtgttgaaggccttcaaattttaaaacgtgtagcggatgaatttgatctggcggttatcagtgaaatcgtaactccggctcatatcgaagaagcgctggactacattgatgtcattcaaatcggagcgcgcaacatgcaaaacttcgaattgctgaaagcggccggcgccgtgaaaaagccagtgcttctgaagcgcggtcttgctgcaacgatctctgaattcatcaatgctgctgaatacatcatgtcacaaggaaatgaccaaattatcctttgtgagcgcggaatcagaacatatgaaacagcaacgagaaacacgctggatatttcagctgtgccgattttgaaacaagaaacgcatttgccagtctttgttgatgttacgcattcaacaggccgccgtgacctcttgcttccgacagctaaagccgctttagcgatcggtgctgatggcgtaatggctgaggttcaccctgatccgtcagtcgcactttctgactctgctcagcaaatggcgattcctgaattcgaaaaatggctgaatgaactgaagccaatggtgaaagtcaacgcttaa

SEQ ID NO: 46939 - DNA, 1701 bp, Bacillus subtilis
gtgaaacaattcagagtaacaaacgaaggagacattcaaacaacattaagaggccttgaagtgctctctgttccttttttgaacaaaggtgttgcttttactgaggaagaaagaaaagaacttggtttaaaaggctttctgccgcccaaggtattaacaattgatgatcaggcgaaaagagcgtatgaacaatattccgcacagcctgacgatttgagcaaaaatgtctatttaacggcgctgcacgatcggaatgaaacgctgttttaccgcctgttaaatgaccatttaggggaaatgctcccgattgtctacacaccgacagtcggaacggcaattcagagatacagccatgaatacagaaaaccacgagggctctatctgtcaatcgatgacccggacggtatgaaagaagcttttaaacagtataaagatcaaagcgatacgatcgatttaattgttgcaactgatgcggaaggaattttaggaatcggtgactggggcgtcggaggaatcgcaatttctattggcaagctggcggtttatacagcggctgcgggcattgatccgagcagagtgctggctgttgttttagatgcggggacaaatcaggagagcctcttgaacgacccgctttatgtcggcaaccagcattccagagtgcgcggggaacgttatgaccaatttattgacgactacgttgcgctggcgagagaaacatttccgaatgcattgctgcattgggaggatttcggggcgaaaaacgcgcgaagcattttgaaacgctataaagataaagtgtgtaccttcaatgatgatatccaaggaactggcgctgtttctttggccgcagtcttatcctgtgcaaaagcgtctaaagttccgctgagagatcacagagttgttatattcggagcgggaacggcaggaatcggaattgccgaacagctgcgggaagcattggtgcgcgagggactgagtgaagaagaatcatacaagcgcttctggtgcatagacaggaacgggctgttaacagatgatatggatcagcttcttgatttccaaaagccgtatgcccgttcggctgatgaagtgaaggattatcagcggaacggagacggcggaggcattgatcttcttgaagtggttcggcaggcgaaaccgacgatcctgatcggcacatctacggtttccggcgctttcactgaagaaattgtaaaagaaatggcgtcacatgtgaaacggccggcgattttgccaatgtcaaatccgacaactctttctgaagcaaagccggaggatttaatcgaatggacagaaggccgtgcgctgatcacgacaggaagcccgttcccgccagttgaatataacggagttacgtatcatatcgggcaggcaaacaacgcgcttgtcttccctggtctcggtcttggaacgattgttacaaaatcaaaattaattaccgacggcatgtttgaagcatgtgcccgggcaatcgcaggtatggtcaatgtcggggtgcctggggcgccgatgcttccaaaagttgaagatttgcgcactgtttcggcaaccgttgctgttgaagttgcaaaaaccgcaatgaaggaaggcgtcgctacggaagagcctgaagacattatacaggcagtgcaggatgcgatgtggtatccggtatacaaaccgattcgcgcgatataa

SEQ ID NO: 46940 - DNA, 2157 bp, Bacillus subtilis
atggtcagcatccgccgcagcttcgaagcgtatgtcgatgacatgaatatcattactgttctgattcctgctgaacaaaaggaaatcatgacaccgccgtttcggcttgagacagaaataacagattttcctctggctgtcagggaggaatactcccttgaagcaaaatacaagtacgtctgcgtatccgaccatcctgtgacatttggaaaaatccattgcgtcagagcatccagcggccacaaaacggatctccaaattggcgcggtcatccggacggcagcgtttgatgacgaattttattatgacggagagctgggcgccgtttataccgcggatcataccgtatttaaagtatgggcgcctgctgcaacctcagctgctgtcaagctttcacaccccaataaaagcgggcgcacattccaaatgactcgcttggaaaaaggcgtctatgccgttacggtcacaggtgaccttcacggatatgagtatttgttttgcatctgcaacaattcagaatggatggaaacagttgaccagtatgccaaggctgtgactgtaaatggagagaagggcgtcgtcttgcgcccggatcaaatgaaatggactgctcctcttaaaccattctcacaccctgtggatgccgtcatctatgagacgcatcttcgcgacttctccatccatgaaaacagcggcatgataaacaagggaaaatacttagcgctgacggaaactgatacacaaaccgcaaatggcagttcttcgggattagcgtatgtaaaagagcttggtgtgacacatgtggagcttctgccggtgaatgattttgccggagttgatgaagagaagccgcttgatgcatacaattggggatataacccgcttcatttctttgccccggagggaagctatgcctcaaatcctcatgatcctcaaacgagaaaaacagagctgaaacaaatgatcaataccctgcatcagcacggtctgcgagtcattctggatgttgtttttaaccatgtgtataagagggagaattccccctttgaaaagacagtgcccggttattttttccggcacgacgaatgtgggatgccatcaaacggcaccggcgttggcaatgatattgcatcagaaagaaggatggcaagaaaattcattgcggattgcgtggtctattggcttgaagaatacaatgttgacggcttccgctttgatctcctcgggattttagatattgacaccgtgctttatatgaaagagaaagcaactaaggcaaagcccggaatcctgctttttggagaagggtgggacctggctacaccgctgccgcatgaacagaaagctgctttggcgaacgcgccaagaatgccgggcatcggcttttttaatgatatgtttcgtgacgctgtaaaagggaacacctttcaccttaaggcaacagggtttgcgctcggcaacggtgaatcagcacaagctgtgatgcatggaattgccgggtcttccggatggaaggcattagcaccgattgttccggaaccaagccagtccatcaattatgtcgaatcacacgacaatcacaccttttgggataaaatgagctttgcgcttcctcaagaaaatgacagccgaaagcgaagcaggcaaaggcttgcagtcgcgattattttgcttgcccaaggggtgccgtttattcacagcggccaggaatttttccggacgaagcagggagtggaaaacagctatcaatccagtgacagcatcaaccagctcgactgggatcgccgtgaaacattcaaagaagatgttcactatatccgcaggctgatctcgctgagaaaagcgcatcctgcattccgtcttaggtccgctgcagacatccagcgccatcttgaatgcttgacgctaaaagaacaccttatcgcatacaggctttatgatcttgacgaggttgacgaatggaaagatatcattgttatccatcacgcgagtccagactccgtcgagtggaggctgccaaacgacataccttatcggcttttatgtgatccatcaggatttcaggaagacccaacagaaatcaagaaaacggttgcagtaaacggcatcggaacggttatcttatatttagcatcagatcttaagagttttgcttga

SEQ ID NO: 46941 - DNA, 711 bp, Bacillus subtilis
ttgacaaatttgcttgaagcttcaatagaacaggccgggtatacaagccgaaaaaaagtgctcaccgatgtttttctggaagtcagaaaaggggaactggttggactgatcggagctaacggcgcaggaaaaagcaccgcaatcaaggcgatactcggcctttcagaagattttaaagggcatattgcctggaacgactgttcatttgcatatattccggagcatccgtccttctacgaagaactgacgctgtgggagcatttggatctgatcagcacacttcacggcattgaagagagtgaatttgcgcatcgggcccaaagcctgctgcagacgttttcgctagatcatgtcaaacatgagctgcctgtcaccttttcgaagggcatgcagcaaaaactaatgcttatccaggcctttctctctaagccggatatgtatgtgattgatgaaccgtttatcggccttgatccgatatcgacgaaacgctttgtggacatgcttaaggctgaaaaagaacgtggagccggaattcttatgtgcacgcatgtactcgataccgcggaaaaaatctgtgaccggttttatatgattgagaaaggttcattatttctccaaggcacgttaaaagatgttcaggacaagaccggattagaggggcagtcattgcttgactgtttttataaggcagttcaaggtgatcggctatga

SEQ ID NO: 46942 - DNA, 1170 bp, Bacillus subtilis
ttgaagattgattcctggttaaacgagcggttagacagaatgaaagaagccggcgtacatcgtaacctgcggtcaatggatggagcgccggttccagagaggaatattgatggcgaaaatcaaacggtctggtcctcaaacaattatttagggctcgcaagcgatagacgtttgatcgatgcagcccaaacagcattgcagcaatttgggacaggaagcagcggttcacgtttaacgacaggcaattcggtctggcatgaaaagctagaaaagaagattgccagctttaaactgacagaagcggccctgctgttttcgagcggttacttggccaatgtcggtgtcctttcatccttgccagaaaaggaagatgtcattttaagtgaccagctcaatcatgcaagtatgatcgacggctgccgactttctaaggctgatacagttgtttatcggcatattgatatgaatgatcttgaaaacaagctgaatgaaacacagcgttatcagcgccgttttatcgtaacagacggagtattcagcatggatggcacaatcgcccctcttgatcagatcatctcacttgcgaaacgctatcatgccttcgtggtcgttgatgatgcccacgcaacaggagttttgggcgattcgggacaaggaacgagtgaatactttggtgtttgtcccgacattgttatcggcaccttaagcaaagctgttggcgcggaaggaggttttgcggcaggatcagcggtcttcatcgactttttgctgaaccatgccagaacatttatctttcaaaccgctattccgccagccagctgtgcggctgctcacgaggctttcaacatcattgaagccagcagggaaaaacgacagcttttattttcttatatcagcatgatcagaaccagtctgaagaatatgggttatgtggtgaaaggagatcacacaccgattattcctgtagtcattggcgatgcccataaaacggtcctatttgctgaaaaactgcagggcaagggaatttatgctcctgccattcggccgccaaccgttgcgccgggtgaaagccggattcgaattacaatcacgtctgaccacagtatgggtgatattgatcatttgctgcaaacatttcattcaatcggaaaggagctgcacatcatttga

SEQ ID NO: 46943 - DNA, 1347 bp, Bacillus subtilis
atgactcatgatttgatagaaaaaagtaaaaagcacctctggctgccatttacccaaatgaaagattatgatgaaaaccccttaatcatcgaaagcgggactggaatcaaagtcaaagacataaacggcaaggaatactatgacggtttttcatcggtttggcttaatgtccacggacaccgcaaaaaagaactagatgacgccataaaaaaacagctcggaaaaattgcgcactccacgttattgggcatgaccaatgttccagcaacccagcttgccgaaacattaatcgacatcagcccaaaaaagctcacgcgggtcttttattcagacagcggcgcagaggcgatggaaatagccctaaaaatggcgtttcagtattggaagaacatcgggaagcccgagaaacaaaaattcatcgcaatgaaaaacgggtatcacggtgatacgattggcgccgtcagtgtcggttcaattgagctttttcaccacgtatacggcccgttgatgttcgagagttacaaggccccgattccttatgtgtatcgttctgaaagcggtgatcctgatgagtgccgtgatcagtgcctccgagagcttgcacagctgcttgaggaacatcatgaggaaattgccgcgctttccattgaatcaatggtacaaggcgcgtccggtatgatcgtgatgccggaaggatatttggcaggcgtgcgcgagctatgtacaacatacgatgtcttaatgatcgttgatgaagtcgctacaggctttggccgtacaggaaaaatgtttgcgtgcgagcacgagaatgtccagcctgatctgatggctgccggtaaaggcattacaggaggctatttgccaattgccgttacgtttgccactgaagacatctataaggcattctatgatgattatgaaaacctaaaaacctttttccatggccattcctatacaggcaatcagcttggctgtgcggttgcgcttgaaaatctggcattatttgaatctgaaaacattgtggaacaagtagcggaaaaaagtaaaaagctccattttcttcttcaagatctgcacgctcttcctcatgttggggatattcggcagcttggctttatgtgcggtgcagagcttgtacgatcaaaggaaactaaagaaccttacccggctgatcggcggattggatacaaagtttccttaaaaatgagagagttaggaatgctgacaagaccgcttggggacgtgattgcatttcttcctcctcttgccagcacagctgaagagctctcggaaatggttgccattatgaaacaagcgatccacgaggttacgagccttgaagattga

SEQ ID NO: 46944 - DNA, 1299 bp, Bacillus subtilis
atgaaaaagattacatttatcggtgcagggagcacgattttcgccaaaaatgttttgggagactgcctgttaacagaggcactgaatggatttgagttcgctctttacgacattgatcccaaacgcctgcaggaatcccagctcatgctcgaaaatctaagagaccgttataacccaagtgtggccatcaacagctatgatgacagaaaactcgccttgcaaaacgcaggctatgtcatcaatgcgattcaggttggaggatacaaaccgagcacagtcatcgatttcgagattcctaaacggtatgggctgcgccagacgatcgccgatacagtaggcatcggcgggatattcagatctctcagaacaatcccggtcttatttgatatcgcaaaagatatggaggaaatgtgccctgacgcatggttcttaaactatacaaatccaatggccactcttacaggcgccatgctccgctataccaatatcaaaacaatcgggctctgccacagtgttcaagtgtgcacgaaggatttatttaaagctctcggaatggagcatgacggaattgaggaacgcattgcgggcattaatcatatggcttggcttttggaagtcaaaaaagacggcacagatttatatccagaaatcaaaaggagagcgaaagaaaaacaaaaaacaaagcatcatgatatggtgcggtttgaattaatggataagttcggctattatgtcacggaatcgtccgaacataacgcagagtatcacccgtactttattaaacggaattaccctgaactgatcagcgagctgcaaatcccgctcgacgaatatccgagaaggtgcgtcaagcagattgaaaattgggagaaaatgcgggatgatatcgtcaataataaaaaccttacgcacgaacgctcaaaggaatatggttcaagaattatagaagcaatggaaacaaacgaaccattcaccttcggaggaaacgtcttgaatacagggctgatcaccaaccttccttcaaaagcggttgtggaagtgacatgcgtcgccgacagaaaaaaaattacaccgtgcttcgccggagaactgcctgagcagcttgcagccttaaaccggacgaatattaatacacagctgatgacaatcgaagcggctgtcacacgaaaaaaagaagcggtttaccaagctgcaatgcttgatccgcatacaagcgcggagctttccatgaaggacatcatctccatgtgcgacgatttatttgcagcacacggcgattggcttccggaatacaaataa

SEQ ID NO: 46945 - DNA, 1392 bp, Bacillus subtilis
atgcaaaaacaaaaacaagagctgcaccgcggactcgaagaaaggcatatttctttaatgtctttaggagctgctataggagtagggttgttcctcggctccgcatcagctattcaattagcagggcctggtattttggtagcgtatgccgcaagcggcctggtcatgttttttattatgagagcgcttggggaaatggccattcaaaaaccggtcgcaggctccttcagcaggtatgcgcgtgattatttgggaccgcttgcaggctatttaacaggttggaactactggtttttatgggttgtcacctgtatggccgaaatcactgctgtcggcatctatatggggttctggtttccggacgtgccaaactggatttgggcgttatcggcactggtcattatgacgggtgttaatttcctggctgtcaaagcttacggcgagctggaattttggttcgcattgattaaaattgttgcaatcttatccatgattgctgtcggtttattgatgattattgcaggagtcggcaatgggggcattgcaaccggaatcagcaatttgtggaacaacggaggatttttccctcatggattaaaaggggttttattgtctcttcaaatggtcatgttcgcctatttagggattgaaatgatcggggtgacggctggcgaagtaaaaaacccgcaaaaatcgttagccaaagcaatcgatacagtattttggcggattttgattttttatgtaggcgctttatttgtcattatgtctatttatccgtggcaggaaattggctctcaaggaagtccatttgttctcacatttcaaaaagtgggcattccatcggccgcaggtatcattaactttgtcgtgttgacagccgcgctgtcttcatgcaacagtggtattttcagcacagggcggatgctgtttaacttggcggaacagaaagaggcgccacaagcatatggtcagctgacgaaaggcggcatcccgggtaaagctgttctggcttcagcgggcgctttattagtcggagtgctgttaaactatgttgtccctgcgaaggtatttacttgggttacaagtattgcgacgttcggagcgatttggacgtgggcaatcattttgctttctcaaataaaatacaggaaaagtttgaagccggaagaaaagaaacaattaaagtacaaaatgcctttatttccgtttacgtcttatgtgtcattggcatttctagcattcgtcgtcattcttatggcttacagccctgatacaagagtagccgtgattatcgggccgatatggtttctcatcttgctggctgtgtactatggaaaagggtttcataaaaaaaatgcggctgctgccagcgaacgaaatatcagctga

SEQ ID NO: 46946 - DNA, 1203 bp, Bacillus subtilis
atgagtaaaaatcgtcgtttatttacatcagaatctgttacggaggggcatccggataaaatctgtgaccagatttctgacagcattttagatgaaattttaaagaaagaccctaacgcgcgtgttgcttgtgaaacatctgtgacaacaggtttggttcttgtaagcggagagatcacaacttctacgtatgttgacattccgaaaacggttcgccaaaccattaaagaaatcggatacacacgtgcaaaatacggatttgatgcggaaacttgtgcggttttaacatcaattgatgagcagtctgctgatatcgcgatgggcgtagaccaagcgcttgaagcccgtgaaggcacaatgagcgacgaagaaattgaagcgattggtgcgggtgaccaaggattaatgttcggttatgcgtgcaacgaaacgaaagagcttatgcctcttccaatttcacttgcccataaattagcccgccgcctaagtgaagtccgtaaagaagatattcttccgtaccttcgccctgacggcaaaacacaggtaacggttgagtacgatgaaaataacaaaccagtccgcattgacgcgattgttatttcaactcagcatcaccctgaaattacacttgagcaaattcagcgcaacattaaagaacatgtaatcaatccggttgttcctgaagagctgattgatgaagaaacaaaatatttcatcaaccctacaggacgtttcgtaatcggaggccctcaaggggatgcgggacttacaggacgcaaaatcatcgttgatacgtacggcggctatgcacgccacggcggaggcgcgttctcaggtaaggacgcgacgaaggtagaccgttctgcagcttatgcggcaagatacgttgcgaaaaacatcgttgcggctgagcttgctgattcttgcgaagtacagcttgcttacgcgatcggtgttgcacagcctgtgtcaatctcaatcaacacattcggttcaggaaaagcttctgaggaaaaactgattgaagttgttcgcaataactttgatttacgacctgccggcattatcaaaatgcttgatttgcgccgtccgatctataaacaaactgctgcgtacggccactttggacgtcacgatgttgaccttccatgggagcgcacagacaaagcggagcagctgcgtaaagaagcgttaggagaataa

SEQ ID NO: 46947 - DNA, 1584 bp, Bacillus subtilis
atgaactcagttgatttgaccgctgatttacaagccttattaacatgtccaaatgtgcgtcataatttatcagcagcacagctaacagaaaaagtcctctcccgaaacgaaggcattttaacatccacaggtgctgttcgcgcgacaacaggcgcttacacaggacgctcacctaaagataaattcatcgtggaggaagaaagcacgaaaaataagatcgattggggcccggtgaatcagccgatttcagaagaagcgtttgagcggctgtacacgaaagttgtcagctatttaaaggagcgagatgaactgtttgttttcgaaggatttgccggagcagacgagaaatacaggctgccgatcactgtcgtaaatgagttcgcatggcacaatttatttgcgcggcagctgtttatccgtccggaaggaaatgataagaaaacagttgagcagccgttcaccattctttctgctccgcatttcaaagcggatccaaaaacagacggcactcattccgaaacgtttattattgtctctttcgaaaagcggacaattttaatcggcggaactgagtatgccggtgaaatgaagaagtccattttctccattatgaatttcctgctgcctgaaagagatattttatctatgcactgctccgccaatgtcggtgaaaaaggcgatgtcgcccttttcttcggactgtcaggaacaggaaagaccaccctgtcggcagatgctgaccgcaagctgatcggtgacgatgaacatggctggtctgatacaggcgtctttaatattgaaggcggatgctacgctaagtgtattcatttaagcgaggaaaaggagccgcaaatctttaacgcgatccgcttcgggtctgttctcgaaaatgtcgttgtggatgaagatacacgcgaagccaattatgatgattccttctatactgaaaacacgcgggcagcttacccgattcatatgattaataacatcgtgactccaagcatggccggccatccgtcagccattgtatttttgacggctgatgccttcggagtcctgccgccgatcagcaaactaacgaaggagcaggtgatgtaccattttttgagcggttacacgagtaagcttgccggaaccgaacgtggtgtcacgtctcctgaaacgacgttttctacatgcttcggctcaccgttcctgccgcttcctgctcacgtctatgctgaaatgctcggcaaaaagatcgatgaacacggcgcagacgttttcttagtcaataccggatggaccgggggcggctacggcacaggcgaacgaatgaagctttcttacactagagcaatggtcaaagcagcgattgaaggcaaattagaggatgctgaaatgataactgacgatattttcggcctgcacattccggcccatgttcctggcgttcctgatcatatccttcagcctgaaaacacgtggaccaacaaggaagaatacaaagaaaaagcagtctaccttgcaaatgaattcaaagagaactttaaaaagttcgcacataccgatgccatcgcccaggcaggcggccctctcgtataa

SEQ ID NO: 46948 - DNA, 1461 bp, Bacillus subtilis
atgctgacagaacagcccaactggctcatgcagcgggcacagctgacacctgagagaatcgctctcatctatgaagaccaaaccgtgacatttgcagaattgtttgccgcgtctaaacgaatggcggaacagcttgccgctcattcggttcggaaaggggatactgcagctattttgctccaaaaccgtgcagaaatggtatacgctgttcacgcttgttttttgcttggtgttaaggcggtgcttttgaatacgaagctgtcaacacatgaaaggctgtttcagctggaggattcgggatccggctttttattgacagattcaagctttgagaagaaagaatatgaacacatcgttcaaacgattgatgtggatgaactgatgaaagaagcagcagaggaaattgagatcgaggcttatatgcaaatggatgcaacggcaacgctgatgtatacgtcgggtacgacaggaaagcccaagggagttcagcaaacgttcggaaaccattatttcagtgcggtgtcgtccgctcttaatttgggtataacagaacaagaccgctggcttatcgcattgccgctctttcatatcagcggattgtccgcattatttaaatctgtgatctatggaatgactgtcgtgcttcaccagcgtttttccgtaagcgatgtgctgcattctatcaacaggcatgaagtgacaatgatatctgcggtgcagactatgctggccagtcttttggaagaaacaaaccgctgccctgaatccatcagatgcattcttctcggcggcggtcctgcaccgctgccattgcttgaggaatgccgtgagaaaggattccctgtctttcagtcatatggaatgacagaaacatgctcgcaaattgttaccctgtcgccggaattcagcatggaaaagctcggatctgcggggaaaccgctgttttcgtgtgaaatcaaaatagagcgggacggacaggtatgtgaaccgtatgaacacggtgaaatcatggtcaaaggcccgaatgtcatgaaaagctattttaaccgggagagcgcaaacgaagcctcctttcaaaatggctggctgaaaacaggtgatcttggttatttggacaatgaaggctttttatatgtattagacagacgttcagatctgatcatatccggcggagaaaacatttatccggccgaagtggagtcagtgctgctttcacaccccgctgtggccgaagccggggtttcaggggctgaggacaaaaaatgggggaaagtgcctcacgcctatcttgtccttcacaagcctgtgagcgcaggagaattgactgactactgcaaagaacgcttggcgaagtataaaattccggcaaaattctttgtgcttgaccgcctgccgcgcaatgcgtctaataagctcttgcgaaatcagctgaaggatgcgcgtaaaggagaactgctatga

SEQ ID NO: 46949 - DNA, 819 bp, Bacillus subtilis
atgataaaaaaagcgatcattcctgcaggcggattcggcacgagaaatctgccggtgacgaaggtgattccgaaagaaatgtttccggtaggatctaagcctgtgattcattatcttgttgaagaattaaaggagtcaggcattgaggacattttgatggttgtatcgagccataaaaatctgattgtcgactattttgattcctctttggcacttgaggcttttttggcctctaagaataaactgcatttacttagagagcatcccattccggatatacggattcactatgtgcggcagccttatgcaaagggtcttggcgacgccatttctttcggaaagcaatttgcaggaggagagccttttgccgtcgttttgccagatgatctgattttttccgccaatcagccggctttggggcagctgattgaagcgtatacgaaatatcagtccagtgtgatcggcttaaaagaaacaaaaacggaggatttacatcattacggggtgataaaaggggagcctgttgaaaaagggctttatcgcatacaggatattgtggaaaagcctaaacaaaaccctccgtctcattttgccgcagcagggcgttatattttcacaccggatatttttaatgagctggaggcattagaagctgatagcggaggagaagtgcaggtaacggatgcgataaaagcttcgctcggggcatgtaccgtatacgggaaattgctagagggcgagcggtatgacatcggcctgcaaaaggattatctgaagctgatttacgatatgctgaaaacggaaaagaacccccaataa

SEQ ID NO: 46950 - DNA, 1287 bp, Bacillus subtilis
atgaaaatttgtgtggttggcgccgggtatgtcggtttaaccctatcagcggcactggcatccatcggacatgacatgatatgcacagacaaagacgtcaaaaaaatcgggcagctgaaaaaaggagtcattcccttttacgagcctgggctttcagatgcaatacttcgttgcggcaatctctcgttttcttctgaagtgaaatcgagcatggaggaatgtcccgttatttttatcgcagtcggaactccgccgcgttcggacggatcagctgatacgaaagccctgcagtccgtcatcggtgatttaagcgaggcgatccgatcgtataaaaccattattacgaaaagcactgttccgcccgggacaaatgaaaacatagcaaaacagctgattgcctccggagtgtctaaaaacctctttaatatcgtatccaatccggagtttctgcgggaaggcaatgccttatatgacatgctgcatcctgacaaaacagtcatcggtgttcaggaagaagatcacgtatcggcagccatcgtcaaatccatttacaaacacattgataccccttttatcgttacaagcttagcgggagcagagctgatcaaatatgccaacaatttctttttagcggccaaaatttcgttcattaacgaaatggcccgcatatgtgaagcctatcaatcagatatctcagatatttcccgcgctatcggtctagacccaaggatcgggaagcactttttgcaggcaggcatcggatacggaggctcttgttttccaaaggatctgcaggcgctgcaatttgctgcccaggaaaaaaacacggagaccttcctgctccgggccgtgcagcacattaatgacacccagcttggcctgtatatcaaaaaaatacagtcattcttcgaaacacttcaaggcaagaaagcggctgtactcggcatttccttcaaaccgaatactgatgacatccggaattctcaggctgtcagactgatggaaaggctggcggagctgggatgtgatgttcatgcatatgatcctgaagctgtacttccagaacatttgcggcaacatgtaactcagcattctcaagcttttgatgcgatcgaagagagtgactttttatttttggcgacagaatggtctgagtttttagcgtttgattggaaaaaggctgcagatatcatgaaagggcgtcttgtgattgacggacgcaacgtactaaaaaaagaactgatcgaggcttgcggcctgatctgtacgggagttggccgtccatga

SEQ ID NO: 46951 - DNA, 951 bp, Bacillus subtilis
atgaaaatactcgtcacaggagcagcgggctttatcggctcccacctctgcgaagaattactaaaagataagaaacataacgttatcggaatcgatgactttatcggtcctactccattttccttgaaattaaaaaaccttaaaaacctgctgccggaaaagcgatttacgttcataaaggaaaatctgctgacagccgatcttgcttccttactggaaggagtggacgtcatctttcatttggcggccataccgggtgtccgctcaagctggggcaatcattttcacccatatgccgcacataatatccaagcgctccaaaggctcctcgaggcgtgccgggaacattctattcaaacgttcgtctttgcatccacctcttccgtctatggcgaaaaacaaggaaaagtcagcgaaaacacgtcgctttctcctttatctccgtacggggtaacaaagcttacgggagaaaagctttgccatgtgtataaacagagctttggcattccaattgtgattctccgtttttttaccgtatacgggccaagacagcggccggatatggcttttcaccggctcattaagcagcaccttcagcaaaagccgcttaccatcttcggtgatgggcagcagtcaagagatttcacttatatcagcgactgtgtcaaaggcatcaccgctgttcttgggaaaccccaccttattggtgaaacagtaaatatcggcggcgcagagcgtgcctcagtcttaaaagttgtctccctcattgaggatatttccgggagaaaagcaacactgcacttttcggacaaaatagcaggggaaccgagcaacacgtgggcggatatttcaaaagcaaaacagctcttgcattatgatcccgccacatccttaaaggatggcttgaccaacgaaatcgcctatttatcgtcgctgtatcagggggaataa

SEQ ID NO: 46952 - DNA, 2397 bp, Bacillus subtilis
atgttctcgagtaaagaacgctttgcagacttatttttaaagcgtctggaaatgacgtgcggaaaaagctttaaagattctgccaagctggatcaatataaaacgttgggcaatatggtcagagagtatatcagcgctgattggatcgaaacgaatgaaaaaagcagatcaaattccgggaagcagacatattatttatcaatcgaatttctgctcggtcagctccttgagcaaaacttaatgaatcttggtgttcgtgatgttgtagaagctggtttaaaggaaatcggcatcaatttagaggagatccttcagatagagaacgatgcaggtctcggcaatggcggacttgggcgcttggccgcttgctttttagattcgcttgcttcgttgaacctgcctgggcacggcatgggcatacgttataagcatggtttgtttgagcaaaaaattgtagacggacatcaggtggagctgcctgagcaatggctgaaaaacgggaacgtatgggaagtaaggaatgcggatcaagcagtggacgtgccgttttggggcgaagtccatatgacagaaaaaagcgggcgcctgcattttcgccatgaacaagcgacaattgttaccgctgttccttatgatatcccgatcatcggctatgaaacgggcactgtcaacacgttaaggctttggaacgccgagccctatgcccattatcacggcggtaatattttgtcttataagcgagaaacagaagcggtttctgaattcttatatcccgatgacacccatgatgaggggaaaattttacggctgaagcagcagtattttttagtatgcgcaagcttaaaaagcattgtgaacaattaccgtaaaacacataaatctttatccggcctgcataaaaaagtgagcattcatattaatgacactcaccctgcgcttgcggtgcctgagctaatgcggattttgctcgatgaagagaacatgagctgggaagaagcttggcatatcactgtacatacgatttcttatacaaatcatacaacattgtcagaagcgctcgagaaatggccgattcatttgtttaagccgctgctcccgcgaatgtacatgattattgaagagatcaatgagaggttttgccgtgcagtttgggaaaagtatcctggagactggaaaaggatagagaacatggcgattacagcgcatggtgttgtcaaaatggctcatctggccatagtaggcagctacagtgtaaatggcgttgcaaaaatacattccgatatattaaaggaaagggagatgcgcgactttcacttgctgtttccgaatcgttttaacaataagacgaatggaattgcccacaggcgctggctgttaaaagcgaatccaggcttgtctgccatcattacagaggcgatcggcgatgaatgggtcaagcagccggaatcactgatccgtttagaaccgtacgccactgatcctgcatttattgaacagtttcaaaacaacaaaagcaagaaaaaacaagagcttgccgatttgattttttgcacggccggggtggttgtgaaccctgagagcatattcgacgtacaggtgaaacggcttcatgcatataaacggcagctgctgaatgttcttcacattatgtatttgtataaccgcctcaaggaggattcggggttttcaatctacccgcaaacctttattttcggggcaaaggcttcaccaagctattattatgccaagaaaatcattaagctgatccattctgtcgcagaaaaagtcaattatgatccggcggtcaaacagctgatcaaagttgtttttttagaaaattatagagtttctatggctgagcgaatttttccggcatcagacgtaagtgagcaaatttcaaccgcaagcaaggaagcgtctggtacagggaatatgaagtttatgatgaacggggctttgacgatcggcacgcatgacggcgcaaatatcgagatccttgagcgggtgggccctgactgtatttacacgttcggcttaaaggcggatgaggttctatcgtatcaggaaaacggcggctataggtcgagggaatattatcagcatgacaggagaatcaggcaggtagcggatcagttgatcaatggtttttttgaaggagaggcagatgaatttgaatcgatctttgactcgctgcttccgcataatgatgagtattttgtgctgaaggatttcagctcatatgcagatgcacaggagcgaattcaagctgattatcgagagcgaaggaaatggtctgagcattcgattgtaaacattgctcattctggatatttctccagcgaccgcacgatccgggaatatgcgaaggacatttggggcatcaagccgatgatgtga

SEQ ID NO: 46953 - DNA, 1455 bp, Bacillus subtilis
ttgaagatattatttgctgtgtcagaatgcaccccatttgtgaaatcaggaggtcttgccgatgtagcaggtgctctgccaaaggcgcttgcgcgattaggcaatgaggtagctgtgatgctgccgaagtacagccaaatacctgaaccgtggaaaaagcgtatgaaaaaacaggctgagtgtaccgtagctgtcggctggcggcagcaatattgcggaattgaacatatggcagagaatgatgtgaattattacttcatcgacaatgagtactatttcaacagggattcgttgtacgggcattatgatgacggtgagcggtttgcctttttttcaagagctgtgctggaggctgccaaagttgtgaatgttcaagccgatattgttcatactcacgattggcatacagcgatggtcaattatttgctgaaagaggagtacagaaaacatcctttttatgaacggatgaaaagcgtgctcacgatccacaacctgcagtttcaaggcatattccctcctgatgtcacacatgacttgctgggtcttgagatggatcattttcattatgaaaggttagaatgcaacggatttgttaattttatgaaagcgggcatcattgcggctgatcatgtgacaactgtgagccccacttacagaaatgaaatcatgacgccgtattatggtgagcagttggaacaggttttgcaatatagggaagatgatgtaaccggcatattaaatggcattgatgatacgttctatcagccgaaaagcgacccttatatagaggcgcaatacgattcaggggatcttgcatgcaagctggaaaacaaaacgaagcttcagcagcggatggggcttccagagaaaaacgatattccgctgatcagtatggtgacaaggctcactaaacaaaaggggcttgatcttgtccgcagaattatgcacgaacttcttgaggagcaagacatacagctggttgtgctaggcacaggagaacgtgaatttgaagattatttccggtatgcagaatttgcttttcatgagaagtgccgggcttatatcgggtttgatgagccgctagcccatcaaatttatgcgggctctgatatgtttttgatgccgtcgaaatttgagccgtgcggtttggggcagctcattgctcttcaatatggcgccattccgattgtcagggaaacgggcggtctttacgacactgtccgtgcctatcaggaggaagagggaacgggcaatggctttacgttttccgcctttaatgcgcatgatctgaaatttacgatagaaagggcgctgtcgttttattgccaacaggatgtatggaagagcatcgtgaagaccgctatgaatgcagattacagctgggggaagtcggctaaagagtatcagcgtattttcgagcaggtgacaaggagtggacgggatgttctcgagtaa

SEQ ID NO: 46954 - DNA, 1143 bp, Bacillus subtilis
atgaaaaaacaatgtgtagccatgctccttgccggcgggaagggcagccgtctcagcggattaacaaaaaatatggccaaaccggctgtatctttcgggggaaaatacaggattattgattttaccctaagcaactgttctaattcaggcatagacacagtcgggattttaacgcaatatcagccgctcgagctgaattcctatattgggatcggcagtgcatgggacctggatagatataatggcggcgtgacggttttacccccttatgccgagtcatcagaagtcaaatggtataaagggacggcaagctccatttatgaaaatctcaattatttgaatcagtatgatcctgagtatgtactgattttatcaggagatcacatatacaaaatggactacggcaaaatgcttgattatcacattgaaaagaaagcagatgtgaccatctctgtcatcgaagtgggctgggaggaagcaagccggttcggcatcatgaaggccaatccagatgggacgatcacacattttgatgaaaagcccaaattccctaagagcaatcttgcctcaatgggaatttatatattcaattggccgcttttgaaacagtatcttgagatggacgatcaaaacccttattctagccacgacttcggcaaagacattattccactgcttttggaagagaaaaagaagctttctgcttatccgttcaagggatattggaaggatgtcggaacggtgcagagcttgtgggaagccaatatggatttgttaaaagaggactcggagctgaagctgtttgaacgcaaatggaaaatttactccgtcaatccaaatcagcctccgcaatttatttcatctgatgcgcaggttcaagattcgcttgtgaacgaaggttgtgttgtatatggaaatgtgtctcactccgttctttttcaaggtgtgactgttggtaagcatacgactgttacatcatccgtcataatgccggatgtgacgattggggagcatgtagtcattgaaaatgccatcgttcctaatgggatggtgctgccggatggcgcagtgattcgctccgaaaaagacattgaagaggtgctgctcgtttcagaggaatttgtagaaaaagaattgatttaa

SEQ ID NO: 46955 - DNA, 1884 bp, Bacillus subtilis
atggccgctgccagcccgacagcacatgatgtttatctttttcacgaaggcagtctgtttaaaagctatcagctgtttggctcgcattaccgcgagctgaatggcaaaagcggatatgaattctgtgtgtgggcgcctcatgcgtcggaagtacgagtggctggagattttaacagctggtctggagaagagcatgtgatgcacagagtgaatgataatggcatttggacgttatttattccaggtataggagaaaaggaacgatataaatacgaaattgtgacgaataacggtgagatcaggctgaaggcagatccatacgctatttattcagaagtcagaccaaacacagcgtcacttacttacgatttggaaggatacagctggcaagatcaaaaatggcaaaagaaacagaaggctaagacgctgtatgaaaaacctgttttcatttatgaactgcatcttgggtcttggaagaagcattctgatggcaggcattattcctataaagaattaagtcagacgcttatcccttatatcaagaagcatgggtttacccatattgaactgcttcccgtgtatgagcatccatatgatcgttcatgggggtaccaaggaacggggtattacagcccgacaagcaggtttggcccgccgcatgatctgatgaagtttgtggatgaatgtcatcaacaaaatatcggagtcattttggattgggtccccggacatttttgtaaagatgcacatggcctttatatgtttgatggagaaccgctttatgaatacaaagaagaacgtgatcgggagaactggttatggggcacggcaaactttgacctggggaaaccggaagttcatagttttttaatttcgaatgcgttgtactgggcggaattctatcatatagatggatttagggttgatgcagtggctaatatcttgtattggccaaatcaggatgaacgccacacgaatccatatgctgttgattttttaaaaaaactcaatcaaaccatgagagaggcatatccccatgtgatgatgattgcagaagattctacagaatggcctcaagtgacaggtgccgttgaggaaggggggcttggttttcattataaatggaatatgggatggatgaatgacgtactgaaatacatggagacgccgcccgaagaaaggcggcattgtcatcagcttatctctttttcattactatatgcgtttagtgaacattttgtattgccgttttctcatgatgaagtcgtatacggaaaaaaatcacttctcaataaaatgcctggcgactactggcagaaatttgcccagtatcggcttttgctgggctatatgacagtgcatcccggaaagaaattgatctttatgggatcagagtttgctcaatttgatgaatggaaagatacagaacagcttgattggtttttggactccttccccatgcatcagaaagccagcgtttttacgcaagatcttctccgcttttaccaaaaaagcaaaatcctttatgagcatgaccatcgtgcacaatcgtttgaatggattgatgtccataatgacgaacaatcaatcttttcttttattcgttatggccaaaagcacggtgaggcgcttgtcatcatttgtaattttacacccgtggtctatcatcaatatgatgttggagttcctttttttactcaatacattgaagtgcttaacagtgacagtgaaacatatggaggctcagggcaaatcaacaaaaagccgttatcggctaaaaagggagcacttcatcataaaccgtgttatatcacgatgaccatccccccttacggcatctcgattttacgggcggttaaaaaaagaggagagataaaaagatga

SEQ ID NO: 46956 - DNA, 1212 bp, Bacillus subtilis
atgatgacattaaatatgaaggtagaaagcatgcagaaattccacacatttgaaattccgactgtgattaagcatggaatcggagccatcaagcatacgggtgaggaagtagctgcactgggcgtttcaaaagcgctccttgtcacagaccctgggatttataaagccggtgttgctgatcccgtaatcgaatcacttaaagaagcaggcattgaagtggtactctttaataaagttgagccaaacccgcctgtccgtctggtgaatgaaggatctgagctttacaaaaaagagaactgtaatggtttggtggcagtcggaggcggaagctccatggatacagcaaaagcaatcggagtagaagcgactcacgaaggaagcgtgcttgattatgaagcggcagatgggaaaaaaccgctggaaaaccgcattcctccgctgacgacaattcccactacagctggaaccggatcagaagtaacccaatgggcggttatcacagatgaagaaagagaattcaaattcaacacgggcggtccgctgattgcagcgcacttgacaatcattgatcctgagcttcatgtttcaatgcctccgcatgtaacagctatgacgggaattgatgcgctcgcccatgccattgagtgctatacaatgaaatttgcacagccaatcacggatgcggttgccttaatggcgattgagtatgccgctcattacatcaagagggcatttgctgatggagaggatctggaagcaaggtacggaatggcgcaggctgcgatgcttgccggtctttcttacggaagtgaatcagcgggcgctgctcatgcgatgagccaaacgcttggcggtattatcccagtcgctcacggccaatgtgtagcggcgatgatgggccctgtcatggaatacaactggaagggctatcctgagaagtttgcgcgtattgcgaaagcgttcggtattgatacaagcaagatgacaacagaagaagctgcgaaagcatctgtcaattggatgtatgatctggtcgaagatttagaagtgccgactttagaagagcagggagtatcacctgatatgatcgaacgcttgtctaaagaagcaatgaaagatccgcaaaccttcggaaaccctagagatttaaatgaaaaagcatacaactggatctacaaacgctgctttaaccttacgcctaaaacggtataa

SEQ ID NO: 46957 - DNA, 1473 bp, Bacillus subtilis
atgagtcaaacattattcattgacggagaatggatcagtgccgaaaaagaacagatccgcagtattatcaacccatttaatcaagaagaaattgcaactgtaagcgagggagggcgagaggacgccatcaaagcaatcgcagccgcacgtagagcatttgacaaaggagaatggtcatcgctatccgggcttgaacgcggaaaaattgttctgaaaattgcggaattaatcagacgcgatcttgaggagctggctgagcttgaatctcttgatacaggaaaaacactcgaagaaagcaaggccgatatggacgatatcgccaatgtttttcaatattacgccggcttggcagacaaagatggcggagagatcatttcatctccgattcctgattcagaaagcaaaattattagggagccaatcggggtttgcggccagatcactccatggaattatccgctccttcaagcgagctggaaaatcgcccctgcactggccgcaggaaacacaatcgtcatgaagccgagtgagattacgccgctgacgacaatcaaagtctttaagctgatggaagaagccggtgttccaaaaggtgtcgcaaatcttgttcttggaccgggagccacagtgggcgacgagcttgccgtaaacaaagacgtcgatttgatttcatttacgggcggaattgaaacaggcaaaaaaatcatgcgggcggcaagcggaaacgtcaaaaaaatcgcccttgaacttggcgggaaaaacccaaatattgttttcaaggacgcggatttagaagttgcggttgatcaggccttaaacgctgtatttttccacgccggccaagtatgctctgcaggttcccgcttgcttgttgaggatgccattcatgatcaatttttggcggagctggtcaaacgggcaaaacgcataaaactcggaaacggttttcatgctgagacagaaagcggtccgcttatttcggcggagcacagggcaaaggtagaaaaatatgtagagatcggaatagaggaaggcgcgaagctggagacaggaggcaaacgcccggaagatcctgagcttcaaaacggctttttctatgaacctactattttctcaaactgtaattctgacatgagaatcgttcaggaagaggttttcggtcctgtattgacagtcgaaaccttcagctctgaagaagaggtaatcgagcttgcgaatgataccatctatggcttggctggagcggtatggtcaaaagacattgaaaagtgcgaacgggtagcagcccgcttgagaatgggaaccgtttggatcaacgattttcatccgtactttgcacaagcgccatggggcggatataagcaatccgggttcggacgcgagcttggaaaaataggccttgaagaatacacagaagtcaaacatgtataccgcaatacaaaaccggcagcggttaactggtttaattcataa

SEQ ID NO: 46958 - DNA, 1458 bp, Bacillus subtilis
atgatttatactgccattgatgtaggcgcatcaagcgggagaatcatggtaggtgaactgaatgaagggaagcttgacatacaagagattcacaggttcgctaacggtttcagtcaaagagacgggcattgcttatgggatattgatcatttgctaaaacaaatcctgcaaggactgcaaaaagtaaagacgcttgggtatgaacactgcaccgtaggcattgatacatgggcagtcgattatgtcttactggacgaaaaaggcgatcggttgcgggaagcaatctcctaccgtgatagaagaacagatcacacaatagacaaactggaacataccctctcaaaagccgcaatttatcaaaaaacaggaatacaatttcagcctttcaacacgatctatcaattgtttgaagaagaccgtgagctgctgaaaaagacagacaaaattatgatgattcctgattatttaggctattgtttaaccggaaaagctgtaacggaaatcacaaacgtgtccacaacacagcttttaaacgtctcaacgggaaatcttgatcctgaattgcttgaagccgtgtctgttctggaacagcaatttgcgccgctcactgaaccggggtgtgaactcgggaagctaagaaatgagtggttcccggattatgatctcccggcgtgcaaggtgatgacagtcgcaacacatgatacggcctcggccgtcattgcggcgccaggcgtaaatgatggctgggcgtatatcagcagcggaacatggtcgttaatcggggttgaaaacaaaacaccgataataactgatcttgctttagaaaacaactatacaaatgaacgcggcgcaaacaacaccattcgctttctcaaaaacattatcggcatgtgggtgatacaagaagtcaaacagcagctacaagcagattattcttttcagcagcttgcagaagaagccaaaaaaacagaaccattccagcaatttataaacttaaatgataaacgtttcctgaatccagaaaacatgataaaggaaatacaacattattgcagacaaacccgccaaaagattccccgtactgcaggcgaacttgcctgctgcatctacagcaatttagccatcatctatgcgatagccatcaaagagctcgaaacaatcacagaaaaaccgatcgagcaatttcatatcatcggcggcggagcccggaatgatttcttaaatcaattaacggcagacatgagtggaaaagcggtatatgcagggccgatagaggcaactgccaccggaaatcttttgatgcaaatgattgctgccaaagaagtcaaagacataaaagaagcccggcaagtcgtcagaaattcctttccgatcaaagtgtttacacctaaagacattgatagaagcacgatcattcagtcatttcagcaaactgttttgaaagcgctatctaaatga

SEQ ID NO: 46959 - DNA, 1665 bp, Bacillus subtilis
atgaaaaaggcttggtggaaggaagccgtagtttaccaaatttacccccgcagttttaaagattcaaatggcgacggaatcggggatattcaaggaatcagaaccaagctttcttacataaaagagctgggcgctgacgtcatatggatttgcccgctgtatgattcaccgaatgccgataatggctatgatatcagggattatcaaaacatattaagcgagtttggcacgatggaagattttgatgagctgcttggtgacattcatgatctggatatgaagctgattatggatctcgttgtgaaccacacaagcgacgaacatccatggttcatagaatcccgttcatccatacactcggaaaagcgcgactggtatatttggaaagacggcaaaaacggaaaaacgcccaacaattgggaaagcattttcggcgggccggcttgggagtatgatcaaaagacaagccagtattatctgcacctttttgataaaaaacagcctgatttgaattgggaaaatgaaaaggtgaggaatgccgtttatgacatgatcaattggtggcttgataaaggaattgacggatttcgggtggatgccattacgcatattaagaaaaaagaagggtttcctgacatgccgaatccaaagggactggactatgtcccttcctttccttatcatatgaatgctgacggcattatggatttgttaacagagctgaaggaaaacacattttcccgctatccgattatgacagttggtgaagcaaacggcgtcgctccaaaagaagcagctgattgggctggagaaaaaaacggcatattcagcatgatttttcaatttgagcatctcggcctgtgggatgtagagatcaatgaaagtattgatatcgttgcatttaaacgaattttaactgactggcaggacagtctggaagggatcggctggaatgctttgtttatggagaatcacgaccagccccgttcagtttctgtgtggggagacgacggagtgtacctgaaagaaagtgcaaaagcgctttccgctgtttattttctcatgaaaggcacaccgtttatttatcagggacaggaactcgggatgacgaacgtggcttttccatctattgaggactatgatgatgtcgcattgaaacgcctgtatgaaacaaaaacagcgaaaggcacatcacacgaggatgtgatgaagattgtctggaaaaagggaagagacaattcgcgaacgccgatgcaatggaatgctggtccatacgccggattttctgaggccaaaccgtggatcggaatcaatgagaattacaaatggctgaatgccgaggcgcaaaaaaacgataaaacatccgtttaccatttttacaaaagcttgatcaagctgcgccaaacatatgatgtttttattaacgggacatacgagctcattttaccggaagatcagcaaatctttgcatatcttcggaaaaacgagagccatactgcactgattgcggccaatctgacaggaacaccggcgttgttcaggcactctggattgccattgtcatcagatgcactcgtcttgtcaaatattgaaacagagccgcacaagcatatgacatcagtactcttaaagccgtatgaagcaagaatatatctatggtgctaa

SEQ ID NO: 46960 - DNA, 1173 bp, Bacillus subtilis
atggaaaatttcacttattataatccgacaaagctgatttttggaaaaggtcagcttgaacaattaagaaaagaattcaaacgatacggcaagaatgtactgcttgtttacgggggcggcagcattaaacgcaacggcctttatgatcaagtcacaggcattttaaaagaagagggcgctgttgttcatgagctgtcaggtgtagagccaaacccgcgtcttgcgacagtggaaaaaggcataggactttgcagagagcatgacattgattttctgcttgctgtcggcggaggcagtgtgattgactgtacaaaggcaatcgcagctggcgtcaaatatgacggtgacgcttgggatattttcagcaaaaaagtaacagcggaggatgcgctgccgtttggcactgttttaactcttgctgcaacagggtctgaaatgaaccctgattccgtgattacaaactgggaaacaaacgagaaatttgtatggggcagcaatgtcactcatccgcgtttctctattttagaccctgaaaatacgttcaccgttccagaaaatcaaacagtatacggcatggttgacatgatgagccacgtattcgaacaatacttccataatgttgaaaacacgccgcttcaggatagaatgtgctttgctgttttgcagacggtcatcgaaacagctcctaagcttcttgaagatctggaaaactacgaacttcgtgaaacgattttgtatgctggtactattgctttaaacggcacgctccaaatgggatacttcggtgactgggcttctcatacaatggaacacgctgtttcagctgtatatgatattccgcacgcgggcggtttggcaatactgttcccaaattggatgagatacacgcttgatacaaatgtaggccgttttaaaaaccttatgctcaacatgtttgacattgatactgaaggcaaaacagataaagaaattgcgcttgaaggaatcgataaactgtctgcgttctggacaagcctcggtgcaccttctcgtcttgctgattacaatattggagaagaaaagcttgagctgattgctgatatcgcagccaaggaaatggaacacggcggcttcggcaacttccaaaaactgaacaaagatgacgtgcttgccatccttcgcgcgtctctataa

SEQ ID NO: 46961 - DNA, 1164 bp, Bacillus subtilis
atgcaaaactttacatactggaatccgaccaaattaattttcgggcgcggcgaagtggaaagacttccggaggaactcaaaccttacggaaaaaacgtattgcttgtgtacggaggcggcagcattaaacgcagcggcctgtatgatcaagtgattgaacagctgaataaagccggagcgaccgtgcatgaattagcaggtgtggaaccgaatcctcgtgtgtcgactgttaataaaggtgttgccatctgtaaagaacaaaacattgatttcttgctggctgtcggaggcggaagcgtaatcgactgtacaaaagcgattgccgcaggagcgaagtatgatggtgatgcgtgggatatcgttacgaaaaagcatcagccaaaagatgctttgccattcggaacggtattgactctcgctgcaactggttcagaaatgaactcaggatctgttattacaaactgggaaacaaaagaaaaatacggctggggcagcccgctcgtattccctaaattctcgattcttgatccggtgaatacattcaccgtacctaaaaaccacacgatctacgggatggttgacatgatgagccacgtattcgaacaatacttccatcatgtatcaaacacgccgtatcaggaccgcatgtgtgaatcacttttgcgtacagtcattgaaacagcgcctaagctgatcaatgatctcgaaaattacgaattgcgtgagacgatcctgtacacaggaacaatcgcattaaacggcatgctttctatgggggcaagaggggattgggctactcataatattgaacatgcagtatcagccgtttatgatattccgcatgccggcggactggcgattctgttcccgaattggatgagacacacattgtctgaaaaccctgcccgcatgaaacagcttgcagttcgcgtgtttgatgttgaagaagcaggtaaaacggatgaagaaattgcccttgaaggtatcgataagctgtccgcattctggacaagtcttggcgctccgaaccgtcttgctgattatgatattaatgatgagcagcttgacacaatcgctgacaaggcaatggctaacggtacattcggccaatttaaatcactcaacaaagaagatgtgctgtcaattttgaaagcatcactataa

SEQ ID NO: 46962 - DNA, 732 bp, Bacillus subtilis
atggaactttatatcatcaccggagcgtcaaaagggctgggtcaagccattgcattacaggctttagaaaaggggcatgaagtccatgccttatccagaacgaaaacagatgtctctcacaaaaaactaacgcagcatcaaatagacctcatcaatctcgaagaagctgaacagcaatttgaaacattgctctcatccatcgattcagatcgttattctggtattacccttattaataacgccggaatggtaacgccgatcaaacgtgccggcgaagcgtctcttgacgagcttcagcgccattatcagctgaacctgactgcgcccgtgcttttgagtcagctgtttacaaaacggtttgcttcatacagcggcaaaaagacggttgtcaacattacttcaggagccgccaaaaatccatataagggatggagcgcgtattgcagttcaaaagccgggctcgacatgtttacgaggacattcggatttgaacaggaggatgaagagctgccggtgaacatgatttcgttctcacctggagtgatggacactgagatgcaggccgtcatccgttcttcatcgaaaaaggatttccaccacattgaacgattccggaaattaaatgaaacaggaagccttcgcagtccggactttattgccggcacgctgctttctttactagaaaaagggacggaaaacggccgcatttatgatattaaagagtttttgtag

SEQ ID NO: 46963 - DNA, 1620 bp, Bacillus subtilis
atgctgaaaggatttacgccttggcctgatgagttagctgagacctatcgaaagaacggctgctgggccggtgagacgtttggagatttgttaagggaccgggcagccaaatatggtgatcgcattgccattacatgcggaaacacccattggagctatcgagagcttgacacaagggctgatcgcctggctgccggatttcaaaagctcggcattcaacagatggatcgtgttgtggtgcagttgccaaatatcaaagagttttttgaagtcattttcgcgcttttccgtctgggggcgcttccagtcttcgcactgccttctcatcgaagcagtgaaattacatatttttgcgagtttgctgaagcggctgcatatatcattcccgacgcttattccggttttgactaccgttcgcttgccagacaggttcaaagcaagctgccgactttgaaaaacatcattgtcgcaggtgaggcagaggaatttttaccgctggaggatttgcatgcagaacctgtaaaactgcctgaagtcaaatcatcggatgtggcgttcctccagctttctggcgggagcaccgggctatcgaaactgattccgaggacccacgatgactacatatacagcctgaagcggagtgtggaggtctgctggctcgaccacagcacggtgtacttggccgcgctgccgatggcacacaattatccgctgagctcacccggcgttctcggcgtattatacgctggaggaagagtggtattatctccttctccaagtccagatgacgcatttcctttaattgaacgggaaaaggtcacgataaccgctcttgttccgcctcttgcgatggtatggatggatgcggcatcctcacgccgtgatgatttatccagccttcaagtgctgcaggtcggcggtgccaagtttagtgctgaagccgcgcgcagggtaaaagctgttttcggctgcacgctgcagcaggtgttcggaatggcagagggtctcgtcaattatacgagattggatgatcctgaggagatcattgtcaacacccaaggaaaaccgatgtctccatatgatgaaatgcgtgtttgggatgatcatgatcgcgacgtaaaacctggtgaaacaggccatctgctgacgcgggggccgtatacaattcgaggttactataaggcagaagagcataacgccgcttcatttactgaggacggtttttaccgtacgggtgatatcgtcaggctgacacgagacggctatattgtcgttgaaggccgggcgaaggatcaaattaaccgtggaggagaaaaggttgcggctgaagaggtagaaaatcatctgctggcgcatccggctgtccatgatgcggcaatggtctccatgcctgatcaatttcttggcgaaagatcttgtgtgttcattattccccgggatgaagccccaaaagccgcagagcttaaagcatttttgagagagcgcggactggcggcatataaaatccctgatcgagttgaatttgtcgaatccttcccgcagacaggagtaggaaaagtcagcaaaaaagcgctccgtgaagccatttccgagaagcttcttgcaggatttaaaaaataa

SEQ ID NO: 46964 - DNA, 786 bp, Bacillus subtilis
atgaatgcaaagggtatagagggaaaaattgcttttataacaggggctgcccaaggaataggcgaagctgttgcgcggacgcttgccagtcaaggcgcacatattgcggcagttgattataatcctgaaaagctggaaaaggttgtgagcagcctcaaagcagaagcccgccatgcagaagcttttcctgcggatgtgagagacagcgcggcgattgacgagatcacggcgcgcatcgaacgtgaaatggggccgattgatattttagtgaatgtagcgggtgtccttcgcccgggactgatccattcgcttagcgatgaggaatgggaggcgacgttctcagtgaattcgactggcgtatttaacgcctcgcgttcagtcagcaaatatatgatggaccgaagatcgggttcgattgtaacagtcggatcgaatcctgccggtgtaccaagaacatctatggcggcatatgcgtcttcaaaggctgcggctgtgatgtttacgaaatgccttggccttgagcttgcagaatacaatattcgctgcaacattgtatctcccggatcaacggaaacagacatgcagtggtcattatgggccgacgagaatggagcggagcaagtcataaaaggatcacttgagacatttaaaacagggatcccgctcaaaaaactagccaagccttcggatattgcggatgcggtgctctttttggtttctggccaggcagggcatattacgatgcataatttatgcgtagatggcggggcgaccttaggcgtgtaa

SEQ ID NO: 46965 - DNA, 855 bp, Bacillus subtilis
atgaactcatttcgatttaccaaaatgcacggcctgggaaacagttatatttatgtgaatcaatttgaagaacagcttccagaagaaaaactgtcagagattgcaattcaggtttcttctgtttatacagggatcggatccgacggaatgatcctgatatgcccatcagaccaagcgcctgttaaaatgcggatttttaataatgacgggtctgaagggaaaaactgcggcaacggcctgcgctgcgtcgcaaaatacgcatatgagcataagctggttgaggaaacatcttttctgattgaaactctctccgggcttgtgaaagcggaggttcaagtcgaaaacggaaaagtgaatgtggtcactgtcgatatgggcgaaccgcgcttgacaaaatccgagcttcctatgcttgacggcggggaagagcacacaatcaatgaaacgatggcatttggtgaagtagaactaacaggcactgccgtttcaatgggaaatccgcatatcgtttttccgatcgcagacattgaacaggcacccttaacgacactggggccggtgattgagaaagatccgagatttccggaaggcatcaatgtggaattcgttgaaaccgtgaatgaacaagaattgcatttccgcgtctgggaacggggatcagggattactcaggcatgcgggacaggagcatgtgcagcggcagtcgcatctgtattaaacggcgtatcaaagcgaaatcaagacatcacggtgcatttagcaggcggggatttggtgataaactggaaagataacggccatgtaatgatgacagggccggctgaaaccgtttgtgagggtgtctatttcttgtaa

SEQ ID NO: 46966 - DNA, 1059 bp, Bacillus subtilis
atgtggaaaggacttatccatcaatataaagaatttttacctgtaacagatcaaacaccggcgctaactttacatgaaggaaacacacctcttattcacctgccgaagctgtctgagcagctcggaattgagcttcatgtcaaaacggaaggcgtcaatcctacgggatcatttaaagatcgcggaatggttatggctgtggcaaaggcaaaagaagaaggcaatgacacgattatgtgcgcgtcaacaggtaacacttccgctgctgcggcagcatatgcagcccgtgctaacatgaaatgcattgtcatcatcccgaacggaaaaattgcatttggaaaactcgctcaagctgtcatgtacggagccgagattatcgcaattgacggaaactttgacgatgcgcttaaaattgtccgttccatctgtgagaaatcaccgattgcccttgtcaactcagtcaacccttaccgcattgaaggccaaaaaactgctgccttcgaagtgtgcgaacagctgggggaagcgcctgatgttttagcgatcccggtcggaaatgctggaaacatcactgcgtactggaagggcttcaaggaatatcatgagaaaaacggcacaggccttccgaaaatgcgcggctttgaagctgagggtgcggcggcaatcgtgcgcaatgaagtgattgaaaatccggaaacaatagcgacagccattcgtatcggaaacccggcaagctgggacaaagctgtaaaggcagccgaggaatccaatgggaaaattgacgaagtcactgatgatgaaatccttcacgcatatcagctgatcgcccgtgtagaaggcgtgtttgcagaaccaggttcttgcgcgtctatcgcaggagtgctgaaacaggtgaaatccggagaaattccgaaaggcagcaaggtcgtagctgtgttaacaggaaacggactgaaagatccgaacacagcggtcgacatttcagaaatcaagcctgtcacattgccgactgatgaagacagcatccttgaatatgtaaaaggagcggcccgtgtatga

SEQ ID NO: 46967 - DNA, 1302 bp, Bacillus subtilis
ttgaaagcgattcgtgtagggcttttaggtttaggtaccgtcggaagcggtgtcgttaaaattattcaagaccatcaggataagcttatgcatcaggtcggctgtccggttacgataaaaaaagtgcttgtaaaagatttagagaaaaagagagaagtagatttgccgaaggaagtgctcacgacagaagtgtatgatgtcattgatgatccagatgttgatgtcgtcatcgaggtgatcggcggcgttgaacagacaaaacaatatttggtcgacgcgctgagatcgaaaaagcatgttgtcacagcaaacaaggacttaatggctgtgtacggctccgagctgcttgccgaagcgaaggaaaatggatgcgatatctactttgaagccagtgttgccggcgggattccgattctgcgcacgttagaggaaggcctctcatcagatcgaattacaaaaatgatgggaattgtgaacggcacaacaaactttatcttaaccaaaatgatcaaagagaaaagcccatacgaggaagtgctcaaggaagcgcaggatctcggttttgccgaagctgatccgacttctgacgtggaagggcttgacgccgcacggaaaatggcgatattggcgcgcctcggcttctcgatgaacgtggatctggaagacgtcaaagtaaaggggatctcccaaattacagacgaggacatcagcttcagcaaacgcctcggctatacaatgaagctgatcgggattgctcagcgtgacggcagcaaaatcgaggtcagcgtacagccgacactgcttcctgaccatcatccgctttctgctgttcataatgagtttaacgctgtttatgtatacggcgaggctgtcggtgagacgatgttctacgggccgggagccggaagcatgccgacagcgacatccgttgtttctgacctcgtcgctgtcatgaaaaatatgcgcctaggtgtaaccggcaacagctttgtcggaccgcaatatgagaaaaacatgaaatcgccgtctgacatttatgcacagcagtttttaagaattcatgtaaaagatgaggttggttcattctcgaaaattacatctgtgttctcagagcggggcgtgagctttgaaaaaatccttcagctgccaattaaaggccatgatgagttagctgaaatcgtaattgtcacacatcatacatcagaagctgatttcagtgatatcctgcaaaacctaaatgatttggaagtcgttcaagaagtcaaaagcacatatcgtgtagaagggaacggttggagctaa

SEQ ID NO: 46968 - DNA, 1389 bp, Bacillus subtilis
atgaaggagaagctccgcttatatcatacaaatgatttgcacagccattttgaaaactggccgaaaattgtagattatatcgagcagaaaagaaaagagcatcagtcagacggcgaagagacgctcgtttttgatattggcgatcatcttgatcgttttcaattcgtgacagaggcgacattcggaaaagcgaatgtcgatctcttaaaccgccttcacattgatggagcggcgatcggcaataacgaagggattacgcttccgcatgaagagcttgctgccttatatgatcatgctgaatttcctgtcatcgtctctaacctgtttgataaaaatggaaaccgtccgtcctgggcggtgccttaccatatcaaatcattgaaaaacggtatgtccattgctttcttaggtgtaactgtgccgtattatcctgtatatgacaagctgggatggacagttacggatgcccttgaaagcataaaggaaaccattctggaagtgaaagggcaggctgatattatcgttctgctgtcacatttaggcattcttgatgatcaagcagtggctgaagcggtgcctgagattgatgtaatcctcgaatcacatacccatcatttgctcgaagatggacaagtggttaatggggtactgctggccagcgccgagaaatacgggcattatgtcggctgtgtagaaatcacggtggacagcgtacagcgaagcatcaacagcaaaacggcttctgtgcagaacatggcggaatggacaggagaatccgcagaaactaaagcgtttctcaatgaaaaagaacgtgaagccgaggagaaactgtccgatgccgttgcagagcttgcacaagatgctgaggtgaagtggtttgaagaatcagagctgcctttgcttttggcatacgccttaaaggaatggtgcgagacggacatcagtatggtcaattcaggtgtcattctcggtccgctaaaagcaggtcctgtgacaaagctggatctgcaccgcatctgtccgcatccgatcaacccggtggctgtccgcctgacgggagaagaactgaaggaaaccattgtccatgccgcttccgaacaaatggagcagctccggatcaaaggactcggcttccgcggagaagtgatggggaaaatggtgtatgccggcgttgaggtagaaacgaaacggctcgatgacgggatcacccacgtcactcggatcacactgaacggggaagatattgaaaaacataaacaatactccgttgcggtgcttgatatgtttacgctcggcaaactgtttccgttgattcgcgacgctgcagaaaaagaatattttatgccggaatttttgcgggatctgcttgcttggaagcttgcacaataa

SEQ ID NO: 46969 - DNA, 855 bp, Bacillus subtilis
atgaaattgattgcggttggagataatgttgtagattactaccaggatcaagaaacattttacccgggaggaaatgccttaaacgttgctgtgcttgccaagcggctcgggcatgagtcttcctatatcggaatcgtcggcaatgacgaagccgcggcgcatctgttgaacgttctcaagctggagcaggtcaatgcagattatatccgccaggcgcacggagaaaacgggatggcgattgtcacccttgatgaacagggggaccgcatttttgtcagatcaaataaaggcggcattcagtcccggcttcgcctcgcgtttcaggagaaagatgtatcttttatcagcgggcatgatctgctgcatacgagcgtgtacagcaggcttgagaacgatcttccgcagctgtgcgggctggtcccggtctcatttgatttttcaaccaatcgggaggatgattatttgaggagggtctgtccttatgtgacgtatgcgtttttttcaggaagcgatttgagtgagtcggaatgcggtgagcttgccaaaacagctcatgggtacggagccaaaatggtttgtatgacccgagggggccaaggagcaatcctgtctgcgggtgatcgagtctatcatcagccgattgtggaagctgatataatagatacacttggagcgggagattcttttatagcaggctttttgactgccttttgcgtgaagcaggatataacgtatgctttgcgccaggctgctgaaacggctgcgaaaacttgcggtgtgtacggagctttcggctatggctatccttatcgcttggaggacgggggaagcagtgaaaaaacgagaatactataa

SEQ ID NO: 46970 - DNA, 1026 bp, Bacillus subtilis
ttgatcaatcttcaggatgtttcaaaagtttacaagtcgaaacatggagatgtcaatgctgtccaaaacgtctcgctttccattaaaaaaggtgagatttttggaattataggatatagcggagctggtaagagttccttaatccgtctgctgaacggccttgagaaaccaacctcaggaaccgtggaagtggcgggaaccaagattaatgaagtaaatggacgcggtttaagaaaagcacgccatgagatcagtatgattttccagcatttcaatttgctttggtcgcggactgtcagagataatatcatgtttcctttagaaattgccggggtgaaaaagagcgagcggatcaagcgcgccaatgaactgattaaactggtaggtttagaaggaaaagaaaaatcttatccgtcccagctgagcggcggtcagaagcagcgtgtcggaattgccagagcgcttgcaaacaatccgaaggttcttctttgtgacgaagcgacatcagcattagatccgcaaacgacagattcaattctggatctattgtccgatattaatgaaagactcggtttgacgattgtgctgattacgcacgaaatgcatgtcatacgcaaaatctgcaacagagtcgccgtcatggaaaacggcaaggtggtcgaagaaggcgaggttctcgatgtcttcaaaaatccaaaggaacaaatgacaaaacgatttgttcaacaggtgacagagccggaagaaacgaaagagacgcttcagcaccttcttgatgatacagcatcaggaaaaatggttcagctcacatttgtcggtgagtcagctgaacagcctctgattacagagatgatcagaaacttcaatgtcagcgtcaatattctgcaagggaaaatttcgcagacgaaggatggggcttacggttcactgttcatccacattgacggggacgaggaagaagtgcaaaacgtgatccgattcattaatgacaaacaggtgaaagcagaggtgatcacgaatgtttga

SEQ ID NO: 46971 - DNA, 384 bp, Bacillus subtilis
ttgagcataccaaaagatttgcgttactcaggagaacacgagtgggtaaaagttgaaggagaaaaagccagaatcggaattacgcattttgcccagtccgaactaggcgacatcgtgtttgtcgaacttcctgaagtgggcgctgaaatcaaagcggacgagccattcggcagtgttgaatccgttaaaacggtatctgagctttatgcaccgattaacggaacggttgtggaagtaaacgaagatcttgatgacagtccggaattcgtcaacgaatctccgtacgaaaaagcatggatgatcgtcgttgagccatctgacgcttctgaaattgaaaaactgatgacagcagagcaatacgaagagatgacacaagaagactaa

SEQ ID NO: 46972 - DNA, 1785 bp, Bacillus subtilis
atggcaaaaaaagcggctgacgtacaaaaaggcggcggatttttaatcgaggatgtcacatacgatcaaatgtatacaccggaggatttcactgacgagcataaaatgattgcgaaaacaacagaggattacatcgagcaagatgttctccctcatatagatgatatcgaaaaccatcaattcgagcattctgtcagactgttgaagaaagcgggcgaactagggctgcttggcgccgatgtgccggaagaatacggcgggctcggccttgataaaatcagctcggcactcatcactgagaaattttcgcgtgcgggaagcttttctctttcttatggcgcgcatgtcggtatcggttccttgccgatcgtctttttcgggtcagaagaacaaaagaaaaaatatttgcctggactcgcttcaggcgaaaagatcgccgcttatgctctgactgagcctggctctgggtctgatgcacttggagcaaaaacaacagctgtgctgaatgaagcaggaacccattatgtattaacaggggaaaaacagtggattaccaactctgcttttgccgatgtatttgtagtttacgctaaggtagacggcgacaagttttcagcctttattgtagaaaaagagttcccgggtgtctccacgggaccggaagaaaagaaaatgggaatcaagggatcatcgacaagaaccctcattctggatcaagctgaagtgccaaaggaaaacctgctcggagaaatcggcaaagggcatgtcatcgcctttaatattttaaacatcggccgttacaaactggcggttggcacaatcggcgcatctaaacgcgtcatcgagctgtctgcggcatacgcaaatcagcgccgccaatttaaaacgccgattgctggtttttcattgacacaggaaaaaatcgggacaatggcctcaaggctgtatgcgatggaaagctctgtatacagaaccgtcgggctgtttgaagacaatatgagccagttcacggccgaagatctcaaggacggccggcaaatcgccaaatcgattgcggaatacgccatcgaatgctctctgaataaggtattcggctctgaaacgcttgattatatcgttgatgaaggcgtgcagattcatggaggctacggctttatgcaggaatacgaagtagaaagggcctatagggattcaaggatcaatcggatttttgaaggcacaaacgaaatcaaccggttaatcgtgccaagcaccttcctgaaaaaagcgcttaaaggcgagctgcctttattcgaaaaagcgcagtcgctgcaggaagaactcatgatgcttatgcctgaagagcctggaagcggcgtcttagagcaggagaaatatatcgtcaagcaagccaaaaaaattgcgttgtttgctgccggcctagccgcgcaaaaatacggaaaagcgatcgatcgtgagcaagaaattctcgtgaacgtagcggatatcgtcagcaatgtatacgcaatggaatcagccgtgctcagaacggaaaaggccattgccgcacaaggcgctgaaaaagcagcgcaaaaggtgctgtacacagaaattttcgttcaagaggcctttaacgaaatcgaagcgcatgcaaaggaatcccttatcgcaatggaagaaggagattcactccgcatgatgctttccgctctgcgcaagctgacacgcgtaacgcctaaaaacgtgattcagaaaaaacgcgaggcggcggcaggcatttttgaggctgagaaatatactgtctga

SEQ ID NO: 46973 - DNA, 1176 bp, Bacillus subtilis
atgaaagaggcagtcattgtgtcaggtgcaagaacaccggttggaaaagcaaaaaaaggatcgttggccaccgttcgcccggatgatttgggagcgatttgtgtaaaagaaacgctgaaacgggcaggcggctacgaaggcaatattgatgacttgattatcggctgtgcaacacctgaagcggagcaggggcttaatatggcgagaaatatcggtgcgctcgcgggcctgccgtacacggttccggcgattacagttaaccgctattgctcttcaggccttcagtctattgcgtatgcagcagaaaaaattatgctgggcgcctacgatacagcgatcgccggcggagcagaatccatgtcgcaagttccgatgatggggcatgttacccgtccgaaccttgctttggcagaaaaggcaccggaatattatatgagcatggggcacacagccgagcaagtcgcgaaaaaatacggcgtctcccgtgaggatcaagacgcgtttgccgttcgcagccatcaaaacgccgctaaagcccttgcagaaggaaaatttaaagatgaaattgtacccgtcgaagtgacggtgacagaaatcggagaagaccataagcctatggaaaaacagtttgtgttttctcaggatgaaggtgttcgcccgcaaacgactgcagacatcttatcgacattgcgcccggccttttccgttgacgggacggtgactgcgggcaattcctcacaaacgagtgacggagcggcggctgtcatgctgatggaccgggaaaaagccgatgctcttggcctggcgccgcttgtgaaattccgctcctttgcggtaggcggcgtgccgccggaagtgatgggaatcggaccggtggaagcgattccgcgcgctttgaagcttgccggacttcagctgcaggacatcggcttgtttgaactgaatgaagcttttgcctcacaggccattcaagtaatcagggaattgggaattgatgaagaaaaagtgaatgtcaacgggggcgcaatcgcgcttggacacccgcttggctgtacgggcacaaagcttacactctcactcatccatgaaatgaaacggagaaacgagcaatttggagtcgtgaccatgtgtatcggcggcggaatgggagcggccggtgtatttgaattatgctaa

SEQ ID NO: 46974 - DNA, 843 bp, Bacillus subtilis
atgaataaaaaaatagccatcgtgacaggagcgtccagcggcttcggtctgctggcagctgtaaagcttgcccgatcatttttcgtgatagccacatcaagacagcctgaaaaagcggaacagcttcgagaattggctgcagcacacaatgtgtctgattctattcacattacagctctcgatgtcaccgatgaacaatctatagtctcattcggaaaagctgttagtgcttacgccccgatcgatttactcgttaacaacgccggaacggcttatggaggatttatcgaggatgtgccgatggaacatttcagacaacaatttgaaacgaatgtcttcggtgtgatccatgtgacaaaaaccgtgctgccttacataagaaagcatggcggcgcaaagattataaacgtgagcagcatcagcggactgacaggattcccagcgctgtcgccatatgtttcttccaagcatgcattggaaggtttttctgaaagcctgcgtatcgagctgcttccgttcggtatcgaaaccgctttgatcgagccgggctcatacaagacatcgatctggtcaacgtcattatcaaattttatgtcggtgcctgctgacgattcagcctatcatcaatactataaaaagatcctttcctatgttcaaaaaaacggagaagaaagcggagatccccaagaggttgccgacctcatttatcaattggcaacaaaacagcacataaagaatttgcgatacccgatcggaaagggcatcaagctcaccctgctgttccgatcgctttttccttggtctgcgtgggagtctatcctgaagaaaaagctattcagctga

SEQ ID NO: 46975 - DNA, 1389 bp, Bacillus subtilis
atggaatacagaattgaacgagacaccatgggagaagtaaaagttcctgctgataaattttggggcgcccaaacacagcgaagcaaggagaactttaagatcggttctgaaaaaatgccgatgcgtgttgtgaaggcgtttgcaattttaaaacgaagcactgctctagctaataaacgcctcggcaatctggacgctgaaaaagcagaagcgattgcagcggtttgtgatgatgtgctcaaaggcaagtacgatgacaacttcccgcttgtcgtatggcagaccggaagcggcacacaaagcaatatgaacatgaacgaagtggtagccaaccgtgcgactgctttattaaaagagaagaactctgatcaaacgattcatccaaatgatgacgtgaaccgaagccaaagctcaaacgacacattcccgactgcgatgcatgttgccgctgttttggctgtttacgagcagcttgtgccggcgcttgatcagcttcgcaatacactggatgaaaaagcaaaagcatacaatgatattgtcaaaatcggacgcacgcatcttcaggatgctacgccactgaccctcggacaggaaatcagcggatgggttcacatgctggaccgttcgaaggaaatgattttggaagcgacagataaaatgcgtgcgcttgcaattggtggaacggctgtcggaacgggtatcaacgcccacccagagtttggagagcttgtctcagaagagatcactaagctgaccggccaaacgttcagcagctcgccgaataaattccacgcgctgacaagccatgacgaaatcacttatgcgcatggcgcattaaaagcgcttgcggctgacttaatgaaaatcgcgaacgatgtcagatggctcgcaagcggaccccgctgcggcatcggggagatcgtcattcctgaaaatgagccgggaagctctattatgcctggtaaagtcaatccgacacaaagcgaagcgttaacaatgatcgcagcgcaaatcatggggaacgatgcgacaatcggctttgcggcgagtcaggggaactttgaactgaacgtgtttaagcctgttattatttacaacttcctgcaatctgtgcagctgctcagtgacggcatgaattcattccatgataaatgtgctgtcggtattgagcctaataaagaaaccattcaggaaaacctgtcaaattcattaatgcttgttacggcgctgaacccgcatatcggttatgaaaacgcggcgaaaatcgccaagcttgcccataaagagggattgacgctcaaagaagcagctttgaagcttgaattgctgacagaggagcaatttaacgaaatggttaagccggaagacatggtaaaaccaaaggcgtaa

SEQ ID NO: 46976 - DNA, 792 bp, Bacillus subtilis
atggatttacagctaaaagaaaaactcgtcttaatcaccggctcgacgtccggtatcgggaaagccgccgcaaaaagctttctgcaagagggtgcggcagtcattgtcaacggacgcaaacaggagactgtcgatcgcaccattgaagagctttctggctatggaacagtgcacggtgctgctgccgatttgtcaaaaacagatgaagcagcggcttttatcgaaaaagtaaatgaaatcggtgatatcgatatccttgtcaacaaccttggtttcttcgaggtaaaagacttcgccgatgtgacagatgaagagtggaatcaatatttcgaagtgaacgtgatgagcgccgttcggacaagccgtcacttccttccaaaaatgcttgccaaaaacagcggccgcattttaaatattgcaagtgaagcaggcgtcaaaccgctgccaacgatgattccatactcaatgacaaaaacggcactgatcagcctttcaagaggaatggctgaaatgacaaaaggcacaaatgtgacggtcaactcagtgctcccgggacctacttggacagagggcgtggcctcctatatggaaggcgccgcacaagcagccggacaggatacagatacatttatcaaagactatttcaaggtcaatgagccaacctcacttattcagcgatacgcgacagcagaagaagtcgccaacacaatcgtattcctcgcgtctgacgccgcatccgccattaacggcacggcacagcgtgtggaaggcggcattatccgttctctgtag

SEQ ID NO: 46977 - DNA, 879 bp, Bacillus subtilis
atggatgcagtattggaagcagacactcgggcagtgattggtgaaggcccgttatgggatgaagagaacggccgcttatattgggttgatatcctggggagcgagctccacatctttgaccctgaagaaaaaatcaaccgatcaatcaaattcaaatcctttgtgacggcgcttgcgaaatattcaaaggatgaactgattatgacgatgaaggacgggttttacctgtatcatcttcgggatgacagcttggaaaaaattaaacagccgaaggacatgcatgagagcctgagatttaatgatgctaaatgtgacccgtacggaaggctttgggcggggacgacgagcatggaaggcgagcaaaaacaggcgtcgctgtaccgtttgaatctagacggcagtcttgtcaaaatcaaggatcaagtctccacctcaaacggtttggattgggaccgcgagcggaatttgatgtattacatcgacacgccgacccaggagattgtacgttacagctatgatcctcaaagcggagatgtttcgaatccagaacctgtctatcgttttgatcagtcagacggattgccggacggcatgacaattgaccaaaatggcatgctgtgggtggcgctgtttggcggcagccgcgttgttcacattgacccgtttcagaaaaaagaaatcaattcaatcagcgtgccggctaaatatgtcacgtgctgcgcgttcggcggcagagacttaaaaaccctttacattacaacggcaacagaacaaatgacagaaaaagagagatacgagcagcctcacgctggagggttgttttcagcacaactggaaacaggcggatatcagccggtaccatttgctggagacgtataa

SEQ ID NO: 46978 - DNA, 1410 bp, Bacillus subtilis
atggaacagacaaaaaaatggggtttttggttattaacggcgtttgtcgttggaaatatggttggatcaggaattttctccttgccgagctcgcttgcttcaattgcgagtccgtttggagctacgtccgcctggcttttgacaggtgccggcgtgctgatgattgcacttgtgttcggacacttgtccattcgcaagcctgaactgacagcgggaccgcaaagttatgcaagagcgctgttttctgacccgaaaaaaggcaacgctgccggtttcacaatggtgtggggctactgggtggcgagctggatcagtaacgtggcgatcatcacaagtctcgccggttacttgacttcgttcttcccgatcttggttgataaacgtgagatgttttcgatcggcgggcaagaggtgacactcggccaattactgacgtttgccgtatgtacgatcttgttatggggaacgcacgcgattcttgttgccagcattaacggcgcaagtaaattaaactttgtcacaacgctttctaaagtattaggttttgtcttctttatcgttgccggtttgtttgtgtttcaaacgtcattattcggtcatttttatttcccggttcaaggagaaaacggcacaagcattggaattggtggccaggttcataacgctgcgatttctacactgtgggcgtttgtcggaattgaatccgcggtgatcctgtccggccgtgcgcgctctcagcgtgatgtgaaacgtgcgacaattaccggcttgctgattgccttgagcatatatattattgtgactttaattacgatgggtgttctgccgcatgataagcttgtcggctctgaaaaaccatttgttgatgtactctatgcgattgttggaaacgcgggaagcgtgattatggcgcttttggctatcctttgtttattcggaacgatgctcggctggattttgcttggctctgaggtgccataccaagccgctaaagcaggagatttcccggcattttttgcaaaaacgaataaaaagggaagtccggtcattgcactcattattacaaacgtcatgtcacaggtcttcattttctcggttatttcccggacaataagtgacgcatttacatttttaacgacagcggctacactcgcatatttaattccgtatctggtatctgcaatctacagcttgaaggtagtcatcaaaggtgaaacgtatgaccagctgaaaggctcccgtgtaagagacggattgatcgcgatactggcgtgtgcatactccgtgtttgttatcgtaacaggcacagcagatttaacgacatttatactcggcatcggtttattctttgtcggcttaatcgtttatccatttgtgagtaacaagttccagaaagaaaaacaagcataa

SEQ ID NO: 46979 - DNA, 831 bp, Bacillus subtilis
gtgccaacaagtttaaaagatactgtaaagttacataacggagttgaaatgccttggttcggtctgggcgtttttaaagtagaaaatggtaatgaagcgactgaatcagtgaaagcggcaattaaaaatggctatcgcagtattgatacagcagcgatctacaaaaatgaagaaggcgttggcatcgggattaaagaatccggtgtggcaagagaagagctcttcatcacatcaaaagtgtggaatgaagatcaaggctatgaaacaacgcttgctgcctttgaaaaaagcctagaaagactgcagcttgattacttagatttatatttgatccattggcctggcaaagataaatataaagatacatggcgcgcgcttgaaaagctgtacaaagacggcaaaattcgcgcgatcggcgtcagcaatttccaagttcatcatttagaagagctgttgaaagatgctgaaatcaaaccgatggtgaaccaagttgaatttcaccctcgcttgacgcaaaaagaattaagagattactgcaaagggcaaggcattcagctggaagcgtggtctccgctcatgcagggacagcttttggataacgaagtactgacacagattgctgaaaaacacaataaatctgtggctcaagtgattttgcgctgggatctgcagcatggagttgtaaccattccaaaatccattaaagaacaccgtatcatcgaaaacgctgatatttttgatttcgaattgtctcaagaagacatggacaaaattgacgcattaaataaagatgagcgtgtcggtccaaatcctgatgagcttctgttttaa

SEQ ID NO: 46980 - DNA, 1716 bp, Bacillus subtilis
atggtgaccaaaattctaaaagcaccggacggctctccaagtgatgttgaacgcattaaaaaagaaagtgattatttgcgcggcacgctgaaagaagtgatgctcgatcgaatcagtgcgggaattccggatgatgataaccgcctgatgaaacaccacggcagttatttgcaggatgaccgcgacctccgaaatgaacgccaaaagcagaagcttgagcccgcatatcagttcatgctgcgcgtgcgtatgccagggggcgtctcgacgcctgaacaatggcttgtcatggatgacctgtcccagaaatacgggaacggcacattaaaattgacgacacgtgaaacattccaaatgcacggaattctgaaatggaacatgaagaaaaccattcagacgatccactcagcacttttggatacgatcgcagcctgcggagacgtaaaccgtaacgtcatgtgtgcatcaaacccttatcaatctgaaatccactcagaggtatacgagtggtctaaaaaattaagtgatgatctgctgccgcggacgagagcatatcatgaaatttggcttgatgaggaaagagttgccggcacgccggaggaagaagtcgagccaatgtacggaccgctctatctgccgcggaagtttaaaatcggtattgccgttccgccgtctaatgatattgacgtcttttcacaagatctcggattcattgcgattgtcgaggatggcaagctgatcggttttaacgtggcaatcggcggcggtatgggaatgacgcatggcgatactgcgacatatccgcaattagccaaggtgatcggtttctgccggcctgagcaaatgtatgacgttgctgaaaaaacgattacgattcagcgtgattacggcaaccgttctgtccgtaaaaatgcgcggttcaaatacacagttgaccgcctcggtttagaaaacgtaaaagaagaattggaaaaccgtctcggctggagcctggaagaagcgaagccgtatcatttcgatcataacggcgaccgctatggctgggtggaaggcatcgaggataaatggcatttcacgctgtttgtcgaaggcggccgtataacggattacgatgattataagctgatgactggcttgcgggaaatcgccaaagttcatacaggtgagttccggctgacagccaatcagaacttaatgattgcgaacgtttcaagcgataaaaaagaagaaatcagtgctttaattgaacagtacggactaactgacggcaagcactattcagcgcttcgccgcagctcgatggcgtgcgtcgctcttccgacctgcggattggcaatggctgaagcagaacgttatttgccgaccctgttagataagattgaagagattattgacgaaaacggccttcgtgatcaggaaatcaccattcgcatgacaggatgcccgaacggctgtgcacgtcatgcactcggtgagatcggatttatcggaaaggcgccgggcaaatataatatgtatcttggcgctgcgtttgacggaagccgtttaagcaaaatgtaccgtgaaaacatcggtgaagcagacattttaagcgagctgcgcatccttctttcccgctatgcgaaagaacgcgaggaaggcgagcatttcggtgactttgtcattcgcgcgggcattattaaagcaacaactgacggtacgaattttcatgattga

SEQ ID NO: 46981 - DNA, 2109 bp, Bacillus subtilis
gtgagactagtgaaacaggaatatgttctggacggtttggattgcagcaattgtgcccgaaaaatcgaaaatggagtcaaaggcataaaaggcattaacggatgcgcggtaaattttgcggcaagcaccttaactgtctcagccgatgggaaagaagagcaatgggtcacgaataaagtagagaaaaaagtgaaatcaattgatccgcatgtaacggttcgccaaaagcatataaagaaatcagctgatgatggctatcgtaatcgaatggtcaatatgctgatcagaatggcggcggctgtcattctcggcgcagcggcatatttggttcagtcgggaaccattgaatttttccttttcctcggtgcttatttgattatcggcggtgacattataatccgcgcagtcaaaaacatcatccgcggtcaggtgtttgatgagcatttcttaatggctcttgccacaatcggcgcttttctgattcagcaataccctgagggggtcgccgttatgctgttttatcaaatcggtgagctttttcaaggagccgcggtcagccgttccagaaaatcaattagtgcgttaatggacatacggcctgattacgccaatctcaaaacaaagaacggcatcgaacaggtttcgtcggaggacgttcagacaggagacatcattgtggttaatccgggagaaagcatacccctggacggtaaggtcgtgcaagggtcagcgatggttgatacatctgctttaacaggtgagtccgttccgagaaaagctgcggaaggacaagatgtaatgtcaggctttatcaatcaaaacggcgttctgcatattgaagtcacaaagggctatcaggaatcagcagtatcaaaaatattagacttggttcagaatgcgagcagccgtaaagcccggacagaaaactttatcacgaagtttgccaagtattatacacctgctgtggtgatcattgcggtattgctggcctttgttccgccgcttgttctttctggcgccgcgctttccgattgggtgtaccgcgcgcttatctttttagtgatttcttgtccttgtgcgcttgttgtctctattccgctcggtttcttcggtggaatcggagcggcctcaaaggccggagtgcttgtaaagggaagcaattatttagaagctttgaatcaagtcaaatacgcggtgtttgataaaacgggaacactaacaaaaggcagctttgaagtgacagaaatcaaacccgcggaaggttttacaaaggatagattacttgaagcggcggcatacgctgagcttcattcacagcatccgattgctgaatctgtgcgtaaagcttacgggaaaatgctttcctccgatgagattgagtcatacgaagaaatctccggtcacggcatttttgcaaaggtaaatggaactgagatccttgctgggaataaaaagctcatggaaagagaacaaattgaggatgtcccggatgaaaatgctggaacaatcgtacacgttgctgtagatcaacgctatgccggagcaatcatcatagcggatgagataaaggaagacgcagcacaggcggttgctgatctgaagtcgcttgggatcaaacagacagctatgctgacgggtgattcgaaacaaacgggagaagccgtcggaaaacagcttgggattggtgaggtatatgcagagctgctgccgcaagataaagtcgcgcaggtcgaagcattagaagctaagcttttgcctagtgaaaaactcatttttgtcggtgacggcatcaatgatacgccggtgcttgcacgcgcagatataggggttgcgatgggaggccttggctcagacgccgcggtagaagccgcagacatcgtgctgatgacagatcagccgtcaaaaatagcagaagcgattcggattgcgaaacggacacggcgaatcgtgtggcaaaacatcggctttgctttaggtgtgaaagcgatctttctcattcttggtgcatttggaattgcgaccatgtgggaagcggttttctcagatgtcggcgttacactgcttgctgtggcgaacgccatgcgcgtcatgcgtctcaaaaacaaataa

SEQ ID NO: 46982 - DNA, 2412 bp, Bacillus subtilis
atgttgagtgaacaaaaggaaatcgcgatgcaggtctctggtatgacctgtgcggcatgtgctgccagaattgaaaaaggcctgaagcggatgcccggtgtcacggatgcaaatgttaatctggcaacggaaacatcaaatgtaatctacgatcctgctgaaacagggactgcagcgattcaggaaaaaatagagaagctgggctatcacgtcgttacagaaaaagctgaattcgatattgagggcatgacctgtgcggcttgcgccaatcggattgaaaaacggcttaacaaaatagaaggcgtcgcaaatgcaccagtaaacttcgctttagaaacagttacggtcgaatacaatccaaaagaagcgtctgtcagcgatttgaaagaagcggtagataagcttggatataagctaaagttgaagggtgaacaggacagtgaggctgctgctaaaaagaaagaagaacggaagcaaacggcgagactgattttttcagctgtcctgtcatttccattgctttgggcgatggtgagccattttacatttacatcattcatttgggtaccggatatatttctcaatccgtggatgcagtttgcgctggcgacaccagtccagtttctgatcggctggccgttttatgtgggtgcgtataaggcgcttagaaataaaagcgccaatatggatgtattggtcgccctcggtacgacggctgcttacgcttatagtctttatctaacttttcaaagcattggctctcacgggcatacagacggcctttattatgaaacaagcgcgattttgctgacgctgattttattaggcaagttgtttgaaacaaaagcaaaaggccgttcctcggatgcgattaaaaagctgatgaagcttcaagcgaaaacagctactgttgtaagagacggacaggagcaaatcatcccgatcgacgaagtgcttgttaatgacattgtttacgtcaaacctggcgaacgaattcctgtcgacggagaagtggttgaaggccgttcagcggttgacgaatcgatgattacaggagaaagtcttcctgttgacaaaaatcctggtgacagcgtgacaggttcaaccgttaacgcaaacggctttctgaaaattaaagctgtcaacgtcggaaaggatactgcgctttctcatatcatcaaaattgttgaggaagcacaagggtcaaaagcgccgatccagcgtctcgctgaccagatttcaggcatttttgtacccattgtattggggattgcggttctcacttttctcatttggtatctttgggcggctcctggcgattttgccgaagcgatcagcaagttcattgcggttcttgtcattgcctgtccttgcgccctcggtcttgccactccgacgagcataatggctggatctggacgcgctgctgaattcgggattttatttaaaggcggcgagcatttagaaaaaacacatcgtctcgatacaattgttcttgataaaaccggaaccgtgacaaacgggaagccgcgtctgacggatgccattccattcggccgttttgaagaaaaagatttgcttcaatttgcagcggcagcggaaacgggatcagagcatccgcttggcgaagcgattattgctggcgtgaaagataaagggcttgagataccgaaacttacccgctttgaagcaaaagtcggcgcaggcattttggctgaagccggaggaaaaagcattctcgtcggcacaagaaaattaatggagagcgaacaggttgagcatggggctcttctcgcccaaatggaagagctagaggccgaagggaaaacagttatgcttgtatccattgatggagaagcagcggggctagtagcagttgcagatacgattaaggatacgtcgcggaaggctgttgcccgtctgaaagagttgggtcttgatgtcatcatgatgacaggagacaatcgcagaaccgcagaagccatcgcgaaggaagcgggaattgcgaatatcattgcggaagttcttcctgaacaaaaggcggcggaaatcgcccgcttgcaaaaagaaggccgccagacagcaatggtaggcgacggaattaacgatgcgccggcgcttgccacagctgacatcggcatggcgattggaactggcacggacattgccatggaaacagcagacattacacttattcgcggcgatctgaacagcattgccgacgcaatccgcatgagcagattgacaatgaaaaacattaaacaaaacttattctgggcgcttggctataacagcctcggcatcccaatcgcagcacttggatttttagcaccgtggatagcaggagcagcaatggcattcagctccgtttccgttgttctgaatgctcttcgtctgcaaaaagtaaaatga

SEQ ID NO: 46983 - DNA, 795 bp, Bacillus subtilis
atgaagctgaatttacaaggaaaaaccgcactggtgaccggttcgacatcagggatcggaaaagctattgcctcttcgttagctgaagaaggtgcggcagtgatcattaacggacgccgggaagagaaagtgaatcaaacgatagatgaactgaaaacacaacatgctgaagcggttctttatccggctgcatttgatttgggaacagaagaaggctgcaatgagctgtttcaggcatatccagaggttgatattttggtcaacaatttagggatttttgaaccggcggagtactttgatattcccgacgatgaatggtttcgtttttttgaagtgaatattatgagcggtgtaaggctgacacgcaggtatttgcataacatgatagagaaaaaagaagggcgtgtgattttcattgccagtgaagcggcgattatgccgtcacaggaaatggcccattacagtgcgacaaaaacgatgcagctgtccatttcccgcagtttggcggagctggcaaccggcacgaatgtcacagtcaacaccgtcatgccgggctctaccttaacagagggtgtggaaaccatgctgaactcgctgtatcctggtgaaaacctgactgttcaagaagctgaggcacgttttatgaaagaaaaccggccgacatctattattcaaagactgatccgtccggaagaaatcgcccacttcgttacatttttaagcagtccgctttcctctgcgatcaatggcgcggcacttcgggcggacggcggtttggtccgcagtgtcttttaa

SEQ ID NO: 46984 - DNA, 1146 bp, Bacillus subtilis
ttgctgacattagaaaatgtctcgaaaacatacaagggcggcaaaaaagccgtgaacaacgtaaatcttaagattgcaaaaggcgaatttatctgctttatcgggccgagcggctgcggaaaaacgacaacaatgaaaatgattaaccgattaattgagccttccgccgggaagattttcattgacggcgaaaacatcatggaccaggatcctgtagagctcaggcgcaaaattggctatgtgattcagcagatcggcctgtttccccatatgaccattcagcagaatatctcactcgtcccaaaactgctgaaatggccggagcagcagcggaaagagcgggcgcgtgagcttttaaaattggtcgatatggggccagaatatgtagaccgttaccctcatgaattaagcggggggcagcagcagcgaattggtgtattacgggcacttgccgcggagccgccgcttatcttaatggatgaaccgtttggggcactcgacccgattacgagggattccctccaggaagaatttaaaaaactgcaaaaaaccttacataaaaccatcgtatttgttacccacgatatggatgaagcgattaagctggcagaccggattgtgattttaaaagcgggagaaatcgttcaagttggaacgcccgatgacattttaagaaatccggcagacgaatttgttgaggaatttatcggcaaggagcggctgattcagtcatccagcccggatgttgaacgggttgaccagattatgaacacacagcctgtaacgatcaccgcggataaaacgctttctgaggccattcagctgatgaggcaggaacgggtcgattcattgctggtcgtcaatgacgagcgcgttctgcaaggctatgtcgatgttgaaatcattgatcaatgccggaaaaaggccaatctcgtcagtgaagttttacatgaagatatatacacagtactgggcggcacactgctgcgcgacacggtccgcaaaattttaaaacggggtgtcaaatatgttcccgttgtggatgaagaccgacgcctgatcggaattgtgacgagggcaagtctggtcgacatcgtgtatgactccctctggggagaagaaaagcagctcgcagcattgtcatag

SEQ ID NO: 46985 - DNA, 1143 bp, Bacillus subtilis
ttgctgaaattggaacaagtgtcaaaagtatataaaggcggcaaaaaagctgtgaacagcattgatttagatattgcaaaaggtgaatttatctgttttatcggcccgagcggctgcggaaaaacgacgacgatgaagatgatcaacagactgatagaaccatcgtctggaaggatctttatcgacggagaaaatattatggaacaggacccggttgagctgaggagaaaaatcggctatgtgatacagcagattggtttgttcccccatatgaccatccagcagaacatctcactcgtaccaaagctgctgaaatggcctgaggaaaaacggaaagaacgggcgcgcgagctgttaaagcttgtggatatgggcccagagtatttagaccgttatccgcatgagctcagcggcggacagcagcagagaatcggcgtgctgcgcgccctggcagcggaaccccctctcattttaatggatgaaccgttcggagcgcttgatccgattacgcgtgattcccttcaggaagaattcaaaaaactgcagagaaccttaaacaaaacgattgtgtttgtaacccacgatatggatgaagcgattaagcttgctgacaggattgtgatattaaaagcgggagaaatcgttcaagtcggcacacctgatgagattcttcgaaacccggcaaatgagtttgttgaagaatttatcgggaaagagcgcctgattcagtcaagaccggatatcgagcgggtagagcaaatgatgaacagaacgccggtgacggtatctgcggacaaaacgctttctcaggcgattcagctgatgagagaaaaacgtgttgactcgctgctcgttgtggaccggcaaaacgtgctgaagggctatgttgatgtggaaatgattgatcaaaaccgcaaaaaagcgagcatcgttggcgatgtataccgttcagatatatataccgttcaaaaaggggcgcttcttcgcgatacagtccgaaaaattttgaagcaggggatcaagtatgttccggtggtcgatgaacagaaccatttagcagggattgtgacaagagcgagcctcgttgatatcgtatacgattccatttggggcgacgaggaaaaccagctcatgacgatctga

SEQ ID NO: 46986 - DNA, 1293 bp, Bacillus subtilis
atgccatacattgttgatgtttatgcacgcgaagtattagactcccgcggcaacccaacagttgaagttgaagtatatacagaaacaggagctttcggccgcgcattagtgccaagcggagcttctacaggtgaatacgaagcggttgagcttcgtgacggcgacaaagaccgttaccttggaaaaggcgtgttaacagctgttaacaacgtaaacgaaatcattgctccagagcttcttggctttgatgtaactgaacaaaacgcaatcgatcagcttttaatcgagcttgacggtactgaaaacaaaggcaaacttggtgcgaacgcaatccttggcgtatctatggcttgtgcgcgtgctgctgctgatttcttacagattcctctttaccaataccttggaggattcaactcaaaaacgcttcctgtaccgatgatgaacatcgtaaacggcggagagcatgctgataacaacgtggatattcaagaattcatgatcatgcctgtaggtgctcctaacttccgtgaagcacttcgcatgggcgctcaaatcttccacagcctgaaatcagtattaagcgcaaaaggcttaaacactgctgtaggtgacgaaggcggattcgctccaaaccttggttctaacgaagaagcgcttcaaacaatcgttgaagcaatcgaaaaagccggcttcaaacctggcgaagaagttaaacttgctatggatgctgcatcttctgagttctacaacaaagaagacggcaaataccatctgtctggcgaaggcgttgtgaaaacatctgctgaaatggttgactggtatgaagagcttgtttctaaatacccaatcatctcgatcgaagacggacttgacgaaaacgactgggaaggccacaagcttcttactgagcgtcttggcaaaaaagttcagcttgttggtgacgacctcttcgttacaaacacgaaaaaactttctgaaggtattaaaaacggcgtaggcaactctatcctgatcaaagtaaaccaaatcggtacattgactgaaacattcgatgcgatcgaaatggcgaaacgcgcaggctacacagctgttatctctcaccgttctggtgaaactgaagacagcacaatcgctgacatcgctgtggcaacaaacgcaggacaaatcaaaacaggtgctccgtctcgtacggaccgtgttgcgaaatacaaccagcttcttcgcatcgaagatcagttggctgaaactgctcaataccacggtatcaactctttctacaacttaaacaagtaa

SEQ ID NO: 46987 - DNA, 1536 bp, Bacillus subtilis
atgagtaaaaaaccagctgcactcatcattcttgatgggttcggattacgtaacgaaacagtagggaacgcagtcgctttagcgaaaaaaccgaattttgaccgctattggaaccagtatcctcatcaaactttgactgcttcaggcgaggctgtaggtcttcctgaagggcaaatggggaactccgaagtaggtcacttaaatatcggtgcgggacgtattgtgtaccaaagcttaacacgcgtaaatgttgccattcgtgaaggagagttcgaacgcaatcaaacattccttgacgcgatcagcaacgcgaaagaaaacaacaaagccttgcacctgttcggtcttttatctgacggaggcgtgcacagccatatcaatcatttattcgcactgttaaagcttgcgaaaaaagaagggctgacaaaggtttatatccatggcttccttgacggccgtgatgtaggtccgcagacagcgaaaacgtacatcaaccagttgaacgatcaaatcaaggaaatcggtgtaggtgaaatcgccagcatttccggacgttactactctatggaccgcgacaaacgctgggaccgtgtagaaaaagcgtaccgcgcaatggcgtacggcgaaggcccatcttaccgcagcgccctggatgttgttgatgattcatatgcaaatggtatctacgatgaattcgtgattccatctgtcatcacaaaagaaaacggtgagcctgttgcgaaaatccaagacggcgattctgtgattttctataatttcagaccggaccgcgccatccagatttccaacacgttcacaaacaaagacttccgtgacttcgaccgcggcgagaattatccaaagaacctgtatttcgtctgcctgactcacttcagtgaaacagttgacggctatgtagcgtttaaaccgataaatcttgataacacagtcggagaagtattatctcagcacgggttaaaacagcttcgaattgcagaaactgaaaagtatccgcacgtcacgttctttatgagcggcggccgtgaagctgaattcccgggtgaagagcgtattctcatcaactcgcctaaagttgcaacgtatgacttgaagcctgagatgagtgcgtatgaagtgaaagacgcgcttgtcaaagaaattgaagctgacaagcatgacgcgatcattcttaacttcgcaaaccctgatatggtcggccactccggaatggttgaaccaacaattaaagcaattgaagcagtggacgaatgcttgggcgaagtcgttgacgcgatccttgctaaaggcggacacgctatcattaccgctgatcacggtaatgctgacattctgattacagaatcaggcgaaccgcacactgcgcatacaacaaacccagtccctgtgattgtaacgaaagaaggcattacgctgcgtgaaggcggaatcctaggcgaccttgcaccaacgttattagaccttcttggtgttgaaaaaccgaaagaaatgacaggaacatctttaattcaaaaataa

SEQ ID NO: 46988 - DNA, 762 bp, Bacillus subtilis
atgagaaaaccaattatcgccggtaactggaaaatgaacaaaacactcggcgaagctgtcagcttcgttgaagaagtgaaatcttccattccagcagcagacaaagctgaagctgttgtttgcgcgccagcgcttttcttagaaaagcttgcttctgctgtgaaaggcactgacctaaaagtcggcgctcaaaacatgcacttcgaagaaagcggcgcgttcacaggcgaaatcagcccggttgctctgaaagaccttggcgttgactactgcgtcatcggccactctgagcgccgtgaaatgttcgctgaaactgatgaaacagttaacaaaaaagcacacgcagctttcaaacacggcattgtgccgatcatctgtgtaggtgaaacgcttgaagagcgtgaagccggcaaaacaaatgatcttgttgctgaccaagtgaaaaaaggccttgctggtctttctgaagaacaagttgctgcttctgttattgcgtatgagccaatctgggcaatcggaacaggcaaatcttctacagcgaaagatgcgaatgacgtgtgtgcgcatatccgtaaaaccgtcgctgaaagcttcagccaagaagctgcagacaagcttcgcatccaatatggcggaagcgtaaagcctgcaaacattaaagaatatatggcagagtccgatattgacggtgctttggtcggcggcgcgagccttgagccacagtcattcgttcaattattggaggaaggtcaatatgagtaa

SEQ ID NO: 46989 - DNA, 1185 bp, Bacillus subtilis
atgaataaaaaaactctcaaagacatcgacgtaaaaggcaaagttgtattctgccgcgttgactttaacgttccaatgaaagacggggaagtaacagacgatacacgtatccgtgctgcgcttccaacaatcaaacaccttgcagaccaaggcgcaaaagtccttcttgcgagccacttaggccgcccgaaaggcgaagtggttgaggagcttcgtttaactcctgtcgctgcacgtctcggcgaactgcttggcaaagaagtgaaaaaagcggatgaagcatacggcgatgctgtaaaagcacaaatttctgagatgaaggacggagacgttcttgtattggaaaacgtacgtttctatcctggtgaagagaaaaatgatcctgagcttgcaaaagcatttgctgagcttgcagatgtatatgtaaatgacgcattcggtgctgcccaccgtgctcacgcatctacagctggaattgccgagcatctgccagcagttgcaggtttcttaatggaaaaagagcttgatgtacttggaaaagcggtttccaatcctgaccgcccgttcacagcgatcatcggcggagcgaaagtaaaagacaaaatcggtgtaatcgaaagtcttcttgataaagtagacaacctgatcatcggcggaggtcttgcttatactttcgtaaaagcgcttggctatgaagtcgggaaatctcttcttgaagaggataaaatcgagcttgcgaaatcatttatggaccgcgctaaagaaaaaggcgttaacttctacatgcctgaagatgtactcgttgcagatgatttctctaacgatgcaaacgtgaaaattgtgccgatctctgaaatccctagtgatttagaagcaatcgacattggtacgaaaacacgcgaaacgtatgctgacgtcatcaaaaacagcaaacttgtcgtgtggaacggaccaatgggcgtattcgaaatcgacttgttcgctcaaggaacaaaagcggttgcggaagcattggcagaggcgaaagatacatactctgtcatcggcggaggagactctgcggcagcggttgaaaaattcggccttgctgacaaaatgagccacatctcaacaggcggcggcgcatcccttgagtttatggaaggcaaagagcttccaggggtagctgcactgaacgataaataa

SEQ ID NO: 46990 - DNA, 1008 bp, Bacillus subtilis
atggcagtaaaagtcggtattaacggttttggtcgtattggacgtaacgtattccgcgcagcattaaacaatcctgaagttgaggtagtagcggttaacgatttaacagatgctaacatgctggctcaccttttacaatatgattctgtacacggaaaattagacgctgaagtttcagttgacggtaacaaccttgttgttaacggcaaaacaattgaagtttctgcagaacgcgatcctgctaaacttagctggggcaaacaaggcgttgaaatcgtagttgaatctactggtttcttcacaaaacgcgcagacgctgcgaaacacttagaagctggcgcgaaaaaagtaatcatctctgctcctgctaacgaagaagatatcacaatcgttatgggtgttaacgaagataaatacgatgcggctaaccacgatgttatctctaacgcatcttgcacaacaaactgccttgcgccgtttgcaaaagtacttaacgataaattcggcatcaaacgcggtatgatgacaactgttcactcttacacaaacgatcagcaaatccttgatcttccgcacaaagactaccgtcgtgcgcgtgcagcagctgaaaacatcatcccaacatcaactggtgctgctaaagcagtttctctagttcttcctgaactaaaaggcaaactgaacggtggagcaatgcgtgttccaactccaaacgtttctctagttgacttggttgctgaactgaaccaagaagtaacagctgaagaagtaaacgcagctcttaaagaagcggctgaaggcgaccttaaaggaatccttggctacagcgaagagccattagtttctggcgactacaacggaaacaaaaactcttctacaatcgatgctctttctacaatggttatggaaggcagcatggtaaaagtaatctcttggtacgataacgaaagcggctactctaaccgcgttgttgaccttgcagcttacatcgcaaaaaaaggtctttaa

SEQ ID NO: 46991 - DNA, 1395 bp, Bacillus subtilis
atgaagaatactccaactcaattagaaccaaatgttcctgtaacaagaagccattcaatgggatttgtcattttgatctcatgtgcggcggggcttggcggcttattgtatggctatgacacggcagtgatttctggcgccatcggttttctgaaagatttatacagcctgagtccgtttatggagggacttgtcatttcaagcattatgattggaggagttgtgggcgtcgggatatccggatttttaagtgacagattcggccggagaaaaattttaatgacagccgctttgttatttgcgatatcagcaatcgtttcagcgctttctcaagacgtgtccaccttaatcattgcaaggattatcggggggctgggaatcgggatgggctcatcgctctctgttacgtatattacagaagcggcaccgcccgctatacgcggaagtttatcttcgttatatcagctctttacgatactgggtatttccgcaacatactttattaatctagctgtgcagcggtccggaacatacgaatggggcgtgcacaccggctggagatggatgcttgcttatggaatggtgccatccgtcatttttttccttgtcctgctcgtcgtcccggaaagtccgagatggctggcgaaagcgggcaaaacaaatgaagctttaaagatcctgacacgtattaatggagaaactgttgcaaaagaagaattaaagaacattgagaactctttaaaaatagaacaaatggggtcgctctcccagctgtttaagccgggtctcagaaaggcgcttgtcattggaatcctgctggcgctgtttaaccaagtcatcggcatgaacgcgattacttactacgggccggaaatctttaaaatgatgggattcgggcaaaacgccggatttgtgacgacttgtatcgtcggggttgtagaagttatttttaccgttattgcggtgttgctgattgataaagtcggacgaaaaaaactgatgtccatcggttctgcttttatggctatttttatgattttaatcgggacgtcgttttattttgagttaacaagcgggatcatgatgatcgtccttatattaggttttgtcgctgctttctgtgtctcggtcggaccgatcacatggattatgatttctgaaatcttcccgaaccatctgcgtgcgcgggccgcgggcattgcgaccatctttttatggggagcaaactgggcgatcggacagtttgtgccaatgatgatcgattctttcgggctcgcctatacattttggatctttgcggtgattaacatcctttgtttcctgtttgtcgttacgatctgtccagaaacgaagaacaaatcgctcgaggaaattgaaaagctttggataaaatga

SEQ ID NO: 46992 - DNA, 1344 bp, Bacillus subtilis
atgaaaaacgacaatcaaacgttaaaacgcacgatgacgtcccgccatattatgatgatggcgctgggcggagcaatcggcgcaggtttatttaaggggagcagctcagcgatcgatgtggcagggccatctgtcattatcgcatacctgctcggcgggattattttgctgtttattatgcaggggctggcggaaatggctgttcgaaaccgtaacgccagaaccttccgtgatcttgtccagcaggtattgggaaattacgctgcttactttttggactggatctactggaaaatgtgggtgcttaacattgcggctgaagctgttgtagctgcgattttcattcaatattggctgccgggctgcccgatctgggtgttggcattaggaatttctcttatcgtcacgattgtaaacttgctttctgttaaaatcttcgccgaaactgaatattggctggcaatgatcaagattaccgttattattatctttattattctgggattgctgctcttatttgtatcattcggtgatcatacagcatccggattttccaacctgacagaccacggcggatttttcccgcacggcggcacagggctgatcacggcgatgcttgtcgtcatctactcttacggcggtacagaaattatcggtgtaacgcttgcagagacaaaaaatccggaaaaggttgtcccgaaagctgtccgcagcacactgacacggattgtcgcgttttacctgctgccgtttttcatcatcgtcagcctgattccatggaaccaagtcaattccgttccggaaagtcctttcgtgatggtctttaaaatggtaggcattccgggcgcggatcatatcatgaatgcagtcatcctgctggcgatcatttcttctatgaattcaggtttatacggatcatcacgcattttgtatacacaggcaagtgacggaaggcttccaaaggtcttctcgaagctttcatcgaaaaacgtaccgatgtttgcgattctgatgtgcacttcttctctctatattggcgtattgatttctctgttcgcaggaagccaaacatttaattatttaatgggatcattgggatataccgttttattcatttggctgatcatcggattcgctcatttaaaatcgagaaaacagcaaacggaaacaccggcctattatgtaaaatggttcccgtacacgacatggtttgcgattgtggcattactcgccattctgatcggggtcatcatgacaacatcaattgtcattaccggcattactgcggcgatctaccttttgattacagttgcatatttggtcaaaggacgcaagcatcagtaa

SEQ ID NO: 46993 - DNA, 906 bp, Bacillus subtilis
gtgatgaaagaagcagtaacagtaagcaacgtgacaaaacatttccagcgaaaaaccgctgtaaacaacatcagcttcagtattgaaaaaggagaaattgcagccattctcgggccaaatggggcagggaagacgaccgtcgtctcgatgatattaggattgctgaaaccgagtgagggagaaatcaaactatttaaccgggttcccgatgatcaacaggttcgtgaaaaaataggtgtaatgcttcaggaagtaagtgtcatgccgggccttaaggtggatgaaatccttgaactcttccggagctattatccgaatccattgtccatgaaagaactcgtttcgttaacagcactcaccaaagaagatttgaaaacaagagcagaaaaattatccggcggacaaaaacgccgtttgagctttgctttggctcttgccgggaacccggagctgcttatacttgatgaaccgacagtcggcatggacacttcatcaagacaccgattctggcagaccattcacggactgtcggaccaaggaaaaacgattattttttcaactcattatttacaggaagcagatgatgccgcacagcgaatcctattttttactgaaggacagcttgttgcagacggctcaccaatgcaaatccgctcaagaattcaaaaacagtctgtttcctttacgcttcattcaagtgaatcattggaaaggctgtcttgtcacccggaagtcgagagagtgatccacgagcatgagagaaccatcatccagacatcaaatacagacaaagtgttggcgctgatctttcaagaaaacatacatgcacgggatattcgaattgagcaagcaacgctcgatgaggcatttcgccagctggctgacggcaacagggaggcgatgtga

SEQ ID NO: 46994 - DNA, 2064 bp, Bacillus subtilis
gtgatgtcaaagcttgaaaaaacgcacgtaacaaaagcaaaatttatgctccatgggggagactacaaccccgatcagtggctggatcggcccgatattttagctgacgatatcaaactgatgaagctttctcatacgaatacgttttctgtcggcatttttgcatggagcgcacttgagccggaggagggcgtatatcaatttgaatggctggatgatatttttgagcggattcacagtataggcggccgggtcatattagcaacgccgagcggagcccgtccggcctggctgtcgcaaacctatccggaagttttgcgcgtcaatgcctcccgcgtcaaacagctgcacggcggaaggcacaaccactgcctcacatctaaagtctaccgagaaaaaacacggcacatcaaccgcttattagcagaacgatacggacatcacccggcgctgttaatgtggcacatttcaaacgaatacgggggagattgccactgtgatttatgccagcatgctttccgggagtggctgaaatcgaaatatgacaacagcctcaagacattgaaccatgcgtggtggacccctttttggagccatacgttcaatgactggtcacaaattgaaagcccttcgccgatcggtgaaaatggcttgcatggcctgaatttagattggcgccggttcgtcaccgatcaaacgatttcgttttatgaaaatgaaatcattccgctgaaagaattgacgcctgatatccctatcacaacgaattttatggctgacacaccggatttgatcccgtatcagggcctcgactacagcaaatttgcaaagcatgtcgatgccatcagctgggacgcttatcctgtctggcacaatgactgggaaagcacagctgatttggcgatgaaggtcggctttatcaatgatctgtaccgaagcttgaagcagcagcccttcttattaatggagtgtacgccaagcgcggtcaattggcataacgtcaacaaggcaaagcgcccgggcatgaatctgctgtcatccatgcaaatgattgcccacggctcggacagcgttctctatttccaataccgcaaatcacgggggtcatcagaaaaattacacggagcggttgtggatcatgacaatagcccgaagaaccgcgtctttcaagaagtggccaaggtaggcgagacattggaacggctgtccgaagttgtcggaacgaagaggccggctcaaaccgcgattttatatgactgggaaaatcattgggcgctcgaggatgctcaggggtttgcgaaggcgacaaaacgttatccgcaaacgcttcagcagcattaccgcacattctgggaacacgatatccctgtcgacgtcatcacgaaagaacaagacttttcaccatataaactgctgatcgtcccgatgctgtatttaatcagcgaggacaccgtttcccgtttaaaagcgtttacggctgacggcggcaccttagtcatgacgtatatcagcggggttgtgaatgagcatgacttaacatacacaggcggatggcatccggatcttcaagctatatttggagttgagcctcttgaaacggacaccctgtatccgaaggatcgaaacgctgtcagctaccgcagccaaatatatgaaatgaaggattatgcaaccgtgattgatgtaaagacagcttcagtggaagcggtgtatcaagaagatttttatgcgcgcacgccagcggtcacaagccatgagtatcagcagggcaaggcgtattttatcggcgcgcgtttggaggatcaatttcagcgtgatttctatgagggtctgatcacagacctgtctctctctccagtttttccggttcggcacggaaaaggcgtctccgtacaagcgaggcaggatcaggacaatgattatatttttgtcatgaatttcacggaagaaaaacagctggtcacgtttgatcagagtgtgaaggacataatgacaggagacatattgtcaggcgacctgacgatggaaaagtatgaagtgagaattgtcgtaaacacacattag

SEQ ID NO: 46995 - DNA, 1470 bp, Bacillus subtilis
atgactcatcaaatagtaacgactcaatacggcaaagtaaaaggcacaacggaaaacggcgtacataagtggaaaggcatcccctatgccaagccgcctgtcggacaatggcgttttaaagcacctgagccgcctgaagtgtgggaagatgtgcttgatgccacagcgtacggctctatttgcccgcagccgtctgatttgctgtcactttcgtatactgagctgccccgccagtccgaggattgcttgtatgtcaatgtatttgcgcctgacaccccaagtaaaaatcttcctgtcatggtgtggattcacggaggcgctttttatctaggagcgggcagtgagccattgtatgacggatcaaaacttgcggcacagggagaagtcattgtcgttacattgaactatcggctggggccgtttggctttttgcacttgtcttcatttaatgaggcgtattctgataaccttgggcttttagaccaagccgccgcgctgaaatgggtgcgagagaatatttcagcgtttggcggtgatcccgataacgtaacagtatttggagaatccgccggcgggatgagcattgccgcgctgcttgctatgcctgcggcaaaaggcctgttccagaaagcaatcatggaaagcggcgcttctcgaacgatgacgaaagaacaagcggcgagcacctcggcagcctttttacaggtccttgggattaacgagggccaactggataaattgcatacggtttctgcggaagatttgctaaaagcggctgatcagcttcggattgcagaaaaagaaaatatctttcagctgttcttccagcccgcccttgatccgaaaacgctgcctgaagaaccagaaaaagcgatcgcagaaggggctgcttccggtattccgctattaattggaacaacccgtgatgaaggatatttatttttcaccccggattcagacgttcattctcaggaaacgcttgatgcagcgctcgagtatttactagggaagccgctggcagagaaagttgccgatttgtatccgcgttctctggaaagccaaattcatatgatgactgatttattattttggcgccctgccgtcgcctatgcatccgcacagtctcattacgcccctgtctggatgtacaggttcgattggcacccgaagaagccgccgtacaataaagcgtttcacgcattagagcttccttttgtctttggaaatctggacggattggaacgaatggcaaaagcggagattacggatgaggtgaaacagctttctcacacgatacaatcagcgtggatcacgttcgccaaaacaggaaacccaagcaccgaagctgtgaattggcctgcgtatcatgaagaaacgagagagacgctgattttagactcagagattacgatcgaaaacgatcccgaatctgaaaaaaggcagaagctattcccttcaaaaggagaataa

SEQ ID NO: 46996 - DNA, 1422 bp, Bacillus subtilis
atgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgaattcgattcgtccacaattaaaaatatctcttctgcaaaaggcctggacgtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacacaagaatggtcaggttcagccacatttacatctgacggaaaaatccgtttattctacactgatttctccggtaaacattacggcaaacaaacactgacaactgcacaagttaacgtatcagcatcagacagctctttgaacatcaacggtgtagaggattataaatcaatctttgacggtgacggaaaaacgtatcaaaatgtacagcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaaacttctgcaaagcgataaaaaacgcacggctgagttagcaaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggttatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgccaagcttcctgctgaacatcaaaggcaagaaaacatctgttgtcaaagacagcatccttgaacaaggacaattaacagttaacaaataa

SEQ ID NO: 46997 - DNA, 1551 bp, Bacillus subtilis
atgaactatataaaagcaggcaaatggctaaccgtattcctaacctttttaggaatattgctgtttatcgacttatttccaaaagaagaacatgaccaaaaaacaaaatcaaaacagaagccggactaccgggcggcatatcattttacgacgccggataaatggaaaaatgaccctcaaaaaccgatctattttgatggcaagtatcattatttctatctatataaccgggattacccaaaaggcaacggcacagaatggcgccatgccgtctcagaggatttggtgcactggaccgatgaaggcgtggcgattccgaaatatacaaacccggacggtgatatttggaccggttccgtcgtggtggataaagagaacacagccggcttcgggaaaaatgcgcttgtcgcgattgtgacacagccctcagccaaagacaaaaaacaggaacaatatttgtggtacagcacagataagggaaaatcattcaaattctacagtggcaaccccgttatgcctaatccgggcacagacgatttcagagatccgaaagtcatatgggatgaccaagataacaaatgggtcatggtcatggctgaaggatcaaaaatcggcttttatgaatccgataatcttaaggactggcattacacaagcggattcttcccagaacaggcgggaatggtggaatgtcccgacctctacatgatgcgggcaagcgacggaacgaataagtgggttctcggtgccagcgcgaatggcaaaccgtggggcaaaccaaatacgtacgcctactggaccggaagcttcgacggaaaagaattcaaagcggatcagactgaagcccaatggcttgactatggcttcgactggtatggcggtgtgacgttcgaagacagcaaaagcacagatccattagaaaagcggtatgcgcttgcctggatgaacaattgggattatgccaacaacaccccgacaatgaagaacggctttaacggcacagattctgtcatacgcgaactccggctgaaggagcaggatggaacatacagcctcgtctcacagccgattgaagctttggagcagctgactgtttcaactgacgaaatagaggatcaggatgtgaacggatcaaaaacattgtcgataacaggtgatacgtaccagcttgatacggatctttcttggtcagagctaaagaatgcaggcgtcaggctcagagaatcagaagaccaaaaacgccatattgatgtcggcattttcgctgaaggcggctatgcttatgtcaatagagcagccacaaatcagcctgacaaaagcaatacctatgtcgaaagcaaagctccttatgatgtaaacaaacgtaaggtgcatttgaaaatacttgtcgataaaacaacgatagaagtatttgttggcgacgggaaaaccgttttttcaaatgaagtcttcccaaagcctgaagataaaggaattaccctttattctgacggcggcacagcctccttcaaaaatataacagtgaaacactttgattcgattcatgaataa

SEQ ID NO: 46998 - DNA, 1563 bp, Bacillus subtilis
atgtctaaacaaggaaattttcaaaaatcaatgtcgctgtttgatctgattttgattgggatgggagccatctttggatcagcgtggctgttcgctgtcagtaatgtcgcttcaaaagcagggccctccggcgctttttcctggatcctcggaggagccattattttgttaatcgggcttgtatatgcggagctcggagccgctctgccccgtaccggaggcatcattcgataccccgtttattcacatggccaccttgtcggctacttaatttcgtttgtcacgattgtcgcttatacaagcttgatttcaattgaagtgacagctgtgcgccagtatgtggcctattggtttcccggcctgaccattaaagggtctgattcgcctaccatttccggctggatcttgcagtttgccctattatgcttgtttttcctgctgaattattggagcgtcaaaaccttcgctaaggcgaatttcatcatatcgatttttaaatatattgtgccgattaccatcattattgtgctgatctttcattttcagccggagaatttatccgttcaaggatttgcaccgtttggatttacaggtattcaggctgccatctcgacaggcggcgtcatgtttgcgtatctcggcctgcatccgattgtatctgtagcaggtgaagtccaaaatccaaaacgcaatatcccgatcgctttaatcatttgcatcatcgtttcaaccatcatttatactgttttgcaggtcacctttattggtgcaatcccgacagaaacactgaaacatggctggccggcaattggccgggagttctcattgccgtttaaggatattgcggtcatgctcgggttaggctggcttgcaacgcttgtcattttagacgccattctgtctcccggaggaaacgggaatatctttatgaatacgacatcccgccttgtttacgcctgggcgcgtaacggcacattatttggcatattctcaaaggtcaataaagatacggggacaccccgcgcttcgctttggctttcgtttgccctgtccattttctggacacttccctttccttcgtggaacgcgctcgtcaatgtctgttcagtcgcgctcattctttcatatgcgattgcacccatttcttcagctgcgctgagggtcaacgcgaaggacttaaacaggccgttttatttaaagggaatgagcattatcgggccgctttcctttatatttacagcgtttatcgtgtactggtcaggatggaaaacagtctcctggctgctcggttcacaactcgtgatgtttttgatctatctctgtttcagcaaatatacgcctaaagaagatgtcagccttgctcagcagctgaaatcagcctggtggcttatcgggttttatattatgatgctgatcttttcctacatcggttctttcggacatggtttagggattatcagcaatcccgtcgacctcattttagtcgcgatcggctcacttgcgatttattactgggcaaagtataccgggctcccaaaagccgccattgattatgataaataa

SEQ ID NO: 46999 - DNA, 681 bp, Bacillus subtilis
atgaaagcggtcatttttgatttagacggagtgataacagatactgctgaatatcattttctcgcttggaagcacatcgcagaacaaatcgatatcccttttgacagagacatgaatgaaaggctaaaaggaatcagcagagaagagtcacttgaaagcatattgatctttggcggggcggaaacaaagtatacaaatgcggagaaacaagagcttatgcatcggaaaaatcgcgattatcaaatgctgatcagcaaattgacgccggaagatcttttaccggggattggcaggcttctatgtcaattgaaaaacgaaaatataaaaatcgggttagcatcttcaagtcgcaatgctcctaagattttaagacgcttggcaattatcgatgattttcatgccattgttgatccgacgactcttgcgaaggggaagcctgatcctgacatctttttaacagctgcagcgatgctcgatgtttcccctgctgattgcgcggcaatagaagacgcagaagcaggcatttctgcaatcaaatctgcggggatgtttgcggttggtgtcggtcaaggacagccgatgcttggtgctgatctggttgtgaggcagacgagtgatttgacgcttgagctgttacatgaggaatgggagcagtatagaataagggagtcaattccttga

SEQ ID NO: 47000 - DNA, 1686 bp, Bacillus subtilis
atgagtgaatggtggaaagaagctgtcgtttatcaaatttacccgcgcagtttttatgatgccaatggagatggattcggagatttgcaaggtgtgattcaaaagctggattacatcaaaaacctcggggcggatgtcatctggctctccccggtatttgattccccgcaggatgacaacggatatgatatcagcgattacaaaaacatgtacgaaaagtttgggacaaatgaagatatgtttcagctgattgatgaagtccataaacgcggaatgaaaatcgtcatggatttggtcgtgaaccacacatcagatgagcatgcttggtttgctgaaagccgcaagtcgaaggacaatccttaccgggattattatctttggaaagatcctaaaccggacggctcagagccgaataattggggatcgatcttttcaggctcagcgtggacatacgatgaaggaacagggcagtattatttgcactacttttcgaaaaaacagcctgatttaaattgggaaaacgaagccgttcgccgggaagtttatgatgtaatgagattctggatggatagaggcgttgacggctggcggatggatgtgattggctctatttctaaatacaccgattttccggactacgaaacggatcacagccgcagctatattgtcggccgttatcactctaacggcccacgtcttcatgagtttattcaagagatgaacagggaagtgctttctcattacgactgcatgacagtcggagaggcaaacggctctgatattgaagaggcgaaaaagtacacagatgcaagcaggcaagagctgaatatgatctttacatttgaacatatggatattgataaagaacaaaactcgccaaatgggaaatggcagatcaagccgtttgatttgattgctttaaaaaagacgatgacaaggtggcagaccgggttaatgaatgtcggctggaataccctttattttgagaaccatgaccagccgagggttatttcccgctggggcaatgacaggaaactgcgtaaggaatgtgcgaaggcatttgcaacggttctgcacggcatgaaaggaacgccgtttatttaccagggagaagaaatcggcatggtcaacagcgatatgccgctggagatgtatgatgatcttgaaataaagaatgcatatcgtgaactagtcgtcgaaaacaaaacgatgtcagaaaaagagtttgtcaaagccgtgatgataaaaggaagggatcatgcgagaacaccgatgcagtgggatgccggaaaacatgcgggattcacagccggagacccgtggataccggtaaattcccgctatcaagatatcaatgtgaaagagtctttggaagatcaagattcgattttcttttactatcagaagctcattcaattacgaaagcaatataagattatgatatatggcgattatcagctgttgcaggagaatgatccgcaggtcttttcttaccttcgagaatatcgaggggaaaagcttcttgtcgttgtgaatttatcggaagaaaaggctctgttcgaagcgcctccagaactgattcatgagcgttggaaagtgctaatttcaaactatccgcaggagcgggctgacttaaagagtattagcctcaaaccttatgaagctgtgatgggcattagtatatga

SEQ ID NO: 47001 - DNA, 1770 bp, Bacillus subtilis
atgatggaatatgcagcgattcatcaccagccattcagcacagatgcttattcttatgatgggcggactgtgcatatcaagattcggacgaaaaaaggtgatgcagatcacattcgattcatttggggtgatccctatgagtacaacgacggcaaatggtcggcaaacgagcagccgatgaggaaaattgctgctacagaaatgcatgactattggtttgctgaagtggtgccgccatttaggcgtttacaatatgcgtttgttgtaacagacgatcatgaagacatctttttcggaagttcgggtgtatgcccttataacgaaaaaacactggaaacgattcattattactttaaatttccgtttgttcacgaggctgatacatttcaagcgcctgaatgggtcaagtcaacggtttggtatcaaatttttccggagcgttttgcaaatggaagagaagacttgtcaccgaagaatgcattgccgtgggggagcaaggacccggacgtcaatgatttttttggaggggatttacaaggaattgttgacaagcttgattatttagaggatttaggggtgaacggcatttatctgacaccgatcttttccgcgccttctaatcataaatacgacacgctggattacttttctattgatccgcatttcggggatcctgagctttttcgtacattggtcagccagctgcatcagcgggggatgagaattatgcttgatgcggtttttaaccatataggaagcgcgtctccgcaatggcaggatgtcgtcaaaaacggagatcaatcccgctataaggactggttccatattcactcttttcccgtcacagacgacaattatgacagatttgcttttacagctgatatgccgaagctaaacacggctaatcccgaggtgcagaaatatttgcttgatattgctttgtactggattcgcgaatttgacattgacggctggcgtttggatgtcgcaaatgaagtggatcacgttttttggaagacatttaggcaggctgtatctactgaaaagcctgatgtttatattttaggtgagatctggcattctgccgaaccctggcttagaggggatgaatttcatgcggcgatgaattacccttttacagagcctatgattgaatactttgctgaccagacgatctcagcttcacgtatggctcaccgtgtcaatgcacatttgatgaatggaatgaagcaggccaatgaggtgatgtttaatttactggatagccatgatacaaagcgccttttgaccagatgccgcaatgatgagaagaaagcacgcgcgttgctggcctttatgtttgcccagacaggctcaccatgcatttattacggaacggaaatcgggctgaacggcgaaaatgatccattatgccggaaatgtatggtttgggaaaaagagaagcaaaaccaagacatgctgcaatttatgaaacggttaattgctttacgcaagcaggaaaacactttattgactgaaggacatcttgagtggaatctgctggacgacaaaaatgatttcattagcttttcgcggactcttgatgaaaaaatactgatttatttctttaatcaagggaatgtggttcaacacgtcagtttacgagagttgaatattgataggaataagaaaatctgtgatgcatggacagagcagccgctacagcatcacgatgtcattgccgttcagccgggagaatttttgattttgagtgctgccgcccctgtataa

SEQ ID NO: 47002 - DNA, 765 bp, Bacillus subtilis
gtgataaaaatgagtgactttctaaaagactgctttcagaaaatcggctgggagaaagaccatgtcagcttcggcgatcttcccctttttcttaaagcaatggcataccgttttccattcgaaaaccgtgccgtacttgcaaaagagaattataagatcacaaaagaagagctatggcgacgtctgctcaaagatcagcacggcggcctatgctacgatctaaatggtttcctttattttgtcttgcgtgaggccgggtttcatgtgaagctcattcgaggaacggtttatgcaggcgatcaagagggatgggcactagaagggacgcatgctgctgtatggctgtctgcggaaaacggcgattacctcgttgatatcggcttcggcatcaacctggcgctccagccgataccgctttccggagaaacggtacagtcaccagtcgggtcattccgaatcaaaaaggaagagacagaaaagggcagctatgttctgctgatggacaaaggagaaggctggcaaattgggtacgcctttacccttgaagagagtgatctcggtgatttagataacatgaaggacatcattcactctcatgaaaaatctccttttaacaaatccctgcttgcctcaaagctgacgccgagcggaaggatggtcatgtcagagcgccattttacgatttatgaaaacggcggtaacattcaaaaaagcgacatcggcccttcaggatttgaagagaaattaaatactcattttttgtaa

SEQ ID NO: 47003 - DNA, 1770 bp, Bacillus subtilis
atgccaaccaagaaacaaaaatctaaaagtaaattgaaacccttttttgccttagtaagacggaccaatccttcttatggaaagctcgcctttgcgcttgccctcagtgtagtaaccacgctggtcagcctgctcattccattattaacgaagcagcttgtcgatggtttttctatgtcaaatctgtcaggcacgcaaatcggtttgatcgcgctggtgtttttcgttcaggcgggtttaagcgcttatgccacctatgcgcttaactataatggacaaaaaatcatttccgggctgcgggagttattatggaagaaattaattaagctgcctgtctcttatttcgatacaaatgcttccggagaaacagtcagccgtgtaacgaacgatacgatggtggtcaaagaattgattacaacccatatcagcggatttattacaggcatcatttctgtcattggatcattgacaatcttgtttattatgaactggaagctgacactgcttgtgttagtggtcgttccgctggccgctcttattttggtgccgattggacggaaaatgttctccatttcacgggaaacgcaagatgaaacggctcgttttacaggcctgcttaatcaaattctcccggaaatcagacttgttaaggcttcaaatgcggaggatgtcgaatatgggcgcgggaagatggggatttcctcattatttaagcttggcgttcgtgaagccaaggttcaatcgcttgtcggcccgcttatttcactcgtgttaatggcagcgcttgtcgcagtgatcggatatggcggcatgcaggtctcatcaggcgagctcacagccggagcgctcgtggcttttattttatatttgtttcaaattattatgccgatgggccagattacaacgtttttcacacagctgcaaaaatcaatcggtgcaacagaacgaatgattgagattttggcagaggaagaggaagatacagtgacaggaaaacaaattgaaaatgcacatctgcctatccagcttgatcgcgtgtcttttggatataagcctgatcagctgatcttaaaagaggtcagcgccgtcattgaagcagggaaagtgacagcgatcgtcggtccgagcggcgggggaaaaacgacgctgtttaagctgcttgaacgcttttattctccgactgcagggaccattcggctgggggacgagccggtcgatacttactcgcttgaatcgtggagggagcatatcgggtatgtatcacaggaaagcccgttaatgtccgggacaatcagagaaaatatttgctacgggttagaacgagatgtgacggatgctgagatcgaaaaagccgcggagatggcatatgcgctcaattttataaaggagctgccgaatcagtttgatacagaagtgggcgaacgcggcattatgctgtcaggcggacaaaggcaaagaatcgcgattgcgagagcgcttctccgtaacccaagcattcttatgctcgatgaagctacctcaagtctcgacagccaatctgaaaaatcagttcagcaggcgctggaggtgctgatggagggccgcacaacgattgttatcgctcaccgcctatctaccgttgtagatgcggaccagcttttgtttgttgaaaaaggggaaattaccggtcgtggaacacaccatgagttaatggcttcccatggcctttaccgggattttgctgaacagcagctgaaaatgaatgcggacttagaaaacaaagccgggtaa

SEQ ID NO: 47004 - DNA, 630 bp, Bacillus subtilis
atgaaacaggcagatgaactgcgttttaacgaggacggattaattcctgctatcgtgcaggatgcggcaagcaaagaagtgctgacacttgcgtatatgaacaaggaatcgtacgaaaaaacgctggaaacgaaggaaacatggttttacagccgctcacgccaagcgttatggcataaaggagaaacctcagggaacacgcaagccgtcaaaggtatccggtatgactgcgatcaagacgcgctgctcgtactcgtagaaccgtcaggcccggcatgccacactggcagctacagctgttttacaaaggaacaaacagaagaacaggccgcggaccgattcggcatcatgaacgaactggagcgggtgatcgcggaacgccaagcggaaatgcctgaaggagcttacaccacgtacctcttccgtgaaggcgtcgataagattttgaaaaaagtcggagaagaagcatccgaagtcatcatcgccgcgaaaaaccgggatcatgaggaactcaaatgggaagcggcagacctgctgtatcacctgcttgtcctgctcagagaacaatccctgccgctggatgatgtgcttgacgtattgaaaaaacgccattctgagattgaagagtaa

SEQ ID NO: 47005 - DNA, 759 bp, Bacillus subtilis
atgatcacaaaacggattatcccatgccttgatgtcaaagaaggacgcgttgtcaaaggaattcaatttctcgaattgaaggatgccggtgacccagttgaactcgccgaagtgtacgaccgggaaggtgcggatgaacttgtttttcttgatatctccgcctcgcacgaaggacgaaagacgatggttgacgttgtggagcaggttgccgcgaagcttgccattccgtttacagtcggcggcggcatcaatcagctcagcgatatgaaaacgatactgcgtgccggagcggacaaagtgtcggtgaacacggcagctgttctccgccctgagctgattacagaaggagccgagtttttcggttctcaatgcatcgtacttgccattgatgccaagtatgacaaagaatctgacacatataaggtctacacgcacggcggcagaaagaaaacagattgggaggtcaccgcgtgggcaaaagaaggcgtcaaacgcggggcaggagaaatattgctgacaagcatggactccgacggtgagaaaaaaggtttcgaccacacgctgacaaagcttgtttccgaagctgtccccgtccctgttatcgcttcgggaggcgcgggaaacgcacagcatatgcttgaggcttttacaaaaggagaagccgacgccgcgctggccgcctcaatttttcattataaagaaacatcgattaaagaagtgaaatcatacttgaaagagtacggggtgaatgtgagatga

SEQ ID NO: 47006 - DNA, 585 bp, Bacillus subtilis
atgagaaaagcggaacgcgtcaggaaaacaaacgaaacagatattgagctggcatttacaatagacggcggaggacaagcggatattaaaacagatgtgccgtttatgacacatatgttggatttattcacgaaacacggccaatttgatctttccattaacgcaaaaggcgatgttgatatagatgatcaccacacgactgaagatatcggcatctgcttagggcaggcgctgctcgaagcgttgggcgataaaaaaggaatcaaacgctacggatcggcgtttgtgccgatggatgaggcacttgctcaagttgtgattgatttaagcaaccggccgcacttagaaatgcgcgctgatttcccggctgctaaagtcggaactttcgatacggagcttgtacatgaatttttgtggaagctggcgctcgaagctcgaatgaacctgcacgtcatcgttcattatggaacaaatacccaccacatgattgaagccgtttttaaagcactgggacgtgcgcttgatgaagcgacaacgatcgatccgcgagttaaaggaataccgtcaacgaaagggatgctgtaa

SEQ ID NO: 47007 - DNA, 1284 bp, Bacillus subtilis
atgaagatcaaaaccatcagcggagcggaacggctttctctcaagcgttccatcgatgccggaacggaagagcaaagaaagacggtccggtccattattgaagatgttaaagcaaacggtgatcaggcggttcgcagctacacggcgaaatttgactgcatcgaaatagacagcccgctggtcacaaaagaagaatttgaggaggcatacacctcactggattcacgtcttcttcaggtgattaggcaggcaatcgaaaatattagggaatatcacgaaagacagctgcaatcctcctggttttatcacagaaaggacggcacaatgctggggcagaaagtgacggcgctggattccgccggtgtatatgtgccggggggaacggccgcatatccttcatctgttttgatgaatgtgattccggcgctcgtagcgggcgttgaaagaatcgttctcgtcacgcctccgggaaaagacggtctgctgtctcctggagttttggttgctgcagccgagctgggcataaaagacatttacaaaatgggcggcgctcaggcgattgcggcgttagcatacggaacagaaaccattgagccggtggataaaatcacgggtccgggcaacatttatgtcgcgcttgccaaacgagaagtgttcggcgatgtcgatatcgatatgattgccggaccgagtgaaatcgtcgtgctggctgatgaaacagcgattccgagcgaaattgcagccgatctgctgtcacaggcggaacacgataagcttagctcatgtgtgtttgtcacagattccatggcgctggccgagacggtttcagccgaggtgaataagcagctggaaaccttgccgcgaagagaaatagcggaagcttcagtgagagattacggttgtatatatgtggcggaaacaatggtagaagcgattgagactgtcaatacactcgcgccagagcatttagaaatcataacacagtctccggaagctttgcttggcagtatcaaacatgcgggtgcaattttcttaggcagatacagccctgagcctgtcggtgattattttgccggaccgaaccatgtgcttccgacaaacggaacagccagattttcaagtccattaaacgtaactgattttcaaaagaaatcgagcattatttcttacagtcaatcagcctttgaagaacatgccgaaagcatcgcggcttttgccagactggaagggttagaagcccatgccagatcaattgaagcgagagaacggaggatttctaaatga

SEQ ID NO: 47008 - DNA, 651 bp, Bacillus subtilis
atgagtgacaaacaagtaacgacgattctgtttgatttagacggaacgcttattaatacgaatgaattaattatcgcgtcctttttgcatacactggagcattattatccgagcaagtataaacgagaagatgtccttgcatttatcgggccgtctctttttgatacgttctcttcgatggaccctgataaatgcgaggatatgatcgctatgtacagagcgtacaatcatgacatgcatgattcactcgtcactgaatatgaaacggtatatgagaccctggatgcattaaaaaaagccggctttacattaggaattgtgacaacaaaattaagagatactgtcaatatgggcctcaagctcacgggaatcggcgaattctttgaaacagttgtcacccttgatgatgtgacgaatgcaaagcctgatcccgagcctgtgctgttagcgctgaaacagctaggaagcgagccggcggaagccattatggtcggtgataattaccatgatgtgctggcagggaaaaacgccggtacaaaaacggcaggagtcgcatggacgattaaagggccggaaatgctggcgaagcatgagccggattttatgcttgagaaaatgagtgatctattacaaatcgttggagtgaagtaa

SEQ ID NO: 47009 - DNA, 1386 bp, Bacillus subtilis
gtgaaaaaaatagctgtcattggaacaggttatgtaggactcgtatcaggcacttgctttgcggagatcggcaataaagttgtttgctgtgatatcgatgaatcaaaaatcagaagcctgaaaaatggggtaatcccaatctatgaaccagggcttgcagacttagttgaaaaaaatgtgctggatcagcgcctgacctttacgaacgatatcccgtctgccattcgggcctcagatattatttatattgcagtcggaacgcctatgtccaaaacaggtgaagctgatttaacgtacgtcaaagcggcggcgaaaacaatcggtgagcatcttaacggctacaaagtgatcgtaaataaaagcacagtcccggttggaacagggaaactggtgcaatctatcgttcaaaaagcctcaaaggggagatactcatttgatgttgtatctaaccctgaattccttcgggaagggtcagcgattcatgacacgatgaatatggagcgtgccgtgattggttcaacaagtcataaagccgctgccatcattgaggaacttcatcagccattccatgctcctgtcattaaaacaaacctagaaagtgcagaaatgattaaatacgccgcgaatgcatttctggcgacaaagatttcctttatcaacgatatcgcaaacatttgtgagcgagtcggcgcagacgtttcaaaagttgctgatggtgttggtcttgacagccgtatcggcagaaagttccttaaagctggtattggattcggcggttcatgttttccaaaggatacaaccgcgctgcttcaaatcgcaaaatcggcaggctatccattcaagctcatcgaagctgtcattgaaacgaacgaaaagcagcgtgttcatattgtagataaacttttgactgttatgggaagcgtcaaagggagaaccatttcagtcctgggattagccttcaaaccgaatacgaacgatgtgagatccgctccagcgcttgatattatcccaatgctgcagcagctgggcgcccatgtaaaagcatacgatccgattgctattcctgaagcttcagcgatccttggcgaacaggtcgagtattacacagatgtgtatgctgcgatggaagacactgatgcatgcctgattttaacggattggccggaagtgaaagaaatggagcttgtaaaagtgaaaaccctcttaaaacagccagtcatcattgacggcagaaatttattttcacttgaagagatgcaggcagccggatacatttatcactctatcggccgtcccgctgttcggggaacggaaccctctgacaagtattttccgggcttgccgcttgaagaattggctaaagacttgggaagcgtcaatttataa

SEQ ID NO: 47010 - DNA, 879 bp, Bacillus subtilis
atgaaaaaagtacgtaaagccataattccagcagcaggcttaggaacacgttttcttccggctacgaaagcaatgccgaaagaaatgcttcctatcgttgataaacctaccattcaatacataattgaagaagctgttgaagccggtattgaagatattattatcgtaacaggaaaaagcaagcgtgcgattgaggatcattttgattactctcctgagcttgaaagaaacctagaagaaaaaggaaaaactgagctgcttgaaaaagtgaaaaaggcttctaacctggctgacattcactatatccgccaaaaagaacctaaaggtctcggacatgctgtctggtgcgcacgcaactttatcggcgatgagccgtttgcggtactgcttggtgacgatattgttcaggctgaaactccagggttgcgccaattaatggatgaatatgaaaaaacactttcttctattatcggtgttcagcaggtgcccgaagaagaaacacaccgctacggcattattgacccgctgacaagtgaaggccgccgttatcaggtgaaaaacttcgttgaaaaaccgcctaaaggcacagcaccttctaatcttgccatcttaggccgttacgtattcacgcctgagatcttcatgtatttagaagagcagcaggttggcgccggcggagaaattcagctcacagacgccattcaaaagctgaatgaaattcaaagagtgtttgcttacgattttgaaggcaagcgttatgatgttggtgaaaagctcggctttatcacaacaactcttgaatttgcgatgcaggataaagagcttcgcgatcagctcgttccatttatggaaggtttactaaacaaagaagaaatctaa

SEQ ID NO: 47011 - DNA, 1374 bp, Bacillus subtilis
atgaaaaagcagtcaaatatatggctttattttttcggagctcttggaggcgcgttatatggctatgataccggagtgatttccggagctattttatttatgaaaaaggagttaggcttaaacgcgtttacagaaggtcttgttgtcagctccttgctggttggggcgatattgggctcaggagcggccggcaagctgactgaccgtttcggaagaaaaaaagcaattatggcagccgcgctgctgttttgtataggcggtcttggtgtggcactggccccaaatacaggagtcatggtgctgtttcgcatcattttgggacttgcagtcggaacatcgacgacaatcgtacccctttatttatctgaactggcgccaaaacataaacgcggggcgctgtcatcactgaatcagctgatgatcacggtcggcatccttctttcttacattgtcaattacatatttgccgatgccgaagcgtggcgctggatgcttggattggctgctgtgccgtcattgctcttgcttattggcattttgtttatgccggagagcccgcgctggctgttcacgaatggcgaagaaagcaaagcgaagaaaattcttgaaaaattgcgtggcacaaaagatattgatcaggaaatacatgatataaaagaagcggaaaagcaggatgaaggcggtctgaaggagctgttcgatccatgggtgcgcccagcgcttattgcaggtttgggactcgcttttttgcagcaatttatcggaacgaatacgatcatctactatgcgccaaagacctttacaaacgtcggattcggaaactccgcttcgattttaggcacggtcggaatcggcacagtcaatgttctcatgacattagtagcgattaaaatcatcgacaagattggaagaaagccgttactgctattcgggaatgcgggcatggtgatcagcttgatcgttctcgctttagtaaatctctttttcaataacactccggctgcctcatggacgaccgtcatttgtttaggcgtgtttatcgttgtctttgcggtcagctggggaccggttgtgtgggtgatgcttcctgaattgttcccgcttcacgtcagaggaatcgggaccggtgtttcgaccttaatgttgcacgttgggacactgattgtttcattaacctatccaatattaatggaagcgatcggaatcagttatttattcctgatttatgccgcgatcggtatcatggcgttcttatttgtccgatttaaagtgacagagacaaagggaagaagccttgaagaaattgagcaggatttacgggacaaaaacggacagggaggagcggccggaaaacagcagactgtcggaacataa

SEQ ID NO: 47012 - DNA, 882 bp, Bacillus subtilis
atgcgtaatatttgtgtgattggtagctgttctatggatttagtggtcacctcggacaaacgcccaaaagccggtgaaacggttcttggcacgtcatttcagactgtgccgggcggcaaaggagcaaatcaggccgttgccgcagccagacttggggcgcaagtgtttatggtcggcaaagttggagacgatcattatggaacagctattttgaataatctcaaagctaacggcgttcgcactgattatatggaaccggttacacatacggaaagcggaaccgctcatattgtgcttgctgaaggcgacaacagcattgtcgttgtcaaaggcgcgaacgatgacatcaccccagcgtatgcgttaaacgcgctcgaacagattgaaaaggtcgatatggtgctgattcagcaggaaatcccagaagaaacggttgatgaggtgtgcaaatactgccattctcacgatatcccgatcatactaaacccagcaccggcccgcccgctcaagcaggaaacaattgatcacgctacctatctgacgccgaatgaacacgaggcttcgattttattccctgagcttaccatttccgaagctctggcgctttatccggcaaagctctttattacggaaggaaaacaaggcgtccgctattcggctggcagcaaagaggtgctcatcccgtccttccctgtagaacccgttgatacaaccggagccggtgatacgtttaacgcagcatttgccgtggccctggctgagggaaaagacattgaagccgcattgcggtttgccaatcgtgccgcttccctttctgtctgctccttcggtgcccaaggcggaatgccgacaagaaatgaagtagaggagctgctgtcatga

SEQ ID NO: 47013 - DNA, 1323 bp, Bacillus subtilis
atgaatataacagtcatcggaacaggctatgtcggtcttgtgacaggtgtttctctttctgagattggacatcatgtaacctgcattgatattgacgctcacaagattgatgaaatgagaaagggcatttcccccatatttgaaccaggtcttgaagagctgatgagaaaaaatacagctgatggacggctgaactttgaaacgagctatgagaaaggcttggcacaggcagacatcatttttatagcggtcggcacaccgcagaaaagcgacgggcacgccaatctggagcaaattacagatgcggccaaacgcatcgcaaagcatgtcaaacgagatacagtcgtggtaacgaaaagcacagtgcccgttgggacaaacgatttgattaatggactgattactgaacatctagcggagcctgtcagtatttcggtcgcatccaatccggaatttttgcgtgaggggtcggcgatctatgatacctttcatggtgacaggatcgtgatcgggacggccgatgagaaaacagcaaatacgctggaggagctcttccgtccgtttcaaatcccgatttaccaaacggatatcagaagcgccgagatgatcaaatatgcctcaaatgcttttctggccactaagatcagttttataaacgaaatttcgaatatatgtgaaaaggtcggcgccgatattgaagcagtcgcatacgggatgggacaggataagcggatcgggagccagtttttaaaagcgggcataggctacggcggctcttgttttccaaaggacacaaacgccctcgtgcaaattgccggcaatgtcgagcatgattttgaactgctgaaatccgttatcaaagtcaacaacaatcagcaggcgatgctggttgataaagcgctgaacaggctcggtggggtgacgggaaaaacgattgcccttttaggcctgtcatttaaaccgaataccgacgatatgagagaagcgccgtcaattgttattgcagaccgtctcgctgcgctcgacgcccgtatcagagcctacgatcccattgcagttagccatgcaaagcatgttctcccgcaagctgttgaatataaagagacgatcgaggaagctgtcaaagggtctgacgccgtcatgattttaaccgactgggctgacattaaacaattcccgttagcggcttatcaggatttgatggaaacgccgctcatatttgacggcagaaactgctacacattggatgaggctttggctgcaggagtggagtattattctgtcggacggaaggcggttgttccgtcaggtgcaattcaatag

SEQ ID NO: 47014 - DNA, 399 bp, Bacillus subtilis
atgcttgatactcagcaaattaaagaaattattcctcaccgttatccgtttttgcttgtggatcggattacggaagttgaagagggcaaacgggcaaaaggctataaaaatgtaaccgctaatgaagagttctttaacggacattttcctcagtacccggttatgcccggcgtattaatcgtagaagcactcgctcaagtcggagctgttgcgatgttgattaaagaagaaaaccgcggcagactggctttttttgcaggcattgataactgccgctttaaaaaacaagtcaagcctggtgaccagcttcaccttgaggttgaaatcattcgtgcccgcggcacaatcgggcgcggaaaaggcgttgccacagttgatggcaagtcgtttgcgaattag

SEQ ID NO: 47015 - DNA, 1311 bp, Bacillus subtilis
ttggaaaaaatcatcgtccgcggcggtcagaagttaaacggcacagtcaaagttgaaggcgctaaaaatgccgttttacctgttatcgctgcatctttattagcaagtgaagaaaaaagcgtaatttgtgatgtacctacgctctccgatgtatatacaattaacgaagtgttgcgtcatttaggagcagatgtgcattttgaaaataatgaagtgactgtaaatgcttcatacgctttgcaaactgaagcaccttttgaatatgttcgtaaaatgcgtgcgtctgtgcttgtcatggggccgcttcttgcgcgtacaggtcatgcaagagttgcacttccgggcggatgcgcaattggttccagaccgattgatcagcatttaaaaggttttgaagcaatgggcgcagaaatcaaagtcggtaatggcttcattgaagctgaagtaaaaggccgactgcaaggcgcaaaaatttatctggacttcccaagtgtaggagctacagagaacctgattatggcagccgctctagctgaaggaacaacaacgctggaaaacgtggcaaaagaacccgaaatcgttgatttagcaaactatatcaacggcatgggcggaaaaatccgcggagctggcaccggcaccatcaaaattgaaggagtcgaaaagcttcacggcgtaaaacaccatattattcctgaccgtattgaagcgggcacatttatggttgctgctgcaatcactgaaggaaacgtattagtaaaaggagcggttcctgagcacctcacctctttaattgcaaaaatggaagagatgggtgtaacaattaaggatgaaggtgaaggtctgcgtgtcatcggcccgaaagagcttaaaccgattgacatcaaaacaatgcctcacccgggcttcccgactgatatgcagtcacaaatgatggcgcttctgcttcgtgcaagcggcacaagcatgattacagaaaccgtttttgaaaaccgttttatgcatgcggaagaattccgccgtatgaatggtgatatcaagattgaaggacgttctgtcatcattaacggtcctgtacagcttcagggagctgaagttgcagcgactgatttgcgtgcaggtgcagcgctgattcttgcggggttagtggctgaaggtcacacacgtgttactgaattgaagcacttagaccgcggttacgttgatttccatcagaagcttgccgctctgggcgcagacatcgaacgtgtaaatgatgagtctgcttctgagcaagagaataaagaagtcgtttctgacttaaatgcataa

SEQ ID NO: 47016 - DNA, 864 bp, Bacillus subtilis
ttggcctcattacgcgatattaagtcaaggatcacgtcaacgaaaaaaacaagtcagattacaaaagccatgcagatggtatctgcggctaagctgaatcgtgctgaaaacaatgcaaaatcatttgtgccatatatggataaaatccaagaggttgtgtcaaacgtcggaagagtttccggcaacgtgaagcacccgatgcttctcagcagagaagtgaaaaaaacggcataccttgtcattacgtctgaccgcggtcttgccggcgcttttaacagttcggttttacggagtgcttatcaggccatgcaagaacgtcatcagtctaaggatgagtatgcggtgattgccatcggaagagtgggccgtgatttctttaagaaacgggagattccgatcatttccgagttaacaggacttggagatgaagtaacgtttacagaaattaaagatcttgcccgtcaaacgattcaaatgtttatagacggtgcgtttgatgaattgcaccttgtttataaccattttgtcagcgccattactcaagaagtaacggagaaaaaacttctgccgttatctgatttgggcagcggcggcggaaaaagaacggcgtcttatgaatttgaaccatctgaagaggaggttctggaggttttgcttcctcaatatgcagaaagcttaatcttcggtgcgcttcttgacagtaaagcaagtgagcacgctgcaagaatgacggcgatgaaaaacgcgacagacaacgcgaaggaacttatcgattcactttcgctttcttacaaccgcgctcgccaagcagccatcacacaagaaattacggaaattgtcggcggagcagccgctttagaatag

SEQ ID NO: 47017 - DNA, 1509 bp, Bacillus subtilis
gtgagcatcaaagctgaagagattagcacgctgataaaacagcaaatacaaaattatcaatctgatattgaagttcaagacgtaggtacagtcatccaagtcggtgacggtattgcacgtgtgcacggccttgacaactgtatggccggtgaacttgtcgaattttcaaacggtgttttgggtatggctcaaaaccttgaggaatcaaacgtaggtatcgtcatcttaggacctttcagtgagatccgtgagggagacgaagtaaaaagaacaggccgcatcatggaggttcctgttggtgaagagttaatcggccgtattgtaaacccgctaggccagccggttgacggactaggcccgattctgacaagcaaaactcgtccgatcgaaagccctgcaccaggcgttatggaccgtaaatccgttcatgaaccgcttcaaaccggtatcaaagcgatcgatgcactgattccaatcggccgcggccagcgtgagctgatcatcggtgaccgtcaaacaggtaaaacatctgttgcgatcgatgcgatcctgaaccaaaaagaccaagacatgatctgtgtatatgttgcgatcggccaaaaagaatcaacagtccgcggcgtagtagaaacattgcgtaaacacggcgcgcttgattatacaattgttgtaacggcgtctgcgtcacagccggcaccgcttctgtacctggcaccgtatgctggggttacaatggcagaagaatttatgtacaacggcaagcacgttcttgttgtatacgatgatctttctaaacaagcggccgcttaccgtgagctgtccttgcttcttcgccgtccgccaggccgtgaagcgttccctggggatgtattctatcttcattcccgtctgcttgagcgtgcagcaaagcttagcgacgcgaaaggcgcaggatcaattacagctctgccgttcgtagaaacacaagccggagatatctctgcttatattccgacgaacgtcatttccatcaccgacggacagatcttcctgcaatctgatttgttcttctcaggcgtacgtccagcgatcaatgccggattgtctgtatcccgtgtcggcggctcagcgcaaatcaaagcgatgaaaaaagtatcaggtactttgcgtcttgaccttgcgtcataccgtgagctggaagcattcgctcaattcggttctgacctcgaccaagcgactcaggcaaaactgaaccgcggtgcgcgtacagttgaagtgctgaagcaggatctgaacaagccgcttccggttgaaaagcaagtagctattctttatgcgctgacaaaaggatatctcgatgatattcctgtggcggatatcagacgttttgaagaagagtactacatgtaccttgaccaaaaccataaagacctgcttgacggaattgcgaaaacaggaaaccttcctgctgatgaagacttcaaagctgcaatcgaaggcttcaaacgcacatttgcaccaagcaactaa

SEQ ID NO: 47018 - DNA, 546 bp, Bacillus subtilis
atgagtggatcagctgtctctaaacgatatgcatcagctctttttgatatagccaatgagtccgctcagctgaatcaagtagaagaagagctaattgttgtaaaacaagtatttcaaaatgaaaaagcgcttaatgatgtgttgaaccatccgaaggtgccggctgcgaagaaaaaagagctgattcaaaatgcatttggctctttgtcacagtccgtactcaatacgatttttcttttgattgaccgccatcgtgccgcgattgtccctgagctcacagatgagtttatcaaactcgcaaatgtggcccgtcaaacagaagacgcaatcgtatattcagtgaaaccgctgacggatgcagaaatgttaccattatcacaagtgtttgcaaaaaaagccggagtcgcttcactgagaatcagaaatgaagtgcagacggatttaataggcggtattaaagtccgcattggaaaccggatttatgacggcagcgtaagcgggaagcttcagcgcattgaacgtcaattagccggggaaaatcgatag

SEQ ID NO: 47019 - DNA, 735 bp, Bacillus subtilis
ttgaatcatggttacagaactatagaatttctaggtcttacttttaatctgacaaacattctgatgattactgtggcgagtgtgattgttttattgattgctatattgacgacaagaacgctttcgatccgtcccggaaaagcccagaactttatggaatggattgttgatttcgtccgcaatattattggcagtacaatggatttaaaaacaggggctaacttcttggcacttggtgtcacattgctgatgtacatatttgtgtcgaatatgctggggctgccgttctctattacaatcggacatgagctctggtggaagtctccgacagccgatcctgccattacattaacgctagccgtgatggttgttgctttaacccactactatggtgtgaagatgaaagggctcaaggaatattccaaagactatttaagacctgttccattcatgctcccgatgaaaatcatcgaagagtttgcgaatacgctgactctaggtttgcggctgtatggtaacatcttcgccggtgagattcttctcggcctgcttgcgggattagcaacaagccattattcgcaaagcgtggctctcggtcttgtcggtacaatcggtgccattctgccgatgctggcatggcaagcattcagtttatttattggtgctatccaggcatttatctttacaatgctgacgatggtgtacatgtctcataaaatcagtcatgatcattaa

SEQ ID NO: 47020 - DNA, 1749 bp, Bacillus subtilis
atgggttattacttaacttggttaactatttcaagaaagaaggagatttgcttgaataacataaaaaaaacgaaagaaggccacttagaaacaactcttagaggaaaagaagttttatctattcctactttaaataaaggcgttgctttttcactagaagaaagacaagaactcggcttagaagggcttctgccgccaactgtactttctcttgatcaacaagcacaacgcgcgtacgagcaattccaagcgcagcctgaccgccttcgtcaaaatgtttacttaagtgatcttgcaaaccgtaacgaagttcttttctataaattgctgaaaaaccatcttcgcgaaatgcttcctgttgtgtacacgccaacagttggtgaagcgattcaggaatacagccatgaatatagaagacctcaaggaatctacttgtcaatcgataacattgacggtattgaaaaagcgtttgaaaaccttcatgcgacagcaggcgatattgatcttatcgttgctactgactccgaaagcattctcggtatcggtgactggggtgtaggcggtattaatattgcaatcggtaaattggctgtctacactgctgcagctggtattgaccctagccgtgttatcccggttgtgcttgatgtcggtacgaacaacgaaaaacttctaaacgatcctttatatattggtaacaagcatgaacgtgttcaaggtgaacgctacgaagctttcattgacgcttatgtaaaagctgcattgaaattcttccctaaagcgcttcttcactgggaagaccttggcaacaaaaatgcacgcaacatcatgaaaaaatacaatcatgaaatcctgacatttaatgatgatattcaaggtactggcgcgattacacttgcaggtgtgcttgccgctatgaagaaaaccggcgcttctattaaagatcagcgtgttgttatcttcggtgctggttctgctggtatcggtattgctgaccaaatccgtgacacaatggtgctagccggattatctgaagaagaagctaacaaacgtttctacacacttgattacagaggcttgctgactgaagacatcgaaggcatccttgatttccaaaaaccttaccttcgcaatgcggatgaagtgaaagactggaagcgcgatgaaaaaggtcaaattccattcgatgaagttgttcgtcaagcgaaaccaacaatcttgattggtacttcaggggtttcaggtgcattcacagaggaaattgtaaaagaaatggcatctcacgtagaccgtccggttatcatgccgatgtctaacccgactcaccttgctgaagctgttcctgaagatctgttcaaatggactgacggaaaagtgcttattgcaacaggaagcccatttgacaatgtagaatacaacggtgtttcttatgaaatcggacaatctaacaacgcattcgcgttccctggtcttggacttggttcaattgtagctgaagcgcgtatcattacacctgctatgtttgctgcaactgctgatgcgattgctgaaatggttgatcttgaaacacctggagcaggattgcttccaagcattgataagcttcaagaggtttctatccaagttgcgattgccgttgctgaagcagcaattaaagacggcgtggcaaatcgtcagcctgaagatgtgaaacaagcggtacttgatgcaatgtggacacctgaatacaaaaaagtcatcgcgaaataa

SEQ ID NO: 47021 - DNA, 1284 bp, Bacillus subtilis
atgaaagacgtatctatttcctctttggaaaatatgaaattgaaagagctttatgaacttgcaagacattataaaatctcctattacagcaaactgacaaaaaaagaactcattttcgccattctgaaagcgaatgcagaacaggaagatctgctgtttatggaaggcgttctcgagatcatccagtctgaaggtttcggattcctgagaccgatcaactactctccaagctcagaagacatttacatctcagcttcacaaatccgccgtttcgatttgcggaacggagacaaagtatctggcaaggttcgcccgccaaaagaaaatgagcgttactatggacttttgcacgttgaagcagtaaatggggatgatcccgaatctgcaaaagagcgtgtgcatttcccggctcttacgccactttatccggatcgtcaaatggtgcttgaaacaaagccgaacttcttgtctacaagaattatggacatgatggcgccggttggatttgggcagcgcggattgattgttgcgccgccgaaagccggaaaaacgatgttgctgaaggaaattgccaacagcattacagcgaaccagcctgaagcagagctgatcgtgcttttaattgacgaaagacctgaggaagtaaccgatatcgagcgctctgtagctggggatgtcgtcagctcaacgtttgatgaagtgccggaaaaccatatcaaagtggccgagcttgtgcttgaacgtgcgatgcgtctcgtggaacacaaaaaatacgtcattatcctgatggacagcatcacacgtcttgcccgcgcctacaacttagtgattccgccaagtggaagaacgctttccggggggattgacccagcggcgttccaccgtccgaaacgcttctttggggctgcgagaaatatcgaagagggcggcagcttaaccatccttgctacggctctggtcgatacaggttcacgtatggatgatgtcatttatgaagaattcaagggaacaggcaacatggagctccatcttgaccgctctcttgccgagcgccgcatcttccctgccatcgatatccgccgttcaggaacgcgcaaagaagagctgcttgtgcctaaagagcatcttgatcgtttatggtctatccgcaaaacgatgtctgattcacctgatttcgcagaaaagttcatgagaaaaatgaaaaaaaccaaaacaaaccaggaatttttcgatattctcaatcaagaatggaaacaggcaaatctatcatctgcaagaaggtaa

SEQ ID NO: 47022 - DNA, 1290 bp, Bacillus subtilis
atggaaaagttgaatattgccggcggtgactcgttaaacggtacagtacatatcagcggcgctaaaaacagcgctgttgcgttaatacctgcaaccattttggcaaattccgaggtgacaattgaagggcttccagagatttcagatattgaaacgctgcgtgacctgttaaaggaaatcggcggcaacgtgcattttgagaatggggaaatggttgttgaccctacgtcgatgatcagcatgccgcttcctaacgggaaagtaaaaaagcttcgcgcgtcatattatttaatgggggcgatgctcggccgcttcaagcaggcggtcattggattgcctggcggctgtcacttagggccccgtccgattgatcagcatatcaaaggctttgaagcactcggagctgaagtaaccaatgaacaaggcgccatttatttgcgagctgaaaggctgagaggcgcacggatttatttagatgtcgtaagcgttggggcaacgattaacattatgctcgccgctgttttggcagaagggaaaacgatcatcgaaaacgctgccaaggagcctgagatcattgacgtcgcgacattgcttaccagcatgggcgccaaaatcaaaggtgcgggcaccaatgtgattcgaatcgacggcgtgaaggaactgcacggctgcaagcatacgatcattccggacagaattgaagccgggacatttatgattgcaggggctgcaatgggcaaggaagtcattatcgataacgtcatccctactcatcttgagtcgttaacggcaaagctgagagaaatgggctatcatatcgaaacaagcgacgaccagctcctcattgtcggcgggcagaagaacttaaagccggttgacgtcaaaaccctcgtatacccggggtttccgactgatttacagcagccgatgacggcgctcctgacaagggcgaaagggacgagtgtcgtcacagacaccatctactcggcaagattcaagcacattgatgagctgagacgaatgggtgccaatatgaaagtagaaggcagatctgccatcatcacaggtcctgtcgagcttcaaggcgcaaaagtgaaggcgagtgatctgcgtgccggatcctgcttggtggtagccggactgatggctgatggcgtcacggaaattacgggactggagcatattgaccgaggatacagcagccttgagaagaagcttgaggggcttggagcgacaatttggcgtgaaagaatgactgacgaagaaatagaacagcttcaaaattcataa

SEQ ID NO: 47023 - DNA, 858 bp, Bacillus subtilis
atgcctttagtttctatgacggaaatgttgaatacagctaaagaaaaagggtacgctgtaggacaatttaacttaaacaaccttgagtttactcaagcgattttacaagcagctgaagaagaaaaatctccagtgatccttggtgtttccgaaggtgcgggacgctacatgggcggcttcaaaacagtcgttgctatggtaaaagcacttatggaagagtacaaagtgacagttcctgttgcgattcacttagaccacggttcaagctttgaatcttgtgcgaaagcgattcatgcaggtttcacatctgtaatgatcgacgcttctcaccatccatttgaagaaaacgtagcaacaactgctaaagttgttgagcttgctcatttccacggagtatctgtagaagctgagcttggaacagtaggcggacaagaagatgacgttatcgctgaaggcgtaatctacgctgatcctaaagagtgccaagagcttgttgagcgcactggcatcgactgccttgcacctgcattaggttctgttcacggcccttacaaaggtgagccaaaccttggcttcaaagaaatggaagagatcggaaaatcaactggccttccgctagttcttcacggcggtactggaattccgactgctgacatcaaaaaatcaatttcacttggtacagctaaaatcaacgtgaatactgaaaaccaaatttcttctgcaaaagctgttcgcgaaacattggcagctaagcctgacgagtacgatccacgtaaataccttggaccagctcgtgaagcgatcaaagaaacagttatcggtaaaatgcgtgaatttggttcttcaaaccaagcttaa

SEQ ID NO: 47024 - DNA, 1140 bp, Bacillus subtilis
atgaatttttcattatcagaagaacatgagatgatacgaaaattggtgcgcgattttgcgaagcatgaggtggccccgacagcggctgaacgggacgaacaagaacgcttcgatcgcgagctgtttcgggaaatggcaaatctgggcctgacgggaattccatggcctgaagattacggcggaattggaagtgactatttagcctacgtcatcgcggtggaagagctgtcaaaagtgtgcgcctccaccggtgtgacgctttccgcccatatctctctttgcagctggccgctgtttgcctttgggacagaggaacagaagacagagtacttaacacagctggctctcggagagaaaatcggcgcattcgctttgaccgaagcagggtctggctctgacgccggcagcatgaaaacaactgctgaacgaatcggcgatgactatgtgttaaatggttccaaagtgtttatcacaaacggcggcgttgctgatatttacattgtttttgccgtcaccgatcccgagaaaaagaaaaaaggcgttaccgcttttatagtagaaaaggattttgaaggattttttacaggcaagaaagaaaagaagctgggcatccgttcttcaccgacaacggaaatcatgttcgaagattgtgtagtgcccgcatcaaagcgtctcggagaagaaggagaaggcttcaaaatcgcgatgaagacgcttgacggaggcagaaacggcatagctgcacaagctgtaggcatcgcccaaggagcgcttgatgcggcgcttcaatatgcaaaagagcgaaagcaattcggaaaatcgatcgccgagcagcagggcatcgcttttaaactcgcggatatggcgacaatgatagaagcttcaaggctactgacctatcaggctgcatggttagaatcatcgggccttccatatggaaaagcttccgccatgtccaaactgatggctggggatacggcgatgaaggtaacgaccgaagccgtgcagattttcggcggctacggctatacaaaagattatccggtagaacgctatatgcgtgatgcaaaaatcacgcaaatctatgaaggcactcaagaaattcaaagactggtcatctccagaatgctcgcggattaa

SEQ ID NO: 47025 - DNA, 1728 bp, Bacillus subtilis
gtgctgcggcaatttttttcatattataaaccatataaaacgttgttctttctcgactttttctcagcgatcgcgggaggtttaatggagctgagttttcctttgatcgtcaattattttattgataccttgctgccgggcagggactggggactgatcatcgcgacctcaatcgggttatttgcggtgtacgcgctcagctcggctcttcagtatatcgtgacctactggggacacatgcttggtatcaatattgagactgatatgagaaagtcgctttttgaccatttgcaaaagctctcgttcaaattttacgacaacaacaagacgggaacgctgatgtcgaagctcacgaacgatttaatgtatatcggtgaagtcgcccatcacggaccggaagacttattcattgcggtcatgaccattctcggggcgttcggagtgatgctgtttattaactggcagcttgctttattaacgtttatcattatgccgatcgtcatttggctagcgctttatttcaacaaaaaaatgaccaaagcatttaccacgctgaacaaggatatcggagacttcagcgcgcgtgtagaaaataacatcggcggcatccggcttgtgcaggcgttcggaaatgaagcatttgaaaaagaacgcttcgccgtcaacaaccagcgttttcgtgtcacaaagctttcttcctacaaaatcatggcgaaaaacggttcaatcagctatatgctgacccggtttgtcacgctgtttgtccttttgtgcgggacgtggtttgtcattcgcggctccttatcgtacggggaatttgtggcgtttgtactcttgacgaatgtgctgttcaggcctattgacaaaattaatgccattatcgaaatgtatccgagggggatcgcgggtttcaaaagctatatggagctcatggagacagagccggatattcaggactcacctgattcgaaagatgtttccggcctgaagggcaatatccgctataaacatgtttcgtttggctatgatgaccatcacaatgtcctcaatgacatcaacctatccattcaagcgggggaaacggtggcgttcgtcggtccgtcaggtgctgggaaatcaacgctttgcagtctgcttccgcgtttttatgaagcatcggagggcgacattacgattgacggcatcagtataaaagacatgacgctttcttcgttgcgcgggcagattggcgtcgtgcagcaggacgttttcttattctcgggcacgcttagagaaaatatcgcctacggccgactaggcgcatcagaagaagacatttggcaagctgtgaagcaggcgcatctggaagagctcgtccataacatgcccgatgggttggatactatgattggcgaacgcggcgtgaagctttccggcgggcaaaaacagcgtctgtcaattgcaaggatgttcttgaaaaatccgtcgatcttgattctcgacgaagccacctcagcccttgatacagagacggaagcggcgatccaaaaggcgcttcaagagttgtctgaggggcgcacgacgcttgtcatcgcccacaggctggcaacaatcaaagacgcggacagaattgtagtcgtcacaaacaacggtattgaagaacaaggccgtcatcaagacctgatcgaagccggaggcctatacagcaggctgcatcaagcgcaattcgggcaaatggtgcatcgatag

SEQ ID NO: 47026 - DNA, 672 bp, Bacillus subtilis
atgagcgggcagatcctctggggtattatgccatacattgtattgacaatctttatcggcggccatatttaccgctatcagcatgaccaatttggctggacggcgaaatcaagcgagctgttagaaaagaaaaaacttgcggctggcagcacactttttcactggggactgctgtgcgttgtcggcgggcatgtcatggggattctgatcccagaaggcgtgtatgcttcccttggcatttcagagcatatgtatcacaaaatggcgattggcgctggcttgccggcgggcattgcggcatgtaccggacttgtcatcctgacgtacagaaggctgtttgacaaaagaatccgcaaaacgagctcgccatccgatatccttacgctcctcctgctgctgttcatgatgctgtcaggcgttgcggccacgtttctcaacattgattcgaaaggatttgattaccggaccacagtcgggccctggttcagggaaatcgttttgttcaggcctgacgcctctttgatggagagtgtcccgctatggtttaagtttcatattgtgataggatacgtcgtttttatcctgtggccgtttacgagattggttcatgtgttcagtctgccgctcaagtatctgacccgcagctacgttgtatatcggaaacgctcgtga

SEQ ID NO: 47027 - DNA, 555 bp, Bacillus subtilis
atgaacaccacagaccggcaaatcacgttctctgctctttcctgtcttctctcttatccggatgaagagtggagagccgagcttcccgattggaaggctcttatccaagaaatcggcaaccggcaaatccgggagaagctgctgcactttttcgagacgtcagccagctattctccggaagcgctgattgaacactatgtctatacattcgacttcgggaaaaaaacaaatatgtatgtcacctactttaactcaggcgagcaaagggaacgcggcattgaattgctgcatttaaaaaacacatacgagcaatccggtttcctgccgacagagaaagagctgcctgattatctgccgctgatgctggaatttgctgcggctgcagaaattgaagcagcgagaagcgtgtttgagaaatatctgtccaatgtgagggagctggcatcccgtctcgaaaaaaatgacagtatatacgctgaactgctgcacgtgctgctggccgcgcttgaaaacattggcgtacgtgaaagcgttgaaggggctgttcaggcatga

SEQ ID NO: 47028 - DNA, 1464 bp, Bacillus subtilis
ttgaagattaaagcgcaaatcggtatggtcatgaacttggataaatgcatcggctgccacacgtgcagcgtcacctgcaaaaacacgtggacaaaccgttccggtgcggaatatatgtacttcaataatgtagaaacaaagccgggcatcggctacccgaagcaatgggaggaccaggacaaatataaaggcggctggacattgaaaaaaggaaagctcgagctgaaatcgggctcgaaaaccaatcggcttgcaggccttttctataatccgaatcagccgtcaattgatgattactatgaaccttggaactatgattatgaaacattaacgaacagcccgcagaaaaaacaccagccggtagcacgcccgaaatcgtccttgacgggggatttcatgaatatcgaatggggaccgaactgggaggacgatctcgcaggcggccacattacgggacttgaagatcccaacgtacaaaagatggaggaatcgatcaaaacagaattcgatgacgtctttatgatgtatttgccccgtatttgcgagcactgcatcaacccggcatgcgtctcatcctgtccatccggcgccatgtacaaacgcgaggaggacggcattgtgcttgtggatcaaaacgcatgccgttcatggagatattgcgtctcatcctgtccttataaaaaagtctattttaactggcaaacgaacaaagcggaaaaatgcacactctgctttccgcgtttggaggcgggactgccaaccatctgctctgagacgtgtgttggcagaatccgctacctcggcgtcatgctatatgacgcggacaaagtggaggaagcggcatctgttgaaaatgaaaaggatctctaccattcccaattggacgtttttcttgatccgaatgatcctgaggttgccaaactggcaaaagaacaaggcattccggctgaatggatagaggccgcgcagcaatcaccgatctataaaatgatcattgactggaagatcgcgctgccgcttcatcctgagtaccgcacgctgccaatggtgtggtacattccgccgctcagcccgattatgaatctctttgaaggaaaaggcagccggcaaacggcggaagatatttttccggctatcgaccaaatgagaatcccgatagattatttggcgcagctgttaacagccggtgatacggatcatattcggtcaacattaaagaaaatgtctgtcatgcgccagtatatgagagcggtccagacgaataaatcaatcgatccggaactgatctccagtgtcggcttaacagaacagcaaattgaagatatgtatcggctgcttgcgattgccaaatatgatgaccgctttgtgattccgagcagccatcgagaagaagtatcagatttatacgctgaacaaggaagctgcggcttatcattttcaggcggccccggctcctgtttctaa

SEQ ID NO: 47029 - DNA, 3687 bp, Bacillus subtilis
atgaagaaaaagaaaaggagtccgttgtttaggagattgaattatttctctcctatcgaacaccattcaaataaacatagccaaactacccgcgaggatcgcgattgggagaatgtatacagaaacagatggcagtacacgaaagtcgttcgctccacccacggcgtcaactgtacagggtcttgcagctggaatatttatgtgaaaaacggaatagtcacgtgggaagggcaaaatttgaattatccatcaacaggcccggatatgcctgattttgaaccgagaggctgcccgcggggggccagtttttcatggtatatctacagcccgctccgtgtgaaatatccatacgtgcgcggtgtgctgatcaatttgtggcgggaggcattgcagacgcatcaaaatccattggaagcctggaaatcgatcgtcgaaaaccctgaaaaagcgaagtcctataaacaggcgagagggaaaggcggttttgtgcgcgctgaatggccggaggtgctgaagctgatttcagcctctctgctgtatacagtgatgaaatacgggcctgaccgaaacgtcggtttttctccgattccggccatgtccatgatcagccacgcatcaggctcccggtttatgtcgttaatcggaggccctatgctcagtttttatgactggtatgcggatcttcctccagcatccccgcaaatttggggtgaccagacggacgttccggaaagcagtgattggtacaattccggctatattatcacatggggctccaacgttccgttaacgagaacgcctgacgcgcattttttggcggaggcccgctataaaggcgctaaggtcatttcgatcagtccagattttgcggaatcctcaaagttcgcggatgactggctgagtattcgccaagggactgacggggcgcttgcgatggcgatgggtcacgttattctgcaggaattttacgtgaaccaagaaactgaacgttttattgagtacgcgaagcaatacactgattttccatttctcgtcactctgtcaaaagaaaatggcgtatacacagcgggacggtttctgcatgcgaaggacatcgggcggaagacaaagcatgatcagtggaagcctgcggtttgggatgaacagacaagttcatttgccataccccaagggacaatgggctcgcgctgggacgggcagcagaaatggaacctgcacatgattgatgaagaaaccggggaaccgattgaaccccgtctctctgtgctgggaatagaggacgaaatcggcacggtgcgcatcccgtatttttcaaatgacggaaacaaagtgctcgagcgggatcttcctattaaaaaaatgaacctgaacggtgaagaaacgtacatcacgaccgtgtttgacttgatactggctaactacggcgtgaaccggggcatcggcgaacgatcggctgtctcctatgatgaccctgagccgtttacgcctgcctggcaggaacaaatgacaggaatcaaaaaagaagctgtcgttaagattgccagagagtttgcccaaaatgcgatcgatacagacggccggtccatgattatcgtaggggccggcattaaccactggttcaactccgacacgatctaccgagcagtgttaaatcttgttttacttgtaggcgcccaaggcgtaaacggcggaggctgggcccattacgtggggcaggaaaagctccgacctgctgaagggtggcagacgattgcaactgcaaaggactgggaaggcgtgcccaagctgcaaaatggcacctcatttttctactttgcgacagatcagtggcgttatgaggaccagccgatcagtgatttggcatcaccgattgctgcttcatcccgctacaagcaccacgctgattacaatgtgctggcggcgcggctagggtggcttccgtcttacccgactttcaatcaaaatggcatcgatctgtataaagaagctgaaaaagcaggggcagcaacacctgaagacgtaggtgcgtacgtggcctcacagctccaagagaaaaaactgaaattcgcgattgaagatcctgacaatgaagtgaatttcccaaggaatctctttgtatggcgggcaaatctgatctcaagctcaggaaaagggcatgaatattttctcaagcatttgctggggacaacgaacggtttaatgaatgacgacagcgacagcatccgcccagaagaaatcaaatggcgggagcaggcgccggaaggaaagctcgacttattaatcaatcttgattttcgaatggcgggtacggcgctgtattccgatatcgtgctgccggcggcgacatggtatgaaaaacacgatctcagcagcacagatatgcatccgttcattcatccatttgctcctgcgatctcggctccgtgggaatcgaagtcagactgggatattttcaaggcgctgtcaaaagccgtttccgatctggcagaagaagtcgatatggagccggtgaaagaagtggttgcgacaccgctgctccacgacaccatgcaggaattggcccagccattcggcaaaatcaatgactggagcaaaggcgaatgtgaagccattccgggaaaaacgatgccgaacatccaagtcgttgaacgggattacaaacacatttttcataaaatgactgcacttggtccgaacgttgctttaaagccgagcggaacaaaagggatgagctggtcaatagccgatgaatatgaatcactcaaacagagactgggagaaatcacctcggacagcgtggcaaagggatgtccaaatataagtgaagcaaagcaggctgcagaagcgattttaaccctatcatccacttcgaatggaaaggtcgcagtaaaagcatgggaatcacttgaaaacatcacgaacctgaagctgaaagacctggcggaagaacgcgaggaagaatgctttacgttcgaacaaattacagcccagccgaaaacggtgatcacgtctccagcgtttaccggctctgaaaaaggagggcgcaggtattcgccgtttacaacgaatgttgaaaaattaattccgtggcggacgctgacaggcagacaatcctattatgtcgatcatgaactgatgatggaattcggtgaaacgatggcgacattcaaaccgatcctccagcatcgcccgtttctgagcaaacggcctgatcaagagggaaaagaaatcgtcctcaattatttgacgccgcataataaatggtctgtccacagcatgtattttgattctctgccgatgctgacgctgttccgcggcgggccgaccgtgtggatgaataaagatgatgcagaggacacggatatcaaagacaacgattggattgaatgcttcaaccgaaacggcgttgtcgtcgcgagagccgttttgtctcatcggattcctaaaggaatggcgtttatgcaccatgcccaggaccgccacatcaacgtgcccggcacaaagctgacgaataaccgcggaggcacccataacagcccgacaaggattcacgtcaagccgacacagatgatcggtggctacgcccagctcagctacggctttaattattacggtccaacggggaatcagcgcgacctgaacgtcgtcatccgcaagctgaaggaggtcgattggcttgaagattaa

SEQ ID NO: 47030 - DNA, 720 bp, Bacillus subtilis
atgagcattttggatatacacgatgtatccgtttggtatgaacgggacaacgtcatcttagaacaagtggatttacatttagaaaaaggcgccgtttacgggttacttggggtaaacggcgccggaaaaacgacactgattaatacgctgacaggcgtgaaccgcaatttcagcgggcgttttacactgtgcggaattgaagcggaggccggcatgccgcagaaaacatcagatcagctgaagactcaccgttacttcgccgccgattatccgctgctatttacagaaattacggcgaaggactatgtgtctttcgtccattcgctttatcaaaaggatttttcagagcagcagtttgccagtttggccgaggcctttcatttttcgaaatacatcaataggagaatttcggagctgtccttggggaacaggcaaaaggttgtattgatgacaggcttattgctgcgcgctcccctgtttattttggatgagccgctcgtcggtttggatgtggaatcgatagaggtcttttatcagaaaatgcgtgagtactgtgaagcaggcggaaccattttgttttcttctcatctgctcgatgtcgtgcaaagattttgtgattatgcggctattcttcacaacaaacagatccaaaaggtcattccgattggagaggagaccgatctgcggcgggaatttttcgaggtgatcggccatgaataa

SEQ ID NO: 47031 - DNA, 873 bp, Bacillus subtilis
atgagatttgatgaagcttattcaggaaaagtatttatcgcgagccgtcccgagtgggaagaggcggacgccattctttacggcatgccgatggactggacagtcagctatcgcccgggctcacgctttggtccaagcagaatccgtgaggtgtcaatcggccttgaggaatacagcccatatttagaccgcgatctggctgacttgaacttctttgacgctggcgacattccgctgccgttcggaaatccgcagcgaagcctggatatgattgaagagtacgtggacagcattttagaaaaagggaagttcccaatgggtatgggcggggagcacctcgtgtcatggcctgtcattaaagcgatgtacaagaaatacccagaccttgcgattatccattttgacgcacatacagatcttcgtgttgattatgagggagaaccgctttctcactccacgccgatccgtaaggcggcagaattgatcggaccgcacaatgtgtattcattcggaatccgttccggcatgaaagaagagtttgaatgggcgaaggaaaacggcatgcacatctcaaaatttgaagtgcttgaaccgctgaaagaggtgcttccgaagctggcgggccgtccggtttatgtcacaattgacattgacgtattagaccctgcacacgcaccgggtacaggaacggttgacgccggcggcatcacgtctaaagaactgcttgcatcggtccatgaaattgcgcgttcagaggtaaacgtaaagggcgctgatttagtggaagtcgcgccggtatacgaccactcagagcaaacggcaaacacagccagcaaaatcatccgtgaaatgctgcttgggtttgtgaaataa

SEQ ID NO: 47032 - DNA, 780 bp, Bacillus subtilis
ttgtcaaaacgaaccgcatttgttatgggagccagtcaagggatcgggaaagcaatcgctctgaaattagcagaccagcacttttccctcgtcattaattcgcgaaatttggataatattgaatctgtcaaagaagacattttggccaagcatcctgaggcgagcgtcattgtccttgcgggcgatatgtctgaccagcatacgagagcgggcatttttcagaaaatcgaatctcaatgcggacggcttgatgttctgattaataatatcccgggcggcgcgcctgacacatttgataactgcaatatagaggatatgacggccacgttcactcaaaagaccgttgcctatattgacgcaatcaagcgtgcttcctcactgatgaaacaaaacgagtttggcagaatcatcaacattgtcggaaatctgtggaaagaacccggcgccaacatgttcacaaacagtatgatgaatgccgctttaattaacgccagtaaaaatatttccatccagcttgctcctcacaacattactgtcaactgtctgaatcctggttttatcgctacagaccgttatcatcaatttgtggaaaatgtgatgaaaaagaacagcatatccaaacagaaagcagaagaacagattgcttccgggattccgatgaaacgggtcggatcagccgaagaaaccgcagcgctcgccgcatttcttgcctctgaggaagcctcctacatcacgggacagcaaatttccgctgacggcggcagcatgaaaagcatataa

SEQ ID NO: 47033 - DNA, 1200 bp, Bacillus subtilis
atggaaataacaccgtccgatgtcatcaagacacttccaaggcaggagttttctctcgtttttcaaaaggtaaaggaaatggaaaaaacgggagcccatatcattaatctcggacaggggaaccctgaccttcccactccgccgcatattgtcgaggctttgcgggaggcttctctgaatccttcgtttcatggatacggccctttcaggggctatccttttttaaaggaagcgatcgccgctttctataaaagggaatacggagtgacaatcaatcctgaaacggaagtcgcgcttttcggaggcgggaaagccggattgtatgtgctgacacaatgcctgctcaatccgggagacatcgctttagtcccgaatccaggctatcctgaatatttatcagggattacgatggcgcgagctgagctttacgaaatgccgctgtatgaagaaaatggctatctgccggattttgaaaagattgatccagccgtgctggaaaaagcgaagcttatgtttttaaactatccgaacaaccccactggagctgtggctgatgcggctttttatgcaaaagctgctgcttttgcgaaagagcataacatccatttgattcatgattttgcatacggggcgtttgaattcgatcaaaaaccggccagctttcttgaggcagaggatgccaaaactgtcggagcagagctttattcattttcaaaaacatttaacatggccggctggagaatggcgtttgcggttgggaacgaaaaaatcattcaggccgtcaatgaatttcaggatcatgtatttgtcggcatgttcggcgggctgcagcaggcagcgagtgcggcgctttctggagatccggagcatacggaatcgttgaaacgaatttataaggaacgaattgacttttttacggcgctttgtgaaaaggaactgggctggaagatggaaaagccaaaaggaaccttttacgtatgggctgaaattccgaatacgtttgagacatctcaccaattttccgattacttgctggagcatgcccatgtcgtagtcacaccgggcgaaatttttggaagcaacggaaaaaggcatgtcagaatctcaatggtgtcgaagcaggaggatctgcgggaatttgtcacgcggattcaaaagctgaacctgccgttcgggtcattacaagaaacatcccgctaa

SEQ ID NO: 47034 - DNA, 768 bp, Bacillus subtilis
atgatcatgaacctcaccgataaaaccgtcctcatcacaggaggcgcatcaggcattggttatgctgcggttcaggcttttttgggccagcaggccaatgtggttgtggcggatattgatgaagcgcaaggagaagcaatggtacgaaaagaaaataatgacaggctgcactttgtgcaaacggacatcacagacgaagctgcctgccagcacgcagttgaatcggcggttcatacatttggcgggctcgatgtcttgattaataatgcaggcatcgaaatcgtggcgcctattcacgagatggagctcagcgattggaacaaggtgctgcaagtcaatttgaccggcatgtttttaatgagcaaacatgcactcaagcatatgctggccgccggcaagggcaacatcattaatacgtgctctgtcggcggactcgtggcatggcctgatattcctgcttataacgccagcaaaggcggggttttgcagctgactaaatcaatggccgttgattatgcgaaacatcaaattcgggtgaactgcgtatgcccggggatcatcgacacaccgctgaatgaaaaatcattccttgaaaataatgaaggcacacttgaagagattaaaaaagaaaaagcgaaggtaaatccgctgctgaggcttgggaaacctgaagaaatcgcaaatgtgatgctgtttttagcctcggatttatcaagctatatgaccggaagcgccatcaccgcagacggaggatacaccgcacaatag

SEQ ID NO: 47035 - DNA, 1413 bp, Bacillus subtilis
atgcagaatcataaaaatgaattgcagcgcagcatgaaaagcaggcatttgtttatgattgctttgggaggggtgattggcactgggctgtttctaggctctggctttaccattagccaggcgggaccgctcggcgccattgccgcgtatatcatcggcggatttttaatgtatctcgtcatgctttgtttaggagaattggctgttgccatgccggtggccggatcgtttcaggcctacgccactaaatttctgggacagtcgacaggctttatgattggctggctgtattggttcagctgggccaatacagtagggttagagctgacgtcagcaggcattttgatgcaaaggtggctgccctccgttccgatctggatatggtgcctcgtgttcggcatcgtcatctttttgattaatgcgctctctgtcagaagctttgcggaaatggaattttggttttcaagcatcaaagtggcggcgatcatattatttattgtgattggcggagccgctgtgtttggcttgattgactttaaaggcggacaggagacaccctttttgtctaactttatgactgatagagggcttttccctaatggggtgctggccgttatgtttacgctggtcatggtaaacttctcgttccagggaacggagcttgtcggcattgcggcaggggaaagtgaaagcccggaaaaaacactgccaaagtccattcgaaatgttatttggcgcacgctgtttttctttgtgctcgctatgttcgtcttggttgccatccttccgtacaaaacggcgggggtgattgaaagcccgtttgtagcagtactcgatcaaatcggcatcccattttcggcagatatcatgaactttgtcatcttaacggccattttatctgttgctaattcgggattgtatgcggcgtcgcgtatgatgtggtcactttcatcaaatcaaatgggtccctcctttctcaccagactgacaaaaaaaggcgtgccgatgaatgccctgctgattacgctaggcatttcaggctgttcgctgctgacaagtgtcatggctgcagaaacagtgtatttatggtgtatctcaatctcgggcatggtgacagttgtcgcgtggatgtccatttgtgcgtcgcaatttttctttcgcaggcgtttcctggcagaaggcggaaatgtgaatgatctggagttcagaacgccgctttatccgctagtcccgattctcggattttgtttatatggctgcgtgttgatcagccttattttcattccggatcaaagaattggcttatactgcggtgtgccgatcattattttctgttatgcatactatcatctaagcatcaaaaagcgtataaatcatgaaacgattgaaaaaaagcagacagaggcgcaatag

SEQ ID NO: 47036 - DNA, 1548 bp, Bacillus subtilis
atgacagtcacatacgcgcacgaaccatttaccgattttacggaagcaaagaataaaactgcatttggggagtcattggcctttgtaaacactcagctcggcaagcattatccgcttgtcataaatggagaaaaaattgaaacggaccgcaaaatcatttctattaacccggcaaataaagaagagatcattgggtacgcgtctacagcggatcaagagcttgctgaaaaagcgatgcaagccgcattgcaggcatttgattcctggaaaaaacaaagaccggagcaccgcgcaaatattctctttaaggcagcggctattttgcgcagaagaaagcatgaattttcaagctatcttgtgaaggaagcaggaaaaccgtggaaggaagcagatgcggacacggctgaagcgatagactttttagagttctacgcgcgccaaatgttaaagctcaaggaaggggctccggtgaagagccgtgctggcgaggtcaatcaatatcattacgaagcgcttggcgtcggcatcgtcatttctccatttaacttcccgctcgcgattatggcgggaacagcggtggcagcgattgtgacaggaaatacgattctcttaaaaccggctgacgcagccccggtagtggcagcaaaatttgtcgaggtcatggaggaagcgggtctgccaaacggcgttctgaattacattccgggagatggtgcggagatcggtgatttcttagttgagcatccgaagacacggtttgtctcatttacaggttcccgtgcagtcggctgccggatttatgagcgagctgccaaagtgcagccgggccaaaaatggctcaaacgggtaattgcagaaatgggcggaaaagacacagtgcttgtcgacaaggacgctgatcttgaccttgctgcatcctctatcgtgtattcagcatttggatattcaggacagaagtgttctgcgggctcccgcgcggtcattcatcaggatgtgtatgatgaagtggtggaaaaagctgtggcgctgaccaaaacgctgactgtcggcaatccagaagatcctgatacgtatatgggtcccgtgattcatgaagcatcctacaacaaagtgatgaaatacattgaaatcggcaaatctgaaggcaagctattggccggcggagaaggcgatgattcaaaaggctactttattcagccgacgatctttgcagatgttgatgaaaacgcccgcttgatgcaggaagaaattttcggcccggttgttgcgatttgcaaagcgcgtgatttcgatcatatgctggagattgccaataacacggaatacggattaacaggtgcgcttctgacgaaaaaccgtgcgcacattgaacgggcgcgcgaggatttccatgtcggaaacctatattttaacagaggatgtaccggagcaattgtcggctatcagccgttcggcggttttaatatgtcaggaacagactcaaaagcaggcggtcccgattacttaattcttcatatgcaagccaaaacaacgtccgaagctttttga

SEQ ID NO: 47037 - DNA, 1275 bp, Bacillus subtilis
atgtcagcaaagcaagtctcgaaagatgaagaaaaagaagctcttaacttatttctgtctacccaaacaatcattaaggaagcccttcggaagctgggttatccgggagatatgtatgaactcatgaaagagccgcagagaatgctcactgtccgcattccggtcaaaatggacaatgggagcgtcaaagtgttcacaggctaccggtcacagcacaatgatgctgtcggtccgacaaaggggggcgttcgcttccatccagaagttaatgaagaggaagtaaaggcattatccatttggatgacgctcaaatgcgggattgccaatcttccttacggcggcgggaagggcggtattatttgtgatccgcggacaatgtcatttggagaactggaaaggctgagcagggggtatgtccgtgccatcagccagatcgtcggtccgacaaaggatattccagctcccgatgtgtacaccaattcgcagattatggcgtggatgatggatgagtacagccggctgcgggaattcgattctccgggctttattacaggtaaaccgcttgttttgggaggatcgcaaggacgggaaacagcgacggcacagggcgtcacgatttgtattgaagaggcggtgaagaaaaaagggatcaagctgcaaaacgcgcgcatcatcatacagggctttggaaacgcgggtagcttcctggccaaattcatgcacgatgcgggcgcgaaggtgatcgggatttctgatgccaatggcgggctctacaacccagacggccttgatatcccttatttgctcgataaacgggacagctttggtatggtcaccaatttatttactgacgtcatcacaaatgaggagctgcttgaaaaggattgcgatattttagtgcctgccgcgatctccaatcaaatcacagccaaaaacgcacataacattcaggcgtcaatcgtcgttgaacgggcgaacggcccgacaaccattgatgccactaagatcctgaatgaaagaggcgtgctgcttgtgccggatatcctagcgagtgccggcggcgtcacggtttcttattttgaatgggtgcaaaacaaccaaggatattattggtcggaagaagaggttgcagaaaaactgagaagcgtcatggtcagctcgttcgaaacaatttatcaaacagcggcaacacataaagtggatatgcgtttggcggcttacatgacgggcatcagaaaatcggcagaagcatcgcgtttccgcggatgggtctaa

SEQ ID NO: 47038 - DNA, 741 bp, Bacillus subtilis
gtgaaaggtgttattttagccggaggaaacggctcacgccttatgcccttaacgaaagccgtcaacaagcatttgcttcctgtaggcccgtatccgatgatatactggtcgattatgaagctgcaggaagccggaataaaagacattttactcatcagccaaaaggagcatatgccgcaattttacaaactgcttgggaacggggaagagcttggcgttactatcacttatcaagtacagccggcagcatcgggcatttcggatgggctgtcttatgcaaagcgctttacgaaaaaagagtctttcattttattattaggtgataatatatttgaagattcattaaagccttatacagaacgctttgaacagcaggggaaaggagcaaaagtgcttctgaaagaagttgatgacccggaacgtttcgggattgctgagattgatgagaaaaacaagcggattcgttccatcatcgaaaagcccgaacagccaccgaccaacctttgtgttaccggcatttatatgtatgatgcagaggtgttttcatatattgaacaaatatcaccatcaaagcgcggcgagctggaaatcaccgatgtgaataatctatacatcgaaaacagccagcttacgtatgatgtgttatcaggctggtgggtagatgccggaactcacgaatcgctttatctcgcttcccagcttgtacaccaggctttacggaaaggacaggacgaaaagtga

SEQ ID NO: 47039 - DNA, 1374 bp, Bacillus subtilis
atgaacagcagcatcccctctatcatcagcaagcataaagcctattttgcggcgggacatacgagaccgcttgaatcgagactgaacattttgcgaaagctgaaacaagccgtcagaactcatgaagccgatctcatagccgctctctaccaggatctccataaatccgagcaagaagcatactcaacagaaatcggaatcgtcttggaggaaatcagctttgtcatgaaacggctgagaaaatggtccaagccgaaacgagtcaaaacgccgttgactcatctaggctccaaaagcatcatcatccctgagccgtatggaaccgttttggtgattgcgccttggaactatcccttgcagctggcgctttctccgttgattggcgccattgcggcggggaacacggtcgttctcaagccatcagaatatacgccggctgtttctgctattctttccaaactcatcagcagcgtttttccaactgattatgtcgctatggcagaaggcgggcccgatgtcagcacagcattattacagcagccctttgactacattttctttaccggcagtgtagctgtaggaaaaatcgtcatggaggccgccgccaaacaattaattcccgtaaccttggagctcggcggcaaaagtccctgcatcgtccataaagatgctgacattcagcttgccgccaaacgcatcgtcttcgggaaatttacaaatgcgggacaaacctgcatcgcaccggattatttatttgtccacgaggacatcaaaacgaagctcacagaagaaatgaagcgtgcgatcagagaattttacggccctcagccggaacggaatccacagtacggcaaaatcgtcagtgagcgccactatcagcggctgctcagctttctgaatgatggcatcccgctcacaggcggacaatctgatcccaatcatcacaaaattgcgccgaccattctcgaacaagtgagagatgactctccagtgatgcaggaggagattttcgggccgattcttccgctctttacataccgcaatatcggggaagtcattgagaaagtccaatcgcgccctaagccgctcgccctgtatctcttcaccacaaacaaagaaattgagcgcgctgttttaggaaatctgtcgtttggcgggggctgtgtcaatgatacgttaatgcatgttgcgacgccgtatttgccattcggcggcgtcggggaaagcggcatcggcagctatcacgggtttgacagttttaacacattcacgcacaaaaaaagcgtcgtcaaacaaacgaaccgtttcgacttcgcatttcgttatccttcctccaaaaacgggctgcgaatgattcgaaaaatactcaaataa

SEQ ID NO: 47040 - DNA, 678 bp, Bacillus subtilis
ttgaaacagcttttacaagacagctggtggaatcagctaaaggaagagtttgagaaaccgtattatcaagagctcagagagatgctgaagagggaatacgcggagcaaacgatttatccggacagccgggatattttcaacgcgctgcattatacatcatatgatgatgtcaaggtcgtcattttgggtcaagatccgtatcacgggccgggacaggctcaaggtttaagcttctctgtcaagcccggtgtaaagcagccgccttcgttaaaaaatatctttcttgagctgcagcaggacatcgggtgcagcatcccgaatcacgggtcgcttgtgagctgggcaaagcaaggcgttcttttgctgaatactgtgctgacagtaaggcgcggacaggcgaattcccataagggaaaaggctgggagcgactgacggaccgaattattgacgtgctgagtgaaagagagcggccggttatctttattttgtggggacggcatgctcaaatgaaaaaagaacggatcgacacctccaagcattttatcattgaatcgacgcatcccagcccgttttctgcgagaaacggatttttcgggagcagaccgttttcccgggcgaatgcctatttggagaaaatgggagaggcgccgattgattggtgtattaaggatttgtaa

SEQ ID NO: 47041 - DNA, 1443 bp, Bacillus subtilis
atgacagcacatgaccaggagcttcgtcgccgggcttatgaagaagtggagaaaaaagagcccatcgctaacagcgatccgcaccgccagcattttcatatcatgccgccggttgggctgctgaatgacccgaatggcgtgatttattggaagggcagctatcatgtattctttcagtggcagccgtttcagacggggcacggcgcaaaattttgggggcattatacgacacaggatgttgtgaattggaagcgggaagagattgcgctggctccgagtgattggtttgataaaaacggctgctactcgggcagcgctgtcacgaaagacgatcggctctatcttttttacacaggaaatgtcagggatcaggatggaaatcgggaaacgtatcaatgccttgctgtttctgacgacgggctgtcctttgagaaaaagggtgtcgtcgcccgccttccggaagcgatattaacggcgcacttttcgcgatccgaagtatgggagcatgaaggcacatggtatatggtgattggtgcgcaaacagagaatttgaaagggcaggctgtgttgtttgcttctgataacctgacagagtggagatttcttggcccgataaccggcgcgggcttcaacgggctggacgattttggatacatgtgggaatgccctgatttgttttcccttcaaggatcggatgtgctgattgtttcgcctcaagggcttgaggctgacggtttccgttatcagaacgtatatcaatcaggttattttgtcggccgcctcgattataacaagcctgaactgaagcatggtgaatttacggagcttgatcaaggttttgatttttacgcgccgcaaacacttgaagacgatcagggaaggcggattttatttgcatggatggcggtgcctgatcaggatgaagggtcccatccgaccattgactgccactggattcactgcatgacgctgccgagacagctgacgctttcaggacagaagctgattcagcagccgctgcctgagctaaaagccatgcgcagaaatgagaaaaaaatacacatcaacatgcatggatcatctggtgcgcttccagtggaaaaacctgaaagaactgagattctactggaagacattcatacggagtctggcttttcaatcagtatccgcggaacggctacgttttccttccataaagacgaggggattgttacgctggaacgaaagagctttgacggaaaaagaacagaagcgagacattgccgcatcaaggatttgcataccgtacacatgtttctcgacgcgtcatctgtggaaatctttatcaataacggagaagaggtctttagtgcaagatattttcctttcccgggaaatcatgaagtaacagccagtgcgaccgggaaatctgaaatgaatgtcggaatttggacacttatgtag

SEQ ID NO: 47042 - DNA, 1173 bp, Bacillus subtilis
atgcgggaagagctaaaggggatatttgcaagtgtattcggagaaaaagaggggttacggttttttttcgcacctggaagagtgaatctgattggagaacatacagactataacggcgggcatgtctttccgtgcgcgctgacaatgggtacatatgctgctgttgcagaaagaaacgacgggcttgtccggatgtattcagataactttagaaacgcaggcatcaaggaatgcagccttgacgacattcgctatcaaaaagaagacgactgggcgaactacccaaaaggcgtgatttatgaatttcaacagaggggatatgcagttccccatggctttgacattgtattttcagggaatattccaaacggggcgggactgtcgtcttccgcttctattgaactgctgatgggggtcgtgctccaaagttattttcatcctgaagtagatgcgcttgagcttgtgaaaatggcgcagcatgcggaaaaccattttatcggcgtcaattgcggaattatggaccaatttgcaattggaatggggaaaaaacatcatgcgatgctgctgaactgtgacacgcttgactatgaatatagcaaactcaatgtctcaggcctcgcgctggtcatcgcgaacacgaacaaaaaaaggacattggctgactccagctataatacgagacgccaagaatgcaatgatgcattgcttgatctgaaaaaaggcctcgatattgccgcactgggcgacatcaagccttctgatttcgatgcgcattccagcctgatccaaaatgaaacgaacagacgccgggcaaagcacgctgtatacgaaaatcatcgtgctattaagacggcccatatgttcaaagagaacaatatagatgaaatcgggcagttaatgaaggaatcccacctttcattgaaggatgactatgaagtaacatgccctgaacttgatgagcttgtgtttgcggcatgggatcacgaaggtgtaattggatcaagaatgacgggagcaggctttggcggctgcaccatcagcattgtaaaagatgagttcgttgatgattttattcagaaggttggagacagatatcaagaaaaaacagggctccgagcggacttttatgtcgcggatatcggagagggagcgagagaactaaagggggagtga

SEQ ID NO: 47043 - DNA, 1329 bp, Bacillus subtilis
atgacaaaaggattgaagattgtaacgattggcggaggttcaagctatacgcccgagctagtggaggggttcattaaacggtatgatgagctgcctgtccgtgaattatggcttgtcgatatccccgagggcgaagaaaagctgaatattgtcggcacactcgccaaacggatggttgaaaaagctggcgtcccgattgacattcatcttacgctcgaccggagaaaggcgctgaaagacgcagactttgtcacgacccaattccgcgtcggacttttgcaggcaagagcaaaggatgagcgcattccgctaaaatacggagtgataggccaggaaacaaacggcccgggaggtctgtttaaaggattgcgcacaattccggtcatccttgagatcgcaaaggacatagaagagctttgcccgaacgcttggcttgttaacttcacaaaccctgccggcatggtaacagaagccttgcttcgctactccaacctgaagaaagtcgtcggtctttgcaatgttccaatcggcatcaaaatgggcgtagccaaagcgcttgatgtagatgtggaccgcgtagaagtccaatttgccggactgaaccatatggtattcgggctggatgttttcttggacggcgtaagtgtgaaggagcaagtcatcgaggcgatgggcgacccgaaaaacgcgatgacgatgaaaaatatctcaggcgccgaatgggaaccggatttcttaaaagcgctcaatgtcatcccttgcggctatcaccgttactattttaaaacaaaagagatgctggagcacgaactggaagcatcacaaacggagggcacccgcgctgaagtcgtacagaaggtcgaaaaagagctgttcgagctttataaagatccaaaccttgcgatcaaaccgccgcagctggaaaaacggggcggagcttactacagtgatgcagcatgtaacttaatcagctccatttataatgataaacatgacattcagccggtgaacacgatcaataatggtgcaatagcgagtattccagacgattccgcagttgaagtgaactgtgtgatgacgaaaaccggccctaagccaattgctgtcggcgacttgccggtgtctgtccgcggccttgtccagcaaatcaaatcctttgaacgtgtcgcggcagaagcggcagttacaggtgactatcaaactgcgctccttgccatgacgattaacccgcttgtcccgtccgatactgtggccaaacagattttagacgaaatgctagaggcgcacaaagcgtatctgccgcagtttttcaacaaaattgaagcgtaa

SEQ ID NO: 47044 - DNA, 591 bp, Bacillus subtilis
gtgacgagagaaaaaaatccgctgcccatcacgttttatcaaaaaaccgctcttgagcttgccccatcgcttctgggctgccttcttgtaaaagaaacagacgaaggcacagcgtcaggctatattgtggaaacagaggcctatatgggggctggagacagagcggcccacagctttaacaaccgccggacgaagcggactgagatcatgtttgcagaagctgggcgggtatatacatacgtgatgcacacccatacattgctgaatgtcgttgcggcggaagaggatgtcccgcaagcagtattaatcagggcgattgagccgcatgaaggccagctgttaatggaggagagaaggccgggcaggagtccgagggaatggacaaacggaccaggaaagctgacgaaagcgcttggcgtcacgatgaatgactacggacgctggatcacggaacagccgctttacatcgaaagcgggtacacaccggaagcaatttcaaccggcccgcgcatcggcattgacaacagcggggaggcacgcgattatccatggcgtttctgggtgacgggaaacaggtacgtgtcgcgttag

SEQ ID NO: 47045 - DNA, 1644 bp, Bacillus subtilis
ttgaaagatgatcatcaaaacaagcagcaccaatcaaatgcccaagggagcgaggaagcgttttctcataagacatccgggaaaaacgagtcagaggataccttaacgaataggcaggggcatcctgttactgacaaccagaatgtgagaaccgtcgggaatagagggcctacaacacttgagaactatgattttctcgaaaagatcagccacttcgaccgggaacgcatcccagagcgggttgttcatgccaggggagcaggtgcacatggatattttgaagcgtacggaagcttcggagacgaaccgatttcaacatacacaagggccaagctctttcaggaaaaaggcaagaaaacaccggcatttgtccgtttttcaactgtgaatcatggaaaacactcgcctgaaacattgagagacccgcgcggttttgctgtaaagctatatacagaagacggaaactgggatttggtcggaaacaacctgaaaatcttttttatccgcgacccgctgaaatttccggatcttgtacacgcatttcagcctgatccagtgacaaacatccaggatggtgaacgtatcttcgatttcatttctcaatctcctgaagcgacacacatgatcaccttcttgttttcgccttggggcattccggccaactaccggcaaatgcagggttcaggcgtacatgcctataaatgggtgaatgaggagggcaaggccgttctcgtgaaataccattttgaaccgaagcagggcatccgcaacctgacacagaaggaagcagaagagattcaagggaaaaactttaaccatgccacacaggatctatatgacgcgattgaaaatggcgattatccagagtgggaagtatatgctcaaatcatgagcgatgatgagcatcctgaactggactttgatcctcttgatccaacaaaactgtggtataaagacgatttcccatggaaaccgatcggcaaattggttctgaacaaaaatccggaaaactaccatgcggaagtggagcaagcttcatttggaacgggagtgcttgtcgacgggcttgatttttcagacgacaaattgctccaggggcgtacgtttgcctactctgatacgcagcgctaccgtgtaggcgcaaattacctgcagcttccgatcaactcgccgaaaaagcatgtcgccaccaaccaggaaggcgggcaaatgcaatatcgggtcgatagagcagaaggacaaaacccgcacgtcaactacgagccatccattatgggcgggctgaaggaagcgaagcaagacggaaaagaccatacgccgcatgtcgaaggtgatgtaaagcgtgaagcgattgacagaacaaacaacttcggacaggctggagaaacgtaccggagatttactgaatttgagcggaacgaattgattacgaatttggtgaatacgctttctacgtgccgaaaagaaattcaggatcaaatgattgagaatttcacaaaagctgatcctgactacggaaaacgcgtagcagaagggctaaaaaaggtctccgaaaacaacagcaacgggccgatcggcacaactgaaacggaacaggctgcaaagcaggctgaacaggagagtcatccgtctgatccgtattaa

SEQ ID NO: 47046 - DNA, 888 bp, Bacillus subtilis
atgctgtctattgaatcattatgcaaatcgtacaggcaccatgaagctgtaaagaatgtcagttttcacgtgaatgaaaatgagtgtgtcgcactattaggacctaatggagccggcaaaaccacgactctgcaaatgctggccggactgctttcgccaacctctggaaccataaagctgttaggagagaaaaagctggatcggcgtttgattgggtacctcccgcagtatcctgctttttattcgtggatgaccgcaaatgaatttttgacatttgcggggagactgtccggcctttcgaagagaaaatgccaagagaaaatcggcgagatgctggaatttgtcggtttgcacgaagcggcgcacaaaaggatcgggggctattcaggaggcatgaaacaaagactcggtctggcacaggcactgctccataaaccgaagtttttgatattggatgaaccggtgtctgcgcttgatccgacaggacggttcgaggtgctggacatgatgcgggagctgaaaaagcatatggccgttctgttttctacacatgttttgcacgatgcagaacaggtgtgtgatcaagtggtgattatgaaaaacggtgagatttcatggaaaggcgagttacaggagctgaaacaacagcagcaaacgaacgtttttaccctttcagtgaaagagaagctggaaggttggcttgaagagaagccttacgtctcagctattgtctataagaatccgtcccaagcggttttcgagctgcctgatatacacgctggccggtcattattaagtgactgtatccgaaagggattgaccgtcacccgctttgaacagaaaacggagtctctagaagacgtctatctaaaggtggtgcacgcatga

SEQ ID NO: 47047 - DNA, 1728 bp, Bacillus subtilis
atgaagaaagaagaatggattttgccgtatatcaagcaaaatgcccgcctgttcgttctggttatctttttgggtgcggtgacgattttttctgctgcttttctcatgttcacctcaggttttttgatttctaaagcggcgacaaggccggaaaacattctgctcatttatgtgccgattgtcgctgtgcgcacctttgggattgcgcgctctgtgtcgcgatatgtggaacggctcgtcggccatcacatcattttgaaaatcgtatctgacatgcgcgtccgcctttacaatatgcttgagccgggtgctttgatgctgcgttcccgttttcgcacgggggatatgctcggcattttgtctgaggatattgagcatttgcaggatgctttcttaaaaacgatttttcctgcgatctcagccttgctcctgtatgctgtgtcagtgatagcgctcggcttcttctcttggccgtttgccatattgcttgcgctgtatttgtttgttcttgttgtattgtttccggttgtgtctttgctcgtgacgagagcgaagaatgcgaagctgaaaagcggacggaatgtgctgtacagccgtctgacagatgctgtgatgggtgtcagcgactggatgttcagcggacgccggcatgcttttattgatgcttatgaaaaagaggaacgtgattggtttgagcttgaacggaaaaaacaacgctttacaagatggcgggactttgctgcgcaatgccttgtcgctggccttattttgctgatgctgttttggacagcgggacagcaagcggacggcgagctcgctaaaacgatgattgccgcttttgtgctagtggtgtttccgttgacggaagcctttttgccgctttcggatgccttaggcgaagtgccgggctatcaggattctatcagacgcatgaacaatgtggctcctcagccggaggcgtcacaaactgaatcaggggatcaaattctcgatcttcaagatgtcaccttggcctttcgtgatgtgacgttttcttatgacaacagcagccaagtgctgcacaacttttcctttacgctgcgccaaggagaaaaaatggcgctgctcggccgaagcggctctgggaaatcaacatcgcttgcattaatcgaaggcgccttgaaaccggactccggttctgtgacgttaaacggagtggagacagcgctgttaaaggatcagattgcggatgcggtggccgtgttaaatcaaaaaccgcacctgtttgatacaagcattttgaacaacatcaggctcggaaacggagaagcaagcgacgaggatgtgcgccgcgccgcaaagcaggtcaagctgcatgactacattgagtcattgcctgacggatatcatacctctgtacaagaaaccggcatccgtttttccggtggagagcgccagcggatcgcacttgcgaggattttgctgcaggatacaccgatcatcatcctcgatgagccaacagtcggcctcgatcctattaccgaacgtgaattgatggaaacggtgtttgaggtgctgaaaggaaaaacgattttatggattacacaccatctcgcgggagtggaagcagccgataaaatcgtatttctcgaaaacggcaaaacagaaatggaaggaacccatgaggagctgctggcggcaaacgaacgatatcgccgcctgtatcaccttgatgttcctgtaaaataa

SEQ ID NO: 47048 - DNA, 1458 bp, Bacillus subtilis
atgagtttcgaaacgttaaacaaaagttttatcaacggaaaatggactgggggagaaagcggacgtacggaggacattttgaatccgtatgaccagtctgtgatcacaacagcatctttggcaacgggcaaacagcttgaggatgcgtttgacattgcacagaaagcccaaaaagagtgggccaagagcacgacggaagaccgaaaagccgtgctgcaaaaagcgcgcggctatttacacgaaaaccgtgatgacatcattatgatgatcgcccgcgaaactggcggaacgatcattaaatcaacaatcgagctggaacaaacgattgcgattttagatgaagccatgacgtatactggtgaattaggcggcgtcaaagaggtgccatccgacattgaagggaaaaccaataagatttaccgccttccgctaggtgtcatttcatcgatttctccatttaatttcccaatgaatctatccatgagatccattgcgcccgcaattgcgctgggtaacagcgttgttcacaagcctgatatccaaactgctatttccggcgggaccatcattgcgaaagcgtttgaacacgccggtcttcctgccggtgtccttaacgtcatgctgacggatgtaaaggaaatcggggacggcatgctcaccaatccaatcccgagattaatcagctttacagggtcaacagcagtcgggcgccacatcggtgaaatcgccggtcgcgccttcaaacgaatggcacttgagctcggcggcaacaatccatttgccgttctttcagatgcggatgtcgatcgtgctgtggatgccgcgattttcggaaaatttattcaccagggacaaatctgtatgattatcaacaggatcatcgttcatcaagatgtatacgatgagtttgtagaaaaattcaccgcccgtgtcaaacagcttccgtacggcgatcaaaccgatccgaaaaccgttgtcggcccgctgatcaacgagcgccaaatcgagaaagcgctggagatcattgagcaggcaaagacagacggcattgagcttgcggttgaaggaaaacgcgtcggaaacgtgctgacgccgtacgtctttgtcggtgcggacaacaacagcaaaattgcccaaacggagctgtttgccccaatcgcaaccattattaaagctggcagcgaccaggaagcgattgacatggcaaatgatactgaatacggcctcagctctgcggttttcacttctgatttagaaaaaggcgaaaagttcgccctgcaaattgacagcggcatgacccatgtcaacgaccagtccgtcaatgattcgccgaatattgcctttggcggaaacaaagcaagcggtgtcggccgtttcggcaatccgtgggtcgtcgaggaatttaccgtgacgaaatggatttcgatacagaagcaataccgcaaatatccgttctaa

SEQ ID NO: 47049 - DNA, 774 bp, Bacillus subtilis
atgagaaaacaagtcgctttggtgacaggggctgccggcggaatcagattcgaaatcgcaagagaattcgcccgggaaggtgccagcgtcatcgtttcagacctccgtccggaagcatgtgaaaaagcagcctccaagcttgcagaagaaggctttgacgcggcggccattccgtatgatgtgacaaaggaagcgcaagttgctgatacggtgaacgtcatccaaaaacaatacggccgcttggatattctggtgaacaatgccggtattcagcacgtcgctccgattgaagagtttccgacagacacctttgaacagctgatcaaggtcatgctgacggctccctttattgcaatgaagcatgtttttccgatcatgaaaaaacagcagtttggcagaatcattaatattgcgtctgttaatggattagtgggctttgcagggaaatccgcttataatagcgccaagcacggcgtcattggactcacaaaagtaggggcgctggaaggcgcgccccacggcataacagtcaatgcgctctgtccgggttatgtcgatacccagcttgtacgcaatcagcttagcgatctatcgaaaactagaaatgtcccttacgactctgtacttgaacaagtcatttttccgcttgtgccgcaaaagcgactgctttccgtcaaggaaattgcggattatgccgtgtttttggcaagcgagaaggcgaagggcgtcactgggcaggctgtcgtccttgatgggggctacaccgcacaatga

SEQ ID NO: 47050 - DNA, 2061 bp, Bacillus subtilis
atgagtgatgaccaaaacaaacgtgtaaatgaacactcaaaggacgagcagcttgagcagtacaggaccgataacagcgggaagaaaatgacgacaaaccaaggcttgcgagtgtcagaggatgagcactcgttaaaagccggggttcgcggcccgacgctgatggaggattttcatttccgggagaaaatgacgcactttgaccatgagaggattccggagcgcgttgtgcatgcgcgcggatttggcgtgcatggcttttttcaggtttacgaaccaatgacggaatacacacgggccaaatttcttcaggacccttcggtgaagacaccggtatttgtccgtttttctacggttgcgggttctaaaggctccgcagacacggtgcgggatgccagaggctttgcgacaaaattttatactgaagaaggaaactatgaccttgtgggaaataacattccggtgtttttcattcaggacgcaatcaaatttccggatttggttcacgcgtttaagcctgagccacacaatgaaatgcctcaggctgcgactgctcacgatacattttgggattttgtcgccaataaccctgagtctgcccacatggtgatgtggacgatgtctgacagaggcatcccgcgcagctacagaatgatggaaggcttcggcgttcacacgttccgttttgtcaatgaacaaggaaaggcacgtttcgtgaaatttcactggaagccggtgctcggcgtgcattctctcgtatgggatgaagcgcaaaaaattgccgggaaagatccagatttccaccgccgtgacctgtgggaaacaattgaaaacggcggcaaggttgaatacgagctcggcgtgcagatgattgatgaggaagatgaattcaagtttgattttgatattcttgacccaactaagctgtggccggaagagcttgtgccggtgaagatcattggaaaaatgacgctgaaccgcaatcaggataatgtgtttgcggaaacagaacaagtcgcattccacccgggaaatgtcgtgccgggcatcgattttaccaatgacccgctattgcaggggcggcttttcccttatacggatacacagctcatccgtcttggcggcccgaacttccatgagattccgattaaccggccggtctgtccattccataacaaccaatacgacggctatcaccggatgacgatcaataagggacctgtcgcttatcataaaaactcactgcaaaacaatgatccgtcgcctgcgacagctgaagaaggcggctacgtccactatcaggaaaaagtcgagggcaaaaaaatccgccagcgaagcgacagcttcaacgattattactcacaggcgaagcttttctggaacagcatgtctcctgtggagaaacagcacatcatttctgctttctgcttcgaggtcgggaaggttaaaagcaaagacgtacagcggcaggtcgttgatgtcttcagcaatgtcgatgcagatttagcagaagaaatcgccaaaggagtaggcgtggcggcgcccgcaaagcgtaaagcatctaaagaaaatcttacttcgcctgcgttaagccaagcccgtacagtgaaaaccgcctcaacaaggaaagtcgctgtactcgccggaaacggatttcatgaaaaagagctgcaaacagtactggaagccttaaagcaagaaggaatcacagtggatatcatcagtcaaaatctggggtatatgacaagcggcagcggacagcagcttgaggccagcggcacgttcctgacggttgattctgttctgtatgatgccgtctatgccgcaggaggactggagttaaaagacaacaaacaagcgatggcgtttatcagagaagcttacaatcactacaaggcgatcggtgcggcaaatgaaggaattgaccttcttcaatcctctgtcgggacaacagaggggctaggcatcgtaacggctaaagatgaacctgactacaccgctttcagcaaggcatttatcgatgcggttgctgctcatcgccattgggatagacgaatttga

SEQ ID NO: 47051 - DNA, 1440 bp, Bacillus subtilis
atgagtcattttaaaaactatcaaatcagtcatgacattttacgagcattggaaggactgggatatacagaaccgaccaaggtgcagcagagtgtgatccccgctgcccttgaacgaaaggatcttgtcgtcaaatcacagacaggaagcgggaaaacggcttcgttcgggattcctctctgtgagctggcgaattgggatgaaaacaagccgcaggcgcttattttaacaccgacccgtgagcttgcggtgcaagtaaaggaagatatcacgaacatcggacgatttaaacggatcaaagcgacagccgtatttggaaaatcctcctttgataaacaaaaagctgagcttaagcaaaaaagccacattgttgtcggcacgccgggacgtgttctggatcatatcgaaaaaggcacgctgccgttggatcgtctctcttatttggtcattgatgaagcggatgagatgctgaatatgggcttcattgagcaggtggaggcgattatcaagcatctgccgactgagcgtacgacgatgctgttttcagcgacgcttccgcaggatatcgagaagctgagccgtcaatatatgcaaaaccccgagcatatcgaggtcaaagcggccggcctaaccacaagaaatattgaacatgcggtgattcaagtaagagaagagaataagttttcattgctgaaagatgtgctgatgacggagaatcccgacagctgcatcattttctgccgaacgaaggagcacgtcaatcagctgaccgatgaattggatgacttgggatatccatgcgataaaattcacggcggaatgattcaggaagaccgattcgacgtcatgaatgaatttaaacgtggcgagtaccgttacttagtggcgacggatgtcgccgcgcgcgggattgatattgaaaatatctcccttgtcatcaactatgatctgccgcttgaaaaagaaagctatgtccaccgcacgggccgaacgggacgcgcagggaacaaaggaaaggccatttcgtttgtcacggccttcgaaaaacggtttttagccgacattgaagaatatatcggatttgaaatcccaaaaatagaagcaccttctcaagaggaagtggcaaggaagaaaccagaatttctagctaaactgaatgaccgtccggaaagcaaaaaggacaaaagcgaagagctgaataaagacattatgaagctgtattttaacggcggaaagaaaaagaaaatcagagccgttgattttgtaggaacgattgccaaaattgacggtgtgtcagctgacgacatcggcatcatcacgatcatggataacgcctcatacgttgagattttaaatggtaaaggccctcatgttctcaaagtgatgaagaacacaaccgtcaaagggaaacagctgaaggtgaataaagcgaataaatga

SEQ ID NO: 47052 - DNA, 1527 bp, Bacillus subtilis
atggtgactttagacggttcttcattgacaacagccgacgtcgctcgtgtgctgtttgattttgaggaggcagcggcttctgaggaaagtatggagcgcgtgaaaaaaagcagagcagcagtggaacggattgtacgcgacgaaaagacaatctacggcatcaacaccggatttggcaaattcagcgatgtcctgattcagaaagaagactcggcggcgctgcagctgaatttaatcctttctcatgcctgcggagtcggcgacccttttcctgagtgtgtttccagggcaatgctgcttttgcgcgccaatgcgctgttaaaaggcttttccggtgtacgcgctgagctgatcgagcagttgcttgcttttttaaataaacgcgtccatcctgtcatccctcagcaaggatcacttggcgcaagcggagatctggcgccgctttcccacttggcgcttgcgctgatcggacaaggagaagtcttttttgagggggaaagaatgccggcaatgacaggcttgaaaaaagcaggtattcaaccggtaacgctgacatccaaggaagggcttgccttgattaacgggactcaggccatgactgcaatgggggtggtcgcctacatcgaagctgagaaactagcctatcaaacagaacgaattgccagcttaacgattgaggggttgcagggaattatcgatgcatttgacgaggatattcacttagcccgcggctatcaggagcagatcgatgtcgcagaacgaattcgcttttatctatctgacagcggcctgacaacctcccagggagaactgcgggtacaggatgcctattcattgcgctgtattccgcaagtacacggtgcgacttggcagacactaggatatgtcaaagaaaaattagagattgaaatgaacgcagctacagacaatccactcattttcaatgacggtgacaaagtgatttccggcggaaactttcacggacagccaatcgcctttgccatggattttctgaaaatcgcaatatcagagcttgcgaatatcgcagagcgtaggatcgaacgacttgtgaatccgcagctgaatgacctgccgccgttcctgagccctcatcccggtctgcaatccggtgcaatgatcatgcagtacgccgcggcctcactcgtttctgaaaataaaacactggcccatcctgcaagtgtggattccattccgtcatccgccaaccaagaggaccatgtcagcatgggaaccatcgccgctcggcatgcttatcaggtgatcgcaaatacaaggagagtcattgcgatcgaagccatttgcgcattgcaggctgttgaatacagaggcatagaacatgcagcgtcctatacgaaacagctttttcaagaaatgagaaaagtcgtgccgtccattcagcaggaccgtgttttttcctatgacattgaacgcttgactgactggctgaagaaagaatctttaatacctgatcatcagaataaagaactaagggggatgaacatatga

SEQ ID NO: 47053 - DNA, 960 bp, Bacillus subtilis
ttggataagtacccttttctcagagaggccggatcttcgtttaaagaccgggatgtcacaaaaatgagcgacctgatcgcaacatgggacggccaggacattaagggaccggcgttgataggtgtccccctatcaaaatcctccatcagtcattcaggcgcttcctttgcacccggaacaatacgccaggctctgaaacattcatcagcctattctgctgagcttggagagcacgtcgtatcagagcttctatatgacctgggggatatcgatattcatgtcactgatatcgtaaagtcacatcatcacattttccaaaccatgcacgctctgctttcggatcatccggattgggtgccgctcatacttgggggagataactctatcagctactccacaataaaagcgatagcacaaacaaaaggaacgacagcggtgattcaatttgatgcccatcacgatgttcgcaatacggaggacggggggccgacaaacggcacccccttccgccgccttttggatgaagagatcattgaaggtcaacatttgatccagctgggtatcagagaattcagcaacagccaggcctatgaagcatatgcaaaaaaacataacgtgaacattcacacgatggacatgatccgggaaaaaggactaatcccaacgataaaagagattttgcctgttgttcaagataaaacagatttcatttttatatctgttgacatggatgtcttagaccagtcccatgcacccggctgtccagcgattggcccgggcggcctctatacagacgaattgcttgaagcagtcaagtacatcgcacaacagcccaatgttgccgggattgaaattgttgaagtcgaccctaccctcgattttcgagatatgacaagcagagctgcagctcatgttctgttacacgcattaaaaggaatgaaactctccccattcaagtga

SEQ ID NO: 47054 - DNA, 1428 bp, Bacillus subtilis
gtgaatcttcaggagaacagcagccaacagctaaaacgcacaatgaaaagcaggcacctatttatgatctcattgggaggcgtcataggcacaggacttttcctcagtacgggctatacgctacatcaagccggacccggcggtacgatactcgcttatgtaatcggcgggttgatgatgtacctcgtcatgcaatgtctcggcgaattgtcggttgccaatgcggtgaccggctcttttcaaaaatatgctacaacatttatcggtccatctaccggttttatggtcggcatcatgtactggatcaattgggtggtgacggtaggctctgagtttaccgcatccggtattctcatgcagcgctggttccctgacagcagtgtatggatgtggagtgcgatttttgcagcccttctttttatatgcaacgcattttcagttaagttatttgcggaaactgaattttggttttccagcgtaaagattgtcaccattattttatttatcattttaggaggagccgccatgtttggcctgatctctttaaacggaacggcggatgctcctatgttgtcaaacttcacagatcatggcgggttgtttccaaatggctttctcgccgtttttatcgcgatgatatctgtgagcttcgccttttccggtacagagttaatcggcgttacagcaggagaatcagcaaatcctcaaaaggatataccgcgatccatccgtaatgtcgcatggagaaccgtgatttttttcattggcgctgtcttcatattatccgggttgatttcatggaaggacgcaggcgtgattgaaagcccgtttgtcgccgtatttgcggagatcggaattccttacgctgctgatattatgaatttcgtaatattaacagccttgctgtctgtcgccaactcaggcttatatgcttcgacccgtatgatgtggtctttagcaaatgaaaacatgatcagctcccgttttaagaaagtgacatctaaaggcattcctttaaatgccttaatgatcagtatggctgtatcttgtttatctctcgtttccagtatcgtggcccctggaactgtctatgtggtgatggtcgcaattgctggatttgcaggagtcgtggtctggatgagcattgccttgtcccaactcttgtttcgaaagagatttttgaaaaaagggggggatgtaaaagatctgacatttcgcacgccgctttatcctcttatgcctatagccgctctcttattatgttctgcttcttgtatcggtcttgcttttgatcccaatcaaagaatcgcacttttctgcggagttccttgtatcatcctttgctatctcatctaccatttcaaaagaaatgttacaaaagcgaaaaaaatcagccaagaggaatatccagccgatcacatcctataa

SEQ ID NO: 47055 - DNA, 873 bp, Bacillus subtilis
atggcttttgtatcgatgaaagagcttcttgaagatgcaaagcgggagcaatatgcaattggccagtttaatatcaacggcctgcaatggacgaaggcgattttgcaggcggcgcaaaaggagcaatcaccggtcatcgccgcggcttccgatcgcctggtcgactatttaggcggatttaaaacgattgccgccatggtcggcgcgttaatagaggacatggcgattaccgttccggtcgtgcttcatctcgatcacggcagcagtgcggaacgctgcagacaggccattgatgccggattcagctcagtgatgattgacggctcccatcagccgattgacgagaatatcgcgatgacaaaagaagtcaccgattatgccgcaaaacacggcgtgtcagtagaagccgaagtcggcacggtcggcggaatggaagacggactggtcggcggggtccgctatgcggatatcacggaatgtgagcggatcgttaaagaaaccaatatcgacgcgctggccgccgccctcggctctgtacacggcaaatatcagggtgagccgaatctcggatttaaggaaatggaggctatctcccgcatgactgatattcccctcgttcttcacggggcatccgggattccgcaggatcagatcaaaaaagccatcacgctcggccacgcgaagatcaatatcaatacggaatgtatggtagcgtggacagacgaaacacgccgcatgtttcaggaaaacagcgatctgtacgaaccgcgcggctatttgacacccggcattgaagccgtggaagagacagtgcgaagcaaaatgagagagttcggatcagccggtaaagcagctaagcagcaggtcggctaa

SEQ ID NO: 47056 - DNA, 978 bp, Bacillus subtilis
atgaagtatacattcaatgaagagaaggcttttgatattgttgccatcggccgggcatgtattgatctgaacgcagtcgaatacaaccgcccaatggaagaaacgatgacattttcgaaatatgtcggcggttcacctgcgaatatcgcgatcggcagcgcgaagcttggcttaaaagcgggcttcatcggcaaaattccggatgaccagcatggaagattcatagagtcctatatgagaaagaccggcgtggatactacacagatgattgttgatcaagatggacacaaagcaggccttgcatttacagaaatcctcagccctgaagaatgcagcatcttaatgtatcgcgatgatgtggcggatctttatcttgagccttcagaggtaagtgaggactatatcgcaaatgcgaaaatgctgcttgtctccgggacagcgctcgccaaaagcccgtcacgggaagcggtgttaaaagctgttcaatacgcgaaaaagcatcaggttaaggtggtattcgaactggattaccggccatatacgtggcagtcatcagatgaaacagccgtttattattctttggttgccgagcagtctgatatcgtcatcggcacacgcgatgaatttgatgtgatggaaaaccgcacaggcggaagcaatgaagaatccgtcaatcatttatttggccattcagccgacctcgttgtcatcaaacacggcgtcgaaggctcttacgcatacagcaaatccggcgaggtattccgcgctcaagcgtacaagacaaaagtgctgaaaacctttggggccggtgactcctatgcgtcagcctttatctatggccttgtcagcggaaaagacattgaaacggcattgaaatacggcagtgcttcagcctccattgtggtgagcaagcacagttcgtcagaagcgatgccgactgcggaagaaatcgaacagcttattgaagcacagtcataa

SEQ ID NO: 47057 - DNA, 1464 bp, Bacillus subtilis
atggcagaaatcagaaaattaaaaaactacatcaacggtgaatgggttgaaagcaaaacagatcaatatgaagatgtcgtcaatccggcgacgaaagaagtgctatgccaagtgccgatttctacaaaagaggatattgattacgcagcgcaaacagcggctgaagcatttaaaacatggtcaaaggtggcggttcctcgccgcgccagaattctatttaacttccagcagctgctgtctcagcataaagaagaacttgctcatctaattaccattgaaaacggaaaaaacacgaaagaagctttaggtgaagtgggacgcgggattgaaaacgtagagttcgccgctggagcaccttccctgatgatgggtgactcacttgcttccatcgcaacggacgttgaagcggcgaactaccgttacccaatcggagttgtcggcggaatcgcgccattcaacttcccgatgatggttccttgctggatgttcccgatggcgatcgcgctcggcaacacatttattttaaagccatctgagcggactccgctgttaacagagaaattggttgagctttttgaaaaagcgggccttccgaaaggggtgttcaacgtcgtatacggtgcgcatgacgttgtgaacggcatcctcgagcatcccgaaattaaagcgatttcatttgtaggctccaagccagtaggcgaatacgtctacaaaaaaggaagcgaaaacttaaaacgcgttcaatctctgactggcgcgaaaaaccatacgattgtcttgaacgatgcgaatcttgaagacacggttacaaacatcgttggagctgccttcggttctgccggtgaacgctgcatggcttgtgcggttgtgacagttgaagaaggaatcgccgatgaatttatggcgaagctgcaggaaaaagtggcggacattaaaatcggtaacggccttgatgacggcgtgttcttaggaccggtgattcgcgaagacaacaagaagcgcacgctcagctatatcgaaaaaggtcttgaagaaggtgccagactcgtatgtgacggacgtgaaaatgtgtctgacgacggctactttgtcggcccgacgatctttgacaatgtcacaacagaaatgacgatctggaaagatgaaattttcgctccggtcttatctgtcatccgtgtgaaaaacctgaaagaagcgattgaaatcgccaataagtctgagtttgcgaacggcgcctgcttgttcacatccaactcaaacgcaatccgctacttccgtgaaaacattgatgcgggaatgctaggcatcaaccttggtgtgccggctccaatggcgttcttcccattctcaggctggaaatcttcattctttggaacgctgcatgcgaacggaaaagacagcgtcgacttctatacacgtaaaaaagtggtgacggcaagatatccggcacctgatttcaactaa

SEQ ID NO: 47058 - DNA, 1386 bp, Bacillus subtilis
gtgaagaaagacacaaggaaatatatgatctactttttcggcgctttagggggactgctatatggttacgatacaggtgttatctccggagcactcctgtttatcaataacgatattcctttaacgacattgacagaaggattggttgtcagcatgctgctccttggcgcgattttcggttctgccttgagcggcacatgctcagaccgctggggcaggagaaaggttgtatttgtcctttccatcatttttattatcggtgcgctcgcttgcgcattttctcaaacaatcggcatgctgattgcatctagggtgatactcgggttggccgtcggcggttcaacggcacttgtgcccgtgtatctttccgaaatggcaccgacgaaaattcgcgggacactcggcacaatgaacaacttaatgattgtcaccgggattttgctcgcctatatcgttaactacctgttcacaccgtttgaagcgtggcgctggatggtcggtctggctgcagtgcctgccgtgcttctattaatcggcatcgccttcatgccggaatcgccaagatggctcgtgaagcgcggcagcgaagaagaagcgagacgcatcatgaacatcactcatgaccccaaagacatcgaaatggaattggcagagatgaagcaaggggaagcggagaaaaaagaaacgacacttggcgtgctgaaagccaagtggattcgccctatgcttctgattggcgtcggccttgccattttccagcaggcagtcggcattaacacggtcatctactacgcgccaaccatttttacgaaggccggtcttggcacatcagcttcggcgctcggcacaatgggaatcggcatcctcaacgtcatcatgtgtatcactgccatgatcttaattgaccgtgtcggccgcaaaaaacttctgatctggggaagtgtcggcatcacactgagccttgctgctttatcaggcgtgctcctgacactggggctttccgcatcaacagcgtggatgacagtagtctttctcggtgtctatatcgtcttttaccaggcgacatggggtccggtagtgtgggtgctcatgcctgagctcttcccgtccaaagcacgcggagccgcgacagggttcacgactttggtgttatcggcggctaacctgatcgtgtcgcttgtcttcccgctgatgctaagcgcgatgggcatcgcatgggtctttatggttttctcagtcatttgtcttctctcatttttcttcgcgttctacatggtaccggaaaccaaagggaaaagcttggaggaaattgaagcaagcctgaaaaaacggtttaaaaagaagaaaagcacccaaaaccaagtgctgaatgagcgtacattataa

SEQ ID NO: 47059 - DNA, 1881 bp, Bacillus subtilis
gtggcgaaaaaagagtttaaagcagagtctaaacgcttgctggatatgatgattaactccatttatacccaaaaagaaattttcctgcgcgagttaatctccaattcgagtgatgcgattgacaaaatctattacaaagcgcttacggacgatgcgcttacgtttgataaagacagttactacataaaggtcgcagctgacaaagatgcgagaacattaaccatctctgatacggggatcggaatgacaaaggatgagcttgaacagcatcttggaacaattgcaaaaagcggttccctcgcgtttaaaaaggaaaacgagctgaaagacggacatgacattatcgggcagttcggtgtcggtttttacgcggcatttatggttgccgatgtcgtgacagtcatcagtaaagcgcttggcagcgaagaggcttataaatgggagtctgcgggtgcagacggctatacgattgagccgtgtgaaaaggattctgtcggtacagacattatcctgaaaatcaaagagaacacagaagatgacagctatgacgagtttttagaggaatatcgtttaaaagcgatcatcaagaagtactccgacttcattcgctacccgatcaaaatggatacaaccattaataagccgaaggaaggcagcgaaaatgaatttgaagaggtgcaggaagagcagacggtcaacagcatggtgccgatctggagaaaaaacaaaagcgagctgacagatgaggattatgaaaaattctatgctgaaaagcattacgggtttgataaaccgctgacacacgttcatatcagcgtggatggagcggttcgctacaacgcgattctattcgtccctgaaaacatgccgtttgactactattccaaggaatatgagaaaggcttggagctgtattccaatggcgtgctgatcatgaataagtgcgcagacctgctaccggaccacttcagctttgtgaagggcatggtcgattctgaggatctgtcgctgaatatttccagagaaatgctgcagcatgaccgccagctgaagctgatcgcgaaaaacatcagcaagaaaatcaaaagcgagctgcaaagcctgttgaaaaaagaccgcgagaaatacgagacgttctacaagtcgttcggcagacagctgaaattcggcgtgtacaatgattttggcgcgaataaggatcaattgaaggatctcctcttattctactcttcaaaagagaaaaaactggtcagcttagacgagtatgtttccagaatgccagaggagcagaaattcatttattacgcgaccggtgattcttacgaccgcattgagaaactgccgcaaacggaaatggtggcggacaaaggctatgaaatcctctactttactgaggacatcgatgagtttgcaattaaaatgctggcttcttatcaggaaaaagaattcaagtccgtatcaagcggagaccttggcatagacacggatgaggatcaaaagcagtccgaggaagaggaaagcaagtataaggatctgtttgaggaaatgaaaaacattctgtcagacaaagtgaaaaacgtcagaatctcaaaacggcttaaatcacatccagtctgccttgctgctgacggcgaagtgacaattgagatggaaaaaatcttaaatgcgatgcctgacagccaaaatgtgaaggcggaaaaagtgctggaaatcaacccaaatcacgaggtattccaaacactgcaggacgcgtttgaacaagataaagagaagctgagcctgtacacaaaccttctgtacaatcaggcgctcctcatcgaaggcctgccgattcaggaccctgtggaatttacgaacaatatttgcaaggtcatggtgtaa

SEQ ID NO: 47060 - DNA, 789 bp, Bacillus subtilis
atgggaagacttgaaaacaaaacagcagttatcacaggcgccgcgacaggcattggtcaagcgacggcggaggtttttgccaatgaaggcgcgcgtgtgatcatcggagatatcaataaagatcaaatggaagaaacagttgacgcaatcagaaaaaacggaggacaggccgaatcctttcacctcgatgtgtcagatgaaaacagtgtgaaagcatttgctgatcaaatcaaggatgcatgcggaacgattgatattctgtttaataatgccggcgttgatcaggaaggcggaaaggtgcacgaatatccggttgacctgtttgaccgcattatcgccgtcgacctgcgcggcacattcctttgcagcaaatatttgattccgctcatgctcgaaaatggaggctccatcatcaacacctcctccatgtcaggccgtgccgcggaccttgaccgctccggctacaacgccgcaaaaggcggtatcaccaacctgacaaaggcaatggcaatcgactacgcacgaaacggcatccgcgtcaattccatttcaccgggcacgatcgaaacaccgctgattgacaaattagcaggcacaaaagaacaggaaatgggcgaacaattccgcgaagcaacaaatggatcacgccgctcggacgtcttggccagcccaaagaaatggcaacagtggcactgttcctcgcatcagacgacagctcatacgtcacaggagaagacatcaccgcagacggcggcatcatggcgtacacatggcctgggaagatgctga

SEQ ID NO: 47061 - DNA, 1338 bp, Bacillus subtilis
atggaacagcaagtaaaggacgacatccagcgtgtctttcagcttcagaaaaaacagcaaaaagccttgcgcgcttcaacagcggaacagcggagagaaaagcttcaacgctttttagattccgtcatcgcccatgaagaagaaatcatcgaagcgatccgcaaagacgtccgcaaaccatatcacgaagtaaaaaaagcggaaatcgaaggaacaaaaaaagcgattagagataatatgaataacctggaacaatggatggcgcctaaagaagtcggttcatcgttaagccctgacgcaaacggaattcttatgtacgagcctaaaggcgtcacactcatcctcggcccgtggaactatccgtttatgctgacgatggcgccgcttgccgcttctctcgcagccggaaacagcgcgattgtgaagctgtccgatttcacgatgaacacgagcaacattgctgctaaagtaataagagacgcttttaatgaaaaagaagtcgcgatttttgaaggagaggttgaggtggcaaccgaactacttgatcagccgttcgaccatattttcttcactggaagcacaaatgtcgggaaaattgtcatgacagcggctgccaaacacttggcatctgtcacacttgagcttggcggcaagagcccgacgatcattgacagtgaatacgatctgatggacgcagcgaaaaagatcgccgtcgggaaattcgtaaacgccggccaaacctgcatcgcacctgattacctgttcattaaaaaagacgttcaggacaggttcgcggggattttacaaacagtcgtcaacgctggatttatggaggatgatcataccccagaccgcagcaaatttacgcagatcgtcaatgaccgcaacttcaaccgcgtcaaagatctgttcgacgatgccatcgaaagaggggcggaagtggtgttcggcggcgtattcgatgccagcgaccgcacgatctcgccaaccgttttgaaaaacgtcacgcctgacatgaaaatcatgcaggaggaaatcttcgcatcgatcctgccaatgatgaactatgaagacatcgacgaggtcatcgattacgtaaatgaccgcgataaaccgcttgcactttatgtgttcagcaaaaaccaagatctgattgacaacgtccttcagcacacgacatcaggaaatgccgccatcaatgatgtcgtcgtccatttcagtgacgtcaacctgccattcggcggcgtcaacacaagcggaatcggctcctatcatggggtatacggattcaaagagttttctcatgagaagggtgtatttattcaggccgctgaataa

SEQ ID NO: 47062 - DNA, 924 bp, Bacillus subtilis
atgacaatcgatcattcagtcacaaatacagagcagcttgaacaacagaaccccgccataaaaacaaagctcaaactgaaaaagcttaaggatcaggtgatcgtcattaccggcgcttcaagcggtatcggacttgtcacggcgagaatggcagctgaaaaaggcgcaaaggtcgtggcagcagcgcgaaatgaagaggcgctgaaggagctcactgatgaacttaaggaaaaagggcacgacgccatatgggtaaaggcggatgtcggaaaagaagaggacgtcaaccgcatcgcagaaaccgcgatcagcacattcggccgctttgatacatgggtcaacaatgcggccgtctcgactttcggacacgccatggacgtcaccgtcgaagacatgaagcgcatgttcgacacaaatttctggggacctgtttacggaacaagagcggctgtcaaacactacaccggcagaggtgtgccgggcgcactcattaatgtaggaagcctgttcggagacaggggaacggtcattcaatccacatatgcatctgccaaatttgcgcttcacggctggacggaaagcatccgaatggagcttgaaaaggaacaggcgcccgtctcggtaacgctcatccacccgggcagaattgacacaccatataacgagcatgcgcacagctacctcgacaaacagccggctcattaccgctccatgatctatccgccggaagcggtcgccgaagcgatcctgtttgccgccgaacaccctaagcgcgacatgtacatcggctcacaggccaaagccatcgccatgctgggcgcgctttttcctcgtctggaccgacagactgatggaaaaaatcatgtatcacagccagcatgccgaaagaccgtccaatccgagagaagaaagcgctctttatga

SEQ ID NO: 47063 - DNA, 1542 bp, Bacillus subtilis
atgactagttatatgttaggaatcgatatcggcacgacaagcacaaaagctgtgctgttcagtgaaaacggagatgtggtacagaaagaaagcatcggctacccgctctatacaccggacatctcaacagctgaacaaaatccggaagagatttttcaggcagtcatccatacaacagcgagaattacaaaacagcatcccgaaaaacggatctctttcatttcgttcagcagcgccatgcacagcgtcattgcaatcgacgaaaatgacaagccgctgacgccatgcattacatgggccgacaacagaagtgaaggctgggcgcataagatcaaagaggaattgaacggacatgaggtgtacaaacggacgggaacaccgattcatccgatggcaccgttaagtaaaattgcctggatcacgaatgaaagaaaagaaatcgcttccaaggcaaaaaaatatatcggcatcaaagaatacatttttaaacagctgttcaatgagtatgtcatcgattactcattggcatcagcgacaggcatgatgaacctgaagggcttggattgggacgaagaggcactgcgcatcgcaggcatcacgccggatcacttatccaaactcgtgccgacaaccgagatctttcagcactgcagcccggaaatagcgatccaaatgggaatcgatccggaaacgccttttgtcatcggcgccagcgacggcgtgctgtccaacctcggcgtcaacgccattaaaaagggtgaaatcgccgtcaccatcggtacaagcggtgccattcggacgattattgacaagccgcaaaccgatgaaaaagggagaattttttgctatgccttgacggacaagcattgggttattgggggacctgtgaacaatgggggcatcgtccttcgctggatcagagacgagtttgcctcctccgaaatcgaaacagcgacacggctgggcattgatccatatgacgtgctgacgaaaattgcccaacgcgtcagacccggttctgacggtctgctgttccacccatatctcgccggagaacgcgctccgttgtggaatccggatgtacgcggctcatttttcggcttgaccatgtcgcataagaaagagcatatgatacgcgcggcattggaaggcgtcatttacaacctgtacacggtgttcttggcgttaactgaatgcatggatggcccggtaacccgcatccaagcgacagggggttttgcaaggtcggaggtttggcgccaaatgatgtcggatatcttcgaatcagaggttgtcgttccggaaagctacgaaagctcatgtctcggcgcctgcattttaggcctgtatgcaacaggaaaaatcgattctttcgacgccgtgtccgatatgatcggcagcacatacagacatacgccgatcgaagactcagccaaggaatacagaacattaatgccgattttcatcaatctatcaagattattagaaaatcaatatacacaaattgcagattatcagaggggcttaatcacacacaaatag

SEQ ID NO: 47064 - DNA, 1407 bp, Bacillus subtilis
atgttcaattcgattggtgtcataggcttaggcgtaatgggaagcaacatcgccttaaacatggcaaataaaggcgaaaacgtcgctgtctataattacaccagagatttaacggaccagcttatccaaaagctggatggacaatctctcagcccgtattacgagcttgaggactttgttcaatcgttagaaaaaccaagaaaaatctttttgatggtcacagcgggaaaacccgtagattccgtcatccaatcattaaagcctttgcttgaagaaggcgacgtcatcatggacggaggaaactcccactatgaagacacagaaagaagatatgacgagctgaaggaaaaagggatcggctacctgggagtcggcatttccggcggtgaagtcggtgcgttaacagggccttccatcatgccgggcggagatcgcgacgtctatgagaaagccgctcctatcctgacgaaaatcgcagcccaagtcggagatgacccttgctgtgtctatatcggaccaaaaggggcagggcactttacaaaaatggtgcacaacggcattgaatatgccgacatgcagctgattgcagaagcttatacgtttctaagagaaacgcttcgtctgccgctagatgaaattgcatctatttttgaaacatggaatcaaggtgagctgaaaagctatttaatagagattacagctgagattttacgcaaaaaagacgaaaaaacaggacagcctctgatcgatgtcatccttgataaaaccggccaaaaaggcaccggaaaatggacgagcatgcaggcgattgataacggcatcccgtccacgatcatcacagagtccttgttcgcccgctacttgtcatctttaaaagaagaacggatggcagctcaagatgtattagcaggcccggaagccgaagaaaaacacttggataaagacacttggattgaatacgtcagacaggctctttacatggggaaagtatgcgcctatgcacaaggctttgcccaatataagatgtcatctgagctttacggctggaatctgccgctcaaagacatcgccttgattttccgaggcggctgcatcatccgcgctgatttcctaaacgtgatcagcgaagcattcagtgagcagccaaatctggctaacctgctgatcgcgccttatttcacagataagctccatgcctatcaaacaggcctgcgaaaagtcgtttgcgagggtatcagcaccggaatctctttcccatgcttaactaccgcgctctcttattacgacggctaccgcacagggcgttccaatgcgaacctcttgcaggcacagcgcgattactttggcgctcacacgtacgaacggactgatatggacggcgtcttccatacgaattggtctgaataa

SEQ ID NO: 47065 - DNA, 564 bp, Bacillus subtilis
atgtctttaatcggtaaagaagtacttccattcgaagcaaaagcattcaaaaacggtgaattcatcgatgtaacaaacgaagatttgaaaggccaatggagcgtattctgcttctacccagcagatttctctttcgtatgcccaactgagcttgaagatcttcaagaacaatatgctgcacttaaagaattaggtgttgaagtatactctgtttctacagatactcacttcgtacacaaaggctggcatgacagctctgaaaaaatcagcaaaatcacttacgcaatgatcggtgacccatctcaaacgatctctcgcaacttcgatgttcttgacgaagaaactggccttgctgaccgcggaacattcatcatcgatccagacggcgttatccaaactgttgaaatcaatgcaggcggtatcggccgtgacgcaagcaaccttgtaaacaaagtaaaagcagctcaatacgttcgtcaaaacccaggtgaagtttgcccggctaaatgggaagaaggcggcgaaactcttacacctagccttgatctagtaggtaaaatctaa

SEQ ID NO: 47066 - DNA, 1440 bp, Bacillus subtilis
atgggaaacatgccaaaggattttttatggggcggtgctttagctgcccaccaatttgaaggcggatggaatcaaggcggtaaagggccgagtgtcgtcgatgtgatgacagcgggtgcgcacggcgtgccgagaaaaatcactgacacgattgaagaaaacgaattttatccaaaccatgaagccattgatttctatcacagatacaaggaagatatcgctttgtttgcggaaatgggattaaaatgtctgcggacgtccatcggctggagccggatttttccgaaaggcgatgaggctgaaccgaacgaagctggtttgcagttttatgatgatgtgtttgatgaattgctgaagcatgggatcgagccggtcattaccctgtctcactttgaaatgccgctgcacctggcaagagaatatggcggcttcagaaaccggaaagtcgtggacttcttcgtcaacttcgcagaggcttgctttacccgttacaaagataaagtgaagtactggatgacatttaacgagattaacaaccaaatggatgtgaacaatccgctgttcctatggacgaattcaggtgttgtggttggcgaaaacgaaaacgccaaggaagtcatgtatcaaacggcgcaccatgaattagtggcgagcgccttagcagtggcaaaaggaaaagacatcaatccagagttccagattggggccatggtatcacacgtgccgatttatcctttctcctccaatcctgaagatgtgatgctggctgaagaagaaatgaggcagcgctatttcttccctgatgtgcaggttcgcggttattatccaagctacgcgttgaaggaatttgaacgcgaaggctacaacatcacattcgaagacggcgatgatgagattttaagaaacggaaccgtcgattacttaggcttcagctattacatgtcaacaactgtgaaaagcgatgtgaaaaatgataacactggcgatattgtaaatggcggcttgccgaatggtgtcgaaaatccgtacatcacttcgagtgactggggatgggcgattgatccaaccgggttgagatatacgttaaatcgtttttatgaccgataccaaatcccgttattcatcgttgaaaatggctttggcgcagtggatacgctggaggaggacggcaaggttcatgatccggaacgcattcaatatttaaaatcgcatattgaagcattgaaaaaagcggtcacgtacgatggtgttgatttaattggctacacgccgtggggcattattgatattgtctccttcacaactggcgaaatgaaaaaacgctacggcatgatctatgttgatcgtgacaatgaaggaaacggatccatgaaacgatataagaaagactcctttgagtggtataaaaatgtcattcaaacgaatggtgaggaactataa

SEQ ID NO: 47067 - DNA, 1761 bp, Bacillus subtilis
gtgattgttatgattataaaaaatctttttgtttgcaattcccaagaaattttgaaagagtataaatttaatgctgtaggagtaaatataatacttggtgaaaagagagaagatcatgaagagactaatggtgtaggtaagtcaacgatgattgaatgcatctcctttttactagggaagactatatcaaatttttatacgacaaatgaaattcttctcaataaaaacgtttttattgttttgaatgtggaaattgatggaaatcaagtattccttgctagatcttttaattctcctaaacatggttatacattacatgatacttctttaacttttaatttggaggaatggaaaaaagttagtataagtgtatataaaaaatttattgaaaaggaaattttaaagggtgagaaagaggatataacttttgcggcgttaagggagtatattataagagacgaaaagacagggtttaatgatatagttttaccgaataggggagggttaaaacaatataaattacttaactatctttttactttaccaactcatacagaaaaaaacataaaggtttttcgggataagattgaaaaattaaatagtgaaataaaattgattgaatcaatgaatattaacattggcgatttaaaagttaaggaagatgaattaataaatgagatagaggattacaatagagttatctatcaaactaagactgccaataaatataataatgatacaaataggtactcagaaattaaaagtgaacttaataaaatacaaaatgaaatatttgaaaatgaacatatttgtaaacaatatcaaagaaatatagatgatttaaataaaaaagtaactaagattaaagaattagaaaatatagaaaaattctatgaagatattgtaggtttttttccagaggaagtaaaacagaattataataaagtccaagagttctataatttcatggtagaaagtagagggagttattttaaagataaaattgttaaaatacaagccgatttaaaaaaacttaatatcaaaaagcaaggattaacagaacaactggaatcaagtgccagaattttaaagagtaacaatttcattgaggatatttccattgtgatggaagaacaaagaaggaaagaaatagagttagcggaagtaagattgagaattagtgactacgataaaaaaaaccatatttttgataagattaatgaacttcaacatgaaatattaagagttaattcaatgtattatgatgagtttcaatcttatagcgctatagttagtgagttaaagaagctttttaataatctaatggatgttacatacaaccaacatggatttttagattttgaatatgataatagaataagtaacgcaaaacaatcaactacaggaaggatcaaaatttcttgttctataccggatgaacgttcacatggtagactccatatgaagataaatatatttgatcttacttggtttttatacaggtgtataaataagtgtagtttgaatattttaattcatgacggatcttattctaatcctgatcctcatgtaaaaggtacattattaaaacatatcaattcaagtctgttagagaataggatcggacaatattttgtaacaataaataaaaatgaattattattagatgaccttcaagaattagagtcgaaaggtatgattgttgcaaaattagatagaaacaatgaagataaaaatagattttttggttttagattttga

SEQ ID NO: 47068 - DNA, 891 bp, Bacillus subtilis
atggataaaacgatttcggttattggaatgccaatggatttaggacaagcacgacgcggagtggatatgggcccgagtgccatccggtacgctcatctgatcgagaggctgtcagacatggggtatacggttgaagatctcggtgacattccgatcaatcgcgaaaaaatcaaaaatgacgaggaactgaaaaacctgaattccgttttggcgggaaatgaaaaactcgcgcaaaaggtcaacaaagtcattgaagagaaaaaattcccgcttgtcctgggcggtgaccacagtattgcgatcggcacgcttgcaggcacagcgaagcattacgataatctcggcgtcatctggtatgacgcgcacggcgatttgaatacacttgaaacttcaccatcgggcaatattcacggcatgccgctcgcggtcagcctaggcattggccacgagtcactggttaaccttgaaggctacgcgcctaaaatcaaaccggaaaacgtcgtcatcattggcgcccggtcacttgatgaaggggagcgcaagtacattaaggaaagcggcatgaaggtgtacacaatgcacgaaatcgatcgtcttggcatgacaaaggtcattgaagaaacccttgattatttatcagcatgtgatggcgtccatctgagccttgatctggacggacttgatccgaacgacgcaccgggtgtcggaacccctgtcgtcggcggcatcagctaccgggagagccatttggctatggaaatgctgtatgacgcaggcatcattacctcagccgaattcgttgaggttaacccgatccttgatcacaaaaacaaaacgggcaaaacagcagtagagctcgtagaatccctgttagggaagaagctgctgtaa

SEQ ID NO: 47069 - DNA, 1404 bp, Bacillus subtilis
gtgaatacaaaccaagataacggaaatcagctccagcggacaatgaaatcacgccatttgttcatgatttcattgggcggagtgatcggaaccggtttcttccttggaaccgggtttaccattaaccaagcgggaccgctcggcgcggttctgtcctatttagtgggcggctttatcatgtttttgaccatgctctgcttaggagagctggcagtcgcctttcctgtgtcggggtccttccagacctatgccacgaaatttatcagcccggccttcgggtttgcgttcggctggctgtactggctcggctgggcggttacatgcgccattgaatttttatcagcggggcagctgatgcaacgctggtttccgcatatagacgtgtggatctggtgtctggtctttgcggcactgatgtttattttaaatgcgatcaccacaaaagcctttgcggaatctgaattctggttctcaggcattaaaattttgattatccttttatttattattctcggcggagctgccatgtttggcctgattgatctgaagggcggagagcaggcgccgtttttgacacatttttatgaagacgggttatttccgaacggcataaaggcaatgctgattacgatgattactgtgaactttgcgtttcaggggactgagctgatcggggttgcagccggagaaagtgaagaccctgaaaaaacgattccgcggtccatcaaacagacagtatggagaacgcttgtgttctttgtgctttcaatcattgtcattgccggcatgattccgtggaaacaggcgggtgtcgtggaaagtccatttgttgccgtatttgagcaaatcggaatcccatatgcagctgatatcatgaactttgttattttaatcgcactgttatctgttgcgaactcaggtttatacgcatcaacacgtattctgtacgcgatggcgaatgaaggacaagccttcaaagcgcttggcaaaacaaatcagcgcggtgtaccgatgtactcgttaatcgtaacgatggctgtggcctgcctatcacttctgacaaagtttgcgcaggctgaaaccgtatatatggtactgttatctttggcgggcatgagcgcgcaggtcggctggattacgatctcgctttcccaaatcatgttcagacgcaaatatatccgtgagggcgggaagatagaagatttgaaatttaaaacaccgctgtacccggtgcttccgctgatcggcctaacgttaaatacggtcgtgctcatcagtcttgcatttgatccggagcagcgtatcgcgctgtattgcggcgtaccgtttatgatcatttgctacatcatttatcatgtcgtcattaaaaaacgccagcaggcaaatcgtcagctagagctttaa

SEQ ID NO: 47070 - DNA, 1206 bp, Bacillus subtilis
atgacagctttatctaaatccaaagaaattattgatcagacgtctcattacggagccaacaattatcacccgctcccgattgttatttctgaagcgctgggtgcttgggtaaaggacccggaaggcaatgaatatatggatatgctgagtgcttactctgcggtaaaccaggggcacagacacccgaaaatcattcaggcattaaaggatcaggctgataaaatcaccctcacgtcacgcgcgtttcataacgatcagcttgggccgttttacgaaaaaacagctaaactgacaggcaaagagatgattctgccgatgaatacaggagccgaagcggttgaatccgcggtgaaagcggcgagacgctgggcgtatgaagtgaagggcgtagctgacaatcaagcggaaattatcgcatgtgtcgggaacttccacggccgcacgatgctggcggtatctctttcttctgaagaggaatataaacgaggattcggcccgatgcttccaggaatcaaactcattccttacggcgatgtggaagcgcttcgacaggccattacgccgaatacagcggcattcttgtttgaaccgattcaaggcgaagcgggcattgtgattccgcctgaaggatttttacaggaagcggcggcgatttgtaaggaagagaatgtcttgtttattgcggatgaaattcagacgggtctcggacgtacaggcaagacgtttgcctgtgactgggacggcattgttccggatatgtatatcttgggcaaagcgcttggcggcggtgtgttcccgatctcttgcattgcggcggaccgcgagatcctaggcgtgtttaaccctggctcacacggctcaacatttggtggaaacccgcttgcatgtgcagtgtctatcgcttcattagaagtgctggaggatgaaaagctggcggatcgttctcttgaacttggtgaatactttaaaagcgagcttgagagtattgacagccctgtcattaaagaagtccgcggcagagggctgtttatcggtgtggaattgactgaagcggcacgtccgtattgtgagcgtttgaaggaagagggacttttatgcaaggaaacgcatgatacagtcattcgttttgcaccgccattaatcatttccaaagaggacttggattgggcgatagagaaaattaagcacgtgctgcgaaacgcataa

SEQ ID NO: 47071 - DNA, 1293 bp, Bacillus subtilis
atgtcttcagtagttgtagtaggtacgcaatggggcgatgaaggaaaaggtaaaattacagatttcctatcagaaaatgcagaagtgatcgcccgttatcaaggcggaaataacgcagggcatacaatcaagtttgacggaatcacatataagcttcacttaatcccgtctggaattttctataaggataaaacgtgtgtaatcggaaacggaatggttgtagatccgaaagcattagtcacagagcttgcgtatcttcatgagcgcaacgtgagtacagataacctgagaatcagcaacagagctcacgtcattctgccgtatcatttgaaattggatgaagtggaagaagagcgtaaaggggctaacaagatcggcacaacgaaaaaaggaatcggccctgcttacatggataaagcagcccgcatcggaattcgcatcgcggatctgttagaccgtgacgcgtttgcggaaaagcttgagcgcaatcttgaagaaaaaaaccgtcttctcgagaaaatgtacgagacagaagggtttaaacttgaggatatcttagacgaatattatgagtacggacagcagattaaaaagtatgtttgcgatacatctgttgtcttaaacgatgctcttgatgaagggcgccgtgtattatttgaaggcgcacaaggggttatgctcgatatcgaccaaggaacatacccgtttgttacgtcatctaacccggttgccggcggtgtcacgatcggttctggtgtcggcccgaccaaaatcaagcacgttgtcggtgtatcaaaagcatatacgactcgtgtcggcgacggtccttttccgactgagctgaaagatgaaatcggcgatcaaatccgtgaagtcggacgcgaatatggaacaacaacaggccgcccgcgccgtgtcggctggtttgacagcgttgttgtccgccacgcccgccgtgtgagcggaattacagatctttctctgaactcaattgacgtcctagcaggaattgaaacgttgaaaatctgtgtggcgtaccgctacaaaggcgaaatcattgaagaattcccagcaagtcttaaggcacttgctgaatgtgagccggtatatgaagaaatgccgggctggactgaggatattacaggtgcgaagagcttgagcgagcttccggaaaatgcgcgccattatcttgagcgtgtgtctcagctgacaggcattccgctttctattttctctgtcggtccagaccgctcacaaacaaatgtccttcgcagtgtgtaccgtgcgaactaa

SEQ ID NO: 47072 - DNA, 1356 bp, Bacillus subtilis
atgaatacgatcttcaaacaaaagaatacacatcctttctcaaacgcagcgaatcgtttagaccgccttccgatttcacgcgttcatttccaagtgttaaccgctctcggcattgtttatttctttgatctcgcagatttatttaccctcagcaacgtagcgccggcactgatcgagcattggggcatcccgctttcaactattgctaacgtaacggccgcttcgtttttaggcatgtttttaggcgcttcactgggcggacggctgtccgatcgaatcggccgcaaaaaagccttaaatctatttgtctttgttttctcaatcgcatcgctatgcaatgctgcggcatgggacattccatctttaatgacattccgtttcctcaccggatttggcgttgcagccgccatggtcattacggatagctatttggcggaatttttcccttcaagtgtacgtggaaaatatatttctttttgtgccatgattggattgattggggttccgatcaccaacattgtgtctgcctttgtcattcctcttggttcatggggatggaggctagtatttgtatggggtgccgtcggccttatttattttttcttcatccaccgtctggaagagtcacctcgctggcacgaaaatcgcggggaatatgcgaaagccgatgcgatcctcacccgaattgaagaacaggttgaaaaggagaaaggcccgcttccggcagcatcccagcctaaagtaagcgaaactgttaagcagaatgcaggttacgcaggcttattgaaaggcagaaacctcaaaattaccatcgtattatctgctgtatggatttttgaaacgtttgggttttacggatttgcttcatgggttccaagcctgctaaaaagcaatggcgtaaccatggaaaatacattatggtataacgtattgcattccgtcggcgctccacttggcgcactgctcggctccatgatttccgaaagatttcaaagaaaatggattttagctgcgagtgcgtttctgacggccatcgccgggctcttatatggtatgacttttattcccatcatgatcattgtatttggttttatcgtgaatatcacagaacgggtctttacctcgaacttatacgcctatacatctgaaccttatccgactgaataccgctcgtctggcagcggtttagcctatggtcttggccgtttttcaaacatttttggctcattgcttgtcggatttattgccgttcagctcggctatatcagcgtcttcttatttattgggggctgttggctcgcatgctccttgctgttaatcttcttcggtcctaatacgaatgcaaaacagatttaa

SEQ ID NO: 47073 - DNA, 759 bp, Bacillus subtilis
atgaagttgatttcatggaatgtaaacggcctgcgggctgtgatgagaaaaatggatttcctctcttatttgaaagaagaggatgcagatattatatgtcttcaggaaacgaagatacaggacggccaggttgatctccagcctgaagactatcatgtgtactggaattatgcagtgaaaaaaggatattccggcacagctgttttttctaagcaagaaccgctgcaggtcatctacggtatcggagtagaagagcatgaccaagaaggcagagtgattacgctggaatttgaaaacgtgtttgtgatgactgtttacacgcccaattccagaaggggattagagcggattgattaccgcatgcaatgggaagaggctttactgtcttatattcttgaattggatcagaaaaaaccagtgattttatgcggtgatttgaatgtagcccatcaggagattgacttgaaaaatccaaaggcgaaccggaataacgctggattttcagatcaagaaagagaggcattcactcgtttcttagaagctggctttgttgattcttttcgtcatgtttatcctgatcttgaaggcgcttattcctggtggtcgtatcgtgccggcgcccgggacagaaatattggatggcggattgattattttgttgtttctgaaagccttaaggaacagattgaagatgccagcatatcagcggacgtcatgggttccgaccattgtcctgttgaacttatcatcaatatatga

SEQ ID NO: 47074 - DNA, 2004 bp, Bacillus subtilis
atgagcaaagtgcatcagtcggcatgtccgctgaattgttgggacagctgcggctttttggtgactgttgatgatggaaaggtaacaaaagtggacggagatccaaaccatccgattacggaaggtaaaatctgcggccgcggcagaatgcttgagacaaaaacaaattcgcctgatcggcttcgctatccaatgaaaaaacaaaatggcgagtttgtgcggatttcttgggagcaggcacttgatgaaattgccgataaacttcgggaaatcaaggaaacgtcggagacgactgctgttttgcacagccatgattatgcgaataacggtctgttaaaagcgcttgatcagcgtttttttaatggatatggcggcgtgaccgaaatcgtcggaagcatatgctggggctccggtatcgaggcgcaaagctgggattttggccgttcgtacggtcacggaccgcttgatatttacaacagcaagcatgttgttgtgtggggaagaaatgtatcaagaacaaatatgcacttataccatcacttgcagcaggtgaaaaagaagggcgccacgattacggtgattgatccgatcttcaacccgactgctaagcttgccgaccgctatatctctgtaaagcctggaatggacggctggcttgcggcagccgttttgaaggttctgattgagatgggaagaacggatgaaacgtttatttctgagcattctgtcggttttgatgatgtgaaagagcttttgaagaccgtttctctggaagagtttattgtgaaaacagaaacttctatggaggagctggagtatttggcaggtttgtatgctgatggtccggtgtctacttttatggggcttggcatgcagcgatataaaaacggcgggggaacgattcgttggattgatgcacttgtggcggcaagcggaaatgtcggaattaagggcggcggcgcgaatttcggaaatgtccagattggtgagagctttgcaaaaacaaagctgacgctgccggaattaaaaacaacatcccgttctttttcaatgatgacacaggctgaagaagtgttgaccgctgctgatcctgcgattgagatgattattgtgacgtgcggaaatccgctgactcaggtgccgaatacaaataaggtgagacaagcatttgaaaaggttccaatgacggtcgcgattgattccattatgacggataccgcagagctgtgtgattatgttttgccgactgccactgtttttgaagaagaagatatctactattccagtatgtatcatcattatgttcagtacgggaagaagcttgtggagccgcagggtgaagcgaaatcggacagctggatctggtcagagcttgcaaaacgtcttgggtttggcgagctgtttgaatacagcactcaagaatttttagagatggggctttcttcattggaagcagaggatgtgacacttgagcgtttaaaagaaaaaggccacctccctcttccagtaaaacaggtgccgtgggatgattatcagtttttgacgccgagtggaaaatttgaatttacttcgtcgctagctgagcaaaaaggatttagcggctcgcttcaattaaatgtgcccgaagaatctgttttccataatgaggagttagctggaaagtacccttatacgctcttatccattcatccgcagcgttccaatcattcacagcatgtgccgtttattgaaaagcttcagcacgttcaggtcgatatttctccagatatagcggctgggcaggatcttcaggatggagacgaagttgtcatctttaatgaccgcggaagcatgaagggcaaggtgaaagtgatgaagcaggctcatgcgaagacgattaatatagatgaaggcatgtgggcggcttttggagggtcagtcaatgcactgacaaatgatacaaattctgataatggaatgggaagtacgctttttgactgtttagtaggcttgaaaaaagcataa

SEQ ID NO: 47075 - DNA, 1146 bp, Deinococcus radiodurans
ttgcccccagcggtccgtgtgccaggaggcctgaagttcatgattcaaccctttactgctgatcccatccgcttcgtggcggaagacgggcggcctgtgctggcgctgccggagcgttacaccccggcgctgctgcgtgagctgcaccgcctgatgctccagggccgcgaattcgaccgcaaactcatcaccctgctgcggcaggggcgcaccagcttctactcgcaggcgagcggcatggaggccacccagatcgggctggcgaaggccattcgcgccgggcacgactgggtgtggggctactaccgcgaccaggtgctcggcatgggcctcggcgtgccgatgttcacgctgatttcgcagtgtctgggctccaacaccgacgagtgccggggccgccagatgccgcaccacttttcctcgcgggcgcacaatttcgtctcggcaagcagctccatcgcctcgcaggtgccgcccgccgccggcaacgcgagggcgcaaaagtacctcggcaccgatgaaatcaccgtcgtgacctttggggacggcgcgaccagtgaaggcgactggcacaccggcatgaacatggcgggcgccatgcaggccccctgcctcttcgtgtgcgagaacaaccagtgggccatcagcacccacatccggcaccagaccgcctccgagaacatccacatcaaggcgaaggcctatgggatgcccggcttctacgtggacggcaacgatgtggtggccgtgatggaagtctgccaccacgccgccgaatgggtgcgggcgggcaatggccccgcgctggtcgagtgcctgacctaccgcgtcggctcgcactccaacgccgacgccgacgccgaaaagagctaccgcacccgcgacgaggtgaacgagtggctgggccgtgacccgattcagcgcgttgaaaacctgctcgaacacctcggcgaccccatcagcgccgaggaacgcgccggaatgattgccgaaatccacaagcagatcgacgacgacgtgcgccgcgccgaggccgccgggtatcccgactggcgcatcatgttcgaagacgtgtactccgacatgcccgaccacctgcggcagcaggcggcgatgctgcgcgaggagcagggaggcagcgcatga

SEQ ID NO: 47076 - DNA, 1035 bp, Deinococcus radiodurans
atgaccgcgacccaggagaaacaggcacaggggaagcaggcagggacggaacagcccgccgttcgcaccctcaacctcattcaggcgatcactgaggcgctggccgacgagctggagcgcgaccccaacgtggttctcttcggggaagacgtgggtgcgcgcggcggcgtgttcatggcgacggcgggcttgcaggaacgcttcggcaaaaagcgcgtgttcgacaccccgctcgccgagggttccatcgtcggcgcggcggtgggcatggcggtgcgcggcatgcgcccgattgccgagattcagtttgccgactacatcggccccggctttgaccagattctgagtcaggcggccaagattcgctaccgcagcggcgggcaattcagtgcgccgctcgtcatccgcactccgtcgggcggcggcgtgaagggcgggcaccaccacagccaaagccccgaggcgtactactgccacatggcgggcatcaaggtggtcatgccgagcacgccctacgacgccaagggcctgctcaaagccgccgttcgcagcgacgacccagtgatgttcttcgagcccaagcgcctttaccgcgctgccaagggcgaagtgcccgagcacgactacgtggtggaactcggcaaggcggccattcgccgcgagggcgacgacctctcgctcatcggctacggcggcgtgatgcccgacctggaacgggccgccgacgcgctcgccgccgagggcatcagcgtggaagtcatcgacctgcgctcgctggtgccgtgggaccgtccgctggtgcttcagagcgtggaaaaaacgggccgcgccgtgctcgtcagcgaggcgccgcgcatggcgaatttcatgggcgaggtggcctacaccattcagaacgaggccttcgattccctctcggctccggtgcagcaggtggcgggcttcgacacgccctatccctacattcaggacaagatttatctgccgggcgccaaccgcatcgtcgccgcctgcgtcaaggcgctgaactactag

SEQ ID NO: 47077 - DNA, 1578 bp, Deinococcus radiodurans
atgaaagaactgctgctgcccgaactcgccgaaagcgtcgtcgagggcgaaatcctgaaatggctggtggaggagggcgacgctattgccctcgaacagccgctgtgcgaagtgatgaccgacaaggtgaccgtcgaactgccgagcccctttgagggcacgctgcacaagcgcatggcgaacgagggcgacgtggtggccgtacacgccgtcatcgccctgatcgacgacggtgcgggtgccggggccggagcaataccaagtgctacccaggccattcaggacagcgccgagaacccgacgacgactgaagtgaccctgcctgcccaggcggaggaggagcgcgaggcgatgggcgggagcatcgtggaagccgggcacatcgccaaggccgacgacgactcgaccagcctcttcaagaccttcgccaacgacgaggaggtcaaggtgcagggcctcggcgcccgttctggcagtggcgcgcccggcagcagcacggcgggcaccgggacgctagaccgcgcaccggagactgcccccgcttcccctacgcctgccactgcgaacgggggccgcgtcctcgccgtccccgccgcgcgtcaggcggcccgcgagctcggcattgacctcgctgcggtgcgcggcagtggccccaacgggcgcattcgcgtggcggacgtgctcgcgcaccagcagagcgggcaggcccagccccagcaaacccagcctcaacaggcggcggcctctcaagcagtggcccctcagcctcaagccgccgctcccgctgccccggcacctgccggcaagctcgccgcgccctccgcgcacctgcccgccccggtgcagtaccgcacgcccaagggctacgaggaccgcgaaacccgtgtgccgctgcggggaatgcgccgcgcgattgccaaccagatgcaggcgtcgcacctctacaccgtccgcaccctgacggtggacgaagtgaacctgaccaaactggtcgagttccgccagcgcgtgaaggacgaggccaaggccgccgacgtgaagctgtcgtacctgcccttcatcttcaaggccattacggtggcgctgaaaaagtaccccagcctcaacacgtccttcgacgaggcgacgcaggaaatcgtccagaagagctactacaacctcggaatggccgtcgccaccgaagccgggctgacggtgccggtcatccgcgacgtggaccgcaagagcatcttcgacctcgcccgcgacgtggtggaccttgcgggccgcgccaacgcgggcaagctcagccccgacgaactcacgggcagctcgttcagcgtgaccaacatcggcagcatcggcgcgctgttttcgttccccattatcaacgtgcccgacgccgccatcatgggcgtccactccatcgtcaagcggcccatcgtggacgagcacgacaacatcaccgtggcccacatgatgtacctctcgctgtcgttcgaccaccgcctgatcgacggcgccgaagccgcccgcttctgcaaagaagtcatccggctgctcgaaaaccccgaccggctgatgctcgaagggttctga

SEQ ID NO: 47078 - DNA, 1218 bp, Deinococcus radiodurans
atgcctggaattgcaattgtcggtgcccagtggggcgatgaaggcaaggggaaaattgtcgattttctggcccccgaagccgagtacgtggtgcgctatcagggcggggccaacgcgggccacacggtcaacgcgaagggcaagaccttcaagctcaacctgctgcccagcggcgtgctgcacgagggcgcgaccagcatcctgggcgacgggatggtcatcgaccccgagaagttcatcgaggaacgccgcaacctgatggaaggcggcctgaacccgcgcctcaaaatcagtgaccgggcgcatatcgtgctgccgcaccacaagtatgtggacgggcgcaaggatttcgtcgggacgaccggcaagggcatcggccccgcctacgcggaccgggcgcggcgcgtgggcatccgcttcggcgacctcctcgacgaaggcgtgctgcgcgagcgcatcgagcgcctgctggaggccaagcccaactcgacgcgtgacgcgggctgggccaccgtcgaggatggcctgaagtcgctggcgcccatccgtgagcagctcgcgccgtttattgccgacaccggcagcgaactgcgtcaggccatcaaggacgggcgcaaggtgctgttcgagggcgcccaggccacgctcctcgacctcaactacggcacttaccccttcgtgacgagcagccaccccaccgtcggcggcattctggtcggcaccggggtcaaccacaaggcgctgcaccgcgtctacggcgtcgccaaggccttcaacacccgcgtcgggcacggcccctttgccactgaggtccacgacgaggcgggcattctgcgcctgcgcggcgacggctcgcagccctgggacgagtacggcacgaccaccgggcggccccggcgtgtcggctggctcgacctcgaactgctgaaatacgcggtggacgtgaacggccttgacgggctggtcatcaataagatggacattctgggcggcctcgacgagattcccgtctgcaccggctatgacgaaggcggtcagcccgtcttcaagaagatgaagggctggtcgagcaccgacggcgtaactagtcgcgcgacgctgccgaaagaagcgcaggcttacctcgacctcatcgaagacaccgtgcagtgccccgtcgtcatcttctcggcgggccctgagcgcgagaagacgtatggggaagtgcactgggggtga

SEQ ID NO: 47079 - DNA, 651 bp, Deinococcus radiodurans
ttgccgcaggcaaggggtgagggggccaccccgccaacgtctctccccaacccttccctcaaaggagtccccttgcccgacaacccgaacaacctcgaacccctcacccgtgagtggcttgccgccatcggcgaagacccggaccgtgaagggcttcagcgcacgccgcagcgcgtcgccaaagcctgggcgtacatgaccgagggctacgggcagacgctcgcgcaggtggtgggcgagggcgtgtttgccgccgagggcagcgagatggtcattgtcaaggacatcgagttttattcgatgtgcgagcaccacatgctgcctttttatggccgcgcccacgtcgcctacattcccggcacccggattctgggcctgagcaaattcgcccgcatcgtggacctctactcgcgccgcttgcaggtacaggagcggatcaccacgcaggtggccgacgctgtggaagagctgctggcccccaagggcgtggcggtgctgatggaaggcattcacctgtgcatggcgatgcgcggcgtgcaaaagcagaacagctccacgacgacctcggccatgcgcggcctcttccgttccgacccgcgcacccgcgccgagttcatgagcgctgtgcagggaacgctgcggggccgctaa

SEQ ID NO: 47080 - DNA, 822 bp, Deinococcus radiodurans
atgcttcccgctccccggtttgaccgtgacacccggctttgcatgagtctcgccgccgggcccggcaacttcggcacccgttttcacaattatctgtatgagttgctgggcctgaactacatgtacaaggcgttcaccacgcaggatttacctgctgccatcggcggcatccgggcgctggggattcgtgggtgcgcggtgagcatgccgttcaaggaagcggtgattccgctgctcgacgaactgatgccgtcggcggcggccatcgagtcggtgaacacgatcgtcaacgatgacggcgtgctgcgggcttataacaccgattacgaagccgttcgcctgctgattcgggaaaaagaactcgacccgtcctggcgtgtcggcgtgcgcggcagcggcggcatgggcaaggcggtggcgtcggcgctgcgggacgcgggctttgaaaacggcgtgctggtcgcccgcaacgaggcggcggggcgcgaactggccgggcggctgggctggcgctggacgcccgagccggaagctgccgacctgctggtcaacgtcacgcccatcggcatggcgggggggccggaggaacacgatctcagctttgcgccggagctgattgcccaggcccgcgccgtgttcgacgtggtggcgctgcccgccgaaacgccgctgattgccgaggcgcggcggcagggcaagcccgtcgtgaccggggaagaagtcgcggcacttcaggccctcgaacagttcgtgctctacacgggcgtgcggcccacgccggaacaggtgcaggcagcggcggcctgggcacggcaggggtaa

SEQ ID NO: 47081 - DNA, 921 bp, Deinococcus radiodurans
atgaacaagcccaagattttcattgacggtgaagccggaaccaccggcctgcaaatcagagagcgcctcgccgggcggagcgacctcgaactgctgagcatcgacccagtgcggcgcaaagacagcgcggcgcgggccgaactgctcaacgccgccgacgtctccatcctgtgcctgcacgatgacgcggcgcgggaagcggtaagcctcacgaccaacccagcttcgcggctgctggacgccagcaccgctcaccgcattcaccccgactgggtctttggctttcccgaactgagcgcagagcagccggagaaaatccggcaggcgcggtacgtggccaaccccggctgctacagcaccggcgcgattgcgctgctggccccgctgactgggcgcgggctgctgcccgccgactttccggtgcatattcagggctacagcggctacaccggcggcgggcgcgcgctggtagacgcccacgagcagggcagcgcgcacccatccaagggcgcgtttatcagttacggtctcacgctggagcacaagcacctgcccgagacgatggtgtacggcggcctgacccgcaagcccgtgttcacgccgaacgtgggcggctgggcgcaggggatgaccgtgacggttcccctgcatctggccgagctgggagtgagtgccgaggcgctgcacgccgcgctgaaggagcactacgccgggcaacagtacgtgaaggtcttcgagctggccgacaaccccgagattctcgacccgcagacgctgaacggcaccaacaacctcgaactgttcgtatacccggcggcggacggcgaacgcgccctgctcgccgcgcggctcgacaacctcggcaaaggggcgagtggcgcagcggtgcagaatctggagctgatgctcggcctatcctga

SEQ ID NO: 47082 - DNA, 1062 bp, Deinococcus radiodurans
atgaccactttggacaggggcggcgtatactttttccctatgacgaaggccgcccgttccagtaagaagtctgctccgtccgtgcccacccccgcgcaggcccggcttcacacgccggacaccctgccgcgcccggtgctggcgggccgcgactttctgagcaacctcgacatgacgtccgccgagttgcgggcagtcatggacaccgcgcactccatgaaggcgggcgagtggcgcgcggtcaagccgctctcggggctgtcgttggcgctggtcttcgagaaggcctccttacgcacccgcaccaccttcgatgtggggatgtaccagctcggcgggcacgccattaccctttccaacaccgaaatcggcctgggcacccgcgagcgcgtgagcgacgtggcgcgcaacctggagcgctgggtggacggcgtgatgggccgcgtgtacctgcaacagaccctggtggaactcgcgcagcatgcccgcattccggtcatcaacggcctgagcgacatgctgcacccggcgcaactgctcgccgactatcagaccatcgaggaagagttcgggcaggacctgcgcggcaagcgggtggtgtacatcggcgacggcaacaacctcgccaacagccacattcacatgggcatcctgaccggcaccgacgtgacggtggtgaccccggtaggctacgaacccaacgcgggcgtgctgatggacgcggtgaaggcgggcgtggaggtgcacctgaccaacgacctggacgccattcagggtgccgacgtgctgtacaccgacgtgtggatttcgatgggccaggaggccgaagccgacatccgccgccgggcttttaggggctatcaggtcacgccggagatgctggagaccatctcgcccgacggtatttttctgcattgtctgcccgcgcactacggtgaagaaaccgtgccggaagccaccgagcaccccaagagccgcgtcttcgaccaggccgagaaccgcctgcacgcgcaaaaggcgctgctctaccacgtgctgggcgacatgaagccgcgctggtaa

SEQ ID NO: 47083 - DNA, 1254 bp, Deinococcus radiodurans
atggcggacatcaaagttcctgttttttccgaatcggtcagcgaaggcacgctgctgacctggcataagaaacccggcgaagcggtcaagcgcggtgagctgctggccgaaatcgagaccgataaggtcgtgctggaagtcactgcccaacaagacggcgtgcttcagagcatcgccaagaacgagggcgacaccgtgctgagcgaagaagtgcttggcacgatgggcgagggcgacgcagcggccccggctcctgccgctcaggaccaggcgagcggcccagtggcgagcgaaaccaccgccggcggcacggcgcagcagcccgacagcaccggcacccagcctgccgcccagagcggtgagcgccgtgaagacctttcccctgctgtgcgcaagatcgtggaggaaaagggtctggacgtgtcgcaagttccagccaccggccccaagaacaacatcaccaaggcggacgcgatgggcgccagcgctcctgcacctgctgctcagcctgcaccccaggcagccaagtcggcggttgtgctgcccagcggcccccgtcccgaagagcgcgtgccgatgacgcgcatccgcgcccgcatcgccgagcgcctcaaggaagtgcagaacacggcggcgctgctcaccaccttcaacgaagtgaacatgcagcccaccatggagctgcgtaagaagtaccaggaccagttcgtgaagaagcacggcgtcaagctcggcttcatgagcctgttcgtacgcgcggccaccgaggccctcaaggccttcccgatggtgaacgccagcgtggacggcaaggacgtcatctaccacggctactacgacattggcatcgcggtggcgtctgagcgtggtctggtcgtgccgattctgcgcgacaccgacaacatgagcctcgccgacatcgagaagcagattgccgagttcgccacccgcgcccgcgctggcaagctgaccatggaagacatgagcggcggcaccttctccatcaccaacggcggcactttcggctccatgatgagcacccccatcatcaacgcgccgcagagcgccatcctgggaatgcacaacatcatcgagcgcccgattgcccagaacggtcaggtcgtgatcgccccgatgatgtacctcgccgtgtcctacgaccaccgcctgatcgacggcaaggaagcggtgcagttcctggtgatgatcaagaacctgctggaagacccggcgcgcatgttgctggacctctga

SEQ ID NO: 47084 - DNA, 1536 bp, Deinococcus radiodurans
atgccggattacgacctgatcgtcatgggcgcgggccacaacgcgctggtgactgctgcctacgccgcccgggcgggcctgaaagtcggcgtgttcgagcggcggcacctcgtcggcggggcggtcagcaccgaggaggtcgtgcccggttaccgcttcgactacggcggcagcgcccacatcctgattcggatgacgcccatcgtgcgcgaactcgaactcacgcggcacgggctgcattacctcgaagtggaccctatgtttcacgcttccgacggtgaaacgccctggttcattcaccgcgacgccgggcggaccatccgcgaactggacgaaaagtttcccgggcagggcgacgcctacgggcgctttctcgacgattggacacccttcgcgcgcgccgtggccgacctgttcaactcggcgccggggccgctcgacctgggcaaaatggtgatgcgcagcggccagggcaaggactggaacgagcagctcccgcgcatcctgcggccctacggcgacgtggcgcgcgagtacttcagcgaggagcgcgtgcgggctcccctgacctggatggcggcccagagcggccccccaccctcggacccgctgagcgcgccctttttgctgtggcacccgctctaccacgaaggcggcgtggcgcggcccaaaggcggcagcggcggcctgaccaaagccctgcgccgggccaccgaggccgaaggcggcgaggtcttcaccgacgcgccggtcaaggaaattctggtcaaggacggcaaggcgcagggcatccggctggaaagcggcgagacgtacaccgcccgcgccgtcgtgtcgggcgtccacatcctgaccactgcgaatgccctgcccgccgaatatgtccctagcgccgccaggaatgtgcgcgtgggcaacggcttcggcatgattttgcgcctcgccctcagtgaaaaagtcaaataccgtcaccacaccgagcccgactcacgcatcggcctgggattgctgatcaaaaacgagcggcaaatcatgcagggctacggcgaatacctcgccgggcagcccaccaccgacccgcccctcgtcgccatgagcttcagcgcggtggacgactcgctcgccccaccgaacggcgacgtgttgtggctgtgggcgcagtactaccccttcgagctcgccaccgggagctgggaaacgcgcaccgccgaagcgcgggagaacatcctgcgggcctttgagcactacgcgccgggcacccgcgacacgattgtgggcgaactcgtgcagacgccgcagtggctggaaaccaacctcggcctgcaccggggcaacgtgatgcacctggaaatgtccttcgaccagatgttctccttccgcccctggctgaaagcgagccagtaccgctggccgggcgtgcaggggctgtacctcaccggcgccagcacccaccccggcggaggcatcatgggcgcctcgggacgcaacgcggcgcgggtcatcgtgaaggacctgacgcggaggcgctggaaatga

SEQ ID NO: 47085 - DNA, 1752 bp, Deinococcus radiodurans
atggctgccccttcccctaccctgaccgtgttacgaacttacctggggccgctccggggcgcggtggcggccctcgccgcgctgctgctcgtcggcacggggctgaacctgctgctgccgcaactgctttcgcgcttcgtggacgccgccaagctgggggcacaggccgacgtggcgctgctggtgcgcctcgccgtgacctacctcgtgctcgctgtgggcgtgcaactgctgagcgccggggcgacgtacctgggggcgcgggtgggctggcaggcgaccaaccggctgcgcgccgacctgaccgcgcacctgctgtcactcgacatgcaggaacacaaggaacgcacgcccggcgagatgatcgagcgcatcgacggcgacgtgacggccctgagcaacttcttctcgcagttcgcggtgagggtgttcggggccgcgctgctgctgaccggcgcggtggtcatgttctggcgcaccgactggcgggtgggagcgggcgtaaccgtcttcgtggccctgacgctgtgggcgatgaaccgcgtccgcaagggcggcgtggaacctacgcagcaggagcgcgaggcgagtgccaagctgttcggctacgtggaggagcggctcgccgggctcgacgatgtgcgctcgctcggcgcgggcgagtaccacctgcgcgggttcctgaaggtgcagcgcgagtttttcagccgctccatcttttcctggcggcgccgggcggtggtgtggcaactgagcatggcgctctttgccgtgggctacgtggcgctgctcgcctcggcggtggggctctacgcggcgggggccatcacgctcggcaccgccttcgcgctctaccagtacatgacgatggtggaagaacccattgatcagctcaccaaccagttgcaggacctgcaaaaagcgggggcgagcgtgatgagggtgggcgaactgctcgcgctgcggtcgcacctgccggaaggaacgcgcgagttgccccccggcccgctcgacctgcgctttgaccatgtgggcttcagctacggcggcgcagagggcacccctgtcctgcgggacgtggacctgacgctggaggctgggcagacgctggggctgctggggcgcactggcagcggcaaaacgacgctgacccgtctggtgtcgcgcctctacgaccccaccagcggcagcgtgcgcctcggcggcgtggacacccgcgacgtgaccctcgccagcctgcgctcgcgggtggcagtagtgacgcaggacgtgcagctgtttcaggcgagcgtgcgcgacaacctcagctttttcgacgagggcgtgagcgacgcgcaggtggaggcggcgctggccgaagtcggcctgggcgactggctttcgcgcctgccggaaggggtccgcacgccgctgcccgccggaagcctcagcgcggggcaggcgcaactgcttgcctttgcccgtgtgatgctgcgcgaccccgccgtcatcatcctcgacgagccgagcagccgcctcgaccccgccaccgaagcccagctcaccgccgccatgacccggctgctcgcgggccgcaccgccatcgtcatcgcccaccggctcgataccgtggcccgcgccgaccgcatcgtggtgctgggagccggtgaggtgctggaagacggtgcccgcaccgacctcgcccgcgatccgcgcagccactacgccggtctgctgcgcgccgggcgggaagccgaagcggtgctggcatga

SEQ ID NO: 47086 - DNA, 1023 bp, Deinococcus radiodurans
ttggacggggtatacaaagggaaaccatttctttgctggaagcggctgttctgcctcggcagacacagcgtgtacctgcggcggctgttcggcataggccgatgctcaacgctttcaggacgtttccactctcgccctttccacgttcccacaccccggaggttttctatgacccagtcctcacccaaccgccccgccgaccccgccaccacctttcgtcccgacctgctcgcgggcaagcacgcgctgattaccggcggcgggagcggcatcaacctcggcatcgcgcagagcttcgcggcgcacggctgcgcggtgacgattctcgggcgcaacctggaaaaggcgcaaaacgccgcgcagggcatcgtggacgcgggcggacgggcgatgggcgtcagcgccgacgtgcgcgactttgcggcgctggaagcggctgtggcggcggccaccgctgagttcggtgacttcgatatcgtgctggcgggggcggcgggcaactttccggcgccggtggacggcatcagccccaatgggttcaagacggtggtggacattgacctgctcggcacctacaacaccatcaaggccgccgcgccacgcctgaaggtgccgggcggcaacatcctcagcatcagcgcctacggcgtgccggtgccgatgcaggcgcatgtggtcgccgccaaagccggggtggacgccctgacccagaccctcgccgtggagtggggcctgcgcggtgtgcgcgtcaacgcgattattcccggccccatcgacggcaccgaaggcatggcccgcctcgcccccgacgaaaagtcgcgctctgccttcacccgcaccgtgccgctgggccgcttcggcgtgccgcaggacatcgccaacgccgcgctgtttctggtgagcgacgccgcgagctacgtgaccggcgtgattttgccggtggacggcggccagaacatgctcggcggggcgccgcagtaccagatgtaccttcagatgcaggcggcgcagcaaaaggactga

SEQ ID NO: 47087 - DNA, 1338 bp, Deinococcus radiodurans
atgttcaagaaaatcctgatcgccaaccgtggcgagatcgccctgcgcgtcatccggacggcgcgggaaatgggcatccagacggtcgtggtgtattccaccgccgacgaaaagagcctgccggtgctgctcgccgacgaatcggtctgcgtggggccgcccgcttcaaatcagagctacctcaacatccccaacatcctctcggcggcgctgatgaccggcgccgaggcgattcaccccggctacggcttcatggccgagaaccccgacttcgccgagatgtgccgcgagcacggcatcgtgtttatcgggccgacgccggaaagtatgcgggcgctgggcagcaaagcgggcggacgcgaaatcgccgcacagagcaatgtgcccaccgtgccgggcactggcgtgctggaaagcgtggacgctgcgctgctcgccgccaagcagatcggctacccggtgctgctcaaggccagcgcgggcggcggcggacgcggccagaaagtgattcgcacccaggaagagctgcaaaagggcttcaatcaggcgcaggaagaagcgcggctgtacttcggcgacccggcgatcatcatggagaaattcctggaggagttccgccacatcgaggtgcaggtgatgggcgacggccaggggcacgtcatccacatcggcgagcgcgactgttcgattcagcgccgcaaccagaagctgatcgaggaagcgccctccacgctgcccgagtcgctgcgtcaggaaatcctcgccgccggggtgcgcctcgcccagttcgtgaactacgcgggcgccggcacgctggaattcatcatggaccgcgacggcaactactacttcatggagatgaacacccgcattcaggtcgagcactgcgtgtcggaaatgatttccagcctcgacctcgtgcgcctgcaaatcgaaattgccgccggcctgggcctcaacattcagcaggacgacgtgaagttgcacggccacgccatcgagtgccgcatcaacgccgaggaccccgacaaggacttccgcccggcagccggcaaaatcgacgacgcgcacttcgcgggcggagcgggcgtgcgggtggacacccacgtctacagcggctactcgatcccgccgcactacgactcgctgatcggcaaactgatcgtgtggcacgaggaccgcgacaaggcggtgtcgcgcatgaaacgggcgctggaagaaaccgtgattcaggggccgaagacgaccattccgctctacatcaagatcatggacaacccgttctacaaacgcggcgcggtgatgaccaacttcctgaagacgcgcatggagatgtag

SEQ ID NO: 47088 - DNA, 627 bp, Deinococcus radiodurans
gtgagtgagggcaaagtcagggtcaaggtctgcggcaccaccaccctccccgacgccctgcacgccgccgcagcgggggccgacgcgctgggcttcatcttcgcgccgggcagcaagcgacgggtcacggcaagccaggcccgcggcatcagcctgaacgtggggccgagcgtggcgcgcataggcgttttcatggggcagtcactcgacgaggtgctgcggacggcggaggcggcgcgggtcagcgcggtgcagctgcacggcccgctgccgggggtatacgtggcggcggtggccgggtattatcccgtcttgcgcgttctgggcccggaggagcttcaggccgggaacgtgcaggccgcaactgtgcaggcaacccccggcgtcaccctgatgctcgacgccccgcagcccggcagcgggcagccgctcgactgggcggcgctggtcccccactttccgccgggcagctggctcgcgggcggtctgggaccggacaacgtggcgcaggccatcgccacgctgcggcccgccggggtggacgcggtgagccggctcgaagcctcgcccggcctcaagaatccacaggccgtcgaagcgttcatagacgccgtaaaacgctcgtaa

SEQ ID NO: 47089 - DNA, 1887 bp, Deinococcus radiodurans
atggctaaagctgtcggaatcgatttgggtaccaccaactccgtgatcgctgtgatggaaggcggtcgccccgaagtgatcgtcaacgccgaaggcggacgcaccaccccctcggtcgtcgcgtacaagggcgacgaaattctggtcgggcagattgcccgccgtcaggctgcgctcaaccccgccgccacgctgttcgaagtcaagcgcttcattggccgccgctgggacgaagtgaaggaagaagcggcccgtagcccctttaccgtcaaggaaggcccgagcggcagcgtccgtatcgaagtgaacggcaaggacctcgcccccgagcaggtcagcgccgaagtgctgcgcaagctggtgagcgacgcctccgccaagctgggcaacaagatcaccgacgccgtgatcaccgtgccggcctacttcgacaacagccagcgtgaagccacccgtcaggcgggcgaaatcgcgggtctgaacgtgctgcgcgtgatcaacgaacccaccgccgccgcgctggcctacggcctggagcgcaagggcaacgaaactgtgctggtcttcgacctggggggcggcaccttcgacgtaaccatcctcgaactgggcgacggcgtgttcgaagtgaaatccaccgccggtgacacccacctcggcggcgcggacttcgactaccgcatcgtggactggctggcgggcgagttccagaaggaacacaacttcgacctgcgtaaggacaagcaggccctgcaacgcctgatcgaagccgccgaaaaggccaagatcgacctgtcgaacgccagtgaaacgagcatctccctgcccttcatcaccttcgaccccgaaacccgcacccccatgcacctggaacgctcgctctcgcgggccaagttcgaggaactgaccgccgacctgctgcgccgcgtgcgccagcctgtcgaacaggccctgagcgacgccaagctgagcgccggtgatatcaacgaagtgattctggtcggtggctcgacccgtatccccgccgtcaagcgcatcgtgcaggacctggtgggcaagacccccaacgagtcggtcaaccccgacgaagccgtggccctcggcgccgccgtgcaggctgggattattcagggcgacagcagcctgggtgacatcgtcctcgtggacgtgaccccgctgacgctgggtgtggaagtcaagggcggcatgatcgccccgatgatcacccgcaacaccaccgtgcctgccaagaagaccgagatctacaccaccgccgagaacaaccagccgggcgtggaaatcaacgtgctgcaaggtgaacgccccatggctgccgacaacaagagcctgggccgcttcaagctcgaaggcattccgcccatgcccgccggacgcgcgcagatcgaagtgaccttcgacatcgacgccaacgggattctgcacgtcaccgccaaggaaaagaccagcggcaaggaatcgagcatcaccatcgaaaacaccacgaccctcgacaagaccgacgtggaacgcatggtgcaggaagccgagcagaacgccgccgccgacaagcagcgtaaggaaaaggtcgaaaagcgcaacaacctcgacagcctccgcgtgcaggccgtgcagcagctcgaagagcaggaaggcgccgctcaggacgccaaggatcgcctgaaggctgccgctgacgaagccgaagaagccgtccgcagcgaagacgacagcaagattgctgacgcccagaagaagctggaagaagaactccgctccttcatgaccgccaaccaggcgagcacgcagggccagccggaaggcacccaggcccaggcgaacaaagccgacgacgacgtaatcgacgccgactttaagcccgctgagtaa

SEQ ID NO: 47090 - DNA, 1821 bp, Deinococcus radiodurans
ttgagccagcctgcccagccctccgtcacccgccgcctctacgggctgcttacgccctaccgtaccgccgtgggggcggggctgctcctgctgctcggcagtgtggccgccgaactctacccgccgctggtgtggattcgggtggtggaccaggggattccggcgcgcgattggggacttatcggcggacagctcgccgtgcttgtcggcgtgtttgccctgcaacaagtgctcagcgcatggcggggggtgctgctggaacgggccgggcaacagtttacgctcgacctgcggactgccgtgtatcgcaaattgcagtcgcagtccgccgactacttcgagacgcagcggaccggcgacctgctcgtccgggtgaccggcgacgtggacgcgctgcaagacgtgctggtgcgcggcaccgattcggtgattgccaacgcgctgcgcctcgtcggcgtcatcggcattttcatcgccctgcaaccgctgctcggcgtgctgaccaccctgccgatgctggcggtggggcttctactgtggaattacggcaagaccgtgcgccccgcctaccgcgccgcccgcgcccggcttggcgaactctcggcgctcattgccgaccggctcgcgggcatccgggtggtgcagggctttgcgcgtgaggaagcggaagcggcccgcgtagaggcgctcgggcgcgaactgtaccgcgagcaggcgcgcgccgtcgcgctgcgcaaccgggcctttcccgtcgcccgcttcgtcggcaacctcggcaacgtcatcatgctcggcggcggcgcgtggctgattctggcggggcagttcaccctcggcggcctgctcgcctaccggggctacgggcgctatttctacggcccgattgacgacctcgtgaacatttccgacctgctgcaacgcgccgaagccgccgggcgccgggtcttcgcggtgctcgacgccccggtaacggtggctgaccccgcgcaccccaagcctttgcccactcccgtgcgcggcgaattgcacttcgacaacgtgacctttggctacgactcagccagctacgactccgccagttctgaccccactcagcccattctgcgcggtgtcaccctgcacattccggcggggcagcgcgtcgccctgcttggggcgtcgggggcaggcaaaagcacgctgctcgggctcgtcacgcgccagcacgacccccagtcgggccgggtactcctagacggcgtggacgtgcgcgacgtggccctcgccgagctgcggacggcggcggcggtgatgccgcaggacaccttcctctttcacgacacggtgctggaaaacgtgcgctacgcccgccccgacgcggcgctcgccgaggtggaggaggcgctgcgggccgcctacgcgctggacttcgtgcgggcgctgccgcaggggctggagacgctggtgggggagcgcggcgtgcggctctcgggcggtcagcgccagcgcctcgccattgcccgcacgctgcttgcccggcccgcgctgctgctgcttgacgaacccacgagcgcggtggacgccgagtccgaggcgcaggtggtcgccgccctgaatgacctgatgcagggccgcacctcgctcacggtgacccaccgcctgagcctcgcccgcgccgccgaccgggtgctggtgctcgacggcggcgtggtggtggaagacggcccgcccgcgctgctcaggacgcgcggcggcccctacgcccggctcgaacaggtggccgagcggctcgaacgcggcgaggtggcggtgatttcagaagttgtcaactcctcactgtaa

SEQ ID NO: 47091 - DNA, 255 bp, Deinococcus radiodurans
atgaattttgaacaggcccagcaggaagtcaacaccctgtcgaagaagcccggcaacgacgtgctcctcaagctctacgccctttacaagcagggcagcgcgggcgacgtggacggcaagcgccccggcggcttcgatttcgtcggcggcgccaagtacgatgcctgggccggcctcaagggcaaaacccaggaacaggcccagcaggaatacgtcgccctggtcgaagaactgaaggcgaaagacgggcagtaa

SEQ ID NO: 47092 - DNA, 1065 bp, Deinococcus radiodurans
ttgccttcgccttctggcgggtgggggtgcggcggtacgtgggcacggggagttgatggtgctcgtcttttctccatccaccatcaggccgtcaggccgaacctctccaccatctcccctccgaaggagccacccatgattgaagtgcgccacctgtgcaagtcgttcgcccgcaaacccgccgtgcaggacatttcgttttccattccggcgggcgaaatcgtggggtatctggggccgaacggagcgggcaaatccaccaccatcaaggtgctgaccgggctgctggtgcccgactccggcgaggtgcgggtgggcggtttggtgccgtggaaacagcggcggcagcatgtggcgcggctgggcgcggtgttcgggcagcgcacgacgctgtggtgggacctgccggtgcgcgagtcgctggagttgctgcggcatgtgtaccgcgtgcccgctgcccgttttgccgagaacctcgccggctttaccgagctgctggagctggggccgtttctgaacaccccggcgcgggcgctctcgttggggcagcggatgcgggccgacctcgcggcggcgctgctacacgaccccgaactgctgtttctggacgaaccgacggtggggctggacgtggtggcaaaggagcgcatccgcgaatttgtcaaagcggtcaatgccgagcgcggcgtcaccgtgctgctcaccacccacgacctcggcgacgtggagcggctcgcgcgccgggtgatgatgattgacaccgggcggctgctgttcgacggcccgctcgcagagttgcaggcccgctacggcggcgagcgggaactgtgggtggaatttgaaaaagcccccgcgcagcccgccctgcccggcctcacgctgctggggcaagacggcccgcgcgtgcgctacggcttttccggggccgccgccgcgcccatcgcgcaggtgacggcgctggccccggtgcgcgacctcgccgtcaaggagccggaggtggaagcgaccatccggcggatttacgaggggaacctgctggggagcagaagcgtaagggagggatga

SEQ ID NO: 47093 - DNA, 861 bp, Deinococcus radiodurans
atggattacgccaaagacgtgttggtgagcaccgaatgggccgcgcagaacctccagacgccgggggtgcgctttatcgaggtggacgaggacatcctgctctacgaaaccggccacctgcccggcgccgtcaagctcgactggcagaccgacctgtggcacccggtggagcgcgatttcatcgagccgcagcaggtcagcgagttgctgggcaagctgggcatcaaggccgacgacaccatcgtcctctacggcgacaagagcaactggtgggcgagctacgcctactggttcctgacctacagcggcgtgagcaacctcaaaatcatgaacggcgggcgtcagaagtgggtcgccgaaggccgcgaaatgaccaccgaagcgcccaccgtcaccgcgaccacctaccccgccctgcaacgcgacgagtcgctgcgggcctaccgcgatgaagtgcgggcgcacctcgaaagcgtgaacaacggccagggcgcgatggtggacgtgcggagccccgacgagttctccggcaaggtcacccacatgcccaactacccgcaggaaggcgtgctgcgcggcggccacatccccggcgcccgtaacattccctgggcgaaggcgaccaacgaagacggcaccttcaagtccgccgacgagctgaaggcgctgtacgaaggcgaaggcgtgaccgccgacaaggacgtgatcgcctactgccgcatcgccgagcgctccagccacagctggttcgtgctgcgcgagctgctgggctaccccaaggtccgcaactacgacggctcgtggaccgaatggggcaacggcgtgggtctgcccatcgaaaagacctacagcgaggaataa

SEQ ID NO: 47094 - DNA, 1989 bp, Deinococcus radiodurans
gtgtgccccgcacggctccgaaccccgcgcacggcgagcctacctacccacaggaggagcgctatgacgactgccaatccgctcaacaccagctttacttccgccgacgccgccgaactctaccaggtgcccaactggtcgggcggctggttccgcgtgtccgacaagggcctgatggaggccacccccgcgccgggcctgcacgcctcgctgcgcgccatcgtggacgaaatcgtggaccggggcgagagcctgccggtcatcctgcgctttccgcaggtgctcgccggacgggtcaagcacctcaacgaggcgtttcaggccgccatcaacgagtacaactactccgggcattaccagggcgtgtttcccatcaaggtgaaccagcgccgcgccgtggtggagacggtggccgccgccgggtacgactacgcgcacgggctggaagcgggctccaaggccgagctcgcgctgtgcctcgcgcagaagatgcaccccgacgcgctgctgtgctgcaacggcttcaaggacgacgggttcatcaagctcgccctgtggggccggacgctgggcaagaacgtggtcatcaccatcgagaagttcaccgaactcgaccgcatcctcaagcaggcgaaggcgctcggggtcaagcccgctgtgggcgtgcgcttcaagctgcacgcccggggctcgggccagtgggaagagtcgggcggcgaccaggccaagttcggcctcaacgcctacgagctgctgcgggtggtcgagcggctcaaggaagagaacatgctcgactcgctggtgatgctgcacacccacatcgggtcgcaaatcaccgacattcgccgggtcaaggtggcggtgcgcgaggcggcgcagacctacgcgggcctcatcgcggcgggcgccgacctgaaatacctcaacgtgggcggcggcctcggcgtggactacgacggctccaagacgaccttctacgcctccatgaactacaccgtcaaggaatacgccgccgacatcgtgtacaccgtgcaggaggtgtgcaaggcgcgcgaagtgcccgagccggtcatcgtgtcggaatcggggcgggcgctcactgcgcaccacgccgtgctgattttgccggtggtggacgtgaccgggccgacgcgcaacctcgaagaccaggaactgacggtgccgggcgaggacagccaccagatcgtgcgcgacatgtacgagacgctggaaaacatctccatgcgtaactaccgggagtcctacaacgacgcggtgggcgacaagcagacgctgcacaacctcttcgacctcggctacgtgacccttgaggaccgggcgcgaggcgaggcgctattcaacgcgattctgcgcaagatcgccaagctgattcagggcgaaaagtatgtgcccgacgaactcgaagacctgcaaaaggtgctcgccgacaagttcatctgcaacttctcgctgtttcagagcctgcccgacaactgggccatcggggcgctgtttcccatcgtgccgctcgaccgcctgaacgaacaacccacccggcaggccacgctggtagacatcacctgcgacagtgatggcaaagtcgagaaattcatcgacctgcgcgacgtgaaggccaccttgccgctgcacgaacccggcgaccggccctactacctcggcgcgttcctgatgggcgcgtatcaggacgtgctcggcagcgcccacaacctcttcggcaaggtgagcgaggcgcacgtgacggtgcggcccggcggacgcttcaacatcgacctcttcgtgcgcggccagaaggcgcggcgcatgatcgagtcgatgggctacgaggagccgatgctgcgcgacgcgattgaggaccaggccgacgccgccatcgggcgcggcacgctgacgcaggagcaggagcacgagctgcttgaggactacggcgaggaactgctcggctacacctacctggagtacgaaagctga

SEQ ID NO: 47095 - DNA, 1854 bp, Deinococcus radiodurans
gtggccgctatggtttcgcacagttccccggttgatggtgcacccgtcagccgtccaaggagtcccgtcatggcaactgaactcaagctccccgatgtcggggacaacatcgaaaaaggcaccgtggtgacggtcctcgtcaaccctggcgacagcgtgaccgagggccagcccatcatcgaaatcgaaaccgacaaggccgtggtcgaagtcccggcaagcgcggcgggcaccatcgaagccgtgaacgtcaaagtgggcgacaccatcccggtgggcggcgtgattgctaccctgggcggcggcgcagccagcgcttccgattctgcccccagcgccagcgcaccctccccggccaacggcggcggcgatcaggcggcgaacgtggaatccacgccggccaccgacagcggcaccgcacagcgtgtggcccaggctcagcaggacgcccagaaagagcaggccgggcaacccacgagcggtggcactgccgatgcaaatcaggctcaggcaacgcccagcgaaggccagagcagcggcggccagcaggtcacgctgcccgacgtgggcgacaacatcgagaaggggacggtcgtgaccatcctcgttaatgtgggcgacaccgtcagcgaaggccagccggtcatcgaactcgaaaccgacaaggctgtcgtcgaagtcccggccaacgcgagcggcaccgtgcagagcgtggcggtcaagatcggcgactccatcccagtcggcggcaccatcttgacgctgagcggcgcggcttctacacaacctacggctcctgcacctgaaagtgctcaacccgcctcccagtcgcagcaaagcacccagcctgagccagctcgtcctgccggcgctccgcaagcccaggccgccgcacctcagcagtccggcacccagaacccccagaccttcgatggccgcccggtggttcccgctgcgcccagcgtgcgccgcctggcgcgtgaaatcggcattgacattcacgctgttcacggcaccggcatcgccggacgcatcagcgaagaagatgtacgccgcactgccggaacgcccagtgtgcaagcgcaggccagcgcagcaagcgccgctgctcccgcccctatggctgctcccctccccaacttcgagaagtggggcacggtccgccgcgaggacatgagcggcatccgtaaggccactgtccgcagcatgaccacggcctggacgaccatcccgatggtcacccacttcgacaaggccgacgtgaccgccatggaagaaacccgtaagcgctttggggcgcgggtggaaaaggaaggcggcaagctgaccatgacccacatcctgatgaaggtcgtggcgaacgccctgcgcaagttccccaagttcaacgccagcctcgacctcggcgccgaacaggtgatctacaaggagttcgtgaatatcggcgtggctgtggacactccggtgggcctgctggttccagtggtcaaagacgccgaccgcaaaggcatcaccgagctggtcctcgacctctccgaactcgctggccgcgcccgcgagcgcaaactcaagcccgacgaaatgcagggcgcgacgttcacgatctccaacctcggcggtatcggtgggaacgcttttacacccatcgtcaacagccccgaagtcgccatcctcggcgtctcccgtggcggctttgagccggtgtggaacaaggaaaagggcgagttcgagccgcgcaacatgctgccgctcagcctgacctacgaccatcgcttgattgacggcgccgacgctgcccggttcctgcgctacatctgtgagtccttggaagaccccttcctgatctcgctgtaa

SEQ ID NO: 47096 - DNA, 2163 bp, Deinococcus radiodurans
atgccctacaagtccctgaccctgcgtcccggttccccctttccgctgggggccacctgggacggcaaaggcaccaacttcgccctgtattccgaaaacgcgaccggcgtggagctgtgtctcttcgacgccgagggccatgaaacccggtttccgctgaccgagcagaccgccttcgtgtggcacggctacctgccgggcatccaaccgggccagcgctacggttaccgcgtgcacggcgaatatgccccggaaaagggcctgcgcttcaacccgaacgtggtgttgctcgacccctacgccaaggcgctcgacggcaccgagcagttcgaccggggcgtgttcggctacgtcgcgggcggcgaggacgactcgcagatgcaggaagaggagcagcgcggcgcgccgttgggcctcgtcgtggacccgatgttcaactgggtgggcgaccagaagccggggattccctttcaccagtcggtgatttacgaggcgcacgtcaagggcctgaccatgacccaccccgacgtgcccgaggagctgcgcggcacctacgcgggcgtggcgaccccggcgattctcgattacctgcgcgacctcggcatcaccgccatcgagtttctgccggtgcatcagcatgtggacgacccctttctgctcgacaagggcctgacgaactactggggctactcgacgctcaactttttcgcccccgacgtgcgctactccgctgaagcccgcaagggcaacccgtcgggcgcggtccccgagttcaagaacatggtgcgggcgctgcacgacgcaggcatcgaagtgattctggacgtggtgtacaaccacaccgccgaaggcaaccacatggggccgaccatgagcttcaaggggattgataaccccacctactaccgcctggtggccgacgaccagcgcttttacttcgactacaccggcaccggcaacagcctcaacgtccggcacccgcagacgctgcaactcatcatggactcgctgcgctactgggttaccgagatgcacgtggacggcttccgcttcgacctcgccagcacgctggcacgcggtctgcacgaagtggatcagctctcgggctttttcaccatcatccaccaggaccccatcatttcccaggtcaagctgattgccgagccgtgggacgtgggcgagggcggctatcaggtgggcaacttcccggtgaactgggccgagtggaacggcatttaccgcgacgacatgcgctcgttctggaagggcgagggcgggctggcgtccgaaatcggctaccgcatcaccggcagctccgacctctacgagttcaacgggcgcaagccgtatgcctccatcaacttcgtgaccgcccacgacggctttaccctgcgcgactcggtgacttacgaacaaaaacacaacgaggccaacggcgaaggcaacaacgacggccacaaccacaacatcacctggaactgcggggtggaaggcccaaccgacgaccccgaaatcaaccggctgcgcggccagcagatgcgcaacttcctggcgacgctgctgctcgggcagggcacgccgatgattctgggcggcgacgagttcggacgcacccagggcggcaacaacaacgcctactgccaggacaacgacatcagctggtacgactgggagaaggtagatgaggagctgctcgccttcacccggaaactgattgcgctgcgcaaggcccaccccagcttgcaccgccgcaagttcttcgcgggccgtaacattcgcggcgaggacgtgcgcgacatcgtgtggctgcgcttcgacggggccgaaatgagcgacgaggactggaacaacccccaaacccagtcgctcggcatgttcctcgcgggcgacggcctggccgacgtggacgccgagggcaagccgctgaccgacgaccacctgctgctgctgctgagcagctcgtatgtggacctgcccttcaagatgcccgacctcggcggctgcggcgagtgggacctgctgctcgacaccagcgacgacggggccgaggaaaaagtcgcggcgggcggcgaaaccaccttgcggggccgcagcgtcaagctctaccgctgccaggtgcccgaaaaggaactggaaaagctcgcggagcccgctgaagcctga

SEQ ID NO: 47097 - DNA, 2871 bp, Deinococcus radiodurans
atgacccagtcgcacgacgagccgatgcagacgatgatgtggggtggcaacgccgccttcatcgaagggctgtacgagagttaccttcaggatccttcctcggtgggcgccgagtggcgcagctatttcgacgggctgcgcggcggcgcccaggagcgcgttcacagtgaagtgcagcagcgcttctacgagctcggccagcaccggggccccgtcaccgtgcaggtgaccggcggcgcgagcggtgcccagcaggcggcgggcgccctcgtgaccgcctaccgcgtctacgggcacatcagcgcccgcaacaacccgctcaagctgcgcggcgtgcccaccgtgcccgagctgacccccgagttctatgggctctccgaggccgacctcagcgaacaggtgcaggacagccccttcagcggcaccctgcgggacgtcatcgcgcagctgcaagacacctactgcggcgccatcggtttcgagtacaactacctgccggccaacgaacgcgcctggtttcaggagcgcatcgagaaggggcgcggtcagggccgctacggcctgagccaggatgagcgccgccgcctgatgcaaaagctcaacgccgccgaaggcctggagctgtacctcaagaaccgctaccccggcgtcaagcgcttcggtctggaaggcggcgagagctttattccgctgatggaccgcatcatccagcaggccggcgggcgctacggcgtcaaggaagtcgtggtgggcatggcgcaccgtggccgcctgaacacgctcgtcaacatcttcggcaagccctcgggcacgctgttcgacgagttcgacggcaaaaagaaactcagcgacgaccccgatatcgcgggcgacgtgaagtaccacatgggctactccagcgacgtgcggacccccggcggcccgatgcacctcgctatggccttcaacccctcgcacctcgaaatcgtgtcgcccgtcgtgcacggctcggtgcgcgcccggcaggaccgccgcggcgacaccgagcgcaagcaggtgttgccgattaccgtgcacggcgacgccgccgtctcggggcagggcgtggtcatggagacgctgaacttctcgcgtctgcgcggcttcacgaccggcggggcgattcgtatcgtcatcaacaaccagatcggctttaccatctccgacccgcgcgacagccgctcgagccgctactgcaccgatgtcgccaagatcgccaacgcgccggtcatgcacgtcaacggcgacgaccccgaagcggtggccttctgcggggacctcgcgctcgcctaccggcaggaattcggcaaggacgtgttcatcgacctgatctgctttcgccgcaacggccacaacgaaggcgacgagccgcgcatgacccagccggtcatgtaccgcgaaatcgaccagcaccccggcacccgcgccctctacgccgcccagctggaaaaagacggtgtgctcgctgccggtgaaggcgacaagctggtgaacgacttccgcgaccgcctcgaccggggtgagaccgtcgtggaagagatggaaaacgccgagcagagcaagctcgcggtggactggagcggctacacgaacacccactggaaggacgacgaggtggcgaccgccgtgccgcgcgagaagctcgaggcgctcggcctgaagctgacgcaggtgcccgagggcttccgcgtgcaccgcaccgtcgagcgcaccgtcatcaaggcgcgtgaagcgatggccaggggcgagcagccgctcgactggggcatgggcgaaatgctggcctacgcctcgctgctcgacgagggctttggcctgcgcctcgacgggcaggactcggggcgcggcacctttgtgcaccgccacgccgtgctgcacaaccaggacgccgtagaccccctgagcgaggagtacatggcgctcgcgcacctctcgcccgagcagggccgggtggaagtcatcgactcgaccctctccgaagaagcggtgctcgccttcgagtacggctactcgaccagcgaacccaaggccctggtcgcctgggaagcgcagttcggcgacttcgccaacggcgcgcaggccgtagtggaccagttcctgtcggcgggcgaaagcaagtggcagcgcctgagcggcctgaccatgctgctgccgcacggctacgaaggcgccggccccgagcactccagcgcccgcctggaacgctacttgcagctgtgcgcgcagaagaacatgcaggtcgtggtgccgagcagcgccgcgcagattttccacctgctgcgccgtcaggtcctgcgtccctaccgcaagcccctgattgtgatgacacccaagagcctgctgcgcaacaagcacgccatgagcccgctgagcgacctgtacgacggcgtgttccacgaagtcatcggcgacgccgaagtgcagaacgcccgccgcgtcgtgctgagcagcggcaagctccactgggaactcaccgaagcccgcgagaaggacaaggaaggctacgccggcaccgcgctcgtgcgcctcgagcagctctaccccttccccgccgagcaggtcaaggccgaactcgccaagcatcccggcgcgcaggtcgtctgggcgcaggaagagcctgaaaaccagggcgcgtggctgatgatctgggaagacctggaacactgcctgcagcccggtcagacgctgacccacgccagccgcccgcgctcggcgagcaccgccgtgggctacaccagcgtgcacgtccgcgaacaggccaaggtcatcgccgacgcgctcggtgagccgatcacccgtcaggacgtggacgcccaggtgccgctcaccgaggaagcgagcgctcagggctga

SEQ ID NO: 47098 - DNA, 1929 bp, Deinococcus radiodurans
gtggctgtgcgcggcgccgtcccccggtggaccttcccttttcgccccggtgcggaagcggagtcctccgggcgaggcaaggcgcccacgcacgccagaggagcttttatgtgtggaattgtcggttatatcggtcccaggcaggcgcaggacgtgctgctgagcggtctttccaagctcgaataccgtggttacgacagcgcgggcgtggcggtcggtgacggcgcgtgcatcgcggtgcgcaagaaggcgggcaagctcgccaacctcgcgggtgacttgcaggccgcgccgctgagcggcagctttggcatcgggcacacccgctgggccacccacggtctgcccaacgaccgcaacagccacccccacaccaccgaagacgggcgcatcgtgctagtgcacaacggcatcatcgagaactacctgccgctcaaggaagagctgctcgcacgcggccacaccttcaagagcgacaccgactctgaagtggtcgcccacctgatcgaggaggcgtaccagggcaacctcgaagaagcggtgcaggcggcgctggcgcaggtgcgcggggcctacgcgctcgtcgtgacccatgtggaccaccgcgaaatcgtggcggcccgcaccgtgtccccgctggtgatgggcgtgggcgaaggcgagatgttcctggcctcggacgtgcccgcgctgctcgcctacacccggcagatggtgttcctgatggacggcgatatggtgattctcagcgacgacggctaccgcgtcaccgacctgcaaggccaccccgtgcagcgcgacgtggagaccatcgagtgggacgccgaggccgccgagaagggcggattcgacacctacatgctcaaggaaatctacgagcagccccaggcgctgaccaacaccctgctcgggcgcctgcgtgacgaacagggcgcggtggacctcgacatcagcctcgaccccacgtcgttcaagcgcatctccatcgtggcctgcggcactgcgtactacgccgggctggtcggcgagtacctgatcgagcagctcgcccgcatcccggtggaggtggacgtggcgagcgagtaccgctatcgcaacccgctggtcggggaaaacaccctggcgattgcggtgagccagtcgggcgaaaccatcgacacgctcgaggccatgcgcgaggcgaaaaagggcggggcgcaaacgctgggcgtcatcaacgccaagggcagctccatgacccgcgaactcgacagcacgctgtatatccacgccggacccgaaatcggcgtggcgagtaccaaggcgtacaccagcatggtgagtgccttcctgatgctggcgctgtggctgggccgcgcgcgcggcaccctgagcgacgcggagggcgccgagctgatccacgccgcccgcgaactgccccgcctggtcgaggacgcgctcaagcccgagcgcgtgcagcgcatcaaggaagtcgccgagaagtacgcccacgcccgcgactacctgtttctggggcgcggcgtgaacagccccaccgccttcgagggcgcactcaagctcaaggaaatcagctacatccacgccgaggcctacgcggcgggcgagatgaagcacggccccatcgccctgatcgacgagaacctgccggtcgcggtgattgcgacggagagccgcttgctcgaaaagaccatttccaacgtgcaggaagtccgtgcccgcgccggcaaggtcattctgtttctctccgacggcgacgaagaaaatgccctgcacggcgacgacgtggtgtacctgccccgtgcccacgaactcgtcagcccggtggtcaacgcggtggcgatgcaactgctcgcctacttcaccgcgacggcgctcggcaaggacgtggacaagccgcgcaacctcgccaagtcggtgacggtggagtaa

SEQ ID NO: 47099 - DNA, 828 bp, Deinococcus radiodurans
atggccgtcaaaaagtaccgtccctatacccccagccgtcgccagatgacgactgcggacttcagcggactgaccaagaagcgccccgagaaggcgctgaccgaggccctccccaagaccggtgggcgcaacaaccgtggccgcatcaccagccgcttcatcggcggcgggcacaagcgcctctaccgcatcatcgacttcaagcgccgtgacaagagtggcgtgaacgctaaggtcgctgccattgagtacgatcccaaccgcagcgcccgcatcgccctgctgcactacgccgacggcgagaagcgctacatcctggcccccgaaggtctgaccgtgggcgcgaccgtcaacgccggccccgaagccgaacccaagctcggcaacgcgctgcccctgcgcttcgtgccggtgggtgccgtggttcacgcgctcgaactggttcccggcaagggcgctcagctcgcccgcagcgccggcaccagcgtgcaggttcagggtaaggaaagcgactacgtgatcgtgcgtctgccttccggcgaactgcgccgcgttcacagcgagtgctacgccaccatcggtgccgtgggcaacgccgagcacaagaacatcgtgctgggcaaggctggacgcagccgctggctcgggcgcaagccacaccagcgcggcagcgcgatgaaccccgtggatcacccgcacggcggtggtgaaggtcgcaccggcgcgggccgcgttcccgtgaccccctggggcaagcccaccaagggcctcaagacccgccggaagcgcaagacctcggaccgtttcatcgtcacccgtcgtaagtaa

SEQ ID NO: 47100 - DNA, 993 bp, Deinococcus radiodurans
atgacgatgaaacaacccgtccgcgtggctgtcaccggcgctgccggccagatcggctacagcctgctgttccgcattgccgccggcgacatgctcggccaggaccagcccgtcatcctgcaactgctcgaaatcactcccgcgctcaaggcgctcaacggtgtggtcatggagctgcgcgacggcgccttcccgctgctcgccgacgtgatcaccagcgacgacccgatggtggccttcaaggacgccgactacgccctgctggtgggcgccatgccccgcaaggccggtatggaacgcggcgacctgctcggcgccaacggcggcatcttcaagccgcagggcgaagcgctgggcgccgtcgccagccgcaacgtcaaggtgctcgtggtgggcaaccccgccaacaccaacgcgctgatcgctcagcaaaacgctcctgacctcgaccccaagtgctttaccgccatggtgcgtctggaccacaaccgcgctctgtcgcagctcgccgagaagaccggcgccgccgtcagcgacatcaagaacgtgaccatctggggcaaccactcctccacccagtaccctgacctgtcgcaggccaccgtgaacggcaagcccgcgctcgagcaggtggaccgcacctggtacgagaacgactacatccccaccgtcgccaagcgcggcgcggcgatcatcgaagcccgtggcgcgagcagcgcggcgtcggcggcgtcggcggccatcgaccacatgcacgactgggcgctcggcaccaaagacggcgaatgggtcagcatgggcattccctcggacggctcctatggcatccccgaaggcctgatctacggcttccccgtgcgcgtcaaggacggcaagtacgaaatcgtgcagggcctggacgtgagcgacttcagccgcggcaagatggacgccaccgcccaggaactcgaagaagaacgcgacgaagtgcgcaagctcggcctcgtcaagtaa

SEQ ID NO: 47101 - DNA, 1437 bp, Deinococcus radiodurans
gtgagtcccgcagcaacgagtccccgccgccaacgtcaggacggacgccagccgcaagccgctcagcaggccgaccccgcgccgcagccgaccatgatttcgctcgccagccccgaggagtggcgcaagctgctcggagagcgcgagccgacgcccgtgcaggcgaaggccattcccgaactgctcgccgggcgcgacgtgatcgccaccgcccgcaccggcagcggcaagaccctcgccttcctgattccggcggcggcgcgcggcatcggcgtgaccggcaagacgcgcggcatggcccccgaagtcctgatcgtctcgcccacccgcgaactcgcggtgcagattcgggacgtggcccgcgaactcggcatgacggcggggcgcattaccgggggcatcacgcccgccgcgaccacccgcgaagcgagcaacaagggcgtggtcagcggcacgccgggccgcctcaaggacctcatcggcaagggtgaactcagcctcgcgcacgtcaggtacgtggtgctcgacgaggccgacgaactgctctcgctcggcttcctcaaggacgtggagtggatcgtgaaccaggcccgcgcgcaggcccggggcggcgagattcaggtggcgctcgcctcggccaccttccccgaggaagtacgcggcgtagcggcgcgggtgctcagaaatcctgttcgcatcgatatcgagccgccccgcaccgccgaggccgctcctctgaaggccggggaagtcgtggccgcgggcgaaggccgcgccgagcacgtcgcccgcgacaccacccgcgacgaggtactcgagcacgccgccgccgaaatccgcgaggcgctgcgcgagccgggcggctgcgtggtggtcttttgccgcaccaaggcgctcaccaagcgccgcgccgagaagctcgggcagctcttgccgcatgaggaagtcgtgccgctcgagggcaacatggaccagcgcaagcgcgagcgcgtgatggacaagctgcgtgacggcaccgcccgtgtgctcgtcgccaccgacatcgccgggcgcggcatcgacctgcctgaagtgcgcctcgtcatccacgccgatgtcgccaccacttccgaagaccacgttcaccgttcgggccgcaccgcccgcgcgggccggggcgggcgcaacctcgtattcatcatccccgagcagcgccagcgctgggcgcaggttcgccggggcctgcccgcgcacctgcacccccccaagaccgcgcaggaacacctgatcgacaaggacattcaggaaaaacagggccggggcagcggcaacggcgtggacccggtgcgctccggttccgggcgctcaggcggtggccgcgatggaggtcagcgcggcggctccgggcagcgttcgcagggccaggggcggggtgggcctcgcggcggacgtcgctaa
